United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 4

SEQ ID NO: 8851 - DNA, 1190 bp, Triticum aestivum
  Clone ID: PAT_TA_8851
gctccggggagccgtcggcggaggacggcggcgactgcccagtgtccatgcgtccgcccacgcgtccgcgcacgcgtggggtgagcatttgctcttgcgcttcttgacactccaatttgccagaaagaagcaaacatccatatttggtagcaatggcagcgtcgaggtgcagcaccgccttcgtcttgctcgtcgtggtcacggtggcggtgggggcggcggcggcgctgctgcagccggcggaggcggcggcggcggcacgccgcgccgacacccgcgtgctctggtacccgggaaccaggcagcgtagccccagcggcttccggggtttccctcgctccaggctgtcgccgccgtccgcgggcaggctaacgccgccgtcgcccagcggcaggccgatgacgccgccgccgtctcaggcgcaggcgccgccggcgcccatctcgcccccgtgcaccgccgcgaacccgcagcccggcttccccggcttgccggtgggcttcggagggtcgtcgccctcgccgccgttggcgccgacggactgcgtgacgccgctggcggggctgatgacgtgcgcgtcgttcctgacggggagcgaggcggagacgccgacgccacagagcgagtgctgcggcgggctgggcatgttcctcaacagctcggcggcggcggacgaccggtcgctgcgttgcctgtgcccggtgatcctcggcgacgtgaaccgcatgctccccaagcccatcgaccccgtccgcatgatgtacctccccatcgcctgcggcgtcgtcctcccgccccaagtcctcttcatctgcttcactgggcagccgacgccgccggtggtgaaccggattcccgactcctggaagacctcgtcttcttcagccttgtcgccttgagctggtgccgacgatcggatttggttactgctcatcacgcaggcacaatttatctcgggacgtatctatctaccaagtttaattaagattacaaacgtgagaaactagctggttactaccaactttgcagccatcagatcgagtggtcaacgcatcatgtgccaattgtggtgtagtattactgatcgatgtaatagctagcatgttttcctttttcttattgagaatgtaaacaaaaataaaattacagattgcatcttgcatcaaaatgtttcccacaaaaaaaaaaaa

SEQ ID NO: 8852 - DNA, 575 bp, Triticum aestivum
  unsure (1)..(575): unsure at all n locations
  Clone ID: PAT_TA_8852
tttttttttaagccataaaattagtcttagaatcatcatcatcatccagggcgggcgccgcggcggccggcagcattatctacaacttggtttcacttttcacccccactcccctcccctgctccttccttcctgagcacaccaaaattcagctactagtgtgaaggtagtatgtaattaatgacctttttctctagttcttcacttagaactaagtaaatattttactcgcccacccacacccaggaccaggagctacaattagccatgacgatgatgattcttccatacgagagcaagtaaaccccaaaaaattgcagacggacgacctctggtgttgggggccgtgtgtttcagtttttcttgaggattcaggtcttccaaccggccaggnccggccgctgtnccccggaganggctcgcgttcggcgtnccgcccggccccggctccgccgccttcctcttnctgctgccgccgccgcagncactcgtgattccggtggccgtcanttccgntgccactttntccaccagctctgttggcgctagctntgncttctgctgctgctgcggct

SEQ ID NO: 8853 - DNA, 820 bp, Triticum aestivum
  Clone ID: PAT_TA_8853
ggggtcattcgtgctcttcactctggaggagttttggaaaaggccttctgcactgaaactcgtccatttaaccagggttccaggcttacagctttcgagttagttcatgacaaaatacctgcgacgctgatagcagactctgctgcagctgcacttatgaataatggacaagttcaagctgtaattgtgggtgctgatcgtatagctgcaaatggtgacactgccaacaagattggcacatacaacctctcaatttctgcaaagcatcacggcgtgcagttttacgtggccgcaccagtaacttcgattgatctctcccttccgtctgggaagcaaatcgtcatagaagaaagatcttcaaaggaattgttgaactctgaaggtggtctaggaaagcaagttgccgcgtcaggtatatcagtctggaaccccgccttcgacgttactccagcaaatctaattactgcaatcattacagaaaagggtgtgatcacaaagtctgatcctaatggaagtttcgacatcaaaggtttcatcgaatgtgccaagtgatgctctccagtgagcataggttggcatgaatgcggtggaacatccttctcacacaattgatgataggatgcccatgttgtactcccagcaataagatctttcgaagtgagagaaaaataaagtcgcgtacgagatgtattgtgaggatgagtgtttgttatccaaaaagtatatttataaaaagatgcatcttttgctaaatctaatggttttctagcacaatgaaccccaactcacggccagatggaggacgagcagctgctatctg

SEQ ID NO: 8854 - DNA, 1708 bp, Triticum aestivum
  unsure (1)..(1708): unsure at all n locations
  Clone ID: PAT_TA_8854
cgtccgcccacgcgatccgctttttccatctgagccgtccgagccctccgaatttcccggccagaatgggggaatccagcgcgcttcagtccatcctctacgaccgcggcgcgcttcgcctcctcgatcagaggaagctgcccctcgaggaggtctacatcgatgtcaaggactccgcggatggatggaatgcgatcagagacatggttgttcgtggtgctcctgccatagccatagcggcagcactatcattggctgtggaagttaatgatcacgatttcactggtacacctgtggaagcagcctcattcgtttccaagaagttggaataccttgtatccagccggcccacagcagtgaacctgtctgatgctgctacaaagcttcagaacttagtgtcaagaacagctgaaacagcaaaagatgccaaatctatctttcaggtctttattgaagctgcagaggctatgctagttgatgatgtggccgataataaggcaattggcttgcatggagctgaattccttcaacgccagcttggaagttcgagaaacatctctgttctaacccattgtaatactggcagccttgcaactgctggttacggaactgccctaggggtcattcgtgctctctctctctggaggaggtttgggggaaggcgttctgcaccgcaactagtccaccaagctaccaggcttacagcattgcagttgagttattacatgataacagagacgctgcgaggatactaggctccgctgcagctgctgaattgaggaataaattagatctagaagtatttgtggtggctgatcatctggcagcagattactgagacaaccaaaaagagtttgacacacatctcctctatatttcaaaagatcaacggcgtgcagttttacgtggccgcacccgtaacttcgcttgatctctccctcccgtccgtgaagcaaatcatcatatcataaaagaatcaaaatcaattgaagaactctgcaaggtggtctaggaaagcaaggtaacgcgtcaggtctagtaatctagatccgcgccttcgccgtcactccagctaatccaagtacagctattaataccaataaggacaggaaaggaaatgatcacaaagtcgtgatcctagaggtagtttcgtcaacagaggtttcatagtgtgtcccaagtgtggccctccagtgggcataggttggtaggaatgcggtggaacacaattctcacaaaattgatgatggtgtgcccatgttgatctcccagctctaagagcttgagaagtgagggaaaataagagttgcattcgagatgtattgtgaggttgagcaaaaagatgtccaatttgtatatttaaaaaaatatgtttttctagcaaagaaccaaaactcggtttgagatggaagacgagtagtcgctatctgaagaacagaagtgggaatactgtgatttacgggcggcagtagtcctgaccttctcctgcagcagtgggctttaccttccgcaagttgaggttgctccaatttaaaaaagctgtttatatggaagaatccacatgtttcactcagcattgtgattatttaatgcacaactactggagcataaacacttcctcctctgttcctcgttatgcagtctatgaaagtttgtaagttgaactttaatcaaaacccgccgccaataacatangaattnccagcgt

SEQ ID NO: 8855 - DNA, 798 bp, Triticum aestivum
  Clone ID: PAT_TA_8855
ggccgtccgcccacgcgtccgctccaccaccgcactctcgctccgacgtcgtcgcggtcggcttgcatcttggcacgtacgtactcgccatggcttccgaccagccgttcgcgagagcactggcggccatctgcgtaggcttcttcgtcatcctatgctgctcgccacaagcgcgagccgtggactacacgttcgcccgggacgcgacgcgggcgccggcggtgtcgtactacgactacatcatcgtgggcggcggcacggcggggtgcccgctcgccgccacgctgtcgcagcgcttccgcgtgctcctgctggagcgcggcgggtcgccctacggcgaccagcgggtggagaacatgacccacttcacggccacgctcgcggacacgtccccggggtcgccggcgcagcgcttcgtgtccgaggacggcgtcatcaactcgcgcccgcgggtgctgggcggcggcagctgcatcaacgccggcttctacacgcgcgccagcgacgagtacgtgatggacgtcgggtgggacctcgaggcggccatcgcggcgttccggccggtggacggcgcggcggcgccccccccgccccccggcccctggcaggccgcgctgcagagggggctcatggaggtcggcgtcgcgccggacaacggcttcacgtttgaccacatcgacggcaccaaggtcggcggctccatcttcgacgacgaggggcggcgccacacggccgccgacctgctgcggtacgcgcgccccgagggcatcgacctgctgctccgggccagagtggcca

SEQ ID NO: 8856 - DNA, 650 bp, Triticum aestivum
  Clone ID: PAT_TA_8856
tttgaaatgtttaagggaacgaactggtgagctaggtactattacaaattgtcccatctcgtgttttcttcccatgcttgatgatgttgtctatactcctgctatatcataactttattggttaaatttgcaatttagtacctctaattttggtttttcgacactttatttattgctagctggacgccaggagcttccatactcagacatccatgttttcggaggttgaccggacaatggcgcacgagccagctcaatgacgtaggctagtgtggcaagttttgcctgatgtcgcgttcgtctagggtgatacggttatctgcatgtgacctttcgtgcagaatcaaccgttttgctccctcgacagcaacaaaattggaatttcggtccgttctgaaccaatgaatcacttgtgctttgagccatcagagctttgcaatgatcttttctccattccgaatgcatgcaaccgcatcactcactagctcatcaacaagagctttagcacttttcttttcgtgaatcactgctgcagccttgcccatgaggaacggccgtgaataatccatagtctcatcgtcaatattatctcccagggattcaatatcatggtcaacggggattatgccctttttggtgagctcttttat

SEQ ID NO: 8857 - DNA, 666 bp, Triticum aestivum
  Clone ID: PAT_TA_8857
cacgcattactgcctgtcaatgatcgttgactctgatggtacaacatataccacctctactgccatcaaacggccacctcccactcccagcaccctctgcaagcaacctaccgcgtaccgcacgcgcagcaaacaacagcctgcaaagaaggcttgctgaaccaaacacctacaacagatcacgcccctcccatctctatttcgctctttccatctcttccctgcagcaaaccttctttcaagctgcctcagacatgggtttggattggtgtcctcctgaatactctgcccctgaggctttcttttccttctcagaatctgaacttatcaaaatcatgctaattagtggaaaaggctgcatattgacctctcactaatacagccacatgtgccaacaaatattttaaccactcaccaggatcattccttggtacagaaaaaccacaacataattaagcatattatatgaaccggtcttttcaaaaccagtattggtatttaaaattaatgaaattcatatgcatggacaagtgtacggtttagaatacacaaaaacagcaaagtactatttggttatagtcagagttcacctactttgcaatgtggtacaagaaacgaaagctgcttaaaaaggaaagggaaaaactgatcttttgtgatttcttt

SEQ ID NO: 8858 - DNA, 861 bp, Triticum aestivum
  Clone ID: PAT_TA_8858
gcacaagaagcgtgttcggatttactaaggaacttctcagcgtcgcgtctttgccaggagtggagtgactggcttacaatgtggagcaacaagaactgccaagtgctaagcaatgaagggatagactgacgttaatcaacagaaacaaagactaaacaagaaaatctgtaggggtttatctgggcaaaatttgtcagaaaacagagtctaacaggctcgaaactctatctgatcagtgattgcgcacgctgcagacgctggctttccttcaacttctcctttggtgacagtttgtcgccgatcagtgtcaccttccagcaatcagcttggaggacgaaaactgacccagctttcggcacaactcggaagcggttgtcctctgatataattccaaaagtctctgcagtgtcacgaatcatgatgccacttacaccttcatatgaggctgctttgcattgtgccactattataagcgccccatgaagatctgctgaaaggaggttttccgacaattgctttttcggggtactttttgtaagctctcgcatatactctttccacatttcatgcattggcttatagaggtcaaacctgcggaatgtatcatgtaaatcaaatgacccacatttcttatgttgcttcagtgacatgtgcctttttgatcgctttgagtgaatcaacaaagatcgtgattgtgcatccactaatataggacccctttgaacatagttatccaaaagaatccctctatccagctttaacttttgcgacgagaccttgaaagcagctttttctaagtgtcagtagcgggacgttctgtcaatcggggaaggtttttggtgacagtcgacgcggccgcga

SEQ ID NO: 8859 - DNA, 779 bp, Triticum aestivum
  unsure (1)..(779): unsure at all n locations
  Clone ID: PAT_TA_8859
atattgaaaggaacttattgtnaaagataacattgagatccctgttcctagtccaccggcatgaacatctcagtcaaaggaacttattcgcgttttgttctctcttttgttctgaaaatgaatctgtaactgtacagcatccaactttttgaacagtccggatgcatagttttgcagagtatgtacacttttattctttacaacatgtatgtacaagtcaacatatgcacaacactgtcaacacatcaacacaacctgaatcaagaacggcataaagcacttgattctcaccttttcttccaatagtaatttccatggagccatggactgcggtatataagagtggtatcttttttctttcaggcgacctgcacgtcagcgttgaggatctgcgggatggacctgatccgcagggcggggctgatggactgcaggcccgcccaagctctccggcgacacccgcatccccccaacgttgatgcactccagttccgggcacttgttcacgagtgctactagtccggcctcagttcacgtggcggcagctccacagtatgatgctcttcaggtttgtacaactgtctgcaactgcatagagcgattcgtcagtgatgaatgtcccaccaatgttcaggtgcttgcagtgaacgagcccttgagaccagatggacgacgccctttgtcagtgatcccggccagcccccacagcgagacggaggtgaggttgccgacgcacgccgccgaggagatgtccagcaggccctggtccgtgatgtggc

SEQ ID NO: 8860 - DNA, 708 bp, Triticum aestivum
  Clone ID: PAT_TA_8860
gttccgaagaagcatcaagcaaatcaatctgggtaacaaagtttgcggatcaaatgggctcgccgcggttttggctcctaatttgacagccctgcagtaatatcactcctcaggcatcactcccgcatcatattggtttgtctgaccccgacacaggtattcttcctatgattgattccactagcatcgctacggtttgtatggactggacgttcctccaattaccgtgctgcccgttttcagagtgccatccgcatttctctcgagcagatcatcaaagaacttgttagaaggaacataagacggccggcgagaccctgcagacatgggttgcttcaggctcttgtttgtcggtgaatctgacgcggcacttcgaagcggtacgcccaaaagattgcgattgctgtaggggcctcatgttcagcggtactttaagaggcgagctggaggttgaaagttgctgcgatgaagatgccacgaaagggtttgactcggtgttgtccttgaggggcccatggtggcggcgggtaaggagatgggttgtaaggaaattgtggttgaggtgggtggtgcctgctcctgctgctgctgcttgatgggtgcagtttgaggttgatgctgagcccaaggagcgacgtagctgttgtgcgctgcagctgtgtgttctgggcctgcataatgaggctgtggatgataactggttgggga

SEQ ID NO: 8861 - DNA, 1775 bp, Triticum aestivum
  Clone ID: PAT_TA_8861
cgtatggcgttaagcttccctcgatggctctttcctgcttttggtagcgcagacacaaaagtgtaactcttctccattctctcgcctttccacctcgccccccactcccccctccccccaggaatcctccccacttttctgttccgtcgcctcgacagatctctcgaggcctgcccctctccccaatccgaagcggcggcgagctcgcgtcgtgtgagatccaccgcctgagtagggttttcatagtttcaacaattctaccagaatgatgttctaggatggttatagaagtgaagctttgtaaatgtagattctgaagctctgccattgctacgtatacacacctaaatcatggcaccacgcaacagaacttcatctagaaggcctctctgggtcatcgtcttgattgcttttgtctgtgcgatagtcaccggagcttatctttataaaccccaacattacacgggttgctacttgtccaattcctgtggttcccagcctgctctagaacctgtgagagtatacactgatgatgagatagctgctcgtgctgtaatgagagaccttgttctgtcacagcctgttcagtcaaagaatccgaagattgctttcatgttcttgacacccagttcattgccttttgagaagctttgggagaagttcttcatgggacatgaagaccgatacacaatatacgtacatgcttcaagagaaaagacagttcatgcaagcccaatattcgctggcagggatattcggagtgaaaaggttgtatggggttcggtattagtgtctacatgtcctggatacctagctagctatgttccagtttgacaatcaactttgtagattctcagtttgacaaagtttttataagatgtttaatttttggatggaacaaaaaaggaagcatagttgaaatgcaatgcaatcagacttgtaaaggtcctgcattgcacaaaatcctaaggatgaggccagaagaaggttcaatgaagtgaaaaaattactccgtacttggtctgcatgcagtgatcgactactggtctgcttgtcagttgttctgtttcccacagaagctgcatctttctagaagctgctacatcagattaacctgggaatgaatctcataacttctattctgatgagcactatctgccaaccttatttaatatggttgatccaaccggagtcgggaattggtcagtgacacgtgatgattgctctgaaggaaaatgacatcctaaagtttatagggctgttgacacaagctttgaactgcttaaaagtatagcgtcgagctacgcgtgcgttcaagggacctgctatgcgaagcacgaaatgcagcgaagaccgtgcatgtggaacggcatgaagaggccctgctacctattcgcacggaaattttatcccgaggcgctcgacactctgatgaacattttctcgaatttcaccgtcatatgagtatgacggatgcctcaaggattctttcttcacaccgattgttgcccgccgtggcgctgcagtccaggcgctgttgtgttgtagctggtgtcagaatacactgcttgttcagcagaggtttgcacgttttcagatggcacctgacctggcctgctgatctctgaagcaaaatctctcaatggttaggctatttagtagcagctcttttaatggcgatttttgctggtgtagaacagtggcaactgcaaaacgaaatgaaccagttcgtctgaccgtgcacggctctgttctttgcctgatcagtaaaaaaa

SEQ ID NO: 8862 - DNA, 666 bp, Triticum aestivum
  unsure (1)..(666): unsure at all n locations
  Clone ID: PAT_TA_8862
acagtgagagctaaaaagaagaagctgaagttttactaaagcggcgacaagtaatatggatcggagggagtatcaaatttcgaagtactatctggcatttgatgatttgctaacctaatgtaaaantgaatgaatacaacagcatggacaactaaaaacaacacaatgtgatttttgtgatccttttcaactatatgtctgtgtaatgaggaaaaaaaagcatgtgtatatggtccatcagcccctgttggcgagtaacgaagcctcgtcgtcatcttgccctacatcaagatgctcctgggttttgcattcctggagcgaggcatcggtgctcgtattcttgtcaacggtaagggaggttagctcgacgttctctattcgtcgagcctcggcaccgtcatactcagccagcaaatcagcaggaagtatgttagaattcgggtcacttctcggcaccaagaatagcagtgccaacggtagtagcctcatcacatttcggatcaagatggcggcccagaggtttttgaactctgttcttgtgatccttaacaaatgaaggagtagcccaccgatccaagatgctgacagcacgccaatattgtcaatggacatgagcagcgcgaagaatgtgccctcgatgccaggtgggcaaagctttgagctgag

SEQ ID NO: 8863 - DNA, 697 bp, Triticum aestivum
  Clone ID: PAT_TA_8863
tgcagcttgagtgtcagaatggtccattatttgatgataacttattcacgacaatcaaggattacgtggttgctgtatcatgtactcccccaagggtttatcgtcaagtagcttcattggttgggctccagcttgtgacgtccttcatatctgtcgccaagactctcagtggacagcgtgagaccacccaaaggcagttgaatgcagagaagaagaagcacagtgatgggccagctgttgaatctctcaacaaaaggctatctattactcatgaaaatattacatatttggaggaatcgatgcgtacaatattcagcgggttattcatgcaccgttatcgggatgttgaccctgagatccgaatattctgcataaaatccctaggtatttgggtcgtctcatatccatcactgttcttacaagacatgtatttacagtatcttgggtggacactgaatgactagaatgctggagttagaagaacttctattcttgccttgcaaagcctgtatgatgtagatgacaacataccttctcttggtctctttacggagaggttttatagcaggatgatccagcttgctgatgatattgatatttcagtagctgtgccagctataggactcatcaagcaattacttcggcatcaacttttgagtgacgatgatttgggtcccctatatgatttgcttattga

SEQ ID NO: 8864 - DNA, 839 bp, Triticum aestivum
  unsure (1)..(839): unsure at all n locations
  Clone ID: PAT_TA_8864
atatgaagcacttgtgagcatgtacagtttctaggtacgggtcatctgtgaaatgacgcatcagtagatgaaactcaaggcttagtctcctaccaaccagtcatactgaatagagtactgatgatgttacagtcgttgccgcttcaattaaacatacatgaaactactgatgatgttacagtcattaccggttcaattaacatacatgaaactttgcgcctcccgtcagcgcagcgtcgtcgcggccgaggtaccaaagcgctacaacaagagctcacttactcctgacaagtcttattcagctagcgaagaagaaagctctccgtaacttccccttgcacatttcccaccagctctctgtttctgtcttctgtccgtagaattcagagtctgcacctaccctcaagacacgatctctcacagttatcaacagttcatctaaagcagtgattttactcacaagagagttcttctcatcctcagcgtcaacagaaagtaggaaggcatctatctctgcaacatttgcttccccatccttaatcaaagcttctttgaatgagcgtaatgctgttatgaggacagatgaagccgtttctgtgccctcaggaccaacatcccccaaaatgtttccagtaacttcagattctgaatcctccaaacggcgccccgaccagtagggagggccaggccagggtaggggctcgctcttcgggcaaggctggttcgccccccctgttcccagagaggggggcgggcacccccccccgggtttgcccctcggccgcgaccgcgcgggacccactccacgggggattnttacctgggcccggggggggccg

SEQ ID NO: 8865 - DNA, 812 bp, Triticum aestivum
  unsure (1)..(812): unsure at all n locations
  Clone ID: PAT_TA_8865
taaagaaaagtacagcgtcttacacaaaggaccctgaagaaacaacaaacgacgaacaagtcctaggacttttgcaagaaggacctcaacctaaagatggaaaacgcgatcaggtccacatcgttctcagcggatacacctcgccatcgccggggacgagaccacttggggcgacgagggagccatagcaaccagccatggcgaccgccggaacgaagaactgcctcccaaatggctacaaggccgggaggaatgggagatggccgcccttcggccagaagaagcagcagaatgacggcgacaaccggccatcgaccgccacagcaggcgccagctcccccaccgcaatagctgctgctgttgagctcgaacccgatctgacatcttcagatgaccgctcctcccaagctcccgctccatcaccgcaacggcttgaagaaaccgggagaatcggctggccttcctccagatccggggcacgaagacgacgcgcttatttagagagctagcaccagaaacatcatctccccttcgccaccaccatgggagaagagcagaagatgtcaccggcgaccaccaggcgctgcgcgcaagcggcggtgggttgcgctccatcggcatgacgccaaacaccggcacaaggccaaactccacaaaggaaacacctagactaggccaactatttacaacagagcgccgcgcacctctcccatctccttcccgaccggcgtcgccggcggcaaagatccaggatcgggccgggcccgagtcgctctcgtggtcagcctctctcgannnnngtagcctcgtgc

SEQ ID NO: 8866 - DNA, 745 bp, Triticum aestivum
  Clone ID: PAT_TA_8866
cgtccgcccacgcgtccgcttggtggtgtggccccatatgctgttccccaggtatccagcgggtcactaaggaaggatattggattcaaaacaaatgtatcccacagtgacgctttaatgaccctgaacttatggatgacatcacaagttccattcagcgcaagtgtggaccagatgtgcaaattctataccttcgtgtcagaaggtgcagctgatgcaaagattgacatcatacgggagttgatgtcatgctcatctatatttacaccactaatccgtgctcgatccagtgaggtcgtccatggtaaatttttatccccaaaagacctctattggcatgacccaacaggttgttctgaaacgacagaggaattcgttttggtgaagaatagaatgttcccaagaaggatgctgtgctcaacctatccaaacctttgtgaattctttacggaagcatgtggtgtgccaaaagttccaacaacagctgattatgtagagatgctcttacggctatctaaagttgcactgccttcacaagtagcccatcaggtcttccgtgtatttgtgagatgggctaccgatatccattctgtgaatgacaagaacgatctagtttatgtgaaagattctcttcagaagctggagacaacgatattgccaaccctggttgataaatgggtctctctccatccatcttttggtcttgtttgctggtcagatgatgatgagttgaaacaacactttc

SEQ ID NO: 8867 - DNA, 558 bp, Triticum aestivum
  Clone ID: PAT_TA_8867
tccctttgctttcgaacactagtaaacaacacatggaaatgccacttttcatcataaatatatacaaccactacaacgtgtcacacgagtaaagccttattccaacatatactcccaacgctgtagataaatacaccagtgcaagtgtaagcgcaagtgcaacacacttgagcttccgtttctcgggatgcttttgagagcatcgcaacaacaacaacaaaagatgcctttgagaccagaacagaacaggctcggtcagtggccgcatagctctcggtgcgcgacgagcccctccgacctcctctggatggtgtagcgcagctgctccttgacctgccgcagcgccagcaggaccgactgcacgtcgttgccgccgacgctcgtcgctctcggctgggggtccgccaggaccatggcgagcccgtccttctcttctttctccttctccttggtctcggccggctctgcgctgtagtgcgggttgtccaccagcaccagcgcgagcctgtcgtcctcctcgtcgcggtagctcgcttcggatttcgacgagccgctgga

SEQ ID NO: 8868 - DNA, 1326 bp, Triticum aestivum
  Clone ID: PAT_TA_8868
ctcctcccttcccgtcgctcgcgccccccctaccccaacctcgaaccttctcgactccctcttcgcatggccgacgccaaggccgaggcggcgaggcaggcgccgcagtcctcccaggaggaggaggaggactggaaggaggccgagggggacgtcgaggtcgcggacaggtccacgagcaatggcggcggcgccggcgaggggatcacggacaggccgatccgggtctacgccgacggcatctacgacctcttccacttcggccacgcgcgctcgctcgagcaggccaagaaatcgttccctaatgcatatcttcttgtcgggtgctgcaatgatgagctgacacatcaatacaaaggaagaactgtcatgacagaggacgagagatatgaatcacttcgccattgcaagtgggttgatgaagtcattcctgacgctccgtgggtagtaacagaagagttcttgaacaagcataacatcgattttgtcgcacatgattctctgccgtatcatgatgctagtggagctagtaatgatgtctatgaatttgtaaaaaagcttggtaaatttaaggagaccaagcgcacagaaggaatatcaacctcagacattataatgaggattgttaaagattataatgagtatgttatgcgcaatctggccagggggtacagcagaaatgatcttggtgtcagctatgtcaaggaaaaacgactaagagttaatatgggattgaaaaccctgcgtgacaaagtgaagcagcaccaagaaaaagtaggggagaagtggagtacagtggcaaaactccaggaagagtgggttgaaaacgcagatcgctgggttgttggttttctagagaaattcgaggaaggttgccattcaatgggaactgccattaaggaaagaatccaggaaaggctgaaggaggcgcagtctagggacttcagccttctacaatacgacagtgacgactttgacgactttgaagaagaagacgatgaagttgccaaagatgccaaatacgtgaaagaatagcgccactgtaaaattttacgtcaaaagtataatacaggcatgcaatgcatgttaacagtcttcgtcaaccacaatccttcaccatgtatctgtccctttgattgtgagcttcactgtcaaggtagatctgcgtgctgtgtttgtagctgtacttgatgtttttctaggcattagcgtacgctcttgtaaaagttctactgtgaggcataacactctttatttggaggatatcgatttcaattccagttcttattaagaagaccttttccatttcgtaaaaaaaaaaaaaaa

SEQ ID NO: 8869 - DNA, 630 bp, Triticum aestivum
  unsure (1)..(630): unsure at all n locations
  Clone ID: PAT_TA_8869
cgtccgagaatgccgaaagctctgtggtgggcatggttacttgaacagcagtgggctccctgaactttttgcggtctatgttcctgcctgcacctatgaaggagacaatgtcgttttgctgtcgcacgttgcaaggtttttgatgaatacggtctctcaggtggccgctgtgaagcaacctgtcgtcaccatagcttacatgggcaacatacagcgtccgcggacgcgtgggcggacgcgtggggtaaatacagactggctcaatcctgctgccataaaggaggtgtttgaagctagggcactgaggatggcggtgaactgtgcgcagaacatcagcaaggcgccaagccaagaagaaggtttctctgagctctcacctgatttgctcgaggctgccgtggctcacgtccagctgatcatagtgaccaagttcatcgagaagctgcaggaggacatccctggccccagggtgaaggagcagctgcagaagctgtgcagcatctacgcgctccacctccttcacaagcacctgggcgacttcctgtcgacggngtgcgtcacggccaggcagggcgcgctggcgaacgagcttgctcggaagctgtacgcgcaggtgcgttctaacgcggt

SEQ ID NO: 8870 - DNA, 1562 bp, Triticum aestivum
  Clone ID: PAT_TA_8870
cttgtacgcggcagcggttgcgtgtgcactctgccgtaccctggctgctgcgcttcgggacctgggctgctgtccgccccccgatcgtcgcgcgggcttccttcccgccggcacctgcggtggccaccgtccgcccgtccggtattgtgctatccggaagcagttcggttcccaagatggtggccctgagactcaggtcctcaattacaagactcaacagagcacatgggcccctttgctggcttcagcttatgcatatagatttgtgggtcagtggctgaagtggctgtacacggatgtcacacagaagctggaggctaaggattactcaacgctgccagaggctcatgcctgtactgctgggctcaagtctgtgacaacatctgccacagctgatgcgattgaagagtgccgaaagctctgtggtggacatggttacctgaacagcagtgggcttccagaactgtttgcggtctatgttcctgcctgcacctatgaaggagacaatgtcgttttgctcgtgcaggttgcaagggttttgatgaagaccgtagctcactgggccactgggaagcaacctgttgcgtccatagcttacatggggaacatacaaaacagctgcattggcaagctgtatgcacaggtgcggcctaatgcggtggccctggtggaggcgtttgactacacggaccactagctagggccctggctgtggcggtagcccagaacatcagcaaggcgccaagccaggaagaaggtttctctgagctgtcccctgagttgcttgaggctgccgtggctcacgtccagctgatcatcgtgaccaagttcatcgagaagctgcacgaggacatccctggccctggcgtgaaggagcagctgcagaagctgtgcagcatctacgcgctccacctgctccacaagcacctgggcgacttcctgtcgacggggtgcgtcacggccaggcagggcgcgctggccaacgagctgctcgggaagctgtacgcgcaggtgcggcctaacgcggtggcgctggtggacgcgttcgactacacggaccactacctggggtcggtgctggggcggtacgacggggacgtgtacccggcgctgtacgaggaggcgtggaaggacccgctgaacgagacggtggttcccgacgggtaccaggagcacctccggccgctgctcaagcagcagctcaagctctccaggctatgatacgcgttggactgtggatgtgaagcagtaataattatcacaaggaaagaggcgattggttattgttgaattggcaaggccggcaagagggacacacagacagacgctgttgttagtagaaataagagaattgtgctcctaccctgggttattagtacggttgctgtggttgtcattttggttaatgcatgtttggccggtggcagtattattggtaattagcattatacttatcagtagcaagtgtgcggatggattcttttctagaatgtacaaggaggaaaattgggagaataatggatggaatggtttatcttaaatttccctgtttttttcgctaa

SEQ ID NO: 8871 - DNA, 2162 bp, Triticum aestivum
  unsure (1)..(2162): unsure at all n locations
  Clone ID: PAT_TA_8871
cgtccgaaattaaaactcttctgcgcctcatatgggaaataaggacaacagaaagttacatgagacttttcacaatgaagtgaatgggacagatgatgatcaaatgaatggtgggaattctaatcctcatgatgaacatgacaatgagaacttcaactctgcaattgcaccttcctatttggatgggatggagcaggaagatcctggtaccgagaatggcatttctacgcctggcaatcagtgggattctccacctgaaaggtctgcaggactagagaagggcacaccatcaccagccaggagggtctcactttcagtagaaaggtcacctcatgctcattcatctgagaaactggactcaccacatcatgcaaaagagggtgataatttggctgactctcgaagcccaccagcaagacatcggtcccgatctcctggatctcctgaaaaccatgacaccaaccgtagaagagctccctcacatgagttgtctccacatgcacgggataactctccagaaagaaaagcacaatctcggcgtggagatgggtcaccgcgccgaagatctacatcccctggaagaagagatgggtcaccgcagcgaagatcagcttcccctaaaagaagagatgggtcaccgcgacgaagatcagcttcccctagaagaagacatggttcaccacgccgaagatctgcatcccctaaaagaagagatgggtcacctcgcagaagatctccatcccccaaaagaagacatgggtcaccacgacgaagatctccatcccctaaaaggaggcatgggtcaccacggcgaagatctccatcccctaaaaggaggcatgggtcaccacggcgaagatctccatctcctaaaagaagagcctcgcccaagaggaggggttcaccaaggaggagggattccccaacaaggagggattcctctccaagaaggagagactcaccaagaaagagagattcctcaccaaggaggagggattccccaacaaggagggattcctctccaagaaggagagactcaccaagaaagagagattcctctccaaggaggagggaatccccaacaagaaagagggactccccaacaaggaagagagatagatcaaaatcaaggtcaccatcaaggaaaactgattcctctagacttgcgtgggcgcggccgaggtctcgatcagggtctccacactctaggaatcaccatagaagatctccaagaagaaggcattcaccaaggcacagatcacctccagcaaggcatcattctcctaaaagatgttggtcaccacctgccaacaggaagactggattgggtaagcctgggcggaatctgtttgttgcaggttttagctatgccaccacagagcgagagttggagaagaaatttgcaaagtttggacgtgtaacaagggtgcgggttgtccgagataaacgaactggagattctcgaggctttggatttttatccctggagaaggatgaggacgctgatgcagcaatccgagcttgcgacgagactgagtggaatggtaggatcattcttgtggagaagtccaaggcacctgcatggtgaatcttacaccctagagctctgcaagcaaacaatgctctgggtgggagggaccgaccagtttgcacagcttttatcgtaccaacagtataacataaactattaattatcattacatgtggcaaagtttacttgaaccagctctctatgctgtactaggagtaagtaataatgcacttgctatggctgccttgctgacaattattgaagaataagattatatgccaaaccttagcttgtttcagggccctgctgctgataaagagggagttagcggtacacattgtaatatctgcaacctctactacacattcatgacattcatcatcctcttcttcctctgcatggtgatcgagtgtttggctggcagttcagttcatggtgatgcatgggcgaaattcagactcgcgaggctgtgttggtcatttttaagttagaacaataattttatacgattgtatgtgttctgtgttttaggtcgtggatactactatatgttggatatggccccataacttttctgctgtcttttcaaaattcctctactcanaatcagaaatattttatgcaaaaaaga

SEQ ID NO: 8872 - DNA, 3421 bp, Triticum aestivum
  Clone ID: PAT_TA_8872
gggggcagcgccaagaaaacccaaaccaaacccccccgccgctccggatccacctcccccgttgcttccaggccgccacattcgtccgaatccggcgcttgccccgccggagggctcgatctggccccggatcgaccggcattccggccccgtgcacgctccagtcccggcggtgaggcatggggaccttcggtggccagttcgaggacttccatgcggacgaccggcgtgcggaggtgatagattggctcggcgggctgctgccggagttcgatttgccgctggattcttcagacgaggagctgcgggagtaccttatcgacggaacggcgctgtgctacactgcggacaagctcatgcctggtgttctggagggggtttggggtggttatgcatcagaccatcggtcaaatgtgaagaagttcctctctgttatcgcggagatggggctgccaggattcagcgtcaaggatcttgaggagggatcaatgtcgtctatagtagagtgcctcttggctctaagagataatgtgtcagcaggattgggtgaaaatatgtctaactatcctgctaagactcctccaaggcctgtggcgcccgtttcctcaccagcagggagatctcctggggaggatagaagaaggggtctttgggacgccaaatccccacaaagaagtccacttctttcaggacagaaggccaacgaggttttccaatttaagcgcggacaatacacagatcttcctgctgctaagatttcagagatgatccagtcaaacagtttagataatgcccctactcaatcacttcttagagttgttaacggcattctggatgaaagcattgagagaaaaagaggagaaataccacatcgagttgtttatttactaaggaacgttgttcaagagattgagcaccgcatttctattcaagcagaacacattagaaatcaaaataacatcatcaaaacacgcgaggataagtaccgttcaaaaattaaagcactcgagacattagtaaatggaacaaatgaagaaaacgagatggcaataaaccgtcttgagctagttaaggtagagaagtcaaaaattgatgagagaagaaagataggcgagcaagacatggtccggctgatgcgtgaaaaggaaaatgcagagaatacagttactaaccttcagcaggaaattcaagtcatgagcaggatgttcgaagaatacagggagcagatggaagaaaaaacaagccaaatggaggaacacttgactctaagagctaaggaggcagagtttcttcttatgcaatcgaaaaagagagttgaagaacttgaaactgcttctgaactacaattgcaactctggagcaagaaggcaaatacttttcgaagttttatggataaccaaaaactgtgtattaaggatataaggatatcgtctcagtcaattaagcaggaaatgtttgcccttcaaatgaaatggagggatgaaatatctaacatgggacttgacctaaaaggtttggtagatgccgctgaaaattaccatggcgttcttgctgaaaatcagaagttatttaatgaagtgcaagaactaaaaggtaatataagagtatactgtcgtgtcagaccatttcttcctggtcaagacggaaaatcaaccgcagttgattatattggtgagaatggtgaaattctcatttcaaacccctccaagcaaggaaaggatggctatcggatgttcaagtttaacaagatctttaatacacatgtttctcaagctgaagttttctccgatatccagcctttgattagatctgttcttgatggattcaatgtgtgcatttttgcatacggccaaactggatctggcaaaacatatacaatgagcggccccggcaaatcaaaacacgcgtccggtgttaactatcgagctttaaatgacttgtttgatatctcgttaaaaaggagaaacactttctcatatgaggtggaagtgcaaatggttgagatatacaatgaacaagtccgggatcttctatcaaatgatattgcacaaaagagactcggtatttggagtacttctcaacctaatggacttgtcgtacccgatgcgagtttaattcctgtcaaatcaacatcggatgtattagacttaatggaaattggacaagcaaatagagcagttggatcaacagcgctgaatgaaaggagtagtaggtcccatagcattttaaccgtgcatgtgagaggtctggacgtgaagaatggatctacttctcgaggatgtctacatctgattgatcttgctgggagtgagagagtagagcgatctgaagcaaccggagatagattaaaggaagcacaacatattaacaaatctctttctgcccttggagatgtcatctttgctttggcccagaagaatgctcatgtgccctacagaaacagcaaactgactcaagttcttcagagctctttaggtgggcaagcaaagacgctaatgtttgttcagataaaccctgatgtggaatcatgttcagaaaccataagtactttgaaatttgctgaaagagtttctggggttgagttaggtgctgcaaggagcaacaaagagggcaaggatataaaagatctgctagaacaggttgcgtctttgaaagacacaatatcgcgaaaggatatggaaatcgaacagcttcaagtcaacaaagtcaaatctcccagttcattaacagataaaagtggcagtagcttgctaaaacagccctctacggcaagccaacagaaccaactaatatcagggtccattggatcaggtgaaactgaatacgaagataatgcatccgacgatggttgctcggtaggtgaaaccgagtattctgtcggcagcgcttcagagtcagcagcagatcgaatgcagaagggtccatcaagactgaccagatttttcctgacgaagaatgggcagccagcggcttccagaccaaaaccaaaggaacctgccccaaagtcgacgaccataggacgccggaactcgatagccagccaggtcccgaccgcggcatcttcgatcaagccccccaagaaacgggtggtccagtagacgacgccgatgatggacagctgcagtggtgtctttgcatctgtcacgagactcggaatgttgttgccctgtaaacctgtagcacgaggcgcgggttaggattgttgtaccttatgtatcgatttcactgggcaggcagccatccatgtacctgtaacacaactccgaatgatttgaactaatgatgatgagcagccgagctacgcttgctggccgctgtgatgacgatatgatgagtatttgggtttaaaaaaaaaaaaaaaagaaaaaaaaaataaaccaaccaaaaagaatctaaaaaggaaatggaaacagggaagaag

SEQ ID NO: 8873 - DNA, 927 bp, Triticum aestivum
  Clone ID: PAT_TA_8873
gtgaggacttccctttccgcgatagcttcttctgaccaccaacgcatctcgcccgccgcgcccatggtttcctcctccgcctccccctcccccagggaggaggagggcggcggcccctgtttgccctcgctccgcggcaagaaaaggagaatgcgagtcagaacggcctcgccagagccggcttccacggccgcgccgccgcagacacatggaaagtggcatccagatgaatcgaacagacctgaaattgatgatgctcctgtttttaccccaactgaggaggaattcaaagatgcaattgggtacattactagcattcgtcctcaagtagaaaaatatggaatttgtcgtattgttccaccatcttcttggagaccaccatgtcctctaaaggagaagagcttttggaaatgtacagagttcaacacccgagttcaacaagttgacaagcttcaaaatcgggaacccaaaaaaaaagaaacacaacctcgagttcagaagaaacgtccgcccacgcggcagcccacgcgtgggatgtctcaaaagcgacgtagcgctgagtctgcagaccaggatgagaagtttggctttcagtctggctcagatttcacactagaggagttccagaaatacgctgatatgttcaaggagcaatattttggaatgaagggaagtgatgaaatttctctttttgaaattaaacagcacaaagaaatgtggcgaccatcagttgaggaaattgagggagaatattggcggatagttgtatgccctgatgatgaagttgaggtggattacggcgctgatctggacactgcaatatttagtagtggattccctaaatcatatctatcagatgcaaataagcaagatccatatggtttattttgctggaacttgaataatttgcgacgaccacctagatct

SEQ ID NO: 8874 - DNA, 981 bp, Triticum aestivum
  Clone ID: PAT_TA_8874
gcacgcgattcaatgctccaccaaacgctcaccccttcttcccttgccttctccgcccccgctccgcccgagcctctccccttcgcctcaaacgccagccccgccgccgccgccgccgccgccgcgaccacccttcgcccctcgcccatgccgtcctacgcgcaccaccacagctctctggacgagaggatggacgccctcaagggcagtacccgacccgaggagacgccacacgaggccagccccccccccggggcgccgccgccttggggctcgcccaagcgggacgcttccccgtcggaggacctcttggacctggagggtttttgcgagccggataaggacggcgccgacgagcccgaggaggcgtcggccgccgacgttaaaggaggagaagttgaacgacgggcccaaccaggccctcttcgtgtctgagctgccccctccggcgccgcccccgccggagattgttgacctgccggcgcatgacgtcgaggaggagctcgagtgggtgtcccgtatcatggactggacgccctccgcgccgccccccccccccgccccgccccccccgcggcgggcatcgcggccgccgcgccccccccgccgccgccccccccggcgccgccgccgccccccccggcacccgcaggatggagcgtaccgcgctctgccgtctatgtccgaccctatgcggactccgaccatatgcgcgctgtccacggaggcgctggtcccggtcaaggcgaagcgcagcaagcgctctcgggcgtcggggtggtcgctctcgggccccgcgccggactccacctcgtcctcgtcgaccaccaccacctcctcctgctcctcgtcggcctccttctcgccctacttcctgctggacacgccgcacttcggcgcctcggagctcatggaggagtacaacatcctgccgccgccgcccaagaagtccaagcacggcaagaggtcgacgcggccgcg

SEQ ID NO: 8875 - DNA, 523 bp, Triticum aestivum
  Clone ID: PAT_TA_8875
ttttttttttcgcggaaccagcggcacctaaagcagcccatactcatcgactaactggccagactgattagttaacggagcaggtcatcattaactatgatcaacatgcttgttccaacggtgcggagaaaaacaaagacaagctgaagctaagccgccatggactgtggcatcggttttgcagcggaactgaactttttgtgcaggcggctttacctcgagggtgttggtgacggagttgatgagcgtggggaggccgcggttgccgacgcgcacctcggcctcgatctccagcttctcgaaccgcacctcgatggtggggtagtcgatgcccaccctgtccatgcgctccttgagcttgaggaggaagttctcgtggtcgtcgtcggccgcgcgacggatggattgcgcgacggatggattgcggggctggaaaagaagaagaggagacgagggttggtgaggggattattagtgcttgctttgtccttttgtttttgacgagtataaagtcgagaggagc

SEQ ID NO: 8876 - DNA, 636 bp, Triticum aestivum
  unsure (1)..(636): unsure at all n locations
  Clone ID: PAT_TA_8876
ctctttctataacttatattgatgattgtttgccagacacctgcgcgcctggccgacatttgggccttgttcaatccaatcagggggtacaaaaagaaacattaaaacaaaatcctctatcctatgtatggctttgcaggaaagaaaaccaactatatatacatgtctatgtacagacactactacagaggatgcctgtctgcctatgcaagcttctgctggtatctcctcccgacgcgctgctgccttcttcgcgcgcgcaaattccagggaataccagcgaaacagtctaacttaactctgctgctggtgcctccgccgccaagtcgccgctattttatttactttgcaatgcaatcctgctgatgcacggcggcaaacagcagcttattgcgttttcatcaacgaatcttcctgctcgagaaaaaaccactacttggtagttcacggcagagttcatttcggacgggatccgctagcactctacggcacaaggtggcccagcaatcattttggtcttgtccatgaagaatgccttgatgtccctgcatctgggaacagaacagcccccgtcaccgnaatgttttgcatgagtgagcagaagtttccacatgaagatacacttcctgcaacctc

SEQ ID NO: 8877 - DNA, 723 bp, Triticum aestivum
  unsure (1)..(723): unsure at all n locations
  Clone ID: PAT_TA_8877
tgtaattttattgaaagacaggcataaagtacgtagtagacaagcatgcccggcaagctcaaacagatactccctccgtccggaaatacttgtcctagaaatggttaaaaatggatgtgtctataactaaaataagtctagatacaaccatttttatcagcacatagtagacaagcatgcccggcaagctcaaacagatacaataataccatggaccataaaatatatgccccgttgttatcccacacgtagacctgagaagatcaatcacgaccagaggtcccctccgtcgccgccacagcatcaagagatgagttccgggcataagttttggtaatgaaatcagcacacctcttctggagctcccagcagttgtactgctcggctaaagccagagttgtcgctgctgtgtccactttgatgccatcatagagcttgctggcgcagatgagcttgagcctgtccagcccatacctgtcagcagcagcaagtagatgttgagcaagagccatcacagatgccgcctgctcatgcgcctcatcccgttgtccggattctggcacggtgtcggtaatcatggcctctgcaccctcctgctgttcgaattctagcacagtgtcggtgtagatgaagtggagcaacgccttgaataccacggcctncatgtccttaatctccacgcattccgagcccctctcaatcatgtcaccaaggaacgcggcc

SEQ ID NO: 8878 - DNA, 697 bp, Triticum aestivum
  unsure (1)..(697): unsure at all n locations
  Clone ID: PAT_TA_8878
caaatttcgtcctagctcttttcntctggttactacgaatctactacactggttggttgtgctttgctgcatgctgcaatgggcctccaactctttgcaacaacgggccagcactgcacagcactgcagcagaatcatcagccaggtgcaacaaccgtaccctactgctgccatgcactattaaccgcacagcaacatccatcagattacaggacgcgccaatcaccatcctctttacatcatgtgtacaaacaaacatacccccggaaccttccattccatctcctacctcaccccacccgacccacaaaattagacgatgaaccatcggtttcggttatcatgtcatatactcctctggtacctaggtttcaggttagacagccctctctcttctctgcgagccgggccagacgggtcggagccggcatggctcgggccacaccagagggaccgccggctgctggtacgcgtcgcaggcccccagcttcaccacgaacggctcgccggccagcccttccccgcgccgtcgctctccagccatatgtgcccacccatcaggctcacaaacctcttgcaaatggcgagcccgaggccgctgccgttgtacccctggttcccgccgctctgcgtgtgagcaaactttgtgaacacatgggatacatcctgggggctgatgccgcaccctgtatcttta

SEQ ID NO: 8879 - DNA, 848 bp, Triticum aestivum
  Clone ID: PAT_TA_8879
caaatagtacaagattcacccaacaaggggctaattacatagagcagctgcactaatacaatagtcagatcggtaactagtagctagtagccgtggttaccaacacacatacacataaattgataacaaggtaatgcacaagttcatgctcagctactcggcatgggcacgaacaagcctgagcttgtcctctcacacttgtttttctgtatccattgctccaccgttggggcataccgccagtgcggtgcgtccgtccccgcttccccccctgctcccggcagccttcgcccccacccacctaaatccagcagcgattgagccaaccgggaaggagccaccattgaagtacttgggggatgaagaaacggaatcatctggattccatgtgtaaatcatgggagctcctaggcatttgatcaaacacagccaacgcctagtactgtcagcaccacatctgcagctgcaggaacgccaccaactgaacgggctctgctgttgctgttgaacggcctaggtggccaagtttgaacggaacttgcaagatgaacccaaggggagctccttcagctcccaagctgcggcgtagaacggcttagccctatgttgtagaacaacttagcgcatgtgcatagtaccatcaacgttgaacttgttgagttctgattttttttaacctttgcattagtaatacatgtactgggcggtacatgcttctgttgttgagcagctgacctatggaaacaaaagcactcctgggtgaacacacaaaatcatgataaaaatagggcagcaagaagcaatcaaaagtgaatatgcagcagtactataatggaatactagtcaga

SEQ ID NO: 8880 - DNA, 853 bp, Triticum aestivum
  unsure (1)..(853): unsure at all n locations
  Clone ID: PAT_TA_8880
tgccgacaagctcctcttcgagcgttgngatactcccatgtctgcaagtaccgcgtgctctgaggaagtccccgagctgcaggacatgggtggcccggtcgaaggtggattcagtgtggcgttcgacccccttgatggttccagcattgtggacaccaacttcaccgtcggaaccatcttcggtgtctggcccggcgataagctgacgggcgtcaccggcggtgaccaagttgctgctgccatgggcatctacggccctcgcaccactttcgttgttgccctcaaggactgccctgggacgcacgaattccttcttctcgacgaaggtaaatggcagcatgtcaaggacactacaaccattggagaagggaagatgttctcccctggtaacttgagggccacatttgataaccctgattacgacaagcttgtcaactactatgtgaaggagaagtacacgctgcgttacaccggaggcatggtccctgatgtcaaccagatcatcgtgaaggagaagggcatcttcacgaacgtgacgtccccgacggccaaggcgaagctgcggctgctgttcgaggtggcgccgctggggttcttgataaagaaggccggcgggcacagcagcgacggcaagcagtcggtgctggacaaggtgatctccgtcctggacgagcggacccaggtggcctacggctccaagaacgagataatccgcttcgaggagaccctctacggctcctccagactcgccgccagcgccaccgtcggcgccaccgcctgataatcgatccatcttctttttttacgcttttttcaacctgaaaaacaagatgtccgttatagagttcgtctg

SEQ ID NO: 8881 - DNA, 1732 bp, Triticum aestivum
  unsure (1)..(1732): unsure at all n locations
  Clone ID: PAT_TA_8881
atctggtccagtcgtgcgtccgccgcctgtgatccattcctcccaaatcctcgagccacgccgcaacgtaataacgtagcatagcttccggaaatcttaagctccgtagcctccctctcctcgtcagcgccggccggaccacacaccggcagccagccagccaccagcaatggagaccgtcgcggccgccggctacgcgcgcggggccgccacgcgctccccggcgtgctgcgccgccatgtccttctcgcagtcctacaggcccaaggctgccaggccggcgacctcgttctacggcgagtcgctgcgggcgaacacggcgaggacgtcgttcccggcggggcggcagtccaaggcggccagccgggcggcgctcaccacccgctgcgcgatcggggcgagagccgggaggagctcgtcaccaggcgacgccggacaagaacctcatcaggctgctgatctgcatgggggaggggatgaggacacgatcgcccttgatcggtccggacggcctcctgcaggcggcacggctcctgcgtcaactacttcggccacgaggagctcgccgtcgccatgctccccgacaagctcctgttggaggccttcgagttactcccatacgtgcacgtacgcgtgctctgagagagtccccgagctggagggcatgggtggcccggtcgaaggcgcgatgcatgtgtgccgttcgacccctttgagggttgtagccaccaacttcaccgtcggcaccatcggcgccatctggcccggcgacaagctgacgggcggcaccggcggtgaccaagtggccgctgcatgggcatctacggccctcgcaccctttgccctgtggccctcctggcctggcctgcaacacacgactgcccccttctcgcccgaattccatcgccgcgtggcagggaaatgacaacatgtcaaggagagaagaagcttcccgcgagtaaatgaaggtctccactggccaaccctgagggccacgttcgtcaccccttgattatagagaaagattgtaaactccctattacgaaaggcgtggtacactctttgcgatagcaccgtgaggcagtggtacccctggatcacaacccacgagcagcctacaaggaagaaggggatcgtgcacggaacgtgcacgtcgccggcgccggcggaaggcagggagctgccgcggcgcttgttcggggaggcgggccccgggtgctggacatgatggacaacgggcccgccggcaacagccagcggcactgccgagcagtcggtgcttcggacaggggtgacgctcccgtcttgggtacggacgcggaccccgaggttgcctcgccggctgcaagaaccgtagatcatctccttcacggcacgccacgagccctacactgcctccctcccagatctactgccgccaacgatcctcacctttctggcgttattcgcctatgaaaacactctttgtcttctttttttaatcgcctttactcaagcctgaaaatttaaacaagctgtccgttatagagtctgaagcatgctgttgtcttgtgatgatccgaactggtaatacagtcggcagaccggcttgcgtacgtctgccgcccttgtctccactgcgaggcgattgttgtacgtacacagtcgtgcgtttgtgcatggcattggcaacacttgtgtcatcagaacaaggaacaaattccgcactacctgctgccgtaggaccccntgg

SEQ ID NO: 8882 - DNA, 1533 bp, Triticum aestivum
  Clone ID: PAT_TA_8882
cgtccgcccacgcgtccgcggacgcgtggggtccgcatgcaacgtccggccactgccctctacctccatggaagagaagaagccgcggcggcagggagccgcaggacgcgatggcatcgtgcagtacccgcacctcttcatcgcggccctggcgctggccctggtcctcatggaccccttccacctcggcccgctggccgggatcgactaccggccggtgaagcacgagctggcgccgtacagggaggtcatgcagcgctggccgagggacaacggcagccgcctcaggctcggcaggctcgagttcgtcaacgaggtgttcgggccggagtccatcgagttcgaccgccagggccgcgggccctacgccgggctcgccgacggccgcgtcgtgcggtggatgggggacaagaccgggtgggagacgttcgccgtcatgaatcctgactggtcggagaaagtttgtgctaacggagtggagtcgacgacgaagaagcagcacgggaaggagcagtggtgcggccggcctctcgggctgaggttccacagggagaccggcgagctcttcatcgccgacgcgtactatgggctcatggccgtcggcgaaagcggcggcgtggcgacctccctggcaagggaggtcggcggggacccggtccacttcgccaacgacctcgacatccacatgaacggctcgatattcttcaccgacacgagcacgagatacagcagaaaggatcatttgaacattttgctagaaggagaaggcacggggaggctgctgagatatgaccgagaaaccggtgccgttcatgtcgtgctcaacgggctggtcttcccaaacggcgtgcagatctcacaggaccagcaatttctcctcttctccgagacaacaaactgcaggatcatgaggtactggctggaaggtccaagagcgggccaggtggcggtgttcgcgaacctgccggggttccccgacaacgtgcgcttgaacagcaaggggcagttctgggtggcgatcgactgctgccggacgccgacgcaggaggtgttcgcgaggtggccgtggctgcggaccgcctacttcaagatcccggtgtcgatgaagacgctggggaagatggtgagcatgaagatgtacacgcttctcgcgctcctcgacggcgaggggaacgtggtcgaggtgctcgaggaccggggcggcgaggtgatgaagctggtgagcgaggtgagggaggtggaccggaggctgtggatcgggaccgttgcgcacaaccacatcgccacgatcccttacccgctggactagagggtgtagtgtctctgtccatttgctggttttatattagcaaggaggtgtatcagtttatggtttgcttgtttattgggttcgtgtgatgatcatgttgtgaatttgacgatggattctttttcttttgtgacaagaactcggatctttataaaagctcacgagaagtacaaggcataataaaaattacattgggcttcaaaaaaaaaaaaaaaaaaaaaaaa

SEQ ID NO: 8883 - DNA, 685 bp, Triticum aestivum
  Clone ID: PAT_TA_8883
gcaatggacttgcactgccggcgacgcagcccgcaatgctttctcctttgattcaaggacgaaatctagtttcagtcttgtagccacaacaaacagtacaagcgctgtcccaggccactcgtgaagcaaaaaatctcaccttattcggcaacgcaagcttagcgtattcgtgaagaagaagaaaatctcctgccgcacttgccccgggttttgcactatcttttttcttgaggttgtaaacaaacagtgtaggcacacatcatggtaaaaaggccatttctttcataatgccaggcagtaaaatccccctttgaatcatcaggtgcactcatattaacgatgatacccgcaccatgcggacggaggaatcgtctgaccaattgttcattccaggaattaccaactctgatgacaagctggctcatccttgtattgtatgcctaccattcatacttcctggacttggttttaaagcaaaatttcagggaagccagttatcacgtcaggccctgatgcactaagcatgagtaaacaccctttcagtactcccaagtatcccaagaagcccagtgaactcttcgctgaccctcatcctctccccaccaaaaaaatccttataagtttcatgcaataatcttttagcaaaccggtcttcaatgggctgaaaacgatttgctttcgtcca

SEQ ID NO: 8884 - DNA, 1067 bp, Triticum aestivum
  unsure (1)..(1067): unsure at all n locations
  Clone ID: PAT_TA_8884
ctagaactgatgctttggatatngcacaagagaaaccatgctgaagttagaagatagccgattacaaatctgaggcaaatcaacagtctgaccatcatcttgaagagcgtgacaaagttgcaacgctgctcggctgatttgtagcacgaaatggactatggtttccccaaaccaaaaggatttgatcatcatcggcaacgcgacgccaaagatttgtcatcaaaaacacacatggaaccaaccttgaaggaaaaaggtggcgctgaatacccacttctccttgacccgcgactatatacatggtggacttggtgaaatcttatatgtacatgtagttagagaatgacatgaccgccatggccatgaaactcagctgctcaggtgttcggagtcctggaacgggacatgctgggtttcataaaccggatgaattcatccagcaccatcttcccgccatttacagggtcaaagttgcacctatagaaactgccatccagaccgatcatcatcacagtggtttgatctccaaatgctgtaatatagcgtgtgacttcgggtaaacggaactgagcaaatgaccattccgaactgaaatatttggggagaatccctttcatgaaagataatgatgagctcacattgggcccaacagaaccagatgagtaactacgatccatttgtcgaccagcaattgcagattccccattacctgcatctttcccgcgcggccgcgctcccccgcctgggcgcatcccctccccccttggcgctttcgcccccccagcccctcctcgtcccctccgggcccggggctaccccgcgcggccccccccgctcctctccgcacctcccgccgccaggcgccgtccatcctgggccctattccgctcctggcacccccaacgctggccgccgcttgggggagcccatccccgggcactgtcatgcatgaaatgttggagtcatgagcagtgatgaacttggtctccttcgacccaaaatgctcaacccgaacaattccttggcgcgtcccagggcaggccatcactgaaatgtctgcatgatgc

SEQ ID NO: 8885 - DNA, 2512 bp, Triticum aestivum
  Clone ID: PAT_TA_8885
cgtccgcgtcaggatgctcagtgctcgctgctccctcttccccctccgagaagatcgtccttcgaagccggccgaagttgagtgctcgctgctccctcctccccctccgcgaagattctccttcgacccctcccgatctccaaggcgacgtcgccgtcgccgtcgccacgcgccagatctactacccgagctcgcggttcgccgtcgccgcctgcgcgatctaccccgctaagatggcgacctatgagcccaagaacatcctcctaactggggctgatggtttcatcacactctcatgatgcgaaccgtctaattaagagctatcttccacttcaccaattgtggtcctctacaagatagactactgctcaagactgaaaatgatcaaaccatcccggccttcacgaatttacaattcaggcaagacaggcatgccaagagctgatttggtgaactatctactcatcacagggtcgcatcgacactaaaatgcattttgctgcagcaactcttcattataattcgtttggctaatgctttgagtttaaaaagaacaacatatattgtacccatgtagtacttgaagcgtgcagggttactgtcaactatagaagatttattcatatcattactgatggggagtatggagaaactgatgatgatgctgtggtaggtaaccataatttacgatattttgttacgcgttatgtttcttcttgtagtataatcagaggtgaaatgtttgggagggcttatgtgagggcccatggtcatcctttagttccaacccgagacaacaatgtgtatggaccaaatcagttccctgagaagctcatcccaaaatttatccttttggccatgaaaggcttgccccttccaattcatggtgatggctctaatgtcaggagctacctgtactgtgaggatgttgctgaagcttttgaggtagttcttcacaaaggagaggttggacatgtgtataatattggtactgtgaaggagaggagggtaattgatgtggccagtgacatatgcaagctatttggcttggacaccgaaaaggtcatcaggtttgtcgagaataggcccttcaatgaccagaggtacttcctggatgatcagaaactgaagaagttaggatgggcagagcgcactacatgggaagagggtttgaagaaaacaattgaatggtacaccagcaatcctgattactggggagatgttgccggtgcattgctccctcatccaaggatgttgatgacgcctggagttgaaaggcataactggactgaggaaatcaaatctcttgcttcttcgccagctgaagccaaggaatgtagtacagtacctgctgcagccacatccaagagcaccagcagtgtccctcaaaaggccacctacaagttcttaatatatggcaagactggatggattggtggcctacttgggaagatatgtgagaagcaaggcataccttatgaatatggtaaagggcgcctgcaagagcgctctcagctcttgcaagacattagaaacgtgaagccgactcatgttttcaatgctgctggtgtcactggaaggccaaatgttgactggtgtgagacccacaaacaggacactatccgcaccaatgttgtaggcaccttgaatcttgctgatgtttgtcgtgagcaggggttgctcatgattaattatgctacaggttgcatatttgagtataatgctgaacaccctgaagggtctggaattggttttaaagaggaggacacacccaactttgtaggttcattttattccaaaaccaaagccatggtggaagagttattgaaggactatgataatgtctgtactcttagagtcaggatgcccatatcatcagacctgagcaatcctcgtaacttcatcacaaaaatagcccgctatgacaaggtggtgaacattcccaacagtatgacaattttggatgaattgttgcctatctctgttgagatggcgaagcgggattgtaggggcatatggaatttcaccaacccgggggttgtcagtcacaacgagattctggagatgtacaaggaatacatcaacccagacttcaagtggaccaacttcacgctcgaagagcaggccaaggttatagttgcacccagaagcaacaacgaaatggacgcgtcaaagctgaagtccgagttccctgagctactgtccattaaggaatctttgatcaagaatgtctttgagccaaacaggaaggtttctactaattgaggattcatgtgacacaggtctgctataagctatttctaattagctaatatattgcatggtggcagctgtggtcaattctattgtggtatagcaggcatacatatttacgattttttgttacgcattacgtttcacttgagtaaacagatcttaaaactatgtagtggtggatatgtttgttggcctggttatctatgagaacagatcttaaaatcttgtttctatttatcaggtgcctttcatgtgc

SEQ ID NO: 8886 - DNA, 621 bp, Triticum aestivum
  unsure (1)..(621): unsure at all n locations
  Clone ID: PAT_TA_8886
tttttttttttttttttttgcgtgtctttttaactagtgacgcagccactttctagctttcaccagagcaatgaagttatcgaatagatattctgtacatcaagcctgagaacatcacctgaacatacaattatgtgctatcaaaacttgattcaatcttcaacagcactacggcacatcattacacatcgaaccgatacctaagtcacagaaacaccagagaagctgcttcttctcaggtctctgcaagcactagcaattctcctgcaccttgagacacagcagcatcatacaacactggtcactgcaatgataatttgccctgcaatacctatcatacacccaagcaccgcaccggcgacaacctgggtcggggtatggcctaaaagttcacgcaatggtcttgtttcagccaagggatgttcagccggtagttcacagactatttggttcaacaccgctgcttgctttccagcatgcaatctgacaccagaagcatcgtacatcaccacacttgcgaatatcgttgatgtggcaaagagggactgccgaagcctcttggaagccaatggctactgatantgctgtacggtcgcggatgcacacgnatgcacggagcng

SEQ ID NO: 8887 - DNA, 848 bp, Triticum aestivum
  unsure (1)..(848): unsure at all n locations
  Clone ID: PAT_TA_8887
gcacgaggtttgtgaactcaaacaaatttcttgcattcagactctccaaccaaacaagtgaggtggaacaaaattccattctaggaaagtaatggctacaaccgggtgcattgcacccacccacgatgaacaaataaataaaatacagcaaacaaagtcgacccgttacactcaaatggggccatatacgacattctatattttacgtggttcctcaaccaaacacatgctaaagcccgcaagtgcatgcatcaacatcttctcgcgcgcgcacgagataacgggagccctataataacaaaaagttcagcctaggcaccaaagcatcaacctggccgggcgcgcgttgctcatgcaggtgagtcggcatcaggagcgccggcgtcggacggggacggggcgccggcagacccgtacgatggtgcgccggcagaccctgatgatggcgcgccggccgaccctgatgatggcgcgccggcagacccggaagatggcgcgtcggcgcccgatggggatggcgacggtgcatcggtagctggcccgctggcggagccataggaggggcctggcgagccacttgagggtgcgtcggaggttggtgcgctcgagggcgtcggcgcatcagtggatggtgcttgggagctcggtgcgctgctggagccgtangangggcctggcgcgccagctgatggtgcgtcggangttggaagcgtttggatggcgccgacgcatcactggaactggatggcgcggacgcatcagtggatggtgcttgggagctgggtgcgctgctggagccataggaagggcctggcgcggcagcttaaggtgcctcngaggttggtgcg

SEQ ID NO: 8888 - DNA, 1537 bp, Triticum aestivum
  Clone ID: PAT_TA_8888
gcaatactcggcattgctctgtgtgggcttgttatcctcctgatgattttaatagctgtttgcaggccgcatagtcctcctgttttcaaagatgtctctgttagcaaaccagtgagcaatgtcccccccaagctagtgatacttaatatgaacatggccctccatgtctatgaagacataatgaggatgactgagaacttgagtgagaaatacatcattgggtacggggcatcaagcacagtttataaatgtgttctgaagaactgcagaccggtggcaatcaagaagctgtatgcccagtacccgcaaagcctgaaggaatttcaaactgagcttgagactgtcggcagcatcaaacaccggaatttagtgagccttcagggatactccctatcacctgttgggaatcttctcttctacgagtacatggaaaatggcagcctctgggatgttttacatgaaggtcaatccaagaagaaaaagctcgattgggagactcgccttcggattgctcttggtgctgctcaaggcctcgcttaccttcaccatgactgcagtccaagaataatccacagggatgtaaaatcaaagaatatcctccttgacaaagattacgagccacaccttacggactttggcattgctaagagtttgtgtgtttcaaagactcacacgtcgacttatgtcatgggcactattggctacattgatcctgagtacgcgcgcacctcccgcctcaacgagaagtccgatgtctacagctatggcatcgttctgctcgagctgctgacgggcaaaaagcccgtggacaatgagtgcaatctccatcactcgatcctatcgaagacggcgagcaacgcggtgatggagacggtcgacccggacatcgccgacacgtgccaggacctcggcgaggtgaagaaggtgttccagctggcgctgctgtgcaccaagaagcagccgtcggaccggccgacgatgcacgaggtggtgcgcgtgctggactgcctggtgcaccccgacccgccgccgaaggccgcccagccgcagccgcccaccggcccgagctacgccaacgagtacgtgagcctgcggggcgccggcacgctgtcgtcgtcctgcgccaactcgtcgagcacgtcggacgcggagctgttcctcaagttcggccaggccatctcccacaacacggagtaggactttgaggccgccgctctggtaactcaggcggcggcgggggatgcaggtagtcagtcagacgagtagtagcacccacattttgtctaaatatgtgccggaggttaaccaagaaagagactggatcggtggcgttctcccctgtaaaaaggccatgtattttctttctcttcctccccctcttatctctaacctagtaggaggtttcgatggatctctcttcttttctgcgaccgttcttggactggaacgatgtgaattggctgatcttgtaaggatgtcggtagcaatgtctctctcctctgtgtgtcaaaaaaaaaaaaaaaaaaaaaaaaaaaaa

SEQ ID NO: 8889 - DNA, 885 bp, Triticum aestivum
  Clone ID: PAT_TA_8889
gttggagcggcggctgacggggaggccggcggtggacttgagcccctggaaaggagcgacggaggtggccgacgaggccatcacggtgggggccatggctgtactatgtaggtatatagcttgctaggaggaggcttttttttttggaccaaacattctcacgttgccatcagctagtaatgatgccgaacaatgctcgaagctatccacgacgcgcagttctttgatgctggcaatgcatgctaccggcagcttgagagaaaaatcaagactaccatatatacaaagaagaaaatggccatcggattcatacccggccgaataattaccgcagattcgtggcgtgcatttgttctttatgcttgtcatttcgtctccgaaggagcaatcttagcattcagcaaagaggatgcagtgcgtggtcagctgttcttggcctcctgcagcacctctacagccttcttcatcttgggccgcttcgccggggcgcgctccgtgcacagcatggcgaccttgagcaccgcgagcatctgcctccgccacgcaaacgacacggtgctcagcctcgggtccatgatctgctccggcgtctcccccctctccggcgcagagtgcacccacttgacaaggtccacaccctcgccaaactcctcgtccaccggcatcttggacgtcaggatctccaacagcagtaccccgaagctgtacacatttcctggtacagtaacctgcattgagtaggcatactctggaggtatataaccaaatgtgccagctaccgcgctgatgctggcagtgccctttgaagggtccagcagcttggagatctcaacttcgccaagaagcgcgttgtagtgcgagtcaaggaagacattacccgaagaa

SEQ ID NO: 8890 - DNA, 870 bp, Triticum aestivum
  Clone ID: PAT_TA_8890
ttagcgtggtcgcgcccgaggtccaaaatgtcgatagttagctctaggtcttccggtcaaaaaacaacgtcgatgaaggcgtgtaggtgcactattacgcggtagggattgcaatttttctcgcattttagttttttcactcaaactcaagggagaaactttgcttcttatctttttttttaaagattgacgaatcaaatgatatttctgttctaatttctgccgcttcttctccctctgaatcaaacttttttttgccataatgtgtcgttgctattattaccaagtatacggttctaatcctagatggaaaaataaatagaaaaagaaatatctcgaggctggtcctccctctctatccaagggtaatgaactaggtgctgatacagtacaaaaaaacaaactaaattaaccaaacttgcctgatgttgaggcaatcaagaaagctgcataagtgaatatataacccacggaaaagtgagctaatccaaccaatcttgcttgcacaatggaaagagccacgggcttatctctccagcgaattaaattagctaaaggtgtgcgttcatgagcccatgctaaagtctcaattaattcctgccaatacccccgccaggaaattaagaacataaatccagtagcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatatgtttccaatgccaataaaaagtaacccacccaatggtatttaacatcca

SEQ ID NO: 8891 - DNA, 659 bp, Triticum aestivum
  Clone ID: PAT_TA_8891
cacactttccccttggcgcgtttcccccacctctcctcccgtgctcccaccaaatcccccgcaattcgaacccatcaatggcgaccaggtgcgccgccgcggccgatctgcccgccggccgcccccgcaagcgggcccgccacggctgggacgtcgcgccagcgaccaaggtaaacagacgcccccatttcccctcccgtctgcgctcccctgccctcgcccgtccggccgattcgcggcgcggttcgacgaaattcgtccgcggtttcgttagccctagcatgatcagggcattttgtgtctgttccgaggtgtagcatgagctggacgaggcgcggtccgtgtagatctagctcgcgcgggtcgtgcttagcgggaattttggcgcagaatccaacgtttagagtgtcgtgtgtctgatgctagacctgcttaggctgcgattgattgattgaactgcagataccgttggctctgcgattgtgtagagctgttacaggccatcgtcggccaaattaggatgttggaccaaattacccctgtaattttcttttgtctgtggttctccctcgggccttgtttgcttggggttcgggtgcttagttttgtacaactttcagcttatcatgatgttggtggatttagtacaattcatgttt

SEQ ID NO: 8892 - DNA, 967 bp, Triticum aestivum
  Clone ID: PAT_TA_8892
cgtccgcacacgcttgctgcctaccctctctcgccgcctctgctgtgagcgagcgagcgcgaggaatggaggcgaggcgggagatcgccaagcgggcgcgcacggccggcacgagcaacgacgacgacgccgggagccaggggagcgcgggaggggcggcggcggtgtcctccggggtcgccgtgaggaccggcgcggcggagatggacggggaggagttggccgtcgtggcggcggcggaggctgaggtggcgggctcggcggagacggaggagcacgtccagcgcatcctcctcgccatcgacaacttcacccgcaaggtgtcggagatgctggactccgggcgcgccatgttcaaggacctcgccgccgacttcgaggaccgcctgtgcacgatccacaaggagagggtggagaagtgggaggaggagatccgggagctgcgcgcccgcgacgccgccaacgagcggacccgcgccatgctccacaacgcccagctccagctcttccacatccgcgaatagacagccgagttcaatctgcttcgatcagctagctgttccacacatcttcagcaaaggcaaggcatccatccaacagcctatctgcatgcaacagcagcagctccctgtttcttccgcatgctttctactatctttctgaacttatcagcacagcaacattaacaagtccagtttgatgtagtgctaccattactgtatgctcgtatgaatctgccaccaacagtgagttgccacttctgaatctgaacatgaatgccttgcactttagttgaatacacacctgtcttcaggaactctttcgtgtttgcgatgcgtttcgcctgttccaatgcatggtggaaccttgatctgtgacgctttcttgtcgaaccgcgtcagcacattctcaaccttactacatgtttcaatctgggaacataaatcatgtgactagttgacagaca

SEQ ID NO: 8893 - DNA, 449 bp, Triticum aestivum
  Clone ID: PAT_TA_8893
cgtccgcggacgcgtgggctccccgagacccacaagcaacccgctcccgcgtcgccgccgccgccgccgccgcctccgcagcgccttcctcggcagaagccccagcgccccaccccccatggcgaagaagaggaagcgcagctccgatgctcccgcgtcagccgtcgtagagaagcccgacgactctgcgccggagcggccggagcgcaccctcttcggcttcaaggaccagccggactcccccgccgagcctgcttcgaaggacgcgggccccttcttccggaacaaggagaaggtgctcattacgtgctcccgccgcatcatctacagataccggcacctgatgcagaacgtggtgtcgctgctgccgcacgccaagaaggacagcaaggtcgagtccaagcagagcaagggcagcgcgctcaacgagctggtcgagctcaggagct

SEQ ID NO: 8894 - DNA, 980 bp, Triticum aestivum
  Clone ID: PAT_TA_8894
gtaatttatgtaaacacttgattttatacaagaacacacatgatagtgcaaaattcagtgcttggcgatagccgccagcatgcattggtttgacgatcaaattcattggtacagtcgcctgctccagctgcctctttttcgagtgcagaaaacagaaagatctttacctttggatggtcaagtcccctgcagggccatccgtgaaatttctagtcaatgctgttcacaccatggaggaactgaagctcaccggcaaccatctgaaagggtcacgtcctctgctaacattttcttcaaattttgaacagcaacctcattggaagctcttgaaggaaatgataacacaaatttttgctactccaaaagatcataggaaggcaaaaccttttcatgatcatgtttttgtgttctccatcgtggatgaccacatttggttcagaaattaccagatatctgtaccccacaatgagattgacaaagttgataaaggaggcctagataaaatgacacttgttgaggttggccccaggttctgtttgaatccaataaaaatatttggtggtagttttggtggccccacattgttcgagaacccattctatgtgtctcccaatcagatccgcgcactggagaaacggaagaaggcaggcaagtacgccaagaaggtgaaggccaaggtgaggaggaagatgcacgagatggagaacaccctcgagcccgacgagtttgctgatctttggaaaggggaagactagctagtgcgggcgactgtactaatgaatttgatcgtcaaacccatgcatgctggctatcgccaagcactgaattttgcactattatgtggtagttctggtatgacaatcaaagcatgtgttttattatgtaaacaactggatttcgctcttgctcatatccatatcgccttgctactggctgtgtgtttcaccttgtcttttgccactgatatactagttgcaagc

SEQ ID NO: 8895 - DNA, 1511 bp, Triticum aestivum
  Clone ID: PAT_TA_8895
cgtgcgctcagggtttccttccttccttggacctccacgccgccgcctcctcctcctaccttgggcggacgaaccaccgcagcgttgttgccgggagtgccttcggagaaccacagctctgccccccgcgccgcgcctccggtggccgcttcttcctcgaccccggcatagatcttgccctcaagtgccgcgcaacccgctcccgcgtcgccgccgccgcctccccgcggccttcctcggctcaagccccagcgtctcaccccccatggcgaagaagaggaagcgcagctccgatgctcccgcgtcagccgccgtagagaagcctgatgactctgcccccgagcggccggagcgcaccctctttggcttcaaggaccagccggactccgccgccgagcctgcttccaaggacgcggggcccttcttccggaacaaggagaaggtgctcattacgtgctcccgccgcatcatctacaggtaccggcacctgatgcagaacgtggtgtcgctgctgccgcacgccaagaaggacagcaaggtcgagtccaagcagagcaagggcagcgcgctcaacgagctggtcgagctcaggagctgctccagctgcctctttttcgagtgcagaaaacagaaggatctttacctttggatggtcaagtcccccgcagggccatcagtgaaatttctagtcaatgctgttcacactatggaggaactcaagctcacgggctaaccacctgcaaggctcacgtcctctgctatcatttacttcattttcaccatggaaaccttaatgctcaccctcgaaggaactgatagcgcaaatttttgctgctccaattgacttccggttggcaaaaccttttcatgatcatgtgtttgtcttctccattgtggatgaccacatttggttcagaaattaccagatttctgtaccccacaatgagattgataaagttgataaaggaggcctagataaaattacacttgttgaggttggccccagattctctttgaatccaatcaaaatatttggtggtagttttggtggccccacattgtatgagaacccattctatgtgtctcccaatcagatccgcgctctagagaagcggaagaaggcaggcaagtacgccaagaaagtgaaggccaaggtgaggaggaagatgcatgagatggagaacaccctggagcctgatgagtttgctgatctttggaaaggggaagactagagcggatgcagcggcagactgtaccaatgaggttgtcttgaaactactcatgctggcaatgaccaagcagtgaattttgcttgatattatgtggtggttcttgtatgacaaagcatgtgttttattactataatgaacaactggatttcggtcatgcctgtatccatattgccgtgtgcttgccagtatatgctacctcagtatcttgctaccagctgtgtgtttcaccttgccttgtgcctgatataattgcaagcaactcagtttttaaaaaaaaaa

SEQ ID NO: 8896 - DNA, 529 bp, Triticum aestivum
  unsure (1)..(529): unsure at all n locations
  Clone ID: PAT_TA_8896
tccggtccgaattcccnggggggggcgcgtgcgcccacgcgtccgagttctggtgcctttgaagtttactgcaatggagatttggttttctcgaaactagctgaacagaggttccctagcgagtttgagctgcgcgatctcatcggcagcaggctgccaccttctccattcgggaaaaacatgggaaacgtcttgtcttagtcgatgatctcagaaagaatatcgtactcagcgcggatgtatctctagttctctactaaggtattttatggttagctagctaatgtcgatcctatcgaaactccacagcttgcctgtaaacactagcttccgaatatgcgtgtggtttgtaaatgccctaaaaataacttgcacgagacagtgactgacagtgcgatcgatactgctgtatgaacacctcccactataatcgtgattgcctgatgctgctatgctactggcaaaagtctgaaaatcaaaaaaaaaaaaaaaaannnnnnnnnnnnnnnnnnnnnnnnnnnnnnannna

SEQ ID NO: 8897 - DNA, 1227 bp, Triticum aestivum
  unsure (1)..(1227): unsure at all n locations
  Clone ID: PAT_TA_8897
cccgccgccgctcccatacagcagcccaaaccggagggaggagcggcgctccgcgccaccgtcggcctgcagctcccccccgcctgcccccccgcgcgacactccatcaccggccgccgcccaggaaaaaagaagggagcacagcatgcgcgcggaagccggcgatggccctccagcgcgtccagctcctcctcgccgcaccacccgcaatcctcttcctatccgcactcaccgcaagctggaaacctccgttcccgcaactactcctcccccacggcatccccccccaccactccccaagcgggtactgccaccaatcctaccagccgcacccgccgcaccaactccaccacccaccgctcctccaccaccacccggaccccgccgcagcccccatacagcatcccattctggaaggaggagctgtattcggcaaaacattggcgatgcatttccgcgccggctgcttgtacaagggaaatgctatgacgatgaggcgccttttggaaactactgttccgggcattaatttttccctgcattagcctaaccgccagtccttcgcaaacgtgtactgagcaaaattaatggcagttattcgcgacggtgtcattgcaaggaaaaatggctgggtgaccactttttccccatacttggatattacgccgacttccattgttttactccgttttagttgcaattagattacggaggtcatggagacaatttgggctgttggccaattttgcccaatctttccctacaactttctggtgcctttgcagtttactggaattgtctgatttggttttctcagaaattatccgaacagaagttccctagcgtgtttgagttgcgcgttatcaactggcagcatagctgccaccttctgatcctcgggaaaaacaagggaaacgtcttgactaatatcgatgatctcagaacatcggtacgcagcgccgatgaatctctagttctctactaaagtgatagttcgataggtactcttatattaatcctatcgaactccaacaggcttgcctataaacactaagcttccgaatatgtgcgtggtttgtaaatgccctaaaaataacttgcacgagacagtgactgacagtgcgatgctgctgtatgaacacctcccactataatcgtgattgcctgatgctgctatgctactggcaaaagtctgaaaaaaaaaaaaaaaaaaaaaaaaanannnaa

SEQ ID NO: 8898 - DNA, 713 bp, Triticum aestivum
  unsure (1)..(713): unsure at all n locations
  Clone ID: PAT_TA_8898
gnagcgtctctaccctnctacagngggccgcgtggtgtatatattgattgggagagacccatctctcaataggttacaaccgaagagatattacaggagggataagagagaatagcaagaaaagaatcctatccctatacaatcaccttggcgcacaaggcagcctcaaaggcgtgacacaagttacatgtttaacaacgtagatctacttttaaatctcaatcgccaatatttatggttaacacaaaatcaacagatataaatagatgacgtatgaagaactatgaaagcctcctctctttaatgttaggtaaagattttctcaagaacagaacagtgctctgttgctttacaatctgaatatccttaacctagagagtagactacaacaagatgcttgaaagggaggctagcacggggttatgggggagtgggaaaatgtcaatatgtgctgcctctggtcgtttctgttaatccttatcttccgtaattcaatgaggcctggatctcttcgagtgtttttcctttggtttcaggcactagccttgccacgaacagtatagtgaccaagctcgacgcagagaacatgaagaacgtccctgctgcgctccagtccatgaggaagttaaacgagtaagagaccgcgaaggaaccaagccagctaatgagggtcaccaagcttncgccgagtgctttgatgntaatcgagaata

SEQ ID NO: 8899 - DNA, 591 bp, Triticum aestivum
  unsure (1)..(591): unsure at all n locations
  Clone ID: PAT_TA_8899
taccgacagtaagnattaacatagtatgataacattacaaatatctagacaaagtagataatatgacaattaattaatttaaaataggcatgtggtagcacaactagttactcataatatgagtaacatcacacatatcaaaacaagatgagtacatctcttcctcctctcctcctggagcgaccgctggcgttagtcttttggcttgggcagcagaatgagcctctcctcctcgagcgaccgctggcgttgcacgccgcgcatggcgttcttggcgaacctcgacacgaggaacgctgtcgtgatctggctcgacgacgacgcagacgccatctcggcggcgtacatctcttcctcctctcgcctccgttgctctgccgccttccgcttctcgtacctcctccacgcggcctggatgaagcacgacgcccaggtgcgccactgctgcgagtagaacctgaaggtctgctgcaattgcttgctgtgcaggcgccggaactgccccgcgacgaacttaagctcatcggcgtgcaacgcgaagccctccacctcggagagcgccttgacactacgagtggacagcgnnnnnnt

SEQ ID NO: 8900 - DNA, 1242 bp, Triticum aestivum
  unsure (1)..(1242): unsure at all n locations
  Clone ID: PAT_TA_8900
ggcagnacacacggnngtcttcaccgnaaccacaaacgcaggccgtccggctttggcttctccgttccgactccccccgtagtccagccaacaaccgccccgcgcacgtaagagcacgaatccccctttgctgctctaaggggagatgcagacggcgacggcggcggcggcggcgccgtgggtgccgagcccttccccgtccacctcctcctccgcggcccccttcaaggctagggtggggattgcgttgccttgtcggacgggtgtccggacctcctctgcaccgaggctggttgctacccccgctcgccggcggcggcggcaagtggttcaggctattgccaacccagatccagcggtccgagctgccattgactgctaaaaaggttgagttgggtgtttggatgaagtgcgtccttaccttatgggcgaaggggggtaatgtccgtgttgcatgagatgagacggaaatgtggtgcgattgaagctgcaaagagcatgtggatcatgcccagatgcacgtgacgacaatgaccatgggtattgagagacattaggaggagaaaataccagcgatcgttgcagttaaaactattgataatgaggagagctggtctttgaattgaacgaagagaacatagataaagtgaattgaccagataaagccatacctttctggcacagggggtggtgagcttgagtttggtggaatggaggagtttattttgatcgacaggcccaccgtcacggctgccgtcgtaatgccagccccagtggtcctgactcaccaggtcggccaaacgatcccgaaaagcgcagatatccagctactgtcatataccttgcagcacacttagaagccaagccccagtcatgtgaatgtgcccgctactgtgatcgtcccgaatacttgtaattcttatgaattggttataactgtatgtgtagcctcccacagccgcttggacactcaaagtacacaaaaaatataaattttctagaattctctcacatttttggttaccagccttgttgatgtctctgctgtacagagtttgcttctgcaaatgaaagtatatgctgctttttttgcaacattgttaaaataattaagataatttgggattcaacggtttagtccttgggggttttggtaggcctggtatcaaaaaaaaaaaaaaaaaaaaaaaaaccaagcccgggcggccgctcgaacacactcgcccctactttcgcccttnt

SEQ ID NO: 8901 - DNA, 2083 bp, Triticum aestivum
  unsure (1)..(2083): unsure at all n locations
  Clone ID: PAT_TA_8901
ggcatcactcaggaccaagtgattctcatggctgctagggcgtctcgaacagaaaaccaagatgctattgatacagcaattgtggggatgctagctgatccgaaagaggcacgtgctggtattcaagaagttcattttctgccattcaatcctactgacaagaggacggcgctgacatacattgacgctgatggcaaaatgcaccgtgttagtaagggtgcacccgagcagattcttcacctcgctcacaacacatcggaaatagagcggagggtccatgctgtgattgacaaatttgcagagcgtggacttcgatcgctggctgtagcgtatcaggaagtaccagatgggaggaaagaaagccctggtggcccatggcattttgctggtctgatgccactttttgatcctcctagacatgacagtgctgaaacaatccggagggcacttaaccttggtgttaatgtcaagatgatcacaggtgatcagctcgccattggaaaggaaacagggcgtcgcctgggaatgggtacaaacatgtatccttcatctgctctgttggggcagaaaaattcagacgagtccatttctgctttaccagttgatgatctcattgagaaagctgatggttttgctggcgtcttccctgagcacaagtatgagattgtgaaacgcctgcaagcacgaaagcacatctgtggaatgacgggtgatggagtaaatgatgctccagctctaaagaaagcagatattggtattgctgttgctgatgccactgatgcagccaggagtgcttcagatattgtcctcacagaaccaggcctcagcgtgatcatcagtgctgtgcttaccagtcgtgcaattttccagcgtatgaagaactacactatctatgctgtctccatcacaattcgtattgtgcttggatttatgctacttgccctcatctggaagttcgactttccaccgttcatggtcctgatcatagcgattctaaatgatggtaccatcatgactatatcaaaggatcgggtaaaaccatctccactacccgacagctggaagctggctgagattttacaactggagttatccttggtggatacttggcaataatgacggtcatcttcttctgggctgcgtacaagacaaactttttcccgagattgtttcatgtcgaaagcctcgagaagacagctcaggacgatatccaaaagctcgcggctgccatttacctccaagtcagcaccatcagccaagctctcatctttgtcaccaggtcacgcagctggtcatttgccgagcgtcctgggtttctactggtctttgcattcttggttgcgcagctgattgctacactgatcgcggtgtatgctgactggccgttcactcagatcaaaggcatcgggtggggctgggctggcgtcgtgtggctctacaatatcatcacatacctcccgctcgatatcatcaagttcctcatccgatacactctgagcggcaaagcatgggatctcgtcatcgatcaaaggattgcgttcacaaggaagaaagacttcggcaaggaggagagggagctcaagtgggcacacgctcagaggaccctccatgggctgcagccaccggatgntaaagatgttctcggagaaggcgggctacaatgagctgaatacatggctgattaggccaagaggagggccgagattgcagggtgagggagcttctacacgctcaaagggcacgtggagtccgtcgtcaagctgaagggtctcgacatcgagacgatccagcagtcctacacggtctgatgctctgagctgcccatgagcgaagagtggatcctcttctttgctatgaacttcactactgtaatcgaccgtgcgcgtggtactgagacataactactctagttaaacgttgcccgctggtgacatagtttcgcaccacctaagtaaccgcgtcgccgtttttttttgtttgatttttttttacgttttcagatagtatgtatattatgttttttttccaaaacacatactccttttttcagctgggttaattgctaaaaggcccgtactcgatc

SEQ ID NO: 8902 - DNA, 2101 bp, Triticum aestivum
  Clone ID: PAT_TA_8902
cgtgcgcccacgcgtccgcccacgcgtccgcccacgcgtccgcccacgcgtccgcccacgcgtccgcccacgcgtccaaccacgcggccgagagcgcaaccgggacagcgagccaagatctgcagagccacaggcgaccacacaccggcgaccatggccgtggacctcatgggctgctacacccctcgccgcgccgacgaccagctcgccatccaggaggccgccaccgccggcctccgcagcctggagctcctcgtctcctccctctccggcgcggcgccgtccaaggcgccgcagcagcacccgcagcagccgttcggcgagatcgccgaccaggccgtctccaagttccgcaaggtgatctccatcctcgaccgcaccggccacgcccgcttccgccgcggccccgtccagtcgcctaccccgcctcctccgccagctccggtcgctcctccgccgcccccaccgcgccctctggccgtcggagccggccaggcccgctcccttgaccgtcgtggcgccggtgtcggtggccgccccggtccctgcagccgcagagcctgacgctggacttcaccaagccgaacctgaccatgtcgggcgcgacgtccgtcacgtccacgtccttcttctcgtcggtgaccgccggcgagggcagcgtgtccaagggccgcagcctggtctccgccggcaagccgccgctgtccgggcacaagagaaagccctgcgccggcgcgcactcggaggccaacaccaccggcagccgatgccactgctccaagagaaggaagaaccgcgtgaagacgacggtgagggtgccggcggtgagcgcgaagatcgccgacatcccgccggacgagtactcgtggaggaagtacggccagaagcccatcaagggatccccttacccacggggctactacaagtgcagcacagtgcgagggtgcccggcgcggaagcacgtggagcgcgccctggacgacccggcgatgctggtggtgacctacgagggcgagcaccgccacgcgccgggaccggtgccgctgcagacggcgccgtcgccgatgccggtgccgctggctgctcccgtagcccaggtgctgtgtccgccggcaaccggcacgtctgacttagttctacttttgtgtccgtcgccgtctgatgtggggctgcgtgcaaaatgcaccgggctggtaaccgtgcacaggagaagattgattgtctcacacacagcgcaacggaaatagacgatgctggtggtgacgtacgaggctttcgccaggaggagagggagctcaagtggggacccgctcaggagcacacccctgcgcccctggccgcggatgccaagaggtgctccacccaggggcgcgacaacgagctgaaccacatcgctgacgcggccatctgcagggtcgtcactgcgcggctgctggagctccacacgttcaacgggcgcgtggcgtcggtcggcaagccgaagggtctcgacatcgaccccatgatggcctcctacacggtctgagacttcggcaagcccatgagcgacgtctagagccccttccttgctaggaacctccgcgcgctcctccacccggcgcctgggccgttgccgtagcaagcgccgttcaatgttccccgtccctgacctggtttcgcccagacgaaggcatcgattgcccggttgctggtgccgcttactgtcgatgggcgcgaggagtccgacgtcaacctgacctttcccgatttggtggcgatcgagcaatcgtaaactgtctgatgatccgcgctgtccaggagaaaaaagggggaaatccctccctaatttatgggttaccgtcatgagtgaagagtggatcctcttctttgctgtcaactttactactgtaatcgtccgcgtagtactcgacgacacatatctaccgtagtttaagcttgccggttggtgatatagtttcgcgccacctaagtaatggcgtcgccgtatttttcttcttcttcttcttcttcgttttttctgttttcagatagtatgtatattatgtttctctctcttcattttaagctcgttaccgaaaaaaaaaaaaaaaaaaaaaaaaaa

SEQ ID NO: 8903 - DNA, 672 bp, Triticum aestivum
  Clone ID: PAT_TA_8903
cggctcgtctgtgtttttttccagcctctctttcggaataaatagcatctcaggttgtttcataagtaaagaaacctatgaaaattgaaattatttagctggatcactaaactgggtattcgaaaacaaaactcattgatcgatccctaactagggagatacgaaaatatagagaagctaagagaaacaacacatcattcactggccataaaaacaaacacattattcacttatccggtgtccggtgtcctcattttatggcggcaaggcgattgacgaatatgccgaatgcttcatcagtgtcgaccatactgatcctgaccaccttttgatcagctccgaacttagtcccgctgcgggttatgatcttgttctcacgcaagaagctctctaggtcttccacttcttgcttctcacagcgcagccatgcgaatgcaggattagaggtgacagtgtccttggtgaaggtgcagaagccggccacctcgttggggaggctaaagatgccggaggctgctacggcagcacggagtgcacaccagcggtgcgccatcttccgccgcgcgtaatggaagaggaggttcgcgtccccaccggcagcggtggcaagctggtgctcgtagccgtcggtgactgccccgagtaccttggcggcgcgtagcttgcgcgtcc

SEQ ID NO: 8904 - DNA, 1879 bp, Triticum aestivum
  Clone ID: PAT_TA_8904
gccgccgcccggtcaggggcccggccccgtcccccctgaccttatagaagcttcagccgcttctttgcccccctcctaccacccaaactccaaaccctagcttcctagcctacgcgtccccgagcgagcatggatcggatcgtcggtagcaagtacaagctgggccgcaagatcgggagcggctccttcggggagatatatctcgccacgcatgtcgacacgtacgagattgtagccgtcaagatcgaaaacagcaaaaccaaccatccccaattgttatacgaggccaaactgtataatgctcttcagggagggactggtattgcaaacataaaatggtgtggcattgatggcgaagaaaatgttcttgttattgatttgcttgggccaagccttgaggatctgtttgtttattgtggccggagattctcactgaagacagttttgatgttggcagatcagatgataacaagaatagagtttttgcattctaaggggtacttgcacagggacatcaagcccgacaactttcttatgggccttggtcggaaagctaaccaggtctacatcattgacttcggacttgccaagagataccgtgactcaaccacgaatcgccatataccctatagagaaaataaaaatttgactggcacagctcgctatgcaagtcccaaccctcatcttgagtttgagcaaagccgatgggatgatctccagtccattggatatgttctcttggattttctaaggggaagtcttccttggcagggtttaaaagctgccacaaagaagcagaaatatgacaaaataagtgagaagaagctttcaacacctatcgaggttttgtgtaaaacccatcctgtggaatttgcttcttatttccactattgtcattcattgacatttgatcaacggccagactacggttttctgcgacggctcttcagagacctgtcggaccgtgaagggcaccaatttgatcatgtctttgactggacattgttgaagtgtaagcaaacccagaaggtgaaggctcaacagcaagatcctggtgtaagtagcaggccggttgcaaagaatatggacaaacaccaagctgaagcttcttgtcagcttgaagcagaacaacgcccagtaatcagaatgcaaataagatctactgctgagaacagccgttcaaataatcgacattctgataaattgagagtgagtgctagcactgataaggaattgctgcaatcaacatcatttggccatgctggtgccccaaggaagaacgtatcaatctccaaaacaccatggcttgtcgatcccaactcaggaccttcaaaccacctttagcactcagatcagtcagttcctatgttcatgccggtctatttagtaaccattgaggggataccgtgtgccccgccagacaacgagccctcactcctggactggtggcaatcggcacgacaatccgccccaacgcccatgcgcaagggcctgggtaccatgaccctcctcgttccctggatgatatggaagcaccgcaacgactgcgtcttcaacggagcgcgcccatcggtgaacgccctgctaacgaagataaggaagaggcctccctttgggcaagcgcaggcgcactagggctcagagccattacccccagacatgggatgcccattaattcgaaagctgtatccgcctcctaggaggaatgtaactacaactctctcttttcaatgaaatgaaacacacgctcatgcgttttcttgaaaaaataatcttacaaaggcttataaattgggctatagatgcaattttgtggttttgtaaataatgctgatgtacacgcacctggcattttatcattggaatttttcttatttgg

SEQ ID NO: 8905 - DNA, 913 bp, Triticum aestivum
  Clone ID: PAT_TA_8905
ccacgcgtccgctccactcccccgcaccctggccgccccggccagagagagagagagagagagagggcccgcccacgcgccccccggctcccccgagctcctccgcctccagatccggcggccggtaatggcgccgtcgcctccgcaagcagcgccgcccctctgagccgctctccacgcaacgtctccgtcgccgtctccgtcgccggccaccccaccccaccgctgcctcgaccacgccccctacccaccccatcgaggttgatgttgaaggcttgtagagctcaaaacacccagatggtactactgccataatgcagccttcagacatttggaaggcgcatgcgtcgcagcagcagcagtcggaggggccagggctggacatggagaggagcaacggatgcaacggccataactgctgcccgtcccctctccagcccgtcgcctcagctggtcagcactccgaaagcagcgccgcctacttctcttggcccacgtctacgctgatgcacggttccgctgagggccgcgccaactactttgggaacctgcagaagggcgtgctgccgggacaccttggccgcctgcccaaaggccagcaggccaccaccctgctcgatctcatgattataagggcgttccacagcaagatcctgcgccgcttcagccttggcacggccataggctttcggatcaggaagggcacgttgaccgacacgcctgccatcctcgtgtttgttgctcgcaaggttaacaagaagtggctcaggcctacgcagtgccttccagccgcccttgagggacctgggggtgtgtggtgtgatgttgatgttgttgagttctcttattatggtgcaccagcaccgactccaaaggaacaattgtatgacgagcttgttgatgggctgcgggg

SEQ ID NO: 8906 - DNA, 914 bp, Triticum aestivum
  unsure (1)..(914): unsure at all n locations
  Clone ID: PAT_TA_8906
tacaccgtatgctttctttactattgcgtaaagcaatgaagaaatgtttcggagaggatgccaaaccagaggaatgttcagttgtgcagtccaatgagttcttttctcaggtacttggaggttttgagccttatgggtttgcttcaattgtaatggagcatccattaagagtgagagtattttgcgcacaagtgcgtgccgggatgtggcgtaagaatggagatgcagctatactaagtgctgagtggtaccgctctgtgcaatggtttgaacagggcttggagtcggatttgtttctgcttcaatgctgtggtgcattatcttctccagagttctttgtgaggaccattcaagaaagatttggtctgtcagattatacatctctggatctcactcaacagaatgagtatgagccggttcttatacaagaaatgctaaccttgattgtgcaactagtcaaagaacgcagattttgtgggtgttccacagcagacaacttgaagagagaattgatttataaattggctgttggagatgccacccatagccagattgtgaggtctcttccccgtgacctttcgtcaagcgaacaacttcaagatgttctagattcagtcgcagtttatcctgatccatctggaaagaaaaagggcaagtatgtgcttcgcgaagcattctggaaggaattggacttgtatcacccgcgttggagtcccagggaattacaggttgctaacgagagatattgccgtttttgcaaagtttctactcttggcgctcaactacctcaatggactaatgttcttagccctctgcggagtatttctaagattgccacctccaaagctgtccttcaaattgntcgngctgntctcttttatgctgnntacaccgacgcatcatcagtatcacgt

SEQ ID NO: 8907 - DNA, 2031 bp, Triticum aestivum
  Clone ID: PAT_TA_8907
gccctcagggaatctgctggcggaatcacagctgctgtccccaatggtctcgctgttcggagcattcgtacacgtgcgattgaaacttccataaggaatgttcctgggtctcgtctcttcattgatgcagctccttatgatgataaagctggttacaagactgagggggagattaagcagaaacttgtgccctggcatgctgatatttttgagttccttgatctgagaaagaaccatggtcaaggtaggagaaccgtgaaagagatcttttctttgctctctgggttcctgatctattcatgcaaagagtacaaaataacgaggattggtcccttttttgtcccaatgaagctccggggttggctgattgctggggtgagaagtttgaggaattgtacaagaaatatgaaaaagcaggcaaagcaaaaaaggttattccggcacagaccctctggtttaacattttgaaggcacggaaagaaactggcacacctaaaatcctctataaggattcatgtaatagaagatgtatgcatcagaatcaggtcacaatcaaatcttcaaacctgtgcactgagaaaactggtgccacaagtcatttggaatctgatgtcttgaacatactgtcgactgctttacaacgtttattgaggggcaaggttgtgtaaagaaactgggatccatcctagcttgctgttagccatagatcaaaaattacaaactttgactttgtcgagcttgtgagattgataatccaggtgtgatttcctatctaaataaattaattgataagaaaataatcgctgttagttattatccggttgaaaccgctaggaggtctaacatgcgacacaggccttttggccttggagttcagggcttggcagactcactcatgttacgtggcacggcagttgattcacctgaggctcagcatttgaatagggatatttttgaaactatttactaccatgcccggacagctgccgctgaactggcggctagagacggcccttgggagccctgtcagcgagggcattatccaacctgacatgtggaatgtagtgccatcgaccagatggaactggccaactttaagggaaactatttctaaagttggagtaagaaactctcttctggtggctccaatgcccactgcttccactagtcagattcttggcaacaatgagtgctttgaaccctacacatctaacatatacagtcggcgggttctaagtggggagtttgttgtggttaacaagcatcttctccatgacttgactgagatgggtatctggacacctgctctgaaaaacaagataatttatgaagatggttctattcagaagatggaagaaatcccagatgatcttaaagcaatttacaagactgtttgggagattaagcagaaaactctggttgacatggctgttgatcgtggatgctacatcgaccagagccagagccttaatgtccacatggatcaaccaaactttgcaaagcttacttcgttgcatttccatgcttggtccaagggcctgaaaactgggatgtactatttgagaacaagggcagctgctgatgcaatcaagttcactgtggatactggctttctgaaggtcaatggggatgctaatggcactaatggcactaactagcagaggaagacgacgaagccaaaatggcgcaagtcgtctgctccttgaacaaccgggaagaatgcctggcatgcgggagttagatgcatccgttgcatctatttttctcttaaccaaggcagccattacacaaccaaacggtctgatcactggcgttgaataattgataagtgagtcgtttatgtaggtgtggttgggttcaagatctgattgagttcctttggtgggcagcccttgatggctggagttgccaacgttggcttgtgttgtatttgtactatctaaaaacatgggttgctgcagctatgtatatatatgtatcattgttcgtcttaaacaccccttgatttggcccggtggggttgttatactt

SEQ ID NO: 8908 - DNA, 666 bp, Triticum aestivum
  Clone ID: PAT_TA_8908
agaaaccaactgtttttccttttgtacaaatatatagcaggaatcttgaccttctggctaaagctagagtactaatctagcagtactagtccagtctcctgactagtggtagtacatcactactacatgattacacgcattcagtcattcagtgtcagtgaagtcaaaagaagcttcatcattacacgagaatgaactcaccagggcccagggctctgctcgccacaaatgagtcattctgtaccagaattaggacttcggaggtcggcagacattctcgcttttcactaacccaccaagccaaagcacgcccaagatggccaaactatttcctttcctacccgtcatcttccaataatgtactagtacaaaacctgacatatccctgctgtagccgagcacgaactgcggcaccgggcccgcccttcctgcccccgggcgggaagggaccgtgtgttccgtgtgcgtgcgtcaatgctccattggctgttcccgcgcaccttccgcatcccgcctttgcccttgcagctttcggccctggggcctcccccctcgatggcgtcgcttaactgacccagctctccgcctgccctacctgctgtccccgcctgtcgcaccgcctgggccttgcatattttgggtgccccacatgccctgtgttaaccg

SEQ ID NO: 8909 - DNA, 673 bp, Triticum aestivum
  unsure (1)..(673): unsure at all n locations
  Clone ID: PAT_TA_8909
ccccccctttttttactttaaaaagaagtctctaccatctgctctctcctttttgtacagtacaatatataaaaaggctcatccgaacatttgggctagtccaaacttacactaactatccgaagttgtatcatcatggnacaagttgtacaaccaaagacggcctgatcattcttgatcaagcattctacacagtatgacacccacaggctcctgcccactctagttatgtacacaccccgggctctcactacgactcggaccctccacagcacacctccgcgcagcactcgtagcagccgaggcacgagagcgcggcgcacacctgcgccatcaagatggcgcactggtcgttcatcttgttgcacgccttgatgcagcacatgcagcagaggcagtccgcgactcggccgcagcacccgcccgccttcttgaatatcttcaacgtctccagtggtttctcgtcgccgaaacatgtgaggaggttttccctggtggctgctttgtcaccgaatccaagttttagaccatgaagctggaatcgtaatggctcattggcgcctttgtgtcctttctgtttctgcttgactttttgtgctgcatccaaattggtttgaagtacaaccatgcttgtgtactctgaaagaacactattctctatgcttaattttat

SEQ ID NO: 8910 - DNA, 819 bp, Triticum aestivum
  unsure (1)..(819): unsure at all n locations
  Clone ID: PAT_TA_8910
ttttactaaataagnaatactgcatacaagtcgatgtgtgtcgcacaaagcggcataaacatagtttacaatccatcaagttacataaaagatctaacacgtggcggttagttgacactctgcatacttatatatcttgctaggttcagtaataggtcgacgaccaagaaaaccgtcaccgacaccaccgcacccgttgctcaaatggtattctctctcttggctgccatgaactgctgccttgaaaggaatcgacagctttccctccatgaagtcaacaaacagtgtatcttcaaacggcacagccgctatgaagtactgtggatgtctcccagcagaggcaacgaaccgatcacactcacgctgctcgcccatgaagtcatacaggctctccgagatcgccgtgtacccacacatcttcacctccatgcctcctgtgggcaccttcgtgaaattcaactctaccgtcgcctcgagcgctctacgaaagatgataaaatcgaacatggccgcaccatttgtatcatccattgtgcactcaatttctgtgtcatatagacaatgactctcgataagatcggaacacccatcgaccagagtgacatcttctatatctccctttattctgatatcaacttccatcaagcattcaaatgtcatgggacatgcctcttttcggactcatcaaaggcaggtagtcgctggtcgtgttgatggtcactgggtcagttcggggtcgattgaaaagataatttcggtgataatcctcaccatcccggattgcaacaaaaccatatacctcgactgaactgcctatag

SEQ ID NO: 8911 - DNA, 465 bp, Triticum aestivum
  unsure (1)..(465): unsure at all n locations
  Clone ID: PAT_TA_8911
agaattttgaaacttgntnngggatttttctacacacgcaccaactattctgtgatttttcatggactgaagatagaatacgcaccaaactaatattaagtctggtacagaaattctctattcttgaactgacaatatttcttctatgtggaatacacaagatctcctcaattggccatgatgcaggcatcgccgcacgcaatacttggcgcaccggagaacctgtactgttggatttgtcgagagaggactgagggaacacgccagcgttagggtggcggatgcaagtattggagttcacccttgagatgatatctcttcttgaggtcttgatgaaaagtgacggtgtaggtaccacataaccaccaattaaacaccancncttaacaaacgannntctctccttccagagtcngaacttactagcttttcataatctgaagaggttaaacctttanctcgtgc

SEQ ID NO: 8912 - DNA, 772 bp, Triticum aestivum
  Clone ID: PAT_TA_8912
caggccctgtggtcttgtcccaggccaacacttggtgttgttgtagcggcatcatcaaagagtagtactagtacatgagtttttagctagagtagtagtacatatttccaagaaatcgtaataattataagcttcatttcagctatatatatagtagtagcagcggcagcagcagcagcagtagtattgaggaggcctttgttgttcctcagtgtggaaggccggcagctctgccgcagagtatggcgttggtcgggatgctgtactcgttggagaagctctgctccgccgtccagaccctcaggtacagctgctggccgaggtactgccggtcccagttcgccgacctcaggttccacatcccttggttgtccagcgacaccaagatcgccgaccatccgttcggatacacctgaacagtatgcctcgcttgcgcgtcgaccaggttgtagttcagccgctcattctccgtccactgcccattatcgccgtacccgacgacccagaaatcatatccgtcaagatgccacgactgcatctcgttctcggtgttctggaacaccacctccacgaactcgtgcaggttgagcctgaccacaggcgtcccgggccggggtgccccgccgtcgggccgctccgggacactgtcccattcgatcacgtttgcgatgttgtagttgtccaggagcttcagaggcgtgtccggtacgacgaatgagacgccgttcacggcgtaccgtctctgcccagcgacgacggcagctgagctggc

SEQ ID NO: 8913 - DNA, 776 bp, Triticum aestivum
  unsure (1)..(776): unsure at all n locations
  Clone ID: PAT_TA_8913
atcttagngcggtgttgttcttagccctaaacccaacccggaccgcagagcacttagaagtcttgtttataacccataaaacataaagaacatacataactaagcacacaaaacgaatgctaaacttaaaacaaacacttactcgaagaaactactaaaaacaagaaatgagccaacatgtgccgaagaagaactcggtggccaagaattattcctccacgttaagcccgaaaactgcaatcagcaaaccaggctgtgcttcttcctcgcaacgaaggtccgccagtaggtggtcacctccttctcaatttggtgtgctgtcttcttcacatgctcgtgatgcccatgcttcttggcatgcgcgtccatctccaccatgaccttcttgaggtcggtgatgaggcgctcggccaggccgcggctgaagtcctcacggatgaccacacgcatgacagcgatgtgctcggcgtcggcgggcattgtgtatgccggaacaatccagccgaagcggcgcaggctctcgaccacctcgaacaccgtgtatttggacgagtccttgagggagaaggccacgagcggcacgcccgagtccttggacaccaggtgaaagtagcccatcttctcgactccctcccggagcaccgttgcgttgtcccggcaattttgcatgatgtccttgtagccctcgaatccgagacggatgagttgataatactgcgcaatgatctggctcgaacctttggagaagttagcgtaaggtggcggtcggcgccgag

SEQ ID NO: 8914 - DNA, 252 bp, Triticum aestivum
  Clone ID: PAT_TA_8914
tcttacgcccacgcgtccgaaccaacttagttcatatgactccacccacgcgtccgaggtattttccgctcagtttggtgggagctggcttcctgtgtttagttcaaccaaggcaagaaaatctgaagatgaaagccactgggtggtgggtttagatgctaataatatattctgcattctatgcaaatcccctgtatgttttcctcatgtgattccctatcctgttctaactatactaggtctgttattttc

SEQ ID NO: 8915 - DNA, 762 bp, Triticum aestivum
  unsure (1)..(762): unsure at all n locations
  Clone ID: PAT_TA_8915
ttttttttttttttttttttcacatgaatagttggataaggttgagataattgaggtttacaattcatacactgaccataggacatggtgcatatctgactacttgcaagtaatcaaaaccaaagctgacaaagctcatacgaatatatagttggatgaagcggagacaataagtctgactagccctagccctagccctctgcaataaattcatcattaagcgccgggtcctcagcaataaattcctcattaggcttcaggcccaaagcaataaattcctcattaaacctagcaccatatactccagtaagaagtccttgcagaagatgcctgagatcatcatcaagaagaggccgcctattaacatcatactggtgataatgagctatgactactttggcaaagtgcaaggctccaaaaactgtttgagcaaaccccacccccccggtaacttcaatttgatggtccagaatcgctgtaagagacgggtctccaacattgcgttgccacccnctgtaagaagatatgtttctccaaccaatctatttggtcatcggtaaaaaaaattcctttttcatataatcttttatacttgctctccctaacgtgggggactgtgactaggaatggatgatcgaggacatcttgtttccttatgtttatatttgggttaatgaggaatgcattgaagtgcgctagttcaatatcatctggccaatgttgcaaaatattggtctgtatcagtagttgcaaaccctgcct

SEQ ID NO: 8916 - DNA, 578 bp, Triticum aestivum
  unsure (1)..(578): unsure at all n locations
  Clone ID: PAT_TA_8916
ttttttttttttgacaacaatcaggaaagggatttcattgcaagtcttcaactgatcaacccagtggtacattcatcggctgagttaactgcagctgtgcacagaattccttctcacacagagtactagcaaataccaacagatactacatgctctgctcccaaagaagaagaaaggctaacacatggtaggtacctaacttgttaaaggtcccgaaaatgataattttacatggttaactaaatgtcacttggtgttcccctaaccttcttccccatgcttgagctttacaaccatcacatgttttctgcaaccatatcgccgccctttcgtggtggtgtttttctagcttgaaactgaagcgctcaggcgctccaaggtttctgtgacatttctcatcaccggtcttcgctcgggattagcatgaatgcaagcgagagcgactttgagtacagcgatcatctcaccttcctgttccgagtccccggcgaggaaagggtcgagcacatcagcggatggtttcttatcttgtatacagaactggacccactggacaagatccatctgcatagtttcnn

SEQ ID NO: 8917 - DNA, 813 bp, Triticum aestivum
  Clone ID: PAT_TA_8917
ggtgtacgggcgccctgccatcacggacggtcgcttatgttccccgcgtgcgggctgtgttgtctgctatgctcgtgtctgtcgtttggcttcccttgttgtttgatttggctttgcttggtgtttgcgcacattggtttagttctccttctttcccgtgccctagacgatgtattgaattatgaacgtaggatatgtcgtcatcggccccccgacgtcgccccccgcagaccgacccccgccaccccgaccgcggtccctaccacggcccccagttccacgctccccggctccgccgccgccagcgggagtgtaccatcgggacgacgaaagtctgcccgggggagtgcgactggtgccacgacgatcgaggtctgtgcgacatgttcattgtgctggacgaagatcggcgcttcagcattaagctcgaggagaccttcgatgttcatacggtacacaacgacgacaatagtttttttcgtaattaagcatgacttcaactattttaacgtgtatttttcatcttttccaattcgactagcttatcccatgctatgcaagacgctatgtcttggagaggatgggttttgaagaccatgaaagttttgaaaccaagaaaattctcctaaggacccatcatggtgtggattttcaagtaaagttgtacaatgctgagagtgtaacccattttggttgcaaaaattgggaagcactttgcaagatgtatggttttgatgagggtatgccttatcaccattggtgatcttacaatcgagcaagagagacctacaatatgggcatttgggtccttgt

SEQ ID NO: 8918 - DNA, 783 bp, Triticum aestivum
  unsure (1)..(783): unsure at all n locations
  Clone ID: PAT_TA_8918
tcgagcggccgcccgggcaggtacttccattgaccnntaacaaagcagcgcagtgctaaaagaggggcagtgtcctcattcaagagagcctagtcatacagcatgctaaaagctaattctagatgtctgaaacagattgagtgctaaccgaagcaatggtcagtgaccaaaactaagatagcgtgctaacatctaattctattagtctgaaacagatcgagtgctaaccgaagcaatggtcagtgaccaaaaataagcacatacatctaaacagacgatataccctgcatcaggacaagaaaagctaatctgatcgctctgcaattgagtgctaacaactaattcttcgtcaactcagaatatgtccaggcctgcatgccaatcgcttctcacttgttctctgcaatttcaaccacatgcccaggtctcatgtccttgacaatcgcttctcacttagtgttctctctttcgttactgtgagtctctaagctgaacacgtgtagttctcccaagcatattgtaacatcccctgcatatccaacaccataacaagatcttcaataagcgtagatatgaaagttggaaatctgtatgaagcaatatactccagttcctcaaggttagagatgttttngttttttatcaccctgattggcatccccgccatgctgctggaagttccataagaacctaaaaaggtcacacgaattgggagcataactggtcagagtgttattggggtcgttgtacttgaatagcaacaccttgntaagtaacgagttc

SEQ ID NO: 8919 - DNA, 641 bp, Triticum aestivum
  Clone ID: PAT_TA_8919
tcgacccacgcgtccggcacggaaaagctttggatacttaaagaagttggaccaatgctctatgaaatagtgcagtgtaactctgatggcgaggaaatatcttcatatgcgctacaagaagacgctatcagtgagcaaatgttccaaagttctgagagtgcattggacgatttggtttggactgctgattcagtattctcatctatgaaggagcatagtttcagttttatctcatccatgtttctgcggaggctgctgcaaccaggagtgaaccactgttctgctctccgcgaaaccttattggagtacaaaaggtcgtccgccgattctgagtttcagtcgcttacaactagtgggctacggaaagaaatattatccattatagaacaagagggaagttcacaggtcgcaagttctactgtttatcactggaaaaagttttctgcacggtatctccacaactggtgctggaataataggccatatgggttgcttcttgatacgaacagtgaagtgtttggtttaattagaaagggttcattttctctcttccgttgtttggagggtgtggagcaacttatttatggttcctctgatgacttgggaaatttcattggcctttgggatgaactcaatcggat

SEQ ID NO: 8920 - DNA, 1024 bp, Triticum aestivum
  Clone ID: PAT_TA_8920
cgtccgtccacgcgtccggcccattttaaaaccttcccttcccctcccttcccgtttcgatcccccgtgtgcgaccccccattcgcctccgttccccgcacccacaagccgacgcgacgcgacgagccccggacccccgcaaaccctagccgtcgccgcgccccgcccgtcccctcgccgcgcgcgcctcgcgagagggcgcgccgtcccctagccgaggcccgcccccgctagggttttcgccggccatggacgaactgcggcgggagcagcaccgcatcgccggccacccctacgccttcgaggtggggtcctacttcctcgccggctactacagcgtcctggccagcaccccggagctggcgcggcagttctacaccaacggcagcaccgtggtgagggtcgactgccagaccatggagtcccagttcggggagacggccgaggaaatcaatgacatattgatgtccatgaatgttcaaaaggtcgagattaaaacggctaatttcttggaatcatgggctggagccatcactctgttggttactggcctagtgcaattgaaaggctaccctttacgcaagagattctcccagagtatcattcttgctcctcaggtcaaaccagatggattttttgtagacagcgacatctttcagctcatctgtgatgagtatgatgatcattaccaagttgctgattacggttatgctaaccaatttccccagatggctgctcataataccatgaccgaaacagcatctgattatgtggctgaagaacttgaattaaaggggtttgcagctcctgctgataccgacgaaagggctaatggtattatatatgagaatcatgaaatgcagcagcaagatcctttggaatttgagtctgcagtcaacggagaaactcattttgaagatcctgctccctccctccctagttcgacagatgttaaacaggatgcatctcttgctcctccccaccctccttccccacctacacctgaagaagagcctgtaggaga

SEQ ID NO: 8921 - DNA, 615 bp, Triticum aestivum
  unsure (1)..(615): unsure at all n locations
  Clone ID: PAT_TA_8921
ttttttttttttgcgatgatgattcatatntagtcccggcttacaaggtacgtatacagcaaccctgctgtcagcactagtactactattattacccccaaattaaacaaggggcccacagaaagacaaccaaccactatgccacgctccgcagccgcagccgcagctatggagcgccttcgatatagatatagtcatacgggcaaggctcaggggtcagggagctcgacagtctccctcaaaacgctacagcaggtcatacgggtggaaggaacatggcccaagtcaaaagacgacgccgcaggtcaggttctcaggtgacgggcgcaaagtcaagcagcgagaggatactctcatggcgccagggttggcatggcctcagctgattgcttctggagctgctcctgtttaacctcaggcgtgccatcagctggttgcttatggtgatcctgagcctctagctgtccagcttcagcttcagacgcctccattttcgcagctttgtcttcggcttcaggcatgtcctgacctgactcttcttggggcttctccgcttctgcaggtgcagacatgtactgagctgactctttctgatgcatttctgcaggctcatct

SEQ ID NO: 8922 - DNA, 1341 bp, Triticum aestivum
  Clone ID: PAT_TA_8922
gtctcgagtttttttttttttttttttgaaacgtaagatccacagatattgtgtcagtgcacttcgcaactattcaattttcctaccattcacaccacctgaatagcacgtgttacagtttcatcacgaaaacaagaaaacaaacaaaaacaggttgcacagcattacaagaaacgaacagatctcaagatgtcgaagtcggtttgaacaacgacgaagcaaatcacaggacatgcattcttgactatgtcctcaataagtcgtgcataaaatgcacataaaaatggggtcacgtctcagtcctcctcctcatctccgggggtgcgcgtgtggttttgttgctgcccccgctcccgcccagcgactgccgccgctggcgctgcttgggctggggtttgtgcactttgcacctattcaattctcctaccatgcacacccctgaatagcatgtattacagtttcgtcactaaaaccagaaaacaaacaaaaagttgcacaggattacatgaaatgaacagatctcaagatgtcgaagtcggtttgaacaacgacgaagcaaatcaccggacatgcattcttgaccatgtcctgcaacaagtcgtgcatacaaatgcacataaaaatggggtcagtctcagtcatcatcctcatcttcttggttgtgcgagtggtttattttttgagcacgatacatgtcagcaacttgctcagctgtggttgcatgttctgggtttttatcatcacgcacccgcaacaaacgaggaaatcttagagagatgcccttatttggatcaactatcccattagcagcgcgatgaactggacttatgctcaaatcagcagctttgacctcccacacctctgacggctcaaaccacacatctgggtcagttgtgtcagcgaacctataatatgcctttgggttctttattactttacttcgaaggctcgtagaacgttcttcaagttgttgctcagaaaatccagtacctatattgcagattgtttggtattcttcattatgctcatcatagcatgccaagaggaacgacccatatacacctgttcgttttcctcttccatgaaaagcagcaattggcactaagtctaaagagtctccaacactgtccatgtaatctttcttcaatttcaaccaattgtttgaccgcttcgccggctcatatgtagcatccgtatccaatgtcttgataatcaacccttcacaactggagttgacagataagtcaagaaatttttgtatctcctcgaggtcatttgatgtaattgcagttgccagttgaaaaacacctggcacttcctcgaaagagtcctcgtgccgaa

SEQ ID NO: 8923 - DNA, 1104 bp, Triticum aestivum
  unsure (1)..(1104): unsure at all n locations
  Clone ID: PAT_TA_8923
tgtcgaccgttnaaaattaacctgtacacaagtaaactctcaaattctcaaaacccatggcacgtgaattacaggaaaggaactggatgtctcaaacgtcacaaggaagtaaactaaatagcactgaaatgatgacccatgctacaggatggtagtatcaaaaatgaagttataactgatgactaaacaaaatgaaaggaagatggcacttctctatgggactaccagatagattcatcgcggcccaccgccttttcctctcctagcctttactcttacagtatatggagtctcagcagcaatttcgccggtcttctgagtaccatcattcacagactgctcgttcggggtctgactggtctctgtgggaacacttgttcggggaacattgctggtctctgtgggcgaacttgctctgggagcagtgctggtttctgtggatgcacttgctctgggaacatatcttgttttctgggatttgcttgcactaatctgcctccttaggcgcaacatctcacccttcgctaaggccagttcctcttcgaggtgcctagacctcatttcaaaagtctcccgttctgtctgaagccttgtgataagattctgagcatcctcgcagttctcttgagcctcggttgtcagttttgtttgttcatcgagagcttttgatagcatttctttctctgcttcaagagtggcattcttggaatgagtgctctctagcgcctcagaaagtgacactgcgctcgtgttcatctcgtttagtgatctggttgcttcatccaggtctgcttcgagtacttttcgtgcttgagaatctgcctcctgccgtttggccaaagcctcaagctccctattcaaagtggtcacgattctcctttcatcaacaagctcctgtgtggtggactcgaacttcttgtacacatccagcaattctttcttcaggttgtcacgagcctccacggcagaagcaagctcattagaggtagcttcaagttcttcctgacccttttgaatcatctctttagctgagaccagttcatctgatagagctttagatactgattcagcctctccaagcttgtaagtcagaccttctcgcct

SEQ ID NO: 8924 - DNA, 1176 bp, Triticum aestivum
  unsure (1)..(1176): unsure at all n locations
  Clone ID: PAT_TA_8924
ggaaaaacacaatgtagtctcttgttccaccaaggaaaagggcctctcgtgcaaagtaacagccggtctttttcttggttgtgttctttgtgttgtatgacacaaaccaaagagagagttgtgtgagatagagcaagaagaagagtggcgctgcgagaagaggcggcgccaacaattggcatcagagccttgttgatccgtggcggcgacgacagtgccggcggctgtggccggcgtggcggtgggcggaggcaatggctgcgacggcggtgacgcagtggactccatgtgaggtggaggacaccggcgcaaggtgatggccggcggcagtgcaatgccgccggtgggacgctgcggtgtgatgccgtgaggtgatgatggtgtggtgatcggcgccgcgatggcgctgtccaagtcaagaggaggatagccacgtgcggcaagttggccgtggtggcgggcngttgtgatggcgtcggcgatggcaagatggttagtggtgattggcactgcgacatcgtcngtccatgccaaagatggtgcgggtgatccacatcgacgattggcgagttaggatggcaagattagggagggcaaagcttcacttgtgcgcacgaaggaggcgagatgccgcggggccgtgtgatgcggcgagagcgacgagatgccgacggtgccgtgtgaaatggcgatgccatgagaagtggcatggcgtgacagtgttggagcatcacaagctatacgtcgagccggttgagccggatagtccgatagtcataggtgcatgtagtttgcttgggctaattagtggccgggtcgctagagtgattctaggagaggaagaccaggttagccgttggtaccaaggttagtgcatgagttagttagtgcatgtgcaagtgttggccgagtcaagtgtgatggccggtgtgagtgcatgcgtgcatggaggtagtgggcatgagtagtgcctagagacttggagttagtggccagatgtggctgccgagtggtgcgtgatggttagctccccagtgtatatataagttcagccaatgaatgagaaaataaaggccatgagggctaaggaaaatatgtagcctgtgtgttcgccaaggagaagagcctatggcaaagcatttgtgctcaaaaaaaaaaaaaaaaaaaaaaaaaaaa

SEQ ID NO: 8925 - DNA, 822 bp, Triticum aestivum
  unsure (1)..(822): unsure at all n locations
  Clone ID: PAT_TA_8925
attcatcaaaatatattgttgtgtgatgatgatatatgttcagtctagagacacgttatttttcttgctttgtagatcgatgtgaactagtacccttgtgtgtttctgttgtcactagttaaattgatcacctatgtactacttgttgtagaaacttgttacattagtccttgtgctagctatgcacctgtgataaatatgtgtgtgatgtgaaacatttctgttctgtcctataatattgtttcctccctcttttgcttgtcattatgctatatgtgttcatgtcctaatgtttccctttatgttagtttctaatttctcatgcctaataaaaataccaaaagacagcaagtaagatctgatcctccctttgctattttgccttttctttgtggatcatctttgggagcaaccttgtttagtttaggtttattttcttgcagccataatctcaattgtgttacctagatttagctgagcatagtcgccgtcgcctagtccctgcggggaacacgacactcgcgatttgggcgaaatatcccaccacatttacaaacgatcagcgaggctcatcgtcgtccttgctaggcggccctttccccttgtgctcggtgtttagcttaccgacctgtttgaagacccaacaatttttgctggtatgattggcaggcttgtcaggggtgccatggatctggcaaggccgatcgagtattctgtccaaactggatgaaccatctttgtttcctttgaatggcttctttcgttgaccgggtttagagccacnaatccagcgtgaccgccgtatcttcggtatcttcattg

SEQ ID NO: 8926 - DNA, 668 bp, Triticum aestivum
  unsure (1)..(668): unsure at all n locations
  Clone ID: PAT_TA_8926
gttgattgggctggagccaacgttaaccatctccatattgccaaggtgtataaccgtggcgttggctctgagcatagtgtctttctttgaaggtgcaaacacttctctgacggctgccgtggttgttctgacgggcctgatcggcgccaactttgtgcaagcggccatggataagcttggcctcaacgaccccatagctagagggatcggaacagcttccagtgctcatgggctgggaaccgcggcgctgtcggccaaggagcctgaggcgctccctttctgcgcgatcgcctacgcgctcaccggcattttcggctcactgatctgctcctccccggcagtcaggcaaagcctggtgttcatagccggctgacacacatatatactggtatacagcaacaacagcagcttgtgatgagtttttctttcctttttataaaaaaatggtaagtgattggagaacaaaagtgcaaaatttcccgccaaaaaaaggtcaacatgtaaaaatggatggttgcaacaagtcaaggtgtgagtagtactcccttgcttgtatagctgcaaaatgttcagtgattgcttttcttcatgtgatgttttccaaaaaaaaaaaagtaataacctaatgcttgatgcaacaatgggatcctacaatggttggttggnac

SEQ ID NO: 8927 - DNA, 640 bp, Triticum aestivum
  Clone ID: PAT_TA_8927
gcctcacctggtatctgctctctcctcgagagctcgggaccgtttccatatatagagcggctagcgcctagccagccgcgctccggcccgaggcgctgccagcgccctggcgctctcggccgggccgccctgccccctccccgcggcggccctggcgctgcccgtcgccctggcgcagggcgccacccggcactaccagttcgatgtgccgaccgcgaacgtgacgcggctgtgcggcaccaagagcatcgtgacggtgaacgggcagttcccgggccccgcgctctccgcgagggagggcgaccgcgtcctcgtccgcgtcgccaaccacgccccgcacaacatgtccatccactggcacggcgtccggcagctgcgcaccggctgggcggacgggccggcgtacgtcacgcagtgcccggtccagcccggccagacctacgtgtacaagttcaccatcaccgcgcagcgcggcacgctgtggtggcacgcgcacatctcctggctccgcaccaccgtctacggtcccatcgtcatcctccccaagctcggcgtcccctaccccttcgccgccccctacaaggaggtgcccatcatgttcggcgaatggtggaaggcggacacggaggcggtgatcagc

SEQ ID NO: 8928 - DNA, 707 bp, Triticum aestivum
  Clone ID: PAT_TA_8928
gctcctcttcctctctcgatctcctctgcctcgcacgccgccaccgctcgccctcgcgccgccgcctccgttcgcccccccccgccgcgcacaccgccaccgctcgccctcgcgccgccgccgtctccgttgcccaacctgctggatccccaccatccacttctccggcgtcgtcgcctcgtcatcgcgtgcacgcggcaggaggagcgagggagacgtggagccgccgctaggaacgccaccgtcgtcctcgcgtgcacacggcaggaggagcgggggaggcgtggagccgctgctgggaacgccggatgcgattatctgcaggtcggtcagccctgccagcctcatgtacctagcacgagatgaaagagggatttagagaagggagggagcaggaggagaagaggaagaagaaccctaccacccccatgcccgcccagtgcttcgtgcggctctgcaccccaaccattccacctccatgcccctccaatttctctatcccttttttgcagaatagggattgagaattggtcaatatactgaacggatacattcactggaaaggaggggctgctgatgttgtgggcttgattgccttttaattgttgatcccaaaatcctgccccgacacgagccaccgccgttcgtccggagaagcgcgggaagaagaagatggatgtgttgagaccttgatgggatggagagac

SEQ ID NO: 8929 - DNA, 733 bp, Triticum aestivum
  Clone ID: PAT_TA_8929
gcggtgcctcgcccttcctataaacaccgagccgccgccggctgcctcgcccaaaccctccccaaaaccctagctgattcggggaactagggttcctccccgcctccaccgccgccgccgccaagttcccgccgagctcagaaaatacatactatgggtaagtcgagcaagaagtctgctgttgcggttgcacctgccgctgggctggtcccagatggaaaatctggaaagaaaggcaagaggaatgcggaagatgacatcgagaaggctgccagtgccaagaagcagaaaactgcacctgagaaggccgtgcctgtgaagtatgatcttaaagtcaagaagctccctccaaagaaggtcgagtgcagcagttctgatgaggattcttcagaatccgaggacgaggtgatggttcaaccaaagaaggctgcaccgtctgctaaacaggagtccagctctgatagcagcgatgagagcagttctgatgacgaacctgcaaaaaagcctgctgctgctccaaagaaacctgctgcacttgctagcaatggttcaaagaaagtcaagtctgacagcagcagctctgacagcagctccgatgaggatgtgatggtcccacccaagaaggctgcacaatctgctaaacaggagtccagctctgatggtagtgacgagagcagctccgatgatgaacctgcaaagaaacctgctgccgcttcaaagaaaacctgctgca

SEQ ID NO: 8930 - DNA, 689 bp, Triticum aestivum
  unsure (1)..(689): unsure at all n locations
  Clone ID: PAT_TA_8930
gcatggnaaccactccaatggcaagcaaactgaacttgctttcatacagatagcagataattggcaggaaactagtacacttttggccgcattagagaggattgaatcttggatattttctcggattgtcgagacagtgtggtggcaggcattaactcctcatatgcaaaccccggcagaaggttcgtctaccccaaaagctcggaaagtgttaggcccttccttgggtgatcagcagcaaggcaccttctccgttaacttgtggaaggctgcatttcacgatgcatacagcagactctgccctcttcgtgctggtgggcatgagtgtggctgcttgccagtattggcaaaactggtgatggagcaatgtgtggcccgtattagatgttgcaagtgtttaatgccattcttcgtgaatcagctagtgagataccaactgaccctatatctgacccaatcgttgacccgaaagtcctcccgatcccagctggtgagctaagctttgggtcaggagcgcagctgaaaaattctattggaaattggtcgagatggttgacggataacttgggcattgatgctgatgaccctgaggatgaaggtttcgtcataggacatgggaatgatgaacgaattggtgcagctgaagcaaagtcttttaagctgcttactgaactgagcgatctcctgat

SEQ ID NO: 8931 - DNA, 739 bp, Triticum aestivum
  Clone ID: PAT_TA_8931
gcccccgatggcgcggaagagtttacgctctgcagcactcaagatgaaacaagtagttcaaataaactgtcgctgtttcatcttgggcgacagaaggaagcagagtgtgataaagatctgccaactttgcaactaaggcagcacgaggaatctgaatacggagggccttcattggaagcaccagatttggagatgaacaatggtgtatcgttcaaggccgcatctgtctcgacagttccagcgttctacccttcattgctccctgttccactaacactttggcctgcgaacgtttctaatgtggaagcagcaaatgcaagccatgaagtcctaaagcccactcctgtgaatttaaaggaggcaattaaggcggatgaggttgtcagtatgtccaagctcagcattggtgggggtacctctggctcaatggagccttccgctctttcccttcagcttaccgggccgacaaatacaaggcaatcagcttttcatgtgagcccaccaatgactagaactgaccttagtcagggaaacaacagcccaatccatgcagtttgaagagtcatggaatgggccttcctggtcaagtcttacagattgtattaatggtcctgatactctataatgttgcgtaagctcctgcgcttgtacttttgtaccgtaacagcttctaagctaatgtatcaccatcttatttattttttcattaataaaggtagtgtcacacaaaaaaaaaaaa

SEQ ID NO: 8932 - DNA, 1359 bp, Triticum aestivum
  Clone ID: PAT_TA_8932
ggtttctacacatccaagatctggagtttagccttgctccaagcaaagccatagcctccaaaaacaaatggtgcatatgaatcaagggcaaggggagacaagctatgctcgtaactccaggattcagaatgctcaacaaaacaggatgaagcccctgatagaagggtccatctttgagttatgcagcaacaacaccttgttccctggaaagatactgatcgcagacttgggctgctcctctggcccaaatgcgcttgcactggtatcgattgccgtcgaggccatccacagctattgccttcagtttgagcagacactaccggaagtgtgcgtgctactcaatgacctgcctgacaacgatttcaacacagtggtgaagagcctggtcacactccgtcaaagcaagaagcccaatgttttgactggtgtcacgccggggtcattttacgagaggctcttcactagtggctcaatgcatcttatctgctcatccaacagcctgcattggctctcaaaggctcctgaacatctcacaaggaaccagatcccggcgtatgacatggatgagcatgctaggtgtgaaagcctccctattgtcctcgaggcttatgcacaacagtttatggaagatttcacacttttcctgaagctaagagccaaggaattggttccaggaggccgaatggttgtttcccttgtagggaggcattctgatgtgaccgcctccaaattctctcacctctgggaaactgtagctcagattctaagtgtcatggcctcagagggtgtgatagacaaagccaagtatgattctttctacgtgccgatgtatggagcatccagtgaagagttgatggagatcatccaagaagaaggctccttctcaatcacggacatgcgggtatatgaccccgcaactgatatgaacaatgcactctttacatcaagttggttcataaatcatctgagagccatatttgagcctataatagtcgagcatttcggagacgtcatgaatgaatttgtgagaactgcggagcagcgctggaccctcgagggcagcgtgcaagacgagcgtgccaaatacccgcgagctatgcaggtcgtatcgcttgcgaaggcatgatgatcaggtacaccccatttgatgcgactgtcttattgctttctttgaggctacaacgcgtgcccacttgataacttgaactacatccaatgacgcgacgcgactgtacaatttctttcttgggggcaacaatgtctgcccacttcgttatgtaaactgcatgctgtcatgtgccagctatttcattatgaatctctgtgtttagtgtgatatgtactcccagcgttcacaaa

SEQ ID NO: 8933 - DNA, 777 bp, Triticum aestivum
  unsure (1)..(777): unsure at all n locations
  Clone ID: PAT_TA_8933
gcatctccatctcttcccgtgtggtccgtcaaccatgcttgtgcagctcgcagacgctcgtcgtttggttcagggctcatgcgtgtgcagtcatgcgagggccatctcttcccttgctcgtaaggttcttttgattctgttctgctaattgagattttgttttttcggttggttttgctggtgacaggggttctggaggtaccttctgaagaagaaccttgatgcccggtggctgcaagggttcccttgcgccgtgtttgcgatcggcgattcaggctaccaggggttgctacaaagaagctccgtacaaggctttcacagcttggtgcaaaatcgatcagtgattggattgggagatgaccaagactcttcaggatatgaaaaagctctaggtccttggctgctgtctttctggaaatcactgaatcgaacaaatccgtcgcttttaccaagaattcaggctcgtccgcgggcactcagacaagcgtccaagcactcctatgagtgtccgtgcacatcagcgcctctaccacaaacattcagaaaaaagaggattcccctagtgtggaaaatggatagctctagaatctactcctcacaatggttatatgctgctttcaacttctctgtgtagtgagttgtattttgtgtgtggatgattgtaacttggagacagaagaaaagaaagggatgcaattttgtcacactgcatcgtgggtttttactcagtttgtaatttctttcattgtaaatgcagtgcgnctngnaaccgaagaa

SEQ ID NO: 8934 - DNA, 158 bp, Triticum aestivum
  Clone ID: PAT_TA_8934
tgcgcgtgaacctgcgcggcacgttggcagggatcaagcacgccacgcgcgtcatggcgccggcgggctccggctccatcctctgcatgggcagcatcagtggtatcatggggtgcctcggctcgtacccctactcgctttccaagctcgccattgcc

SEQ ID NO: 8935 - DNA, 887 bp, Triticum aestivum
  Clone ID: PAT_TA_8935
gctcctctcctctctctccctcccccacagctcgctcgtcatccccgccactcctgcagcttcttctcctcccccagactgcgtctgcgtcctccgatccatcggaacagaagcagggccgtcatccggatccctgccaggagctcgcggccgagcaatccgaggagaatccaactagaaccagaaccaggaaaatttggaacgcaaggtactacaaagccagttgtagacccggctggagagaactcaggggtccatccacatccatctcgactcgaagcaaccaggggaacacgaaagccagttgaaagatcacaagcatggacaggacaggaaatgtggtattggatattgagagcctgcctcaacaacccgataaatgctgcactggaagtccaaagatgactagagccctgtcgcgtaagggtccaaaccgcatggagaggaggggcggtgaagagcaggagccagatgacttggcaaaaaaagttatcattaaagttgttccatctcagttggagcagatcaagttgccgctagtgcacaacaaaactttggtcactccacattgcactgccaccgcacctgttctgactgactctgttgaaggaaggtccaagagatttaatcgactcacggcgtttcatccgcgcagaattcttctcttctttgcaactttgtcgagcgtggggacgatggtgctgatatacttcaccctcggcatcaccggcaaggtggaagcatagtctttctttacattggcggcgtggcggtacattccatagctaggaccagctttctttcttttcagtttttgctttgttttggggagatgaaggactactgtagcattatagcgatgcaacagcaaggagacggacaccaac

SEQ ID NO: 8936 - DNA, 413 bp, Triticum aestivum
  Clone ID: PAT_TA_8936
cgtccgctcctccttcgggctctcagccgccgtatctttctcccgctcccgcaccaacctcgccgtcaccgccgtctcggctcctctcacatcagttcttgatgtctactgtggaagaggggacagaaagacaaagagaggcaaaaggttcagccactcatatgggaatgtgagtcctctagcacaatctcaaactgatgtgtttgttgtgattcttatctctctgtatcgtcatgttaggcacggccccgtaacaagaacaagggaacaggcccagcacggctttacgcccctccagcgcctcctaagaaggatcagtttgaggacggggagatcatcgcaattgagattgatgatgacatcatggaaaggatggattaggatgtctggattttcccttatttcatgatttc

SEQ ID NO: 8937 - DNA, 733 bp, Triticum aestivum
  Clone ID: PAT_TA_8937
cccatcgaacacacactccccactccacaccccactagcgctccactccctgctccctccaatggcgttccccgccccccaggccacgcccatgtccacggccgccttcccctccccaccaccgcgctctcgtaccctctttctctctcgcgctctcacccaccgcttcgctctcccgctcccgcaccacccacgccgccactgctgtctcggctcctctcacatcagttcttaatgtcaactggtggaagaggggacagaaagacaaagagaggcaaaaggcccagccactcatataggaaatgcacgacccccgtaattagaagaagggaacaccgcccagcacggctttacgccccgtcccgcgcatcctagggaatggaacagtttgaagacgggggaagatcatcgcaattgatgattgatgatgacatcatggaaaggcattcggattaggatgtctgaattttcccttatttcacgatttccctgtcctttgtgaaatacaattccctgggagtaattattttgtcattatcctatgcgaagtgcaatttcttagaagtaattatttggtctttctcgacgaaacacagatgcctatgtaccttcgattgcttgggctgtatgcatatagggaaactggcacctatgttgtctaaaataaataagatattttctcgccatctcagtattattacgtgtgactcctgaattaagttgtagttatttc

SEQ ID NO: 8938 - DNA, 616 bp, Triticum aestivum
  unsure (1)..(616): unsure at all n locations
  Clone ID: PAT_TA_8938
cggagcagggattgcaagaagaatatatacccgattccctccgtcccgagctcaaatcttgtttccctccgtcatctgcttgatcgcctcgcctccctcgtttctccgtcccgcgcgactcggccagggggatccggcgcggagaggaatggcatcgccgatgtccggagacgcacgcacgccgccccggggcgcggcgccttacgctctgtaccagttcggcaccagcggcgccgccgtcgccgtcgccaccgccgtcacgcatccgctcgacgttatcaaaattagactccaaatgcagcttgctgggcaaagaggaaacttagttggaatgggggcaatatttacacaaatggtagaaagggaagggcctcgatcactctatctgggatttgcaccagcattgactagatccctcatctatggtggccttcgattaggattgtatgagccctgcaaacatgtctgcagctacgcatttggttcaacaaactttgcttttaaatttgcatccggagtagttgctggtgccctagcaactgcattgacaaatccgatggaggttttaaaggtgnnnncacagatgagtacaagcagaactagtacaattggagtn

SEQ ID NO: 8939 - DNA, 1115 bp, Triticum aestivum
  unsure (1)..(1115): unsure at all n locations
  Clone ID: PAT_TA_8939
gctacacccagcgggcgagccggcgtgcctcgctgggaagatgctacgctggttgcaggcccgacgccggccgcaaatgacgtttccgacgccgtcgtccgcttcatcaacaacaagaccctccgcgcaacttttccaagttgcccagaggctcggaggctacacccagtgggtgcgcttgcgtgcccccactcagtcggcggactccgtgtccgcgcccggcacccttgacgtcatcatcagcttcttcaacaacaacaagaccctccgtccaacttttcccagttgctcggaggctcggaggctacacccagtgagtgcgctcgcgtgcccccaccggaagcaagctgcgccggctgtggttcgtggccggctgtcttcaacaacatcgtctacatcaacatcagcacaaaccctccgccgaacttttcaagttggccggaggctcagaggctactgtcgggggggatgacccccgggtagtcccaagacggcgagccggacggggtgcccgcctgtccggtcggctgctccgactcgcgcccacggccggcttctccagcaagccggttgcccgaagttaactacggcgtcccatcggacacgcgcggtcgtgacggtcgtaccctagtcactattgctgcataggcggacactgttcatccgtcatcgtcatcatctacagtacatcatcatcatctacagtggtgcactattcatccattaccactgtcatccacagtgcatctagtccctgggcgtctgttgataaagaccccagggactcctctcgcatcatcatgctcgcggacgttcgttcccgcctctctcatccaggacgctgacgacccggccctacaaccatgtaacattactattgtaccactgggggttgacctataaaaccaccaggagccctcatgcatataggaaagcagcacgacaagaacgataacattgacacaacgaactagactagccacatcgagagggggagcagcctaagccttggctcgcccttcttcctcctccatatagctctaggagcaaccctgtactgnaacgtattaaccacactcggcaggactaggggtgttagcncnccggagagcccc

SEQ ID NO: 8940 - DNA, 257 bp, Triticum aestivum
  Clone ID: PAT_TA_8940
gaagctcatccacgacgcctgcggcgaagaccaggcggcggtctggggcgtcgccacctgatctgtggagtagtggtgggagtagcgcatcggccggccgggcgtgctgtttaatgttggggctggctaggaatcagtcgactgagactcggctgacgtcagcgtatattttttatggcgcagcacttgttttcagccaggttttgttactttttctagaggaactaagccagattttgctctacgcaaaaaaaaaa

SEQ ID NO: 8941 - DNA, 423 bp, Triticum aestivum
  Clone ID: PAT_TA_8941
gggcaggcggaacaactgggtgtttgcatactactactactggcgtgctaacaacatgcgtcgaaacgacaagactgtatactaggagactgaagaagccagagcagttggccacctccctgcctctacatgttaattgcctttcttggcgtcctgatgccatttgtacagaagtaatctcaagtaaaagccaaccaatattttgcacaggagaaacagttgagccaaattatttttaacagctacccgaggctgaagcggcggctgcaagtcaccatggaaactcgtacaaagagcatggtccctaattaaattagctctcccgacatgtataatttctcattcagatgtaccatgcccgtccagttgttcatattgaatccgtatatatacaacttgtctgcgttactgccaaaaaaaaaa

SEQ ID NO: 8942 - DNA, 871 bp, Triticum aestivum
  Clone ID: PAT_TA_8942
ggggggacgcgtccgcctctgtctctcgcacctcgctctctccccacgaacctctctgtctctcgcgaatcctctctcccccacgaacccctctccctcgccgccgccaccaccgacgccggccggttccggcgagctccggcggcgcgcagcacgaccccgagctcccctaggtccggtccaccttcccctccgtccagaatcggcgctcccgtcctccaccgaccccgtggctagctagggtttcgaccgccacccctaacatcgccgggatcagccagatccggcgacggcgaggccagagctcgacggatctgttacgggcgtggcgcaggtcaccttggtgcggtctggacggcggcgacggcaggagggcgccgtccttcctactcgaggaggcggaggacgaggggcgcacctagctggcggccctgtcctgctcgaggaggcgggggctgccgagctcaagcacggccacgacgacccacctcggcagagatgcaaggagggagggacgtccatggattggactggaaggattggatgcaaaccaatgcacatgaggaggagagatgcaagccaggccatgacctaaagatgtccttggagaagatggccattggagtgtaggggagaaacaaccttgtcctgctcgaggaggaggaggaggaccacccgagctcgacgacgatacggcaacagccttgtctccccccccaccgcccctcggcctcctataatgttgttgtggattcttagaatggaaatgttatgtacataaaaaatatactatgttctgtggttgcaaatccatggctgttgaatcatgtttgtataagcatttgtaaatagctagccttgttggttaatc

SEQ ID NO: 8943 - DNA, 1148 bp, Triticum aestivum
  Clone ID: PAT_TA_8943
caagaactttcagcattgctggaaattcaatgatctgtggtgtcaagtctggagacaattgctcatccgtgtcgctggacccgctttcttatccaccagatgaccttaagattcagccacaacaatccatgtcaagaagtcaccgtattgctatcatctgtggagcaaccgtgggttctgtagcgtttgtcgctatcatggtcggtatgcttctttggtggaggcacaggcgtaatcagcagatattttttgatgtaaatgatcaatatgacccagaagtatgcttgggccatctgaaaaagtacaccttcaaggagcttcgagcatctaccaacaatttcaactcaaaaaacatattaggtgaaggtggatatgggatagtatacaagggtttcttacgtgatggttcaattgtggctgttaaaagactgaaagactacaatgctgtcggtggggaagttcaatttcaaactgaagttgaagtcataagcttagctgttcatcggaatctcctacggctcattggattttgcactacagagtgtgagagattacttgtttatccttatatgccaaatggaagtgttgcttctcaattgcgtggcccttttcagcgccaccctcctccagggtgccctaggggcgcgttgctcccgccggctccggctcccgccctgcgctctgtgcacgatcagtgtgagccaagctgactccctcgcccggtcagggcctccgatccgcttctcgtccaccttggccacgcccttgtgggggcttctcggctggcagtgcttgtggttctccaggcgtcccaggtttcctcagccgcgcgtggtcccccggccccctgtgctcctgagttttggccctcccggccctccccggtgctgtctgtcgtcctgggtagcttcatccttctgccgtgccatcaaacaaaacctgactatgttgattgcttctattagatttttttgaggggtgcttctattggaagtacactacttgtgctgatagaagtagttccatcaaattaatttaaatcgtattcctgctccccgactacctgtatttacctaagtgtccatttacatttcacagtgcactatattttgggatatgaactgagctatccacaacatcacatgtct

SEQ ID NO: 8944 - DNA, 729 bp, Triticum aestivum
  Clone ID: PAT_TA_8944
gccggccggtccgggatcagcagcacagtccgcaatctccaatcgccacatctccccacttcccgaatccttttcccttcaagcgcagtagatcgccatggatgcctcagccaccgtagccgccggaaaggcgaagaagggcgcggccgggcgcaaggcgggtggccccaggaagaagtctgtgtcgcggtccgtcaaggccggactccagttccccgtgagccgcatcgggcgctacctgaagaagggccgctacgcccagcgcgtcggcaccggcgctcccgtctacctcgcggcagtcctcgagtacctcgccgccgagctgctggagctcgcggggaacgccgccaaggacaacaagaagagccgcatcaccccccgctacctgctgctcgccgtcaggaacgacgaggagctcggcaagctgctcgccggcgtcaccattgcgcacggcggcgtggtccccaagatcaacccggtgctgctccccaagaagacggctgagaagtcgaccaaggagcccaagtcgccgaagaagaccgccaagtcccctaagaaggcataggaggcgcgtcgctttgcttagattgttgtacgtagctgggatggatctgttgggtgtgcttcagaggagacgattgttgtacgatgctgtatcttctcacctgtgacttccatggaacgatgcgttgcataaacaattgtgttccctttgcctgcgcgccccta

SEQ ID NO: 8945 - DNA, 663 bp, Triticum aestivum
  unsure (1)..(663): unsure at all n locations
  Clone ID: PAT_TA_8945
cataaggggtcctgcaccaggatgtactttgcgggaatatatgacccggtcgaccagtcctggaggggcaaggagaatgagattgccctgtgctggtctgggccgacggtcgtcgttgatgggacgctctacatgctcgaccagtccctcggcacgaagctgatgatgtggctgaacgagaccaaggagtgggtaatggtcggcaggctgtcggacaagctcacgcgcccgccctgcgagcttgtggccatcggcaggaagatctatgtgatcggcaaggggctgagcacggtgaccatcgacatggacatggcggccagggtggacgggttcctggtctcctcgtcaaccgggccgctgatggagcacgacttctcgccggagaagtgcagtgtcatcaccatctgaagacggccattcgctgggttgcctgtgccgtgaactgaaataacagtggacgtttggtctttttcttgtggctgtatatcgacttctgtattttggtgggatggctgtacattgattgacttttgactgtaaacatgcgggaagaaaagttgagttgtatgtttgtatttgttgaatatgaataaattctgatcgtaacaggtttttgctctgtcctgttcacattnnnnnnnntttttttttnnnnnnnnnnnn

SEQ ID NO: 8946 - DNA, 1819 bp, Triticum aestivum
  Clone ID: PAT_TA_8946
ccaacccgcgcttcgccgtagccctgcccgcccgcccgccctccccccctccgccccccacgctgttccccgcccggccacaccgacgggctgacttcccccctacttctctcgccgcccctggcgcagccgcccactcccgcttctcgcacaagcaccccgtgaccactccacacctaggggcattcatcccgctgagggtcaaccttcacctccacattagcgtgtccaggaagaggctctgttttgcgtggcaatctgccccggtccagacgccctggcggccggcagcgcgtccgtctacccttcggctgacgcgtgcggcggccggcaaaccctagcccagcccagcccagcccagcccgcccacccggcaccacccccaccccctgcacggggccagatctaggtgttccccgcctccccagcctctcgcggtcggtagccccccgtcccaccccgagtcccgtcagatccgatgggcacgcacgcacccccacaaggatgaaccatcaccttgaaagtggtgattaccagaagctattctgtaggaagatggaatctgctgagctccatactccacttctacatggtcttccggacgagatcgctcttctttgcctggcaagggttcctcgccagtatcacaatgctcttagatgtgtctcgaggggatggaaggcattgttatgtagtgaagagtggcactcttaccgcaagaggaacaacttggatgagtcctggatatatgtgatctgtaggggtacaggcttcaaatgctatgttcttgttcctgaccctacgacccggtgcttgaaagtcatccaagtcatggaacctccatgctcagggcgggaaggcgtttccatagagaccttggacaggaggttatttctcatgggtggttgtagttggctaaaggatgctactgatgaagtgtattgttatgatgctgcttcaaatcactggagcaaagcagcaccaatgcctactgctaggtgcttctttgtaacagcagctctgaacaacaagatttatgttactggaggacttggactgacagacaaatcacctaattcttgggacatctacgacaaagccacggactcctggttctcgcataagaacccgatgctcactcctgacatcgtcaaatttgtcgcattggatgatgagctggtgaccatccacaaggcgtcctggaacaggatgtactttgcgggtatatacgacccggtcgaccagtcctggaggggcaaggagaatgagattgccctgtgctggtctggcccgacggtcgtcgttgacgggacgctctacatgctcgaccagtccctcggcaccaagctgatgatgtggattaacgagaccaaggagtgggtgatggtcggcaggctgtcggacaagcttacacgcccaccctgcgagcttgtggccatcggcaggaagatctatgtgatcggcaaggggctgagcacggtgaccatcgacatggacatggcagccagggtggacgggttcctggtctcctcgtcaaccgggccgctgatggagcatgacttctcgccggagaagtgcagtgtcatcaccatctgaagaccgccacctgctgggttgcttgtaccgtgaactgaaataactctggacgttttggcttttcttgtggctgtatatcgacttctgtattttggtgggatggctgtacatcgattgacttttaactgtaacatgagggaagaaaagcacagtttgtttattcctcggtgagtcgagtgtgaataaattctgattgtaaaactgaaaaaaaaaaaaaaaaaaa

SEQ ID NO: 8947 - DNA, 1222 bp, Triticum aestivum
  Clone ID: PAT_TA_8947
ccgggctgcaggaatcggcacgaggcgtgatttcaagtcaagcaacatactgctagagcatgatttcacaccaaaagtttcagactttggactggccaggactgcgaggggggaggggaaccagcacatctccacccgtgtaatgggaacattcggttatgttgcaccggagtacgccatgacaggccatcttcttgtcaagagtgatgtatacagctatggagtcgtattacttgaacttctcacaggtaggaagcctgtggacatgtctcagcctgcaggccaagaaagcctagtcgcatgggctcgcccatatctgacaaatgtggtgggcttgcgtcaagctgttgatccacttcttggccctaatgtgccactggacaacgtggcaaaagcagctgccatcgcatccatgtgtgtacagcctgaggttgcacaccgaccgagcatgagcgaagttgtgcaggccttgaagcttgtctgcagcgagggtgatgagggtcttggttcgggaagtttcagccaggaattggcggctcgtacgacagcggcttacgatgtaactggcatggaagcggagagggtgctattatctgagatgtttggttcaacgcctgtcttcactccagctgacgattcaggttctttccgcatgcagtccagctctggccccctgatgacaggcaagaacaagaagttctggcagaggatgcgaaacttgtcgagaggtagtatgagcgagcatggcgcctcgccagattttgagacacactcacagtgtagcaataggtgagtttttcgtcctctgtccagcttccagtctcgacatggatattcagatgactggacataaagagtttgaagacctagtttgtgtacattatgcatgtggagataaaaggctatatatagtttccggtcagcagagtagcagaccggatcatgggttatggatcaccggaggcttgaataagattggctcagatctggttcttcattgaacgggttctgccgtactgctatgtggccatacacagatacgcctgccttccgatttttaccgcttctgttttttcagcatgtcagtttgagttagtttgttttcccttttgtttggttagctgtttggtaggaattgtcaatgtatagatttggagtttcttggactgcatttggccatgtgaatttcagctccatgcacgtacactagcatttgctgcaa

SEQ ID NO: 8948 - DNA, 797 bp, Triticum aestivum
  Clone ID: PAT_TA_8948
cgccggtgtacaagggagacgcactgcgagttcctgacggagcaggtgacctgcatgcgcaacggccgccgcgacgactcgtatcagaagtggcggtggcagccgaccgactgcgacctcccccggttcgacgctcgtctgctgctggagccgccgcgcggcgtgcggcggcgcctcgggggggcggcccgcgtccggtgcccgggggagtcgagtggtgtgcctggtccagtcggcgatccccaagggccacaagaccctcaccaagttcgtcaacaacggatccagcaacgtcttctacgcccacgattacaacgcgacggtggagttctactgggcgcccttcctggtggagtccaactcggacaaccccaaggtgcacagcgtcccggaccgcgtcatacagtggcactccatcgccaagcacgccaagaactgggtcggcgtcgactacctcgtcttcaacacctacatctggtggctcagcgcgctcgacatgaaagtcctgaaaaaagggtcgttcgacgagggcgctaccgagtacgaggaggtggaccggcccgtggcgtacagcgaggtgctcaagacgtgggccaagtgggtcgaccgcaacattgaccccaacagcaccaccgtcttcttcatgggaatgtcacccaaccacatcacgccggaggcatggggcaaccagggcggcatcaagtgcgcaatggagacgcagccgatcgcgaaccggagcgcgacgctggacgtgggcacggactggcgcctctacgcgggcgcccaggacgtgctca

SEQ ID NO: 8949 - DNA, 781 bp, Triticum aestivum
  Clone ID: PAT_TA_8949
ggaaagattgatatcatttggttgcaatggtccaaggacaatcagggtgatcgcggcaccgaaactgacggtgttgggctatccgtcttgccgtttctacgaacttgtgatgggcctgggaaccataattgttaaggaaatgatccccatcagcttggctgtgtcggtgcgcacagtgaaggtcttggttctagaatctattggccccaatctggacgtagttgttggattccttagatgttttccctgcgtggagaagctatacatccagtcatgtcttaggaaggatatgaaaaatgtggggcaatatggcacgctcgatcctatcgaatgccttgaactcaatctcaaagcaatagtattgaacacctacgaaggcaagacaccagatgttgactttgccaagttctttgttctgaatgcaaaggtactcgaggtaatgaaatttggagtctatcgtaatagctgcaatcagaagtgggtggctaatcagcacatgcggctacaactggataacagagcttctagagatgcacgatttgattttgaacgagattatggtaattcccgtttttattataagaagcacatgcatgatatgtggatagctgatccctttgataggtcattatgcaaattctgtcggaaggtttgatgccctttcaagagaatatcaagggatagatgctctgtttgtgcgcgcgccgctttcgttccaaacattctaatgtctttttgtgtaatgatcctttgttgctaccgtctagcatatgtatgttag

SEQ ID NO: 8950 - DNA, 1263 bp, Triticum aestivum
  unsure (1)..(1263): unsure at all n locations
  Clone ID: PAT_TA_8950
gccggccggtttcggtctctcgtccgcatcaatggcggccaagactaaggcaccagctggtactccggtcggccccgtccctttcgcggacgtcgagaccgacccaggcttggtctccccagtgccggagcagctcccggaagagcacgccgccctgccgagcgcgtccgcgttcaacggccggatgaacatccgttgctaccagggcttctggctgccggattacttcgccgccgcggccgtcgccctgcagcgccgcttcgagccctgccgcaacgacgtaatcgtcgcaagctttcccaagtccggcaccacgtggcttaacgccctggcgttcgccaccatggcacggcgggcttatccggccgccgacgccgggcatccgctgctacgcctcaacccgcaccagtgcatccctttcctggagaacctcttccggagccgcgcggaggccgccaagctcgaggcgctgccgtccccgcgcctaatgaacacgcacatgccgctcggcatgataatgccgggcgccggcgggtgcaaggtcgtctacgtgtgcagggagcccaaggacatggtcgtctcgttgtggcacttcctccagcatgtgcatccagacctggcgctggccgacgtcctcgactccgtgtgcagcggcgcggtgccgtatggacccgtctgggacacatcctcggctactggcgcgccagcatcgcgaggccagacgccgtgctcttcttgcggtacgaggagctgctgcgcgacccgccgggaacgtcagggatctggcgcggttcgtcgggctgccgttctccgaacgaggaggaggacgccggcgtcgtccaggacatcgtcaagctctgcagcttcggtcacctcaagcccttggaagccaattcgacgggccagctggatcccctcgtcccggtgccgcgcgaggcgctgttcaggaagggcgtggccggcgactgggcgaaccacatgacgccggagatggcgcgacgcctcgacgaaatcgtcgccgacaagttccatgcgaccggcctcacttttcagtgattcgagacgactcccgtcccccatacactatcatgatttctcatgatcaagtaatgtttgtactttcgtaatcactaagcatgaataattagtggagtggttttaataattagctcgtgccccctccgtncctaaatgtaagtatctgtagagattccactaaatggactacatacgggcaaaatgaatgatcaaacttaaaaaaat

SEQ ID NO: 8951 - DNA, 580 bp, Triticum aestivum
  unsure (1)..(580): unsure at all n locations
  Clone ID: PAT_TA_8951
gcggccggcgtccggctccggtcgatccgctccgctgtctctccccgagaaaccctaaaccccgtaaccctcgccgccggtgatcgctggtcccctgcgtcggccgccatgttcgggacccccaactctccctccctcttcgggacgccctcttctgcgccctctttcggaactccctccactacccctgccttcggcaccccttcctccacgccggcatttggcgcgccctcgtccaccccggccttcggagtcccttcatccacccctgccttcggcgcaccctcctctacgccgtcgttttggacgcccacttcgagcccgacgtttggcacgccatcgtcgaccccggcgttcggagcgctgccgtcgtcatcgccgtcaccctttgggttccagcagcaggtgactccgtccccttcgccttttggtttcggcggcggggctggcggggcagattaccacccagatggccccagttgcgccgctgccgctctcgccctccgaccgcgacattcaggctatggtggatgcgtacaannnnnncccaggcaaccctcgctatgcttttnggcatctg

SEQ ID NO: 8952 - DNA, 1012 bp, Triticum aestivum
  unsure (1)..(1012): unsure at all n locations
  Clone ID: PAT_TA_8952
cgtccgcccacgcgtccggcaaaaccaaaaacaagattcagctcatcggtgagctcgcgtttcgctcttggattttcggtcgtggattcggcctctccaatccagatgggtggtacgattctcgcctaaaggatacttcttggggcgaagccctcgggggattgctggagttcccctgggtgttcggtggcagctagggtttgctcctccagagccccatcgtctctgcgggccttctacatttgtgtggttccaagatgcagccttccaagaaacttgctcgcgtcgacacggcggagatcaagtcgcagctagtcaggaagctcggccaccagcgctctgagctctacttccatagcctcaagaagttcctgagttttcagctaggcaagagcgagtttgacaagatctgcgtggccacactggggaaggagaacatcaagcttcacaatttcctcgtccagtcaatcctcggcaatgcttatatgtcgctggggccaccgcccagcaggcagacgccaactgggaattcacagactagcgctgtgacgaatgggacattggccagtggcgtgccgctagcaaggagagtgcggccggtggctaaccgtgacaagaggtttgctgataagccgagtccactcggaaagtcccctcttggacatccaggggccgcggagtttgtgtccgtcgaggatggcgaggaggttgatcaagccaggggcagccccgtatgtgtgcagagtcagagcccaatcagggctccgttgggaatccccccaaaggctcagaattctcagccttcgatatcttaccccttagagatttgctataataatggtgaattgccaggtagcgaggacctgtcaaagctacttgagaataagctgaaagccgaaggccttagcatatccgtagagatgtgctgatctgctgaaactctgggccgaacgtgtacataagtcagatgctgaagtctttgtttgggggttgcaaaacaaggggaaagant

SEQ ID NO: 8953 - DNA, 427 bp, Triticum aestivum
  Clone ID: PAT_TA_8953
gtcatggtctacggcgggctggcggcgctcgtcttctgcggctacatcatctacgacaccgacaacctcatcaagcgctactcctacgacgagtacgtctgggccgccgtcgcgctctacctcgacgtcatcaacctcttcctctccctgctcaccctcttcagggcatccgattcctgaagtgcctgcatctcctgccgtagcgtagcgtagccactcgtcgtatcctactccagtaatcctgcccctgccgttacataacgaatgtgatttgcttgtgtgtgaaacaatttattgtaaattagttttgacttgttttacataatttggtctatgtaactttgtagtctgccaatatcaagattgctgaatggaatgaaattcaggagctgctactgctagcttgggctctgttttaaaaaaaaaa

SEQ ID NO: 8954 - DNA, 1117 bp, Triticum aestivum
  unsure (1)..(1117): unsure at all n locations
  Clone ID: PAT_TA_8954
gcccgggccgaacccgccgagccgctgtggcacgaaccttcgccttagacgagctcgcggccttcgccttggacgagctcgcggcggcgaccaggaacttcagagacgactccagcgtcgttggtcgggaggcgaatctctacaaagcttatctcaagagcatcaacaagatcgttaatattaagctgcagcatgccgttcgtactagtggaccatcggagcaactcaacagggagtttctcgcccatgtcctgacgctgagcgccctgcgccacccgaatgtcgtcaacctcattggcttctgcgcggacggcgaatacaaaatcttggttcacgagcacgtcccattgggttctctcgaagatcacctccatccccgtgatcggtctccagcaggcaaagcaccgttggactggaacacaaggatgaacatagctgcccgtgtggccaaaggtttagagtatctgcaccacaaaggtgtggtgtaccgtaaatccatgggtagctcggacatcttgctcggagatggctaccacccaaagctgtcccagtatggactggcagaccttggacggttgcttgcagaggataacaaagactggagtactgaattctggggaagcactaccattgcccctgagacattcgttaccgggaaggtgaccatggagtcgaacgtgtacagcttcggcggactactgctggagatgatcacggggcggaggcccattgaccccgcccagcccgccgccgaggatcggaaccttatcgcatgggccacacgactgatgaaggacaggagccaattccgaaggatggcagacccggcgctgcagggccggtacccgtccatggatttggaggaggccctgacagttgcttccatgtgcgtccaccaacagccggccatgagatcgcccatcggcaccgtcgtcacggctctgtctcgcctcgcatacgatgtcgatccacccgaatcatcacaccctgcagcacctagttaacctagtagagaaacgatcatgcacccgacatcttcagatgcatcggtcatcatcaagttatattagttccttgcttgctgtgatatgtgactgttgcttgttgngaataagaa

SEQ ID NO: 8955 - DNA, 546 bp, Triticum aestivum
  unsure (1)..(546): unsure at all n locations
  Clone ID: PAT_TA_8955
gcacgtggccaaggnagttgatgctgccagcctatctgttcttcacgaccagtgcatgtgggctcttggcatatctcaactttgatcagcttgtcaagagaggctacgtgccctccaaagttggggactccttcacgggcggttacctcgacacccctgtgggctggataaccggaatgatcagcaacggccgccatccgcgacctcccaacgttcacccgcacgaccgacaccaacgatgtcatggtgaccatcaacatcaagcagtgcgagctggacgctcccgccgctgacggcatcctcctcaacaccttcgatgacctagagcacacgtcgctggccgccatccgcgagcgtctacccaacaccatcaccatcggaccactcatctcgctgccgtcctaccttccatccctcacctcgagtctgtggaaagaggacaatgtatgcacttcttggctggacaagcaaccggatggctctgtggtgtacgtcaacttcgggagcatcacagtcatgtcgacggagcagatggtggagtttgca

SEQ ID NO: 8956 - DNA, 603 bp, Triticum aestivum
  Clone ID: PAT_TA_8956
cgacccacgcgtccggaagggacctgcagcacacccagcggcgactgtactccgacggaagccatcccctctccgctccggcggacgcccctccttccaccggagcgcgccgcctcggagggaaggctgcttgagagtgttcctgggcccagaagcagtcaccagaacagagctgaagggtttgtgttactttcctctggaaccagtataataatggccacaaagcttgtggtttttgggctcccttgggatgtggacagcgaaggattacgaaagcatatggccaagtttggacccctggaggattgtgttgtcatgaaggatcgcttttccggtcggtctcgtgggtttggctacgtaacgttctcatcggctgatgatgtcaagaatgttcttgaatgtgagcattttcttgggaaccgagctctagaagtgaagatagcaactcccagggaagaactgaaaccactgtcacagggaacaaaaacagctactaggatatttgttggtcgaattccgcaatctgcagatgagtcaatgttccgtaggcattttgaagcatttggagaaattatcgatctttacatgccaaaggaacatggt

SEQ ID NO: 8957 - DNA, 492 bp, Triticum aestivum
  Clone ID: PAT_TA_8957
ggctcgacaagcttgtgatgaccccctggcccttattttttcatttcaggaagatgaagctacaagatgtggttcttgtgggtcaattttccacaaacaatgcttaaggaaaattagtgtctgcccctgtggtaagagtgccagcacaggcatgaaaatcgtggcactagaacaagctatagaatacggctcaaacaggctgtcaactgagttcatcccacccccttctttttcttcatcgtcaagatttttcgccggtattctttcgaaagcaaggccagataagatttggaaaccgagagacagcaatcctgtgattttgatgggttcattgccggatacgtctatgtgagttcagcttagctgcatgtgtggggtttatcataacaattttttacttgcgtgaatgctgtatattttgctgcgacagtatagcaaagagaagggattctcactgctgtttctgtatgttgtgcaaatttaaaaaaaaaa

SEQ ID NO: 8958 - DNA, 682 bp, Triticum aestivum
  Clone ID: PAT_TA_8958
gcatctgcagacgctgttcctgggcatctggggaaggccgccttcggtcacgtatagaaggcagctgtacacagttcgtgatggtggaaccattgctttggattggctactagcctctgactgggaagctgcagatggtagttcttgtgatggaactatttctagtgatgattcaacacccattgttgttgtggtgcctggattaactagtgattctactgccgcttatgtgaaacacttggtcttttctatggcgagcaatggatggaatgttgttgtaggcaatcacaggggtctgggcggcatctccataacatccgattgcttttacaatggcggatggacagaagatattcgtgaagttgttaattaccttcatcaaaagtacccagaggctccactattcactgttgggacaagcttaggcgccaatattctggtcaagtatctgggagaagagggtgaaagtattcctatagctggtgctgcatctatttgttcaccctgggatcttctggtgactagcagatttatttctcgcaagctagtgcagcgttgttacgataaagctcttgcaattggtctcaaaggatatgcaaaactacatcaaccagtcttggcacgacttgcaaactgggaagctattacgtcggtatgcaatgtgctaacctgctggtctaat

SEQ ID NO: 8959 - DNA, 442 bp, Triticum aestivum
  Clone ID: PAT_TA_8959
gcgtccgcggcgtccgcgccaaaatcccaatcgcccgccctttcctagctgcagtagaaccctagcagcagatcgggcagccgccggccgggatggaggggctcgacgtcgacgacgtcttccaccactaccggctgagccctacggaagtggaggtcgtcacctactacctgccacgcctcctctccggcgagacgctgcacggcgccgacaagctcatccaccgcgtcgaaatttccggctgcgagcccaaggatctggccgtccgatacgcgcccgcgccgcaggccgtgagcagcggcgatcggtgcttcttttccgtgcaagagcaagaacgggagcaagcttcaaagcgtgcgcggcgccggcgccggcacctggagcatccagaagaccacggagatttgccacgcgggatgcaaggtcggcgaggtcaagaacc

SEQ ID NO: 8960 - DNA, 817 bp, Triticum aestivum
  Clone ID: PAT_TA_8960
gcgcaaaaccctaaaccctagccccccccctccctccccaaatcctcccctcgcggctgcaggggacggagaccaccgagccgccatggcgaccctcctgaggcgcgcgtcgctgcggcgggccatcgcctccgccgcctcggccgccaccgcctccgcctcctgccccgagagctataggcaggtgatctgtggctctacctttcattgccgagatttcgcatctaaagccaaaaagaagtcaaagtcaagtggcaccgactccggtgaggagaatatgtcaaagaaagacttggctttacatcaggccatcgatcaaataacaacttcgtttgggaaaggagcaataatgtggcttggccgctctgaaggtcatcgagaagtacctgttgtgtctaccggatctttctctttggatctggcactgggaattggtgggcttccaaagggacgtgttgtagaggtgtacggcccagaggcttcaggaaagacaactcttgctcttcacgttattgcagaagcacaaaagcttaccggcgggggttgtggtgcgtttgcagacgcgctgcgtccttcgggtcctcctcgggccgacgcgactggtgtcgacccgaccgcttgacgtctctctctgcccctctctgcggacctggcgctctgtcttggacacccgccgatccgatgtggctctgttgatgttgttgttgttgacagtgtagcagctcttgtccccaagaccgagcttgatggagagatgggtgatgcacatgtggctctccaagctagactgatgagtcaagctcttcgcaagctgagc

SEQ ID NO: 8961 - DNA, 1476 bp, Triticum aestivum
  unsure (1)..(1476): unsure at all n locations
  Clone ID: PAT_TA_8961
aagcacaagcgaggaatttaatgtattactccatgagggcactaagctccacatacctgaagtagaggacatctctagagacgcattcccgcaacctgatgaagtaccagaagccgtgagcataacagagaaaatggaagatcgtatcaagatataccctagcaaagaggagcggcaggccgagatcatagcaaatgcagtagaaggtcctattgaagtgcatcaatgtgaatctgatgactttgcagacaactttgtcaaactgtacccatgcgattctaacatttctttggacgttggcaaaccttaccctcatgaatgtctgactgtaaagaggtgtataacgagctccaaggatagtgcattggctagaagtcagagttgcagggctagcttcatgatcattccaaatagttggtttgatgatccggaaaacaccgggcagacaccacctggtgaaatcttcaggtatcctcccagaaggcctgataaagttaggagaagtctgtaccaaggaaatgatgattgccaaaacaataacacttcagtagacctctccgctgattctggcgaagtagtttgtgatgaagtagttaaggacacgagtaccagtgatgaagtagtcaaggacatgagcaccagtgatgaagtggtcaaggacatgagcaccagtgatgaagtggtcaaggacatgagcaccggtggtgaagtagcctaggagtggagtgccaatgaagcagaacaagaagtttgtgccggtgacatcagttgtgtgacggacctggaacagaaggcagcaaaacaccatgaggaccaacctgaggaacatcaggcagagcagcagattgttcgagatgagtgtgcagcagttaaaactgtcaaagatgttggcatagatgcagtcccgagtagtgccgagtctccttcgcgctggcctattgattttgcaaataggcagcgacagatcatcgagttgtggcacgactgcaacgtgtccctgggtacacaggacctactcttcctcctccttcaaagggagatgccgcaagatagcgtcctacatggaaagttggagcacaggagactgtccttcatccctggantccctttnagcaccactcccgcaaggaggcgacttnactcccgcaaccgcatcccacttttnaagaattatgaaacgccnanaaggacatgctcctacaagcaaatnctggaagaactcaaccaacngggacaaggagnatcctacccaaatggggttcnattttgggtcccaaacaacggngtttaactactcccctggtagggcccnggttacatggacatttcaaanacccncctggtggcaggtgntgacngtttaccanggaagnccaagnntttcggcnaantnagctggtccaaacaagccgtcttacctgcnggccctatcttgctangtgagnaaaggnttgttacntcaggttactaagagag

SEQ ID NO: 8962 - DNA, 842 bp, Triticum aestivum
  Clone ID: PAT_TA_8962
aaaccagaatgtcatcatttatacttgtataacacaacaccttttcacacaaacttaacaatgacttgggggcgagtcattaaacagtcaacttccacgccaacgcaacacttcacaatgccatacacacacttactccacaggtgaacaaaggttccatgacacagaatagataacaacataatctcaggcaatttcagatgaactattgcaagcaacagcctccacagatcattaattagttacatgttcgatgacataaataaaaggacaacgtcaggctatgtcaggcaatctccagcaccaaagagcctcccttgatcaactggttggaggtagaccaccaaccggtgggtacttcaggataagagaccaggcgacagtgatttccagcttacacatgccgttaagatcaagcgtaccacggcttcgacctgcatcaagaggcgcaaaggatgccttaccctctgccagaaccttgtcatggtcaccaccacctcgattcaccacgccacggactatcagttggccaaacctctcaacagacacaacacggcgcgagagctgaattgtgccatcagcagcaataacaggcgacttctcttctctacagtcgaacagcatgacattcatgtcacccacactgccgatacaggcagtaagctggcctcgggacccttctggccatgaccccttgacgatctgcgcggcgatggtggcctcaacagaagacacaacgaggccacatgttaactccaatgtactaagcttgcttggtgtagagactgctactcacgcaggaacggagcatgcactctccaaagcttacgcataaattgagc

SEQ ID NO: 8963 - DNA, 1212 bp, Triticum aestivum
  Clone ID: PAT_TA_8963
ggaagctcccctttgatatccagtgctcttcagaaacttatcttcatatctttgagtcgagatgatgagcataacccttctaggacaactgtacgtgcatcctctggagcaattcttgctaggcttttggtgatgaatacaaacttttcggcacagctattatcagagcctacccttttggcaaacattcaacagtcagggatatctctaaaggataatctgctactctctttggttgatatgtggattgataaggctggacaatgcatctgctatacagcagaaggaatacgcaatggctctctctgtagttttgaccttgcagatacctcaagtcatcgacaaacttgatgatatattaagtgtttgcacgactgttattattgggggccgtgaagtaaagaccgaggatgattctaggggcgatattacaagccctccttggcttggaaatgataattcaggttactccagcaaattcttgaaaaagcgacaagcaaaggatttagatccgatcaaacaagcttcgctagagaacatactaagggagaacttgaaggcatgtgcagctcaccacggggattcgactttcaatgctgccattagcaggatccatccatcatcatttgctcagttgcagcaggccctgaatagtgcatgagatgcgcatatttcctaactgattctttgatgttcttttgaatacattgaagaacatccggcgcatcacgagccaccatttcttggagcgcatggtgatccccatgcaccatgtgctgccatttgatgcgctgcctttttcggtcctgtgatgtactgtcgaagatgagggcagttcatcgtgtaggtgtagagtgccgactaacgtgtgaatagcaagagttgtgatcgagcagctttttcatcccccaccctgggttattggttgacggtcatattcttctacgtgttaggtctttcgtgtgggtttgaccactctaaagaggcggttggagttttcatggacattattgcgggctatttttctgcttttctttttgttttctgctgggggttgattgggctagtcttctggttggcagaggttttacttcccaggcggctgactttacatgagaagaggttgtcagagttggtgaatgtaattgtttgtgcgagaacaatattattgtgataatgaattgttcaaaaaaaaaacggacgcgtgggtcg

SEQ ID NO: 8964 - DNA, 615 bp, Triticum aestivum
  Clone ID: PAT_TA_8964
ctcgtattcggcacgagggctgttcgtcttcttcttcctgccggagcacgaagcagctgcccatggtagcagatggagcaggtgtggaggaggcactggttctggaagaggatagttggggagggggaggaagaggctgatcaggcgcagaccggagcaggagccatagccatgtccgccgcagcacatagcagttagtgacattcttttggggggtgtaaaaacctgcactccgaaaatgatgaactagcctgatgatcggtatatctgtatgtacaaggggaggtacagtactcatatagtcatatactgtatgtgtcctaactcgctcaatagatcagcggtcctgtgaggagtatgtaacctatatatagttaagttgacatttccgggtggcagaagggtacgaggctttcttcccgccgcccgccttgtcccggcttgctggcctcgccccgctgggtgctgcgtgcacgctggtggcggagagagccacagcgaggatggcgaagacgttcttcatggtagcggttggaaggtcgttgaaagttggaaagagtcgagaatggttgtgttggatggagttcaagcgcgacctcggccgcgaccacgcta

SEQ ID NO: 8965 - DNA, 1073 bp, Triticum aestivum
  Clone ID: PAT_TA_8965
gcgcgcactctccaatgacagcttgtatgatggcggcattgcagcggctgatgagttcacgtacgtggtggagcaggacgtgtcggaactggatgatgactgcgaccgggtgtacactgtggacgcagtgcatcgcgtgcctgtcgccgcacctgaggactgctgctactttcagacaccgatggggaacgacgtgggctttgttgatggggttggggcgtgggctgaggagcagcggatacaaaagctcagtgcaaggctacaagcgctggaggcagatcgggagtcgatgcggcatgcaatcatgtcaatgggagcagagaaggcgcaggttgtgatgctcaaggatatcgctcaccagctctgcgaggaggcagcaccattgcctgcagtttcattgaaattgcatccagtgccgcaagcggtagtagcgccaaagaggaagttggtgaagaggcagcctttctgcgtgaaattcttcattgtgaccgcaattaagtggattgtatctgtcttttcccggcaaaagaaattagatcgcatcaagtacccatttggcttgtgcgggagctatgttggactaatgctgctgcttgataggtcccacaaacagagatacagaagatttcttaagagagctaggtgatgccgctcacttataatatgcagcggccgaggaagactctgcgcttgtatgatgcttttgtgaaaagtgttgtcattgctgcatatatcttttcgctcttttgtccataaattttatgctggtttggtctggcgatctatctagttatcaactgaggttcgaggtcttgtccatttatttgatttggtgcctatttttctcctactattgtaatgattgttttttttagacaagtacgaattggttcatttgtacaaagtactccaagtaacgagcaatatcagaagtagagattgtttagcagtgctatgatgtgctactgtttctgtactcataccagattttgtggaagaccggattttgaagttaccagtaattttaccaaaaaaaaaaaaaaaaaactcgagactagttctctctctctctc

SEQ ID NO: 8966 - DNA, 412 bp, Triticum aestivum
  Clone ID: PAT_TA_8966
gggcgcacgcgtccgcttacaacagggccccctctccttttgaccagcttgccctcgcaaattccttatttctgcatttgaaaaacgacaagacaccaacttatctgatcaatgccaagagctccggaaagcaaattgatggcaaggacttgatgagactaatcgagctggcgcaatctaacggcatgccagacagcagcaagcctgaggacactagagtggctgaactcaaggggaagtacaggggctttatatccggcaagttcggcaaatttttacccgaggagttctcattctgatagatataagtgttaacctaattcagtgtacggggtttttacgccggggcctagataggctttgttgcgttctgaattgaactgagataggctaccccaatctccctcctggg

SEQ ID NO: 8967 - DNA, 964 bp, Triticum aestivum
  unsure (1)..(964): unsure at all n locations
  Clone ID: PAT_TA_8967
ccacgcggcggaaaccctctttcccctccctcccggccgttgcggtggcgaatccgggctgcgacgcggggccggcggcgtgaccctccgtccgtcccctcctccgccgcgtccccttcgtcgggtcgccaatccacctcgtccccaccccgcctcgcctcgcctcgtctcgtctcccaacttttcccgatctcctccgtcgctaagcaaacaaacccttattaaccccccgccgaagcagaggttagcctggagaaaagggcgccacttccactggggctatgcactctgctccccggatgctactagagtaagagtgagagccggagcgcctggcaccgtgccacgcggtggggccgtctgctccgcggccgggcgccggcgcgggggccggtgttcctcctgcgccttctttcgccgttcttcgcacgggcgccggccggcccctgcgcttccttgccccgttcgcgggtggggcgccggcctgctccggttgcacggcggccgggggggagcggccgccggtgcccggcctcggagcggccgccccagcccgtctatggaagttgccgccccggctccacgccacggcctggaaccaaattgccgagcacggcccggctcgcctgcccttctgacgctgctgctcactccggtgcccgtcttctgcctcgttcttgctccggatcggccgattgccgcgggcctgctatgacggtggtcatgggtcggcgccggtgcgctcactggatgctgctgctcttctgttgcctcctcctcacgtccccctcacatggtcatcgtcacaatcgacccgctgacgcgtttgtcgggggatacgggataaactacgggagaatagcgaacaacctcccgtctccggacaaggtggtggagctcctcnnnnngtccaagataaggaatgtcaagatatataatgaagatcacgctgtgctcgatgcgt

SEQ ID NO: 8968 - DNA, 1532 bp, Triticum aestivum
  Clone ID: PAT_TA_8968
ggaaggccccgacaagtccgcccgcccgccgcggccgcagctgccctgctccgccgtcctgcactcgagcgagggcccaggccgcgccaatggctgacgttggtgggacggatggccaccgtgccgcctaacctgccagggacgctgggggctttgtcttccccaggccggagacgcccctgtgcgacgttgtgggcaacgagccgccggcaagttgatgcatggggagcgacttcggtgacatcctcagcggcgacacggtcccccttgccaggacccacacccacatctgcagctctcccagggacgcgctcgcgcagcacactcacaccttcgtggctgtcctcaccatgatcctctctacgccggacgaggccgcccaagtcctttggattcgctggcgggaagccatccccctcccttagcgagaagtgccggccctgctgtaatcgcgcggccgtcaggaagtaccgcgagaagaagaaggcccacacggcgctgctcgaagaggaggtggctcacctcaaggctgtcaaccagcagctcgtcaagaagctccagagccactccgcgctcgaggccgaggtcgccaggctccgctgcctgcttgttgacatcagagggaggatcgagggggagattggcaccttcccttaccagcggacggtcaaaagcaacgattttgtcgaccaggggagctttctcggtggtgcccaggttatgaattcctgcggtttcagatgcaacgatcagctgtactgcaatccaggaatgcagcaggccagaactatggacgacgatggtgttatgagtggccaggttttggggcaaggtgctggtgactctatgggctgtgtaaaacaaggttctttaaaccccccaggctgccgtgggggccaaatgctgtaaacaggtcgaggacgctgaggtgcttatcttctccttgcgagagacgattggcttccccgtaaaggaggatgtataattgtggttctcccagaggccgcgtttggttcaaactgtcgtgtttgtggctctgttgccgatggtgccttctatggtccctggggcgccacaagttcgttagctaggatgctaccagcctcagtaatgttcttggagttggacacctttgctcctagtcctagatgctcgctgataattagtagaacagatgcgttcgaaggtatcttcaataatttagatttcggcatccaggttttgtgggaagattacatgttcagttttgggtagacctcaagttggatgtgagctgcatgaattctttcgttggtatgtatgcccgttgtgtttgttttctacaccgtgcctatgatcaaagcaatcgcatggatttcatcattgcttgggtgttatttgattcttaagggaatgttctgtgccatgatatattatttgtacaaagtaacctctgcagaaatggggttggtttggagggtcgtattgccgcccagtttgtctctgtggttcaatatttactgaaaagttgtggtctaaaaaaaaaaaaaaaa

SEQ ID NO: 8969 - DNA, 792 bp, Triticum aestivum
  unsure (1)..(792): unsure at all n locations
  Clone ID: PAT_TA_8969
gccgcccctgcatcttgccaccacgcatcgagcgatgcagcactcagggtcgtttcgccaccaccacctccggccgttcagcgatgcagcagcaagatgttcaacgcctcagcccccctgcgaatcccactgttgcagcaaccggacgaggcccatatcttttttctttgataagataatttttattgcatactgtctgttattttgctctgtcattttgctgatgcctaaaaagaagttagatgatgggctctgcggtctgcaagctgcctccaacctttggcaatatttgtaaaaatgattgtgcagattttttgttaccccattttagttactgattgaagaaaattttgttcattaggtgaaagaacttgatttcttttgttcctttgtggaggaagaaggtcaccacagaggtagggagaaggtcaccataaaggcagggagaaggtcacataaggtgcagaaagaatgtcagagttcagcaacnggggtgtgatctttgtgttgtttttggggtgcaaatcatgggtatgcgagctcacatcctgtgtactattgagatggcctcccttagcctcaaaccatattgcctacaaaaatgatagtcgcaatgctaccgtcatgtgtgtaaagagaattagatatgtacatgtacacaacctacaacaactttatggggagttgatggattattcagtggttgttgctgccactactgattttttcttgagatggtctacatcaccattcaataattcacttgtttcttggttgcatctaaaaaaaaaa

SEQ ID NO: 8970 - DNA, 1026 bp, Triticum aestivum
  unsure (1)..(1026): unsure at all n locations
  Clone ID: PAT_TA_8970
attcggcacgaggcggaaaggaagccgctgtaaaaagnactcagtaagatttctaggcaagtggccgatgagttcaaaaatgaggtgatcttggttagcaaattgaaacataagaatctcgttcagcttcttgcctattgcgctcacgaggatgagaagttgctagtctatgaatacctgcataataaaagtttggatgccttcctttttgacactacaaggagatccatacttgattggccaacccggttcaaggtaattaaagggcttgcaagggggcttctttatctacacgaagattcgaggttgacaataattcatagagatatcaaagcaagcaatgtgttgctagatgcaagaatgaaccccaaaatatctgattttggtatagcaaagatatttgagggaaatgagccacaagcaaaaactacccacattgtcgggacactcggttacatgtctcctgagtacgcaacggaaggtttctattctgtcaagtctgacacctatagctttggtgtcctactgttggagattataagcagattaaagattagttcagtccatgtcatagcggatgactcaccaagccttacggcttatgcgtggaagttatggaaagatggaaatgcgagaggattggtggactcgtcaattgtggaaaattgtccacttgacatagtcgttagatgcgttcaaataggtcttctatgtgttcaagactatccagatgataggccatgcatgtcatccactgtctccatgttggaaaatgaaacagttccgcttcttcctccgaaggaacctttatactttcgacaacagaaccatggaacaggagaccacggagataatgtgggcatgtccgtggatgacattactatcaccgaggtagaggcctgctagatatttacttccattgatcttttatgtaaacatctctagtttgtacattcatgttcgtacaaataaatgaatagtttttgaatacattggaaaaaaaaaaaaaaaaaaaaaaaaaaaaaa

SEQ ID NO: 8971 - DNA, 1038 bp, Triticum aestivum
  unsure (1)..(1038): unsure at all n locations
  Clone ID: PAT_TA_8971
gcacgaggcccatgtgtccttccacccccggtggtagtgtacaacacaagagccaccacgagctcccagtgtctcctcattcctttcccttggatcgggagcagagcaggaacagaaaggtccggcgacgcgcggatcagccgagactccgtaccgtcggatttcgtggagggaggccatggagaaggggcagaaggtggagcccgacagcgccgcggcggccgccgcggccacgcagcggtgggtgatcggtgtcgggttctgggtgcagggcttccggctcttcccctggctcggcgtcaacttcttcctcaaggacgccatgggcgtcccctcctcctcgctgcagatcctccaggcctccgccaccctgcccatggtcgccaagccgctcctcggcctcctctccgacgccgtccccatccgcggctgccgccgcctgccatacgtcgccatcggcgctctcttgcaggcagtttcatggttaggaattgccctctggccgtctctttctcttccggttcttaccatttttctcctcttgagcaactttggtgcatccatatgtgaggttgccaatgatgccattgtagcggaggccgggaagcaagcaacctcttcctcaggggggcagcttcaatcctttgcttgtatgtttggcgcttccgctggcgcgttaggaaacctccttggtggcattgctctcagctacttctcccccaaactcatgttcctatttttcgcaatcgttctcgtgctccagttcttcactactgtggctatacctgagaggtccctcaaactcccaaaggcaagtactaatacatccgtgatctcaagcatccgtaaacaaaccaaagagctgtcgtgtgcgctctgtatgccggaaatattctggtcaatcatatggtttcagtatctatgctgcatacaattcnacccggacagttctcacanactgaatgttagactgaccatcacatcgttatcaaggtttggcaaatggtcctggttgggnaggataaaaatgctaagaaa

SEQ ID NO: 8972 - DNA, 705 bp, Triticum aestivum
  unsure (1)..(705): unsure at all n locations
  Clone ID: PAT_TA_8972
ttcggcacgaggcacccatcggtggattggggactcgaacggcggctgcgcgtaccctaaccagatcgaggcgacgagaggccctgggagttggggcgagcagcggcggggatcatcggagcagcttcgctcaggagtcctgacaattactttcccctgttttctgaagaaaaaaaaggttatggacttcgatagggccatggcaaggagtgcagcctgcgatcggttgggagcctctgtgtcgcgccccagcggaaacctgtctagcgacaccaaagccgtcctctgcattggggcagccgctgctttgggctgggcagcgtggaggtactaccaacgtcgtgtctgcctcgagaagttcggccgagacatgacggcattggctggaaaagctgatccggtgattggccgcgatgacgagattgaccgcgtcatctccatcctctgccgccggaccaagaactgcgttgcgctcgtcggtgctgctgctggcctcgctcgcggcgcttcacgctgtgattgtgtgaccaagtgacagcacgctgtggcctgtgatacggacgtgcacggatcaaggctgtgtttagtgctggggccgagggggctgcaacgttacgtacgtacgctatgtatggtgtgtactgcgtatgccagttcacaagacaagagctacgnaacaaagcaaaatttagtcaataaggcatc

SEQ ID NO: 8973 - DNA, 1231 bp, Triticum aestivum
  Clone ID: PAT_TA_8973
ggctccccaccgaaaaccccgacccgatctaggtctagcgctgacagtgacgggaagctccgccgccaccatctcagtccacatcgccgccgtctccacaccaccatggccggcgctggatcgggttcatccgcaccaggagaaggaggctttcacttgatgagttgcctaaaagaagttccgacactcagaggtgacaaccacactgagcggaggaagaaagttgaactggcatttatttgtgctgatcctgactgggttgtggtgaaaccacagccggtcagacccacagagccagtaagagaggccactgatgatgatgctgcatgggctaaaaagaagggggactatgctcctttggagcagtcctacctcatagataatcaaaagtgggtcaatgcaagcaaaaagtgcatgacttttataaagaatacaattgagagcgccattgtgggctccattccagagtgcacttccgcaggggagttgcttacaaagataaagagccagttcactggctcttcaaagatctatgccacccagggtgttagagcaactggtgacagaacgctacacagggtggtagtcgtggaataagagagcacatcctcaggatgagtaatatggcagcaaagctcaagcccatggatgcagatctggagatcaaaccagcgctcctggtccacctggtcatggcttcactgccacaggagtttgcaacttttgttgtaaactataatatgtcacctggaacatgggacattaaaaagacaatagcaatgtgtgtccaagaagaggacagactcaaagccgcacatggtggttcaatcaactatgtgaaggattggaagaaaaagaattacaatcaaaacaacaaaagttctccttcaaagaatggaaaagccccctatcagcatcagcatcagcaacagcctttctcagtggacaaagacacgtgtctccactgcaagcagaaaaggcattacaagaaagactgcgctgcttggctgaagtcagtcatggcaaaaagagggattccatttgacgcgaactacgctaagaagcgaaagacgcattgaagtggcaaacggagttgaagcagaagttgaagctgtcggtgacatctccttggagttagctggcggattcaatcttctacttagagatgttttatttgttccatcatgtcatagaaacttaattagtgtttcttgttggacaaagataatta

SEQ ID NO: 8974 - DNA, 2253 bp, Triticum aestivum
  Clone ID: PAT_TA_8974
cgtccgcggacgcgtggggcttgttcacaacaaggaaggccatggaccgcggacctgctcgacctgctcgacctcctcctcacgccgcctcggcctcccggcccttgtcgccgttggtcgccctccacgggttctgacgtgccgtcgccaaccgctagagatgccacctcctcaacgcacgatataaccacatttacgtgcaatatgcaacagttgttttctctgcttcagtatttttgtgtctctggcaaagttaatcatcgtattcatgtcatttatttaggagggatcccaattactgactgcatcaggcgaccaatctgtaaagatatggagcatggagaataagaaatgccttggtgtgctgtcagggcacactagaagtgtgaagtcactgacatgccattcttcaaatcctggacgcccgccgtccccgtccccgctccggtcctcctgcgcttcgcgatctcccgccgcacccccgacccccgcaggaggatcccgcagcctgactaattcgtgcccggtcccgtgcgcccgaggcggcggatcttattatttctggttcaagagacggttcttttgcactttgggatctaagatgtgacccccaaaccccaaatggtcatggtgaagcatgactcctcgtccgttttgctctatcagtgtaggtttcccgaattttttgggttaggcgtcgaagcttgagcctctgtactgaccgtaaaattagccccgctggtatatgtgtcgaacagtccgtcttctcaaggagatgaggctggccattaaggatctagctgcgtggggtgatggtcatcccgttatgctctactgcccactgcttccactgctgatattttgagctcttttatccgagcggacctcagtagtgacgccggtaatgcaggagctatatgtgacgtctgaaacagggatgcctgctcatggcgcccggagtcttaaaactacccctacttctggacattggatatgccctttcatatagcctctgtctagaagctggacaccagactctaaacatgggtcaagctggtgcgactcttgttgcagcttggctcctggtaccctatatgagtgattcaaatttgctcacggtgaacaatagctggcatggagccaaccggcggaaggactcttgatcctaaagtttacaatcctcccaacaaccagttcttgccacggacactgaatgttgtgacgtcaatttggaagccacgggatggatccctttcagagcgatctagacgccctcgatgcctcgacaacttcacgagtgtctgaagtgtaaactgacatcatacttataactggtaggaggagacaggtaagatcagtcaccagtgatggagtcatgagtttgttgacgtcgtgctaaacgttgtgtaggccaaaggagaagacatggtgcaaattcttgagcttgacattatggtacaatataaatttgagtattctttcctgtcatagcagtctatagcctatatcacattgcaaaattccatgaacaattggtccacattatttgtttgttatattgttcatgcccaagcatggatgcagctggatgtgggtgccatgggaagatgaaataaccctgcctaaaaaaaaaaaaaacataatctatgtccctttaattgggaaagatgctggggtgcgaactgtcccgacaacgacacttctgcctgctgactgcgtgaaggactgcctggctcaacctctatctcaatgtttgtgcgattcagttaactcaatgcccaacaatgtcgtcaattgtgagcaagcagttacttcaaattccattgcccaaatgccgtatgtacgtaccctgagtacaagagacgatggatgcaaaagaaaattaggaacctgaagggaaaatggaaggcggctttgatcgacattcagcccagagtacaaggatgatccctacatctatacttttgatatgctgaagcacattggcattgagccaaggcagatgtagggcagtggtggcgggtgcatatgtagggcagcgggagcgggtacaaccatcttagggagatcctcttctcatatcatgcccagttgttactcctccattcgctcgcctctcaccatatgttctacaatagcacgatggcggcggcacagatgtgtgcagcggtgatgttctgctcaagagagtctctggcggctcgggcgggatgcgctgaccctctctacgtcagcattttctggcggcatctg

SEQ ID NO: 8975 - DNA, 689 bp, Triticum aestivum
  Clone ID: PAT_TA_8975
gcaccagtccacagtggttgtgacagaggagcatggccgtccatggcagagtgtgcccgagaagggagtgttttttgagggggtcgagccagagagaggtggcaaatagattcgaggcggcggggagacgtgctgaggcggcgaggtagcaagcctccaaattgccagcggagcgacgcgctacttcatcctggcagcgcatagagacgacaggccgcctggatggaacgaagggaggaggtagctggtagcgagttctatcagagaagcactcatgcgattattctcattcttcaggcaatatgggccgtcttcttctccaaaccatcttccccgaatcgagctgattcctgataaactatcttgcaagatggtggaacgaatttgaagtctttatttattgtcgacacccatcagccatcgtctgcaggtgtcgtccgtgtttgccgggacaggtctgcagccctagatgtctcctcccctctccaagtctccataccaggttctccctgcagcctcttcgtcgcagagtctgttttgattctgccccaccatcctgtttttgcagtctggttcttaaattcagagatttaaaattttaaaaattgttgtacgtagaactacatcagttgtctgtcttggaaatttcatgtattggctgatgcaaagcttgaattataaaaaaaaaa

SEQ ID NO: 8976 - DNA, 1474 bp, Triticum aestivum
  Clone ID: PAT_TA_8976
ggcaggccggcgacgccgagctcagcagcacaagatctgcgttgggttcgggcagcctgagacgagcgacctgacggtgatgctgtatggcaaggaagggattgctgtcaggatgagtgtgcatagggatgttctctgcggaagcagcgctttcttcaccgagaaactctccgacggccatgttggctctccggtgccatgcgtggagatccatgattgcgacgatgcagagatctatgtggagaccgtcgggctgatgtactgcgacgaggcgaaacacaagctgctcaagcagaatgtgtcgcgtgtgcttcgtatcatgaaggtcgctgaattactcggtttccatgcttgtgtcaagtcatgcttggattatttggaagcagttccttgggtcggtgaggaagaagatagcgttgtgtcatcgatacgacatcttcagagcaagtcttatggagttagccctttgctgaaaagagttacgtctgacaccccgtactcaccaaccgatactttgtctcatattatggagatggtcttgaagagcaatgatgacagggggcgtcgggaaatgaaggccttagttctgaatcttctcaaggatagcagccgttgcgcggatggaacatcagacatctgttctgaattattttacggttcgtgtcgaggttgcttagaaaggcttcagccactctttgtggaagcatctgaagccggttttccttcccaagttacacgccaaataactctggagactgacaatatcctctggttggttgagatattggttaaccaacgaatttgcgatgattttgtggtcatgtgggcaagccaaagtgagcttgcgtcattacatgcaaaattgcctatcgcctctcgccacacagttagcagtataacagcaaggctctttgttggcattggaagaggagaaatgcttccgtccaaggacactcgtcttctcctcctgcaagtctggctgcaagcactcatcgatgactactcatggctacaatgcagctgccggtcatttgataggaagcttgtcgaggaagggattgggcagacaatcctgacacttcctttggaagaccagcggtctatattactgtcatggctcgggaggttcttgaaattaggcgataactgtccgaatttgcagagggcattcgaggtatggtggagaaggactttcgtcagaccttatgtcaaccaagcaaggtaatgtctgtcctatgatcaaacagaagctcatcttgaaacgatagggaagagtagtgattgtagccatagattctttcggggattgtcgtggtcaatctgatagtggacatgaaacccggtgagaatttcagtggctagtttttccttactgcgtaaatgtcgatgacacaggaaatttgtatgactgcacgttttagcctatgatgtaaaaccatatgcttttccagtagttgttataagaaaacctcga

SEQ ID NO: 8977 - DNA, 1970 bp, Triticum aestivum
  unsure (1)..(1970): unsure at all n locations
  Clone ID: PAT_TA_8977
ggcacgcgtccgcccacgcgtccgggggtttcaaaggcagtgctggcgcagtggagcaatcagggtatcagggtcaggtctgacccagaaacaggtatgggactggtacaacatgaaggtggcccttgcctcactaaagggaacaaaagctggagctccaccgcggtggcggccgctctagaactangtggatcccccgggctgcaggaattcggcaccaggtggggtcttagctacagtgcaggcatatgtccttaaatatcttctgtttttctctgataatttgggtaacccagaggtcagtgacccgtcatttgctctgggacaaagacgattttatcagagttcttttgctgcaagggatgatttttcttctcttaccgaggatggaaagacgagagcattggttcatgctatggtggaaattctatttttatgtggaactgggaaaagagctgttgctgcattcattggaggtgtcactcgtgagaaagttgatgctgctttggaaggcctttctcttgaatcggcaattgatttccagaaagttcttagaataagtacgtttacctcaaggaaggatgcattcaacatgcttctggcaaacattcctctgtttcaaagtcgactgggtgccatgttatttcttatctcttctttactttcgcggggactggattgtatccaagcagatagggatgatccaagccaaccattggtcacggctccatttgggcatgcttctcaggaaattgtaaatttattgctttgtggagaggctgtcccaaatgtatttgatggcaagatggaccttggtggcggcatgtccctgaaaggcattccaaatgatgttgaagttgggttccttacccttctggaatcgctaaatttgtgcaaggttggtcagtacctaaagtgcccgaaatggcctatatgggtggtgggaagtgaaagtcactacactgtcctttttgccctaaatcccaacgtccaagaggagaatgagctggaagagcgggaatccaaaattaggagggcatttgatgcgcaagaccaaagtggaggtggaggctttattgcggtggagggattccagcaagttctgagggacaccgacataacatttccttctgacaagctcgacgatctctgtaatgcgggcgttatagtatggagtgagttctggcaggcactgcttcagttggataaaagggctggaggcatgaaagatccaactggccttatgggcaagaagcaattcactatctaccacttcaatggaattgccaagtcagtgcttaatgggagtggaaacacaggaggaggctcaactccaatacaaagacctaggatatgcaagttaaatgtcagcgtcccacctaggtggacgcaggatgaatacctagctgatgttgtaagctcatcggccagcggcagcaagaatgacagtgttctttctcttgctccaccagttcagactgcttgtcagcatgcgccattagtggactgcattagaactcgatggccacgggcagcttgcagttggtctggagatgtgccgagtatcgtctgatgcttgagttccagtcgtatcgtttgttgggctgatttcgagcagactgcttggactcccatagtgttggccatgccatgcaaagttttggaaggggctgctggtgttgtaattgtttagcctgatgaatatatgttttccccccttgacatgaatcctttttatcgcgtcatcttatcagggacatgagttttctttttttcttttaattgacattagatgtatacaccttttatggatatgctgttaagtctcgaggcacattctttcctgtacacagatgattttgttgtagtttattttatatctgacacagctgatcgacttgtttgttttacatctgacggagttgtaaaagttctatgatagtgcttacttgtccaccttttgatttctt

SEQ ID NO: 8978 - DNA, 694 bp, Triticum aestivum
  Clone ID: PAT_TA_8978
gcctctctctcttcctcgccatcatcatccccccccgctctccctccccctccccccgaccccggccaatcggagcacccaaatccgccgcaccccgcgccccccgccgccgtctccgacgcgtcgccggccgcggatccccggaaaacccaggaggaggattcccggcggccaccgtccggggcgggttcttctcgcccccggcgccggaggggaggctgggtttcggcgcgcgccgtgggatgagctagatttccttcgacctactaggatggcggccgcggcttgagcccgaccaccgcctccctccctcccgcccgccccggttaattatttgctactgctgctgacagagattttagcctagcccctagagcctagaggtgttgctgttgctgttgctgctggcgatgagctccgaggcccccaagaacatgaggacggtctactcgagggagttcctcatctcgatcggcgagtcggaccgctgcaagaacctgccccccggcgtcaacctgtcgctcctcaacgagctgcaggaggcgtcgtcggtggcgtacgagaggggcaacaggggccagtacacgacgcccctcggaaggtccgacgggtccgggggttacacttactcgtcgcgtggcgggagctccggcgggaggtgggacactcgctcgacggggtcgagcgaccggga

SEQ ID NO: 8979 - DNA, 637 bp, Triticum aestivum
  unsure (1)..(637): unsure at all n locations
  Clone ID: PAT_TA_8979
agattagaaaaccngaccaagcatttgcaaatatctggtctgatatggtttatggggttgccctattccttcttatgtactttaaccagagtaaagttgcaataataaagttcacaggatataagttgctaaacaatatctgggacagtgggaaggcttttcttatcattttagtgtcagatatccttctagggtaccattcggaggcaggttggcattcattggtggaaattattcttgaccactatggactggaaacagatcaagctgcagtcacctttttcgtttgtctggttccagttgccctggacgtatttataaagttttgggtgtacaaataccttccaagactatcacctagtgtgggaaacatcttggatgaaataaggcgtcactaggaattctttccatcaggaattttggttccttcctttaggaaattgctagtagaatttcacaatccaggtatgtattgacttgcatgtactgttggctcctacttgccaatgtttgataaatagtgaaaaaactacctgtgactgatacggttattcattcacccttcaatttttttttttggtgaaagcccttaaattatattgaagctggtttctgcagtatgccgttaccaattatt

SEQ ID NO: 8980 - DNA, 391 bp, Triticum aestivum
  Clone ID: PAT_TA_8980
gggagccaggcgtccgcaaattccacacgagacgaggggagaagcgagaaaatccagcgaggaaagaaatgggcccgaagagagaatacgatgacctggcccagccatcgagcgagggaagcagcggagacgacgacggcggcggcggcgatgctagaccgacgaaggccccacggttgccggcagcaccggcaccgcccgcgcagtctccctctcgcgaccagacggggcttcccacctcaccgtccccgcttcagcctccagggtccccgccgcctcccgccgacaaggatccggtggagctggaagaaggggagctaggagatgatgaatattcaggggaggacgaagaggatgatcacgattctgaaggggagctcggggggtcact

SEQ ID NO: 8981 - DNA, 438 bp, Triticum aestivum
  unsure (1)..(438): unsure at all n locations
  Clone ID: PAT_TA_8981
gggcgcacgcgtccggttacaccaccgcccccgacggatcccgtcgaccccagagaccaccggcgtgatggagcccccccaaccccaccgtcccgacggatccttgcgccctcgaatcgggccgagcctggcacccacggatccagccgagcctcgtgtctccggccatcttccttgctggatccagggaggatcctgctgcgccgtcgcgccccttcccctgctgcgccgccgcacccggatccagtcaacctccagccggtgcccaccatcacgcgcagcctggagttggcgggcggatccagccccggtccatcgtcctcgcggcagagagctagatcgaggggagaagacatcccatgttttccagcgtcctncaccaaccacggcaacgtgtgcggcggctgactgcttcctatggctacttgacggacaaca

SEQ ID NO: 8982 - DNA, 762 bp, Triticum aestivum
  unsure (1)..(762): unsure at all n locations
  Clone ID: PAT_TA_8982
ttctggtattcagcctcaacagtccacaatggcaatgtcacatgcacataccccactgttgagcagcatatttcttggggcattctacatcatattggccatttatgtgatgtttgttggaggacagatgctgtctttggtgatcaacaaggggctccgacggaggatatacatgctaatatttgccactatgatattacttccccgagctacacttcttgggctctccgttgtttcatggccaggtgaaacagcccatgaaactctcgtatttacctccttcctggtgctgatgcttgctgccatggctggtattgtgattttggtgtattttccggttgctgatgcctttgctatagttgatcaagggaacattgagatgcaaacggatcaggagactatcctatgactcaggctttgttatttgactggttgtttagctgattgttcaaggacaaattgatggccattccattggtttcttccctgacctgcatatgatctcagagacattgtaaacatagaatagattaaatagggacaacattctcctttttatcttattctttttatgcttttctccacnacgttggtgtgaagagaagtcctgtaaaatagtttctacagagtagtgaagatcagccatgttttccttactgtcttctgtacattgaaagaagagattatacactttcacctctccgaaaggggcttatatcttgtgggtgatgtctccaccattttagtagttcaaaaaaaaaa

SEQ ID NO: 8983 - DNA, 526 bp, Triticum aestivum
  Clone ID: PAT_TA_8983
gcacgaggcccacctcctcactcacacacgaaatctctcaacacctccagccctctcagctcaacctcaccagtaccaagcaaggcaagtgcgtccgcccacgcgtccgcctcatcgccctactcgccgccctcgctacgccacaagctgcggaccaccgtctgcagctgcttcggctcgcctggcagcggcgcggagaggccgcacaccgggggcggcaggagcaggtggaggcgacgcttcgtccccacgggggagttcaggtacgacccgctcagctacgcgctcaacttcgacgacggcagcagcgacgacggcgacgccaacgcggaggacgccgccttccggcaccggaacttcagctcgcgtctgccgccctcgccggtgccggcctcccgagccgtcgccatcgcctgaagtcctgaatcgtagtagtagcgatcgtcctttttaaccttttgtagcttccgtctctctggtttttcttcttgtatgaacgagacgaatcactacatctgtaaaagca

SEQ ID NO: 8984 - DNA, 716 bp, Triticum aestivum
  unsure (1)..(716): unsure at all n locations
  Clone ID: PAT_TA_8984
ccgataacgacatctccaaagaggctgaaccatctgaattcatcagaactgcgcttcccgttcttcagaaaaatggtgttgttcatttcctcgggttcggcaaccggctcggcttcgactcggtgcctgccgatctgcagaggctgcgatgcagatgcaacttccacgctctcaagttcgccccggagatccagaagctgggctcgctgctggtccagcggctgcggggggtgagcgcgatgcagacggagatggacacgcagctgttcggaagcaacatgctggagcggccgttcggggagaagggcgacgacgccggcgggccgagcaggtacctcgctctgcacctgaggttcgaggaggacatggtcgcctactccctctgcgagttcggcggcggcgaggaggagaggagggagctgcaggccttcaaggagacccacttcccggccctcgtgacgcgccttcggaacaccacggtgtcgccggaggagctgcggagccagggaggtgcccgctgacgccggaggaagccgggctcatgctctgcgcgctcggctacgaccggaggacgttcatctacgtggccgggtcgcagatatacggcggcgcgacgcggctgcgcccgctcacgcggctgtacccgaacctggtcaccaaggaagacatcctctactacgacgagctcgatgcgctcaagaacttctactncggat

SEQ ID NO: 8985 - DNA, 768 bp, Triticum aestivum
  unsure (1)..(768): unsure at all n locations
  Clone ID: PAT_TA_8985
atcccgcgccacacccccccttcgtcttcccccgccgctccccaattcgaaaccctagccagggttccacagccttccggatcgggagcggaggccaccggacgatggccgacggcgcgctgctcgacctgctgccccagatccacgccctcttctccgaccagctccgcgtgatttcgtacaaatggttaagcgtccgcggacgcgtgggcggacgcgtgggcaagaggttgcttcaggagtttgtcaacaaacacgggagtgatcatgaagttatttacagtgtgtctgggtggttaaagaacaatccccaaaattattgtgtaaaactcacttcaagctctaaacttgaagaagcaaggcgaacctttaaggattcttgttcagtccaggtttacagtatccaggcatgtattccaaaagatactgctgtactttggaatcctgaatttgtgcaggcagaggagcttttcaaccagccatttgatgaagaaaattgtttgagagataataggttttgtggtgtaagaaattcttttgtcaagcgaactaccacatgaaggcatgcgagctcaatgcccccaaagcctaaataagggtttacactcngnggcnaactatangctcnaaaggnattttnttttnacagaaattactaacatccntcaaggaaaaacaacttaactngaagtatccccgcttgtaaattatgtctttnnaaacctattgngggtnaaaacaantaaangaagccnccnangggtctgt

SEQ ID NO: 8986 - DNA, 777 bp, Triticum aestivum
  unsure (1)..(777): unsure at all n locations
  Clone ID: PAT_TA_8986
gcggggggaggcacgcgtccggttcataccagttattcgccactgcgtcaatcttcgcactttatgggttcttgatactgtgggtgatgaaggccttagggctgtggctgaaacatgctcaaatctccgtgagctacgtgtttttcctctggatgccaccgaggattctgagggctcagtctcagatattggtctccaggcaatctcagaaggctgccggaagcttgaatcaattctctacttttgccagcgcatgacaaatgcagcagtaattgctatgtccgagaactgccctgaccttttggtgttccgcctctgtattatgggccgccaccgccctgatcggattaccggggcgcccatggatgagggttttggggcgattgtgatgaactgcaagaggctcaccagactttcagtctctggcctgctcactgataaggcgtttgcatacattgggagacacggaaaactcataaagactctgtctgttgcctttgctgggaatagtgacatgtctcttcagcatgtgtttgaggggtgcactaggttgcagaagctcaagtcagagatagccttttggcgacaaaggattgctctctggcctgaactattttacaacatgangttctttggatnaactcatcaagctaactgtgaagggtgtggggattttctaaacaaatgctanctggnggtnaagtaatgaaggaaatnaagggaaatggtacgttataactgtactgtannatngttggaagacaagggaaaatctca

SEQ ID NO: 8987 - DNA, 868 bp, Triticum aestivum
  unsure (1)..(868): unsure at all n locations
  Clone ID: PAT_TA_8987
gcggcggcctccgcagtgggcggccgagtatcacgacgatatccgacggccggcgcgacgccgcgaacgaaggaccctctcctccgccgcatccggtcacttaccatcgccccgccgctgttgagcggtcagccagcggcgggcgccgaggatgtcaccggctgcccgggtgtgcttgtacggaagcccgccgccgccgccgcggccgccgctggccttctccggccgttcctgttctctgagcttttcgctatgtaccgtgaatggcaagaagagatggccaaggaaatcagtggaaaacagggagagctagaaaataagatagaaacggcagatgcattggctgttaaacttctccagcggttcaattactctgttacttcgatgagatcagcctctcacaatcttgctgaagttcatccattgcaggtggaagttggtgaattgaagggcaggttaactgaagtaataagtaactgtgacgcattgtgcaagaggattactgcagaagggccagaaagtttgcgaacgtccgtcgaacctttcaccactggcatactggggacgggaggtggatcccctgacccaaaagagcagccctgaggacactaatatgcctgcttgtctgaactgctggtgacataaaggcattgcagggaattacgtagttagtacggaggatgtcgatcagaacgatgtgccatgggacatacttcctccgtccgtaaatagtgctagatacatccgtttgagcgacaactaattatggatggagggggtactctttcctggattgattggattattggtctccttttgttggaattcattctctcctcttgtagggttaattttnccttgtgcgtgt

SEQ ID NO: 8988 - DNA, 905 bp, Triticum aestivum
  unsure (1)..(905): unsure at all n locations
  Clone ID: PAT_TA_8988
gaggaattcggcacgagggtngccggattggttgatgcagatcgtgaggtgtttgagaaaagatttcagagttctgggcatggcgtcgccgagtttgtcacaccaccaatggtgctaagcttcatcttgttcttcttgcggtgattggaatggattgggatcttctgcatggaagacaccgactctttttttggcatagtccccattactgctatcagctgggttcggccatgtattgggaatagaagaattgcacaactacaattggctgacctatgaagaatattgagactataatatgagagattcaaatgcagagtcagtgattggagaattaagcgctggcatggcaatgtttctatacagagtagcttctacaagtattagctcactagatagggaggccctaatgctgtgcatgtggtggtgtacgagagaccagaatcatccgggacatacatctgggcgccaaattacgttggcacaaagttaagacgtaccccgactgcactttatttaaactggcaggagaatcgacgaatctgtaggaaattcccttggatagcatcaagtaccgccaacaaataggaactctacaggatgtggtgggacagacatctcaccttctttatcattttgctcttttgatgttgtctaagtgctcagaaatgagtcgcgggcggcaatacaagtgctttctatatatgtcattgtttccctgaatatttcatgaaatattgaaggataacttggaatgacgaagttccaaatcttcagggaagatcgtcgcaaaggagctggtgaagcaccgcattgcctcacgtagaactatttagttcaagatagtattacctattttttctgttatgttttgttcaagttgattatgttgtacattgttttga

SEQ ID NO: 8989 - DNA, 967 bp, Triticum aestivum
  Clone ID: PAT_TA_8989
aggaattcggacgagggacgccccacttctcttcccctatcaagtttcaaatcgatgaaaacacccaggacaggcacggcaaagccgtttcgaatcaaaggggtggggttggggatgcatcaatgacaattctgcttctctaccggtgtccgtagatccgatcgttggagacaggccccctcccacgtcgcgcgaatggccgtgggcaggaggctggagctcctcgtcctctcctccacagccgacagcttccttctcgtcttggaggtggtgttcgtcgtctgttgcctggaggacccataccagccatcgttcaggctacccaaccagttgatgtggtgggctttgatgtgcggtgccttcccgtggagtgcggtgctactggcgttacagatgaagtggctgtcttccgaaggctgggagcccaccaatgtcgagctcctggtcctcatagccgtcgagtgggtcgtcgcgtgctccaccttcggctcggcgtgcgccgccctcgccgtcgaccagctcgctatccagcacagctactgccacccggaggccaccgtgtgcttaacgtaccttgtcgccgttgcgaccgcatgcgccgccggggccctctccgccatgtcggcactcgggatgctctggatcctcgcctcccggttccgcccggctcatgcggcctagtcagtcaagcaccagtgccatggttagcatatgttcacattttgacgtgaatagcaggagctctgcctttgctttatagtaggggggaaatgggtacagaacggatgccccgtcggggaagatccgagttcacacactactacatcagtgggaggcttaatctgaaagaaatatgccctagaggtaataataaagttattatttatttcctcatatcatgttaaatgtttattattcatgctataattgtattaactggaaacataatacttgtgtgaatacatag

SEQ ID NO: 8990 - DNA, 1091 bp, Triticum aestivum
  Clone ID: PAT_TA_8990
tcgacccacgcgtccgaaggaaatgtatgggtttactattcagcaatcacatcttccttgccttatggttggcaaccaaaagaaggcaaactatctaccaatggaggcctgcaagattgttgagggtcagagatacacaaagaggttgaacgaaaagcagatcacatcactgctaaaggttacatgccaaaggcctagagaaaaggaaatggatattctacagcacagttcatcaaaacggatatgaccaagatccttacgcaaaggaatttgggatcaacataagtgagaagctaacatccgttgaagcgcgcgtccttcctgcaccttggctgaaatatcatgatgctggaaaggaaaaggagtgcctgccacaggttggtcaatggaacatggtgaacaagaaagtgatcaacgggggcaaggtaagccactgggcttgtataaacttctcgaggagtgttcaagaaacaactgcacgcggattctgccaagagttggcacaaatgtgtcaaatttcgggcatggaattcaacagtgaacctgtgcttccaatatattcagctagaccagatcaagtagcgaaggcactaaagcatgtgtataatgtagcactacacaaactcaagggtaaagaacttgagcttcttttggccatcctaccagacaataatggagctttatatggtgacatcaaacgtatctgtgaaaccgatttgggcttgatatctcaatgttgcttaacgaaacatgtttttaagatcagcaagcagtatttggcaaatgtctcgcttaaaatcaatgttaagatgggaggaaggaacaccgtgctcgtggatgcgctaagttggaggattccgttggtcagtgacataccaactattatatttggcgcagatgtaacacatcctgaaaccggggaggactctagtccatccattgctgcagttgtggcttctcaagattggccggaagttacaaaatatgctggattggtgtgtgcacaggcacaccgacaagagctcattcaggacctttacaaaacatggcatgaccctcagagaggcacagtaacaggaggcatggtcagg

SEQ ID NO: 8991 - DNA, 774 bp, Triticum aestivum
  Clone ID: PAT_TA_8991
cgtccgatccattgcttcttcttcccttctctctccaagggtggaggagggggaggaggaggagagaattttctctcacgggccggggtaagggacatcggagcaaggagggaaggactcccactgcagaagtggctgcctccgtggcgtctttcgtagatggattacatatcccctgagagaagtctggatgggacttgtggagaccctggtcctttatttggagatcaagatggttgcttgttggagcacatggattatcatggtgaaggaattacacaacctgaatccccactactgaatgatggacttttagttgacgcagccgatcaaatttcatatttgtctgcagattctgtaccctatatgaatgatcagatcatgtgcaatacaatgaaatctgcttcgactagtccagcatctcccctgaagcaagacgaggaacatcatgtgcatatagaatctgatatgcaaaacgatgcagctgaacggaaagttcaccataatgatgactgtgaagtacgtaccacttctccgggttatgatgtgcatcagaatacagaagcggttgaaggtgtgcttcctccagagcttcatgaaagcagtggtaatgatatatcaaactttcaacaagaaactacacattctgatgcctatcttggtgactctatgttagctgataatagcagtagggattatcaatttagcaatagcggtgatgatgatgatgatgaaattccaaactcttctgcgcctcagatgggaaataaggac

SEQ ID NO: 8992 - DNA, 777 bp, Triticum aestivum
  Clone ID: PAT_TA_8992
cttcaagttttgtactcaatatatacttgctttcaaggctcaataatacatccatcatattccacgacaatccttatctctctcttgtaacagtcacgaccacgacggcggcggcgccgtgcccaggcagcggtccattgcaaacacattactaatacccacgcagcgcgtgcggtccaataataaacccagcgcgtgcggtccacgactcggcggcggcgccgtgcccaggccgcgagcacgggcacacagcgcttcgagaggcctccctcccgcgactgaagatcatccctctcgggcgcaccccacgcgcgatggcggaggcgcctctgctgccgcggaaggaccaggaggcgacggggtactggcggagcgaggccaggaagctggcgtacctggcgctgccgatggtggccgtgagcctgtcgcagtacgcggtgcaggtgtcctccaacatgatggtcggccacctccccggcgtcctcccgctctcctccgctgccatcgccacctccctcgcttccgtctccggcttcagcctgctcaccggcatggcaagcgcactggaaacgctctgcggccaggcctacggcgcaaggcagtaccacactctggggctccacatgtacacagccatcgtcactctcctggtggcgtgcgtcccgctgtcgctcctgtgggcgttcatgggcaatctcctggtgctgatcgggcaggaccccctgatcgcgcacggcgccgggaggtacatcgtgtggctcatcccggggctcttcg

SEQ ID NO: 8993 - DNA, 433 bp, Triticum aestivum
  Clone ID: PAT_TA_8993
cgtccgcggacgcgtgggcgccttggcgcacgagcccgcttccagcctccttctccctctgcaacgcgccctcctcctcgaagctggccccgccgccaccgcccgggcgagcgccgcccctgagctcctcgccatggcctctcttgcgcctcctctgatcctccctccgttttcctgcactgttgaatcgccggagcagccctgcatcccacagcccagccgcctcctcatccagcgccacatcgagctcgtcggcctcggcctcctctgcatcgcgcctcccgacgccaccccacctccatcgcccttgctgctgctgctagaccaccatggccaccttcccatgtttcttcttcggccatcagtgcatcgaacacccccaccggtgcctctatgatcgttgccaagtttggccaccaccgacaccctctaa

SEQ ID NO: 8994 - DNA, 669 bp, Triticum aestivum
  Clone ID: PAT_TA_8994
aggaattcggcacgaggctccgctccgcgctccgcccagacgcctacacgctcccattcctcctcctcgccgccgcccagtgccccgcgcccgccttcgccgtctcggcacatgcgctcctgcagaagctcgggctacacagccacgaccacaccgtccactccctcatcaccatgtactccaacctcggccgcccccacgccgcccgcagggtgttcgacggaatcctccggcgggacgtcgtgtcctggaactccatgataaaggcgtatcaggcagcggggatgaaggacgacgcgttgcgcatgttccatgctatggtcgccgagggcgcggtggcgcccaacgcggtaaccgtggcggtcgtgctcgcggcgtgcagggacaccggagacctggcgcttggcaggtggttggaggagtgggtgagatccgcggggatcgaggtgggttcgctcatcggctcggctctcgttgggatgtacgagaagtgtggagagatggcggaggcgaggagagtgtttgatggcattgctgacaaggataacgtcgcttggaatgccttgatcactgggtacgcacagaacggcatgtcaaaggaagccatttccttatttcacagcatgcggcaagcaggggcacgataaccttggtaggggtgctctcggc

SEQ ID NO: 8995 - DNA, 1766 bp, Triticum aestivum
  unsure (1)..(1766): unsure at all n locations
  Clone ID: PAT_TA_8995
ggccgcctccgccacccccagcgctcctagggttccatcttggctgctcgcgcgccgcgtcgccgttgccggggttcggaggaggggcgtgctgctcggggggaacccaaatcgggcctcgcgggagccgttcccccgccccgccgccgatgcctgcgaggtttcgcggctgagctttcgtttttgcctccgggggctcgcggcggggaggtctcggcgtttctggggtttagatcggggcctctgagctcgctctccgcaatgccggggaggtcgggcgtcgattgctagggttttgctcgtggatttgccgagagagggctggggatcgttcggaatgcggcgagtcgcccgaggtctgctgcttgctttcgcgcaatttgatgtttcccgaccagctgtgcctcgtcgatttggtttcctgctaagcctgtgaaggggcgaggaggaggaggggttttggggaggttgggacgagttgctgatttggccgcgatgtccgggtctagttcgagggggcgtctgtctccggcttcaggtggtggagactctgagccgcggtctgcggggagcaggacacgatctgtgtctgctacccggggtcggaaggcgtcgccgaggcctgggagggatgtcgcatcagcaacagcgacagtggaggagaagaagcctgctgcggtgcctacattgctcccttcgctcagcgtgccggcagggatgcgccggcaggagctgctactgcgctcagggttctctctcgacgcctcatgctcatcagacgcttcgacagactcgttctgcagccgggcatccactgggcggattgggaggccggtgtttgggccgaggaagaagaagaccgtctcccaggctgatcataaggtctctgccatgctggaaagggaggctggatctgcttctccaagtgatgcttctggtctgaagaggaggtgtgcttgggtgactgctaataccgatccatgttatgttgcatttcatgacgaagagtggggagttccagttcacgacgacaagaagttgtttgagttactggtgctctcgggttcactggccgaacttacatggccaacaattttgaacaagagatctatattcagggaggttttcatggattttgaccctgcatcagtctctaaattaagcgagaggaagattattgcacctggaagtcctagcagctccttgttatctgaacagaaattgcgcggtgttattgagaatgcccgacaaatactgaaggttatagaggagtttgggtcatttgataagtactgctggagccttgtgtacccctggcctgcattgtgcgcatcctggggtccccgtccgcggcctgtcaagacatctaaagcggacgcgataagcaaagatttggtccgaaggggtttccgcagcgtaggcccaacggtcgtgtacaccttcatgcaagtctctggcatgacgaatgaccacctcatctcctgctaccggtttgctgaatgcgctgcagccgcaaccggtgctaagcctactaccgaatctggcagcgaagcaaattcaggcgccagcaatcacgccacggagcaaaaggcgaacggggccgctaacggactagccgttgacatcgagctgtccagaacgatagacgagctcagcatctcgtagcagcggctgggagggggacgctggagccatgtataagcgttgtgtgcattttgtgtatcgtagggagcttttctcggcgtttaagacggtnaacagcagca

SEQ ID NO: 8996 - DNA, 681 bp, Triticum aestivum
  unsure (1)..(681): unsure at all n locations
  Clone ID: PAT_TA_8996
gcgcagtggagcggtgccgcaacaagaggtgaagatgacgcaggagaaagcccccaaaggtgggaccatctaccatcggccaccatgggaggactggcgactggcatgacatgttgcttttggagaagatcggtaaaggtggaggccattgggattttgggaggaacttccgccaaagttgggcatcggtagtgcagcagcatgagtggcgaacactcgacctatctccctagcaagaccacaccttctccgccacggcttctccctgtcggctgagctgctagcttcaccatccttcctcggtcgctctccttcgccttagctggctccttgaccccatggctcaagtatggtgtaagtgctggaagcagcgatataccctccacaagatgcacttgtagggcggccttaatttttgctacaacggccggagtaccaactgctgttcatggtggtgtgtacgcgattggagcaggtggctacggaggttttttttcccaacatggatggtagcataacctacggatcgatccaccacctcttcgacataggcatagtgtcggtctaaaggactctactgttgccgatttgtcgatttttatttcatgaatttttgtcagacttttggatttggctgtgtgcatncttagttacgcagaggccgggtgttatctcataatg

SEQ ID NO: 8997 - DNA, 402 bp, Triticum aestivum
  Clone ID: PAT_TA_8997
cgtccgcggacgcgtgggcgtgcaccaaggatcaccagcaaggtcaagaaaccaaacgaggttccgtggtgttctcggcggagctctttggcttccgttggtgagctgcgccgccacttcgtcctgctgagcatttcgtcgagcagctggtcggcggccacgggcagagcaggaacatttccatcgcctgcgttcctctcctgcttcttctcctggttcctcggtgcgatctcggcctctaaattccttcttttgggtggaaacagatgtcgtctagatcgagaacacagtatccgtgttagcttctgggtctggaggtcaagaagccacttgggctttcttgctttggggtttgggcagatgggctgcactggtgctcaccttggtggtctgctggtctgg

SEQ ID NO: 8998 - DNA, 796 bp, Triticum aestivum
  Clone ID: PAT_TA_8998
tccctaggaacgtccgggggccaccgtgcaaaattacccccttgctaagccctccaccgtcaccgaccgcccctggcaacgaagacgacgaaccaatccatccaatccctagtccctaggaaacaaggaggcgaaggaccaccagaccggcctcttctcgacgcggctccgccgctccgccgctccggccccgccgaccagcacgagggtttactgtcgttggctgaatcgagagctcgcgcgttcgtgctagtcgctaatccgcggaccggcggtcgttgtgtcagttgattcgccatggggagcaaggggcgcatgcctcctccttaccaccaccggccgctcccaggtcccggctctggcccgccgcatggcatgatgcaccatgatccgtacggcccgagcatgcaccaaccgccagggccggggccatacccctacgatatgttgccgccgcctgagatcctggagcagaagctcgcggcgcagtgtggagagatacagaagctggcggtggagaacgaacggctcgccgcgagccatgcatctctgaggaaagagctcgctgccgcgcagcaggagctgcagaggatacaggcgcagggggaggctgcgaaggtcgccgaggagcaggagatgagggggctccttgataaggctgccaagatggaggccgatctgaagtcgtacgagtctgtcaaggcggacctgcagcaggcgcacgccgaggcgcagaacctggcggcggcaaggcagcatttgttggcggatgcgcagaagctgaacaaagacctgc

SEQ ID NO: 8999 - DNA, 671 bp, Triticum aestivum
  Clone ID: PAT_TA_8999
gaggaattcggcacgaggctcctctgctctgccccccgcccggccacagcgccctacaccacacagcaaggcggcggctcgcctcacccagcgccgccgcggaccgcaaggttggtggtggcggcgtctgtcagcggcggccatccatggatcccggcgatgcaccggaacggattcgcgaggaaacgggttctcggagcagagacggcctgcctcagcgtgacgcgactggagcaggtccagatgctaatcgccatgggggagaccgcgtccttaccaagcgcctgaaggatgaatcgcctgacacatcggagccgccgccgtcacggctgaagaaggctgtggagctggagcctcaccccgctcagaacagagacgagcagttcgtctggccctggatgggagtgctggtcaatgtgcctaccgagtggaaaggagggcgccaggtcggggaaagtgggaaccgcctgaaggagcagctctcggccttttgcccgcacaaggtcagtcctttgtggaaccatagaggccacaccgggaacgccatcgttgagtttggaaaagactatgcttctttctgcaatgccttcaagtttgagaaccactttgaggcagaaggatatggcaagcgagactgggagcagcacaagtatcgagggcccgagatgttt

SEQ ID NO: 9000 - DNA, 735 bp, Triticum aestivum
  Clone ID: PAT_TA_9000
gcagcgatgcttcgccggctgcgcctgcctcctactccgggtgacccgctggacctcctactagatccgcccgccgcatcgtaccttctcctgctgcaaaaaaagcgggcgcaccggctacatccgacgacctcctgtcggtcgccgcggcccgatccacccctccaatgtccggatccgccgcggccctgtcttgcctcgcccacctgcttgccgatccgtggctcaagttctttcttcgtgcatgtgaagttcactattgttcatccgctcccagttcgtgcgtgtgcagttccctttgtttttgcagagcagcgatagaaggtggaaaaaagggcgaggccaaccctcaatctccaccgcgcagctacgcccccagcggcaaagtgcgggggcatttcaacagtcatgtgcagcatgcagtcagctaggcagcgagcttgcattctggcgcaaatggctgcacagtttgttttggcttattttgttccctgtcgcagtgcgcttgtgaatagtttttgcagttctctagatgtgtgttgcagtgcactgcataagatatggtctagttcggctaggtgccccgcacgactcacactctattttttcataggatggagttcactgtgtatagctttgttggtcactattgtgaaaaaaggattaaagatgtgagtgtggctgtgtcaaaataatgaatggatatgtatgttttgaaaaaaaaaaaaaaaaaac

SEQ ID NO: 9001 - DNA, 648 bp, Triticum aestivum
  Clone ID: PAT_TA_9001
gaggaattcggcacgaggcctcggccgccccgtgctctgccggcgcccgtcggcctcgatccggccttggcaggaggagctcgccctcgagacaggaggaggggagcaggaggatacaggagcatggccttcttctcgcgctgcagccaccggccttgtcctgctcgaggaggaggagcagcaggaggggcgcacccagccaccaaggtagccttcgtcgagggcttcttacacctgaacctcgatctccacggtgctggcgtccagcaactcaagttcaagggaaggagaggatgatgacgcccagacatggagaggaacaacagcagctcaagtgcctgcttataaagtggtgaagctacagggaagagggaggaagtcggcgacagggtgaaggagcaggccggccctcatggaggcagcgctaccagccagctagggaggcggtccggctcacctctgctatgccatgagcggcggcgctacctctgcctccagtctcacctcctctgccaaccattggaaaatttaggggagacccaagaataataattcaagcggatggccaatgcaccttggtgtttagcagtatgatggtcggtgaaagtatgttatatatatatattgcaaggatcataagatgctttt

SEQ ID NO: 9002 - DNA, 975 bp, Triticum aestivum
  Clone ID: PAT_TA_9002
ttcatctcgccccccgtcccctctccgaatcctgagggcgccagcctccagggacctccaccgcgattcgagctgccgtgccggccggcaggaccgcccgccgcaggcctccggctcccagggagggacgatggccgtgtacttgaacgacgatttggaagacctgcaagacgaccacttcgactccgacgggtttggcgtctccggcggccgcgacggccatccctcgagcccgaataagcataagagtgatacatcagccgtgcagtacagaaatggaaaagacatgcaagggataccatgggagaggttaaaatacagtagagatcagtatcgcaagatgaggctggagcattacaagaattatgagaacctcgcgaggtcacaccaggggtttgatatggagtgcaaacaagtggagacaaatgacaggttctatgatttctgcttcaacacacgacttgtcaagccaacgatagtgcattttcaggtacagttcccttcccctttttaagatatttatgcttgcattgatataagaaccttaacatcaaaggtgttaaacaacatgttcaattatttaaagaattccacagagtttgtgattgttgctcactatagttagctcaattttcaatattttttaaggaaaaatatatgcactcaaactacgtggaatgttttacttttcggaaaaaaaatagcacaagctgttaatatggccgcccacagttactacatcataatgcattgcattttactcctcatatgcagtagaagaactttcagtattcacctcattgtttacctttactagtgcaaatatttaactgttccctctctgtcctttcttcgcttatgtcttcggctccaaaaagaaaaacaagtatgaggaaaacttataccaaaagcatataaataataactggtgaatgcatgacatattcaagttatattagcgttgtgcattttatg

SEQ ID NO: 9003 - DNA, 612 bp, Triticum aestivum
  unsure (1)..(612): unsure at all n locations
  Clone ID: PAT_TA_9003
gcacgagggtcgaccaggcagtagaagacggtgttgatgttatcagtctttccatggcaccttcttcggtttcacctggccctgcagctttcctcagcgggcttcggacgcggctgctccttgccaccagagctggagtctcggttgttcaagcagtgggcaatggaggccctgatgcgagctcagtagtttcattcagcccatggataacaagtgtcgcggcttcgacaacggaccgcaagtataacaaaacaatcgtagctggaaatgggcaaattttctcttgcggcggcctttccccaccaacaccaggcgacacaatgtacccattagcattggcagacgacgtgagcaccgacaattcggcacttgatgggtctaatggttgccaggatccgaaggtcttcataagatctctagttcaagggaanntgattgtctgcatgattgtgtcatctaactactatcaaggtgacaactttgccggcattatcgatacgattcagaagatcggagctgctggagtcgtgatcattgatcgttattccggtgatgtagactatgaatatcagcccatatttcctaccgcggtaccttcagcnntggttgtgg

SEQ ID NO: 9004 - DNA, 1013 bp, Triticum aestivum
  Clone ID: PAT_TA_9004
gaggaattcggcacgaggcggttggcaagttgcccctgctgatctcctcctcctctgcaaggtgctctggcagcaaggtgcctctgctggtcccctcctcgtctgcaacaacaacagcagcaaccaggacatgcattagtttgaagacgggaccgtcgttgcagggcttcttgttggagggacaaccggcaccgagccactcaatgcatttatgggattatgtttctcccgcttgttaaagaaaccggaagggggtgggtcaacgaaggtgctggcttgaggattgatgtatacggtgggaagttcaaacagcataacgggcccgactctgatccggcctcacaggacattgatgctacgatttccgtctagtcgggacaaggcaagaagggtggccggttatacgttggtgacggcgccatccggaagaaggacattccgaatctctcccacctccgtgctaccacgtcgagttcaggtcctgctatagagcgttgcccacagcctgggctgcacatgctccatcaattcgagggccgcctagaggaagaaaccaggttgcggtaggaggcttatgccaatgccggcgcttaaacaggagcaagccatgaaaatgcagcaagccctatttcaacagcaggaatgatcactcgaggtttgcatcgtggatgccgttgggagtgggcatacatgctgcggtggagctcattgcatcttttaggttcacgcctggtgtcaacttggaactcacggccacggtcctttcatttgtgaactctggatgcctatgtatgtatgttgttgtgaaccttcgttggatatgtatgcatgtgcggacttggaactcactcacggtccattcgtttgtgaacttgtgttgcgtatgtatgcatgtgcggactttgaactcagggccgggtttcgttgttatatagttggtgtgaaccatcgttggatatatattgctggatatattttggttgatcaaaaaaaaaaaaaaaaaaaaaaaaaaa

SEQ ID NO: 9005 - DNA, 790 bp, Triticum aestivum
  Clone ID: PAT_TA_9005
aggaattcggcacgacgcatatttcccctccccggatccacccatcccgttcgccagctccgccctcgcttcttcccggtgcgccaccgtcagggtatacctcacatgttctaggtcgttggtgagagtttgtgcttcagatggctggggcgctgcacagttcttgttgtcgggctctgttattgttggctgtgctgttgctgactttgtctccaggcaatgcattctacttgcctggcagctacatgcacacatactcccaaggtgaggatatatgggcaaaggttaattcactcacgtccattgagactgagatgccgttcagctactacagtctgccatactgccgtccacctggtggcatcaagaagagcgccgagaacctgggtgagcttctcatgggtgaccagatcgacaactcaccctaccggttccgtgtgaatgtcaatgagtccctcttcctctgcaccacgaaagggcttaatgagaatgatgcaaagcttctcaagcagcgggcccgtgatctttatcaggtgaacatgatgctggacaatctgcctgtcatgcgtttcgctgagcagaatggtatcacagtacagtggactggttttcctgttggttacactcccgctggtagtgctgatgattatatcatcaaccatttaaagtttaaggtcttggtccatgatttctaaggaacaaatgtagaggtgatcggtactggagaagaaggatctgctgtcatatcagagatggacaagaaggggatgtctgggtatcagattgttgg

SEQ ID NO: 9006 - DNA, 445 bp, Triticum aestivum
  Clone ID: PAT_TA_9006
gcatggatggtaggaattcaactggcatccacctcataggaattcaactggttgtcagatgcatggatggtaggatttgcatcttcaggaagatcaacgggagaaggtggagccctatgaggtggatgtgcctgagtacaagaaggatgagcttgagaaaccagccccgctggctccaatggaggagaagccttatgaggccccttttgccagggtaacatcattggaggatgcttcaagcaagactcctgcttacaaccagcacccgttacctgcgcaggaacccgagacacttgcgcgtgcagcgagcgtgagggcacgcgtacctgagcctgctgcatatgcagtctcagccgaggagacacatggagaaaatggcaagcctcgaagcaaagaaccgaaaggcttcaggaaactgctgaaattcggcaagaagagccacact

SEQ ID NO: 9007 - DNA, 1588 bp, Triticum aestivum
  Clone ID: PAT_TA_9007
cgtccgcggacgcgtgggtcccagtacccacaagagttcgaagttcactgacgctgaaccaagatcctcttcgcctctaagaaaaattattcctgccagaagcagtaccccagggagtgatcctcacaaaacagccaaagcaagcaaactcggcggtgacagctcaagtgcagtgagcaagtcaacctcatcactggctgagatcaaaaaggagaaaagtggcagaactgaatcgtcgattgagcgattgaaaaagcttgctgaacctaaaagcaatgcttcgactgaccatccttcgaatcccaagtcagcgagcgtggatcacccacggagaaaaagcctgacgtggacggaagttgtgcagaccatgaaaatctctgatacattgctgctcgaggagaccaggtgggctgtccttccaaagctgaaagtacattctccccgaacccccgccgctgtcgttgcaaagaacaaggcggcggctaaagtagcaaaagaggcgccacgtggtggacctaaagcacatgctacttcagaaagtagagatggaaagaaatcttccaacggtaaagtttcaagggtaatcagcagtgatgacaatgtggtggttgagaagaccgtcgtgatgcttgaaaacgaattgttctctacgcctcctggtgttctccctcctggacgttgtcgtccgagctaaactcgcagcgatgaccgaatggacaatcccagcctggaacaggagtatgttggcatcagggctccaccttctactattgatcttcctgaagatgcaaatcctaccatccatgcatctgacagccagttgaattcctacgaggtggatgtgcctgagtacaagaaggacgagcttgagaaaccagccccgttggctctgatggaggagaaaccttatgaggccccttttgccagggtaacatcattggaggatgcttcaagcaagactactgcttacaaccaccacccattacctgcgcaggaacccgagacacttgcgcgtgcagcgagcgtgagggctcgcgtgccggagcctgctgcatatgcagtctcagccgaggagacacatggagaaagcgacaagcctcgaagcaaagaaccgaaaggcttcaggaaactgctgaaattcggcaagaagagccacacttcaacaatggattccgatgcatcgtcagtcgacgaagcccctgcaggagatggttcgatgctgaaaaacctcatttcgcaagacgactccgcgggctcttcatacaaagcttctcggtccttctccctgctggcgccgttccgcaagaacaaggtggtcgtgctgtgatgcggtgtgaggattttcttgtactatttttgttgttgttgttgatgaggccggccaacagcttgattgcgtatcgattgagattattagtttgttgatttctctaggtacgtacgtacatacatacatacatacatacatacgtgcatactatttcgtatatatatacttgcactgtacgcttgtgttgtgttgtttgtaagcagtatgtgtgatctgtccaaaaaaaaaaaatttacattgtattacaatctacacatc

SEQ ID NO: 9008 - DNA, 610 bp, Triticum aestivum
  Clone ID: PAT_TA_9008
ccgggctgaggaattcggacgaggcgccggtggacagcgctcacggcgccgcaggggctctacccgcgcccggccgcccgccgcaagaagctgcgccgcctcatcctcgaggccaagctcgcgccctgccacccgggcgccgacgaccccaggccagacctcgacgagtgcccaatctgcttcctgttctatcccagcctcaaccggtccaagtgctgcgccaaggggatttgcaccgagtgcttcctccagatgaagtcgcccacctcctgccggcccacacagtgtccgtactgcaagatgctgaattacgcagtggagtaccgcggcgtcaagacgaaagaggagaagggcgtcgagcagattgaggagcagagggtgatcgaggcccagatcaggatgcggcatcaggagctccaggacgacgccgagcggctcaagaacaagcaggttgctgcttcgaccgacgaagtaacgaccgcgcgagttgaatcttgcgataccggtggcacatccaccccagctgcaagcgctgcccaaggcaacgatgtggtctctggtcaagtacagcattcggagctgctattgaagaatgctgaacgcttaaggc

SEQ ID NO: 9009 - DNA, 436 bp, Triticum aestivum
  Clone ID: PAT_TA_9009
cgtccgcggacgcgtgggctcagtcgatggaccttttcatggtttaaattaaaatcgtttactgaagaggaacaccttactttggatagagattaaaatggtatctgcttggactatgttgcccatacaggtttgatctgtatatacatctgaagctggctatatatggatgggttgcagtttttttccttcaaaaaaaaagagatgttcttggattatttgcttatctactctttgcatggccatctattaagactattactgattacatggttttggtattttttctgtacactggcatgatctctaaaacaagtcgcaagccatatataggattttcatcatgtgtgttatttagttattatatagaaaaactaagcacataactgcacatcacagaacaatgctgcttctgagctgatgttgccattgataa

SEQ ID NO: 9010 - DNA, 627 bp, Triticum aestivum
  Clone ID: PAT_TA_9010
aggaattcggcaccccgtccaaccgccgtatctatggccgccaacggccagccggcggccgcggccgccaccatcgacgacctccctgaaatcctgctgctcgatatcttcctccgccttccctccctctcggacctcgtccgcgccgcctgcacctgcctgccctggcgcaacctgggtgaccaacttcccccccttccgccgtcaattcatcgacctccacccgggcgcccctcctcggcctcttcttcgacacgccgtttcaggctgtccccggcatccccgccttcgcccccgcccgccggaatgatccggagctcctggccgccatcttgagcggtgactttttcctcaccgccctccaggcgcgcgacggcccggaagctaactggagcttcctcgacgcctgtggcggctaccttctcctcatcaaagaggatgaggtattgctcctgctgctaaccccctgggcgcggtcctgcgtccggttctttggtccccctctctcccgcatcttcgacgacgacgacgacgaccgcgaaggcgatcgtcaactcctttacgccggcctgatctgcgatgacgaaaaccccgcgagctttggcatcttctgtcttgctgcccatg

SEQ ID NO: 9011 - DNA, 862 bp, Triticum aestivum
  Clone ID: PAT_TA_9011
cacacatgaacgccaccagcacgacacgatgcagacgagaccagcagctccatctccacaagtcgtcggccgcccccccccaccacgccgcgccccccgaggcgacgcgtgccgcctcccccccctctccccgtccccgccccgccgccgcgtcgggattgggcgccgctcgctcgactcccgccccgacttgcgtggcgtggggaggccatgcctgcactgcgctgctcgcctcccccggctcggctgcgggtcgcgtggcgtgctgctcgccgagccggcccggctgccggtcccggcccgcctgctccacagagagcagggaagagcgttcatatacctgctgccaggggcagaaagggtgctccttggagaagggtgccgcccgcaccagcatgcaagaaagggggcggaagttgttgacttggaggctatcccctgggctctgcacacccccctagcgctggtcccacacgcgcaggtgttggggatcccaaggaccctgctttgaacaaggttgttcagtgtgtcggcaataaaggtttgagaatggatggtgaaagtgctgaaaagcttgtcggcgctgaagaccgttccagaattgcccccatccccggggggggtcctcgttgccatttctcctgggcatgtaactgacaggaaactacgtaaaggtggctttggtcaagtgtatgttggtagaagggtatctggtgggactgcccgcactggtcctgatgcatatgaggttgcattgaagtttgggccccggagggctcaagcgtgcggtcctgcaccccctgttgaggggccagttcttcacactcgctaccgcgccgttggtcgaccggcagtccactat

SEQ ID NO: 9012 - DNA, 1141 bp, Triticum aestivum
  Clone ID: PAT_TA_9012
ccgggcccctgtcggaacccggtgtttgttccagctctgtcccgttgtctgttaataaaggcttttcttgccctcagcactgcctcacggttgctttacctgtatgttgttgcagttcacatgccctctccgggcggcgtcccctccttgcgaatgtcattgtgtcatgtactcgtctcctgcagagctcaggggccgacaagacgcagctgggagtgtaggaaagggaactgcaagtccgtcgaagccgacgtcctgcctctgtcgggcccttcgtttcactcttccgccgggtgatgattccggccgttgcgcacggttggacgtacttcccctggcagcgtcccccgcaggccgtccagcttgcaccggaaggatgagattacccccaaggttggcggacaggcagcacgctactcctgttgctcacagacgccatggtgttcgtgtcgagtcgcgggatcggtcattgctgcgttgttgcttcgacggacttaccgcgtctagttctcgtgcgcgacgtcactctagcagggggtcgacgagtttgctcatcagcaccagacgggccaagtttaggaacacgatcattgttccagcactgtcccgttgtctgtgaataaaggcttttcttgccatcagcactgcctcacggttgctttatctgtaagtcgttgcagttgacatgccttctccgggcggcgtccattccttgcgaatgtgattgtgtcatgtacccatgtcctttagagctcaggagcctacaagatgcagctggaaatgtaggaaagggaacgggaagactgtcgaagccgcagagctgcgtgtgtcgggcccttcctttctttttctgcagttacacgatgtcgacgagtacgctctgctgcacctgtgttctggaactgattgcgcaaccgtgccaggcagtttcttctgatggatgagatttcaggtttggttgggggataggatagagattacccatgtttcgtacagctgctattgtttttgtgtcgagtcgcgggatcggtcatttatttgtattagcttcgacgtacttctgcttgtatcgtagtgcgaacatggtttagcatgcagcaaaagtatcaggttattcagaatttcagcacccatacattat

SEQ ID NO: 9013 - DNA, 770 bp, Triticum aestivum
  unsure (1)..(770): unsure at all n locations
  Clone ID: PAT_TA_9013
ttggtcaaaggctggaagggtcttgaaatctcactgcttcaatgccctccctcaaaatgttaatttacggttttggggggcagttaccgcccggggattaccctatctatcatagttgggcaggctattgatttggggctgtgcttgcccgcaggcacatcaaaacatcgcggacatacctctgctcgaccggctggggcgaaaagcacaggctctttgtcaagtggaggcacttggaagcaaaagcaccggtgtacgactaccggggggcttatcaccgactatggttacactgagaaaatttacggcgcggacgtagccacgattcattccgcggaggagtccatgagggagtcaacagcagtatgtgaggccgtccacaccccttcgcactttactcggcggacgagaagatccattagggctccgaaggcgaggatggcgtcaacaaggacctctactgcaatgttgacgggacacacgagatggtgccggcactgcgagatcgagagggtgccctctagccagttgggggcgggttgcaccgtgctggagccgcgcctgaggatcaatccatggctgcccattgtatcattcccgtttggtgttccttggttctcaactggctaataattcacgagggcgagtccccatccccgattcttggattccttccatgccgtatcaaatgtggagctgaaccgcacaatctggaaatgccagtcaccgaaaggaataacatcctnagctagtttcagcagccgaaatag

SEQ ID NO: 9014 - DNA, 912 bp, Triticum aestivum
  Clone ID: PAT_TA_9014
aacggaggcgtccggaaccacccgagccaccgccggcagacgggcccgcccgctagtgctgtcaaccgatcgaagaggaccgtcgccggaccaggtccgggcgcggcggggcacgcaaagggcgcggcgaggcccgcgccaaacgccccgcggaagtactgcgcgaccatcaccaagccggcgacccggaggctagcccggaggggcgccgtgaagcgcatctcggagcgcatctacgaggtcatccacggcgagccccgcagcgtcctcaagaacttcatccgggacgtcgtcaccgacaccgtcccctcccgccagaagacccgccccgccacggacgtcgtctacgccgtcacccaccaccaaccaccaccgctcctccaaccccacattcgctcatcagcagctcgaagcggatcgtcggcgaccatgtccgggcgcggcaagggaggcaaggggctcggcaagggcggcgccaagcgccacaggaaggtgctgcgcgacaacatccagggcatcaccaagccggccatccggaggctcgctcggaggggcggcgtgaagcgcatctcgggcctcatctatgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctcgtcctcgcccctccctgcatatcccaaaagtttgatatgaatgcgacttgtttagttccctacttcctctgtagttcgaagtgaatcgtgaaacaaagctattcgcatctggagttggaaatcaaacacctgtgtctgtgcaaaaaaaaaaaaaaaaaaggccccta

SEQ ID NO: 9015 - DNA, 716 bp, Triticum aestivum
  Clone ID: PAT_TA_9015
gaggaattcggcacgtggggaatttcatatttattctgtttgtttcacttggtattcctgtcctgaacatgggagatgaatgcgggcactcctctgctggttcgacatcatacaaggatagagttcctctaaactggaaggccttgaagaccagttttgttaaggaagttactggattcatttcatttctagctgcactcaggagtcggcgaggtgacatttttcagagaagagaattcctcaaactggaaaacataagttggcatgggaacaatctatctgaaccacgatgggaggatcctactagcaagtttctttgcatgcacataatcgcagaaaatgatgttaatacaccagagttaaccaaaggtgacttgtacatatgtttcaattcaaatgaggaaccagcaagtgctacattacctgctcctgcagaaggatctgtgtggctacgtttggttgatacatcacttgcgcttccaggtttctttacaaccgagtctaatctgaaagtacaccaagtgctaggatattcatcttatgaagtaaaagcgcacagttgcgttttatttgaatcaaagagggatctcccccagtttctctgataaagtagttagtctgttgacgcctacttcctactttcagagctatggctggaataagttgatctgtactgtagctgagaatgtttatgataataaaatgtagcatttgtc

SEQ ID NO: 9016 - DNA, 849 bp, Triticum aestivum
  Clone ID: PAT_TA_9016
ggcgcacgcgtccgcaatcacctctccatccgtagagccgatcgaagcaagcgaggcacccgtgttcgcttcgccgaggaagggcggagcgggagaggcgggcgggcgagccggaggggcggcgtcgcgcggcggcgggggcggagatgacggacggccacctcttcaacaacattctcctcgggggccgcaccggcacgaatcttggtcagtttaaagtgcactctggagggctcgcatggaagagacaaggtggaggaaagacaattgagatcgataaagctgatttaacttctctgacatggatgaaagtccccagggcatatcagcttggagtcagaatcaaagatggcctgtcctacacatttattggcttccgcgaacaggatgtaagcagcctgatcaatttcatgcaaaagaatttgggcatctcaccagatgaaaagcagttatctgttggtggtcacaactggggagggattggcatagttggaagcatgcttacctttatggttgaatcgaagcaagcatttgaagtttctctagcagacgtctcacagacccagatacaaggcaaaacagatgttctcttggagttccatgttgatgatactactggtgctaatgagaaagactcgctcatggatatgagttttcatgtacccacgtcaaatactcaatttcctggaaacgagaatcgtacttcggctcagatactgtgggaggcaatacttgctagggctgataatggttccggctcttctggagaggcagttgtcacctttgaaggaatagctattcttacaccaagaggacgatacgccgttgagcttcatcttccatttctgc

SEQ ID NO: 9017 - DNA, 456 bp, Triticum aestivum
  Clone ID: PAT_TA_9017
cccaggtccggcgccggcgcctagcttggtggcgctaggactggcggggcccaggcgggcccccgcgccggcccccccggcccgcctcctcctcctcctcgtcgccctcgcccgccgtgccgccgcccgccccatcggccccctcaccccgggaagcccgccggcccctcacacgtgcacgaatccgcagcagtcctacaccaggggccgccctttccccggcccttgcccccccccgggggcctagggccgcccgggtccctccgaggaccttttgccttttggtcccccccccggggggtcctttctctttgagcgcgcagtgtggtgttactgcgccgtatatgtatttgtgtttgattgcggtagctgctgcaatcgttttctaccgatcggttccggaacttacattcgattgggaaacttcatctcatgtagctgaatactgtttgcctc

SEQ ID NO: 9018 - DNA, 341 bp, Triticum aestivum
  Clone ID: PAT_TA_9018
cgtccgcaccgaatagcccccatcgatggcgctctaggctctccctccgccaccctgtcgccggccccgtcgctcccccgccctatcgccggccgcgtcactcccccgccccgtcgccgtcgctcccccgccccgtcgccggccctcccccgacccgtcaccggccctccccattcaccctggcggcagccctgtcgctaacccggcccggtgctaagcctacccctcgtgcacgggccgccctgtacaggtgcagggacacgacggatccgtctacgccggcgtcttacacaccacctccctcgacgctggatacagaaatgactgaactcgtaatgctc

SEQ ID NO: 9019 - DNA, 532 bp, Triticum aestivum
  unsure (1)..(532): unsure at all n locations
  Clone ID: PAT_TA_9019
ccggagtgcatcgtcgtgagcggtgagccgctccgacgtgcgccgctgacctcgctggatcaaccatgcctaagtctcacagccacccagatccacccgtcccaatcctccatgtcgctggatcttatggttccaaggcacactgcctccatctccggccatcacgagacccgaccctgccatgccatgcgatccagctgctagaaagtgtcgcccctcttccaagacgtcatcgagttcctgccacacgcatccgttggatacggcgtcccggtaccctcggctgcggatctagccgcaactctgttgttccccttttgcgagactcatttattgggcggatggcgtggtttgtgtgttaattcatgtcttgatatgtagtgcagatgctcctctcgtccatcccatgttgggttgttcaattaacctaagcnaananttcttggttgnacnttcaacanactttcngtgtctgttcaacatttgtcctttaaaaaaatancaacatttttaagcaaanaaaaaaaaaaaa

SEQ ID NO: 9020 - DNA, 610 bp, Triticum aestivum
  Clone ID: PAT_TA_9020
acgcgacttcgacctggagatgctcgcgctggaccagtaccagcagaagctgttcgacaaggtgtgcaacaacgcgcactcgcctagggcgagctggggcgcgcccaacgggggcctcggctcgccgcacgccggcgggtagcccgccagaaacatgccggactacaccgacctgcttgggtccatggacccggccatgctttcccaggttcacgcgctgtcgctgaagcaggcgggcgacatgtcgccgtacagctccatgccggacacgcaactgcacatgccgaccttgccgatggtgggcgcgaacaactcgttcggcctcgaccactcaatggccaaggccatcatgacctcccgcgcctccgcgttcgccaagcgtagccagagcttcatcgaccgcggcgcgcgcgccccggccgcacgctccctcatgtcgccggccaccacgatcggcgagccatccatgctcaccgactggggctcccccagcggcggcggcaacctcgactggggctcacccggcggcaagctggactggggcgtccagggagacgagctgcacaagttccgcaagtcggcgtccttcgggttccgcgggcagtccgcc

SEQ ID NO: 9021 - DNA, 2183 bp, Triticum aestivum
  unsure (1)..(2183): unsure at all n locations
  Clone ID: PAT_TA_9021
gcgccgccgcgacccgcgcaagtaccactactccggcaccgcctgcccggacttccgcaagggcgggtgcaagcgcggggacgcctgcgagtacgcgcacggcgtcttcgagtgctggctccacccggcgcgctaccgcacgcagccctgcaaggacggcaccgcctgccgccgccgcgtctgcttcttcgcgcacaccccggaccagctccgtgccatgccgtcccagcactccagccccaggagcacgcccctgtcgccgctcgccgagtcctacgacggctcgccgctccgccgccaggcgttcgagagctacctcagcaagagcatcatgtcctcctcgcccaccagcaccctgctctcctcgccgcccaagtcgcccccctccgagtcgccgccattgtctcccgacggngccgcctcctatcgccgcggttcttggcacgaggcggccccacccacaggcctcagcctcagtcctccactagcagatctcttcttcccatagagcagagcgagcagagcagccagcatacagccatgacgatgatgcgccagggagggcccccgccgccccggggccaccgcctccccgtgcgcccgccccgccgcggcggccgagcatgcccagaccagacgccccccctgtgcgcgcccccgggcccgtccctgccgtgcagcgacgtcctcgccggcggacggcgccgcccggcgcacaagcacaagggcccactccgccgacgcggccctgacgggggacatgcccgcgggcgtgctcgccaccgacgacttccgcatgtacaggctcaaggtcaacccgtgctcccgcgcctacacgcacgactggaccgagtgccccgccgcccacccgggcgagagcgcccgccgccgcggcccgcgcggcgtcccatccgcctgcgttccccgcccggacgtccgccgggccccggggccggtgccgccagggcgtcgccggccagtacccgcacgcggcgatcgagtcatggctgcacccgaggcagtacctcaccaggctctgcaccgacgaggtcggctgcccccgtcgcatcggccacttcgcgcacgccgcccgccagctccgcgccgtcggcgacctctcggctcaaggagccgcgcaagctcgccgcccatttcccgccagtggcgcgagcccgagcagagggtggcctgatccccccccggcgacgatcgacccaccactggctcatagcatcgagctcaccaaaggtcttcccttcaactttgtcagccccttttatttgcgtaatttgcttccctatctgccgcttccttcgtgcctacatatatcctgttcacaaaactaatatcgatgctcttcaggcaatccgcatggatgcccaaacggcgcattaggctgaggcggaaacaccagcgaatattttgctcccgcctccccttcccgccggcttcttgtacatagccgtccacaacaattccatcaccgagtttatttactgggtattcacgttcgccaagcgtagccagagcttcatcgaccgcggcgccctcgccccggccgcgcgctccctcatgtcgccggcgaccacgttcggcgagccttccatgctcaccgactggggctcccccaacggcggcaacctcgactggggctcacccggtggcaagctggactggggcgtgcagggagacgagctgcacaagttccgcaagtcggcgtccttcgggttccgcgggcagtccgccatgccggcggcctccgcagccacgccagccgagcccgacgtgtcatgggtgaactctcttgtcaaggatggccacacaggcgaccattttccgcagtggctggagcaggagcagatggtggcctgatcccaccccgtcgacgaccaaccgatcgatcactggctcatagcatctagctgaccaaagttctttccttcaaattttttcacccctttttatttgcttaatttgattcatatgagatggttctttagtacgtacatatatgctgttcacaaaaataacattgctgctcatcagcaatcagcatggatgcccaaagggagccttaggttgatgaagaaagacagccaatatttactctctttcccccccttccttcggtccccacgcgtccaactcgcgccgtgaccngcccccccgctactgggtaatan

SEQ ID NO: 9022 - DNA, 550 bp, Triticum aestivum
  Clone ID: PAT_TA_9022
ggtcgtgggggatgaatggatcaggaagctgccgccgtcgccgccgctcccgtccacccccctccccccgctcaagaggctgcccttgcagttcctgctgcccgacaccatcccgatctccacctctctggtcaaggccgtcggccgtgcgcagccggcggagaagtcgcgcggtggcgggcgagctggactaggtcatcggcatcaacaaggagatctgacgcgtggtgcggatcctatagcgacgcgcatgaacaaccccgtcatcacctagccgccgtcgcggtcaacgtcgccggcgcctcgccggcgccagaatcaatcatcgccgccggcactccatcatggacgctggcgccagagcctgccggtccgtggtggttgcggcggcgtcgcggcgaagccgtcgacctcgcctaggctcaaaagaggagaggattacgaagatgctgggagaaacgacgggccgaggtctgtacaaaataccggttaattacaggtgtaatcgaacgaacctgtgtaaatattacggaccaaaaacgatcaacca

SEQ ID NO: 9023 - DNA, 505 bp, Triticum aestivum
  Clone ID: PAT_TA_9023
cccctcctcctccgattcgcgtttggatcccagcgccaaacttggcggatgctgtacaaatggcggaggcgctcgcgtccgcgggtgggctcgccatggcggcctcgacctccttcacgcccggccagctttctgcttttctgggatttctttgggttcttgcggcctgcgtgtatgcctgaggttctctttcatgcgaagaatgctgcttcacttaaaacacactcggacatcaattgatcacgacatggatagcagctcaaacaaaggagaggatcaaacaatgttactggaggagggtggtccagtagctggtgcaaagccagtttatgcttctttcacatcacagatgctcacacttttctgtatggacgagacacttcttctggagcatcgattgacactgagggcaacatccgagcttggaggccatctactttatttctacatatgtgaccgcacaaatatattcggagagtctgaaaagaattacagccgagatctc

SEQ ID NO: 9024 - DNA, 406 bp, Triticum aestivum
  Clone ID: PAT_TA_9024
ccgccgccgccgctcccagtacaggaggcaccggagaaggaggaggcggcatcgccagcgtcaccggcagcatcatgacatgggccacgtggccaccaaaatgcgcatggttacccttgcgaatgagtgggaagagtcactcatatactcttgtatccgaataccacaagatttggaaggatgctatttctgcaaaagatatttcgagaaaagaaccggtaggcggtgtgattgccttgaaggagtccatgaagtacttcgatgctgattttttcaacgattcaaaactacgtgagatggaaaacggcgcacaagaatttaatgtgcctgcatttagagaagaccgaaggttggtggctatcaaggatggtggattgcatgacccttctgttctagtcttcaaatc

SEQ ID NO: 9025 - DNA, 525 bp, Triticum aestivum
  unsure (1)..(525): unsure at all n locations
  Clone ID: PAT_TA_9025
ngaaggcnacccaaagccttgacaggaggcttcccaggggttggcaatcccagtaaaaatngttnatacactacnggaggacacggaaaanccagcttggtgttgatggcaactgtgagcgaatcgttatgcatttgttggtgtaagtnacaccatatcagcntttggacnaatcggtacccagcgagaacatttgagggttcggacttcaactagagacgcctgcgtcggattaatctttccttcggagcgccttccatcttgggatatgtaatataacaatgcgatggcgaggaggggagatggttggccgattgaccatcttgcaatgagctcccttggtttctatttatcttgcagacttgtatgccaatcaaggattgggaaatgcaacttgtactggagtagaaagagttgataccgtattgggctattgaccagttcgcttttcttatacctgagggtttaatactttttatgtaatatatatattatctcatgcatgcatcagcggctccgttgcgc

SEQ ID NO: 9026 - DNA, 683 bp, Triticum aestivum
  unsure (1)..(683): unsure at all n locations
  Clone ID: PAT_TA_9026
agccgccgccgctccgcccccctccggcgggcggggccgccgccacagtcactccaggagggtacgtagggaagcaccgcctctccgccgccatccagcgcctcgaccaggagctccagtcactccaggatgaattgaatgagcttgaaaccatggaacctgcatctgcggcatgccgggaggtgatcacaagtactgaaggaaagcctgacccgcttcttccaatcacaagtagcccggagaactcttcctgggacaggtggttccagcgcgtgcgaagctcccgcagcaacaaatggtggcaatccaaaggctccgattttgcctagctttcgccgaagctgagacaagctgtgtgcagattgaatctcccctgatccgtatggtccatccatgggatggcttggcaacatgaatacaacccagtttttcctgagaattgttgtgtatgtaatcccttaacaaaaacatgaatttgtccccattagtcctggattgctgttcacgaaaatagtcctgataattcatctagccattgttcgattcttatggtcgttggagcaaaattggtcctgtacttttgggcaagtttgttgacctttgagcaaaatttctcatgtgcatctaattttgttgaaattagttgaagcaccgcatttcgtgtgcccnnncggccgctcgaa

SEQ ID NO: 9027 - DNA, 1489 bp, Triticum aestivum
  unsure (1)..(1489): unsure at all n locations
  Clone ID: PAT_TA_9027
gccccccgcccccccccccccccctcccgtcccgccccgcccgagacacctttgccccggtcgcccccgcgtccgatcccccgcccctccgttttcggcgcggccgcgaggagagttcgtcggcggcggcgatgaggtcggccctgagccgcctgatccgttcctcctgctccgtctcgccctcccgtctcagctcgccagttctgttgaagaacggcaaggcgttctcgagcgatgccacgcccagggattccggccgggtcgacgagcctttcaaagtcgaggaggcagaacccgtgaaggtgccgccgccgccgccttctcctcataagctgcttgtgctaggtggaagtggtttcgttggttcacatgtttgcaaggaggctttggagagaggatttgttgtctctagtctaaatagatctggaaagccatcgataagtgaatcttgggctgacaaagttatatggaatcaaggcaatctccttgaacctgcttcactggaggatagtatggatggtgtctctgctgttgtatcctgtgttggaggctttgggtcaaattctcaaatgttcaaactgaatgggactgcaaacatcaatgccatcagggttgcagctgagaaaggcataaaaagatttgtgtatgtgtcagctgcagactttggtttagtgaattacttattgcaaggttattatgagggcaagagagctgctgaagctgaactgctgtcgaagtttacctatggaggagtgatattgcggcctggttttattcatggaactcgtcgagtgggtagtgtgaacataccccttggacttgtgggttcacctatgcaaatggtgctccaaaatgcaaaaccactaaccagattgccacttgttggcccgatgctaactcctccagtgagtgctacctcggtagcgaaggtcgctgtaagagcagcgacggatccggtgttccctcctggtatcgttgatgtgtatggcatcatgcgttacagcgagcagaagtaagcgtatgcttgtacaggatgataaggcgtgtctccacccatcttttgttacctggtttttcctatttgctctaaatgtgtaagcggacatcacaagaccatggggtctcagctacggtcgcagattctctgatagttgtatcctggcgtggccctgtttgcctgatctacttactagccaaggatgtgctcaataaagaagcagttaacctcgagtttcctgttggaaactgtttttacatgcttgttgcttgaaagtgttccttttagttactgtagagagcaggttaaggtttgtaacttactttgagtttatggtaaggaaaactctattcctggtcgattgaaccgattggtnggataatttcctaaagttaacccgtaaccgattgggtgctttggggaaaactantagcatacaacatgtttacttcccntggtatatttcccaaccaatcgttnaaaaaaaaaaaa

SEQ ID NO: 9028 - DNA, 953 bp, Triticum aestivum
  Clone ID: PAT_TA_9028
ggccgcccctacggataagccggccaacgcagcctccctccccagccagccgccacggcgccaccacctcctccccctgcagccatgtacatcgggagccgaccacgcgcctggcctaggtgggtctcagcctccctccccccttcgtccaaggccaggagctccccgccccgacggatcggatgcatcaaggcagtggcgacggtcgcactgctcccctatagatcgagcaaacctaccccctcccctgcatcggtagcgcctgcagacccaccctccgctcaccctcacaccgggctctccacgtgcctgttcttctctgaggggaccctcatctctctcagcctccgcgaggagaaccgccctggcttgcccctggccgtcgatgtccagatcaaggtttccgtaggaggaacaaggtttgttgtcgtcggatccatgaagatttgacgccttcctcgcgatggtgctggttcatcggccagatcccatcggagagtaggaggttcatggcggagggctgcacggaggagagggacgacctcgcaggcaccgcgtcatgcgactggcccttgttacgccatggctagcgaccccggcgacgcgtgcaaggccaccagcgcgaaaagcggcgcccaaggactgacacctcgccacgatcgtcggtgcccagtcgcacaccaaagtcggcaactttgacaatccagtcaatgcactgatggatggatcatgcaggttgctctgcaggttggtctaaagacactggtagaattgcacctgcaagctctgaacattcatgtcatcaggtgattagcttgctgcttagattaggacacaacagaggcttatcagcatgtgtgcgactaacaacccattgcagctgtgcttggtcgatgtggactattctttcctcacacaagaaaaattcaattgtcttcgtgggaaattaattg

SEQ ID NO: 9029 - DNA, 848 bp, Triticum aestivum
  Clone ID: PAT_TA_9029
ctttcctctcttcatcgcgccgccaccttcccttctcctccggcctcgccttttcctcccttctcctccggtgcctcctcccaagggaagtgaagggaaggatcgagcgacaaggtgaggcctaaatccacatcggcatcagcgcttcgtcgtcgacttcatccccgaccgtcctcgagaggtaggccatggaggtccggtccggcccggcagcagccatggatggagacgcccggaaccctagccctccaaggacgtgcgccggctgcaggccatctcccggcgagggcatctccggcgagctcatccacgggtcctccgactatgctgctccgatctggaagagggggtggagctgctgctgctgcaggtggacgagacacgagctctcatggctgctccctcctcctaccccctgacgtggttgctctgatgaggacaagctgcttctgcaggtggacgggccctcatggtcgccgcactctctcatcgggagttggcaggagaagcgtcggccgccgaagcagacgagccgagccattagtggctgcatctttgacgtcctttcctagcgtgctcgccagcgtacgctgtccaccggcagtagcaaggatctggttatatggtgcaggatcatggtgcaggacccaggcactcaaactcaaagcatactaacaaccaggcctggagatatagtttgcacaatgttctgttctgccatatgccattttgatatggctaaaatgtttgcttttgatatgtgtcagaattttggccccccgccggccagtgataaataaaagctacatgccattattgtattaaagctcgttgtcaaaaaaaaaaaa

SEQ ID NO: 9030 - DNA, 968 bp, Triticum aestivum
  Clone ID: PAT_TA_9030
ggcatcagcattggaggcttgggcgagaaccaaagtaatgacaggatacacaagatcaagatggacactatgctcctctccaacaccaagaacggcgtacgcgtcacgaccttccggaacggcctccgcgtcacctcgccggtgtacagccccggcaccgccggcgtcctcgtcgtcagctccaccaacgtgcacatcaagaatgacctcttctccgtcggtggcgactgcgtgtcgattgtgggcaattgctcggatgtccggctcatggcgatctcctgcgggcctggcctcggcatcagcattggaggcttgggcgagaaccagtagtagtcacaagatagagaagatcaagacggacaccatgttcatctccaacaccaagaacggcgtacgcgtcaagacctacgaggacggctgcgggttcgcgcgcaaggtgaagttcgcgcagatcatgatgaggaacgtggccaaccccatcggcatcgaccagcactactccgccgcccaccggggaactccatgcggcgccccgaacgggagcgcggtggcggtggagaacatcaactacatcgacatcaccggcacgtcggcgacggagcgggcggtgacgttcgcgtgcagcgacgccatgcccgtgcaggcgcctgtatctggacggggtgaacctgacgacggccggcgggggcagcacgtccgcgttctgccaccaggcgttcgggaagcacgtcggggacgtcctcccggagtcgtgcctcggcaaggaggacttcgtgcagctgcaagccccgaccgccggagacgctcaagacgaagaagatgctgctgattggtgaccctgttcctagaatttgatcttgtagtgcgagcttgtatgcagtgtgtgtggattcatgaaataaatcattttttgtttgagatataaatgaacatgccttcaaccccttgcagcccggccgaggcaggcc

SEQ ID NO: 9031 - DNA, 431 bp, Triticum aestivum
  Clone ID: PAT_TA_9031
gttgagaatgaagtttctgcttttgttgactttctgataaattacaaaaacatcgacaaggttatgtgggagccttttatagagtcctcatgttttcagttaaatatacttcgaatgttgtttttcatgcactggatgtatctcccagtactgtggtgtcgctaaattcaagcaagcagcttaatgttaacatatcagagcccttcatcgaggattgaaaactacttgttacatgtagtcttcagaacctgtgctgaaatggcatttctttgtttggaaagtgttaaattttgcaaaacttttggctgtcttgaatagttttcaagttgtttcagtgacatcagttctgctaagaggttttaaatgtgaacctaactacctgttaccataagtgaccaaacttgtggtggtgtgcaatgttcacctaactt

SEQ ID NO: 9032 - DNA, 441 bp, Triticum aestivum
  Clone ID: PAT_TA_9032
gggacgccacgcgtccgcccacgcgtccgcggacgcgtgggttgcattttgcctacaggtaaggaaacttgtaccttatttctgcaaagatgtgctctattttttttattccatgagtatttgcattccctatagaagctgactggttaagataaaagttgaagaatgcatacgatagtcgattggaaacatatatctagtagttcattttttcatgcgcacaatgggataaattgatgtaacacaagactttacaacttagtgctgttgttattagaatcaggagacttgctttgttaccgtacttagagttgccgattgcttactatagtaatagccaggaaggtttgtagtcaacttatatgcagttgtaattagtcgacttatgctccttaaattggtgttctttggtgaccagtgaatgggcaattgactcttgcg

SEQ ID NO: 9033 - DNA, 934 bp, Triticum aestivum
  Clone ID: PAT_TA_9033
ctcagattacaaatttgagatgtccataattactccaatgtagtaaccaacccatactctgtaaactgagctttttaaatacttcaaaaagaagtatacaggcaagaatgtgtcttccataggtatgtttactttttctaaaagtgtattcaaatgggagtagtatgtaaaaaaggtgaagactaataatgtggtatgcatatatctagtagttcattttttcatgcgcacaatgggataaattgatgtaacacaagactttacaacttagtgctgttgttattagaatcaggagacttgctttgttaccgtacttagagttgccgattgcttactatagtaatagccaggaaggtttgtagtcaacttatatgcagttgtaattagtcgacttatgctccttaaattgttgttctttggtgaccagtgaatgggcaattgactcttgcgtatatggctgatctaattgttgggaaaatcttcagcacattgtaatatgaaaggttttaccctgcaaaaaaaagcatgaaagattttgatttttttcttaggacttcttcatacactttttactattgtattcactatagttttcctggattgaactgatttttcgcttgcattgtagatatcaagtcttagagaaggaagttttgtatggcagtcgactcgctgcttctccgattcagattcacagttaaatatcccattcttcttttttcagcccttgacattttctcctacttgctaatgcaggatggaacacttcctgttacatgtagtcttcagaacctgtgctgaaatggcgcttctttgtttggaaagtgtctgattttgcaaaacttttggctgtatcgaataattttcaagttgcttcagtgacatctgttcctgctaagacgttttaaatgtgaacctaaatacttgttaccat

SEQ ID NO: 9034 - DNA, 1722 bp, Triticum aestivum
  unsure (1)..(1722): unsure at all n locations
  Clone ID: PAT_TA_9034
ctcgtgccgaattcggcgccacggcccctcccctcctctcctctcccctcccgtctcctctgctctcatcaccaccacacttcgcttctcctcccagcccacctctcctctcccctccccttccggcgcgcgcggccgcctggttcctacaccggcgggtgcgctggcggctccggggatgaccaggcggtgctcgcactgcagccacaacggccacaactcgcggacgtgccccaaccgcggggtcaagatcttcggggtgcgcctcaccgatggatccatccgcaagagcgccagcatggggaacctctccctgctcgggggatccaccagcggcggcggcggcgcatcccccgctgacgtcggccacgacgccgccgcagagggctacgcctccgacgacttcgtgcagggatcatcatccgccaaccgcgagcgcaagaaaggggttccttggactgaagaagaacatcggaggtttttgcttggactgcaaaagcttggaaagggtgattggcgaggaatctctcgtaattttgtggtctcaagaacacctactcaagtagcaagccatgctcagaaatattttatacgccaagccaatatgagcagaaggaagagaaggtctagcctctttgatttggtgcctgatgagtcagacctgccacccctacctggtaatcaagaacctgaggcccagatattaaatcacccaccattacctccacccatggaggaggaggaggtagaatctatggagtcagatacttctgtcattgcagagagttcttccgcttctgctatcatgcctgagaatttgcagtcgagctatccggtgctagttccagcatatttctcaccattcttgcaattctcagttcctttctggcaaaatcagaatgatggagatgatcttggacaaggaacacatgagattgttaagcctgttccggttcattcaaagagtccaatcaatgttgatgaactggtgggcatgtcgaagctaagcataggggatcccaagcaagatacagtatctacctctctttccttaaaaatggtaggaggtcaaaatagacaatcggctttccaggcgaatctcccaacgagggctcaggcgtgagccccctcagcacacaaactgcacttagatgagccctggcaaaaataagctttgcctcttttccttttcttttctttttaagattaactgtggtctgtagtctgtccaatgtaccctgtgttgtaagttatgttatgtatggatgcatctgttgtttgtatggtacatgatatgcccagtgcatgttgacagaatcattaatgttagtgctgatctccagggttgtactgcaaactcttatataagaaaaagaaagaccagtcaagtaatggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccacgcncggggagaggcggtttgcgttttgggcgctnttccgcttcctcgctcactgactcgctgngctcggtcgttcggctgnggg

SEQ ID NO: 9035 - DNA, 1945 bp, Triticum aestivum
  Clone ID: PAT_TA_9035
cgtccgcggacgcgtgggcttggctgaacttcgggaaaaggatgcaccgaatcttagttttactagtgcgagtgatcttgacttccttgcagagaggactagagatatggggtacttgagtggttcatctgcactccagataactttcagttttgttgttcaaaattgagcaccgccttgccaaacagcattccgccactaaatggcagcatatacaggaccaactaacaatgtacggagaccaactaaacctggtatcttttccagatcaagttagaccctggttattgatggttgagcatccaaaaaagttgatattccatggcacgagggtcaccatatccgccctcaaggcccccggcaccccgcactcctggccgccgctcctctccgtcctctactggctcaccctcctctgccgcgccaccgacgggctcgccgcgtctcctcccccctccactgacctcatgacctacatcaccgagagctactacctgttcctcactggcgaggatgacgccgtcgccgccctcgacgacgactaccactccaaggcccgcgcccaagtcggtgcgttgggggtggccattcaggacctggagaaggaggttcaggatctcgaggccaagcggagcaagcaattgtcggcgccctctcgcctcaaggcgctggaggagaagaaggatgcatttactgccgacgttcagaagttcgaggcggtggtcaagagctggtccaccaagatcaaggagaaggaagatgccttggtggagaaggagaaggagctggaggccaaggtgatgaattgccagcagacgatggccgagaatgaggagctgctgaaacaggtggagacgcaggtggtcaatgtcagggacgtcgataggatggctagggagatgcaagcggtggagcatgatattgccaagttggagaatgccaatgctgtactggaggagaaggggtgggaacttgaagctgcacttgtcagcaagctcgaggagatcgagggccttgccgagctgtgcaaccagtccctcaggaagttgaaacccagtattgatttccagtacgaggtaaatgcaaaaggatcctccccggctgagatccttggtaccacctacaaaaccatcctgaagcctgcactgaatgctcttgctaatgagactaaacggctagttcgtccgcggacgcgtgggcggacgcgtgggcaaaagcagctgcaaggaattgttaaaatgctggaggagaaaaggagtcatgtttctgttctacaggctaaaaataatgagatgactgctcaggtggattcactggatcgtgaaatccaaagtcatgtttcacgctgcgcagctgatgctagaaaaatgaaagacgagctagagaaaaaggaacatcacctgagcaccattgagaaggaggcagaggtctttttaaagaactctgaagagggtctccaagctgcgttgagggagaccgacgaagaaacccagatgtgcgcgagggagctgctcaagctcattgattccatcgcagagtacaaggagtttgtggaacagtcgactgccgagatgaagaaagagctctacgaatgcgtggacgacatagcttcgctgtcagccaacatagtctgaggctggttacacgttggatgcgagttagatgttctccctcggttccataatgcagtgcatgttgatctgtgggagtggcttgcctcacgcgctttgattgagtttttttggagaaaaacatttacatcacaagaagtagttttgtattcgatatttggtatcgaagatataaatagttttttgtgtaaacctggtcaaattttgcgaagtttggcttttcaaaatatctgtacgcactacattatggattatggagtagagggagtatgtatgatgcttttagagattgttgaaatgacggctgtgtttcc

SEQ ID NO: 9036 - DNA, 1307 bp, Triticum aestivum
  Clone ID: PAT_TA_9036
gccatgtcgtcggcacagactacgacagcgaccctggggtttgagaccgtgggcgacgaggtcccgttcctgaactcgtgcaaggacgcgggggtcgtgcacatcctcgggaacactgtcatcagggctcgcagggactcggggccgctgaacaagcttgccatcgactacctctacgccttcctgaggaagatctgcagggagaacagtgccatcttcaatgttccccatgagagcctgctgaatgttgggcaagggttctgggtgtagccttcccggtggtgtcgctgcctgttggggtcccgttcttgtcccccgtcatctcgacggttgtgctgggcggctgggttcccctcgcgttcgctgcggccttccggctcatcatgtacgtatggcactatggcacgctcaagcgctacgagtttgagatgcacagcaaggtgtccatggcgtggatcctgggcctctggcccgagcctcggcctggtccgggtgcccgggataggcctggtgtacacggagctggcgagcggcgtcccccacatcttctcgcacttcatcaccaacctcccggcgatccactccaccctggtgttcgtctgcgtcaagtacctgccagtgtacacagtgccactggacgagcggttcctggtgaagcggattggccccaagaacttccacatgttccgctgcgtggcgcggtatggctacaaggacatccacaggaaggacgacgacttcgagaagatgctattcagcagcctgctgctcttcatccggctggagagcatgatggaggagtactcggactccgatgagtacagtgccctggatcagcaggagctgatcgacgaggcgagcagcgacgccaggtctgccgccgacctcagctatgcctcccgcgactccatcgtgccggtgcgctccccgaaccacctgggggccatgtcgtcggcgcaggctacaacggcgaccccggggttcgagaccgtgggcgacgaggtcgcgttcctgaactcgtgcagggacgccggggtcgtgcacatccttgggaacaccgtcatcagggctcgcagggactcggggccgctgaagaagctcgccatcgactacctctacgccttcctgaggaagatctgcagggagaacagcgccatcttcaatgttccccatgagagcctgctgaatgttgggcaggtgttctatgtgtagctaaagtggatgtaaactactgtgtttgtgtgtagattattttacaggagaactctacagaaatgatgattaattgattttacaaaaaaaaaaaa

SEQ ID NO: 9037 - DNA, 719 bp, Triticum aestivum
  Clone ID: PAT_TA_9037
ggccccacccgcccgtccggaaagtggagggtaaaacccagaaatgacatgattagcgagtgaatctagcgatctaaaactgacaaagccggagggcccgaggcttgaggataggcaccatcatcgccatcttgattcttgccgcatcgccctcgccagcaagcggaaaaggagcggagggggggcaccacccaccctgggattctctccggcccccccccccccccggcccagtccccgctccgcgtccgccggctgcgcctcgcctttggccggattcgtgcgcgcggatggcgacatggacacagatctggagacagacgggctggccgccacttcatcctccagtgcctctgcagcgttcacgggagccgcacgacgacgacgaggaggcgcagtgtgggctgaagggagagtggcaagaaccggccaagagtccggcgggcggcgccactgccatccgagaatgccagagccagcgacggtgccggacagaggctgcttacctgcacggtaggaaggggctgaagcagcggccagcctcgctcgacttcggcagcgccgggttcaacagcgggactccgttttctccgggctttgtggttggaggtgccgggtttgtaagcaagggacttgtgtcatcgcagataagctccggcgtgttccctagccccggcacgccgagctacccgcggcggctccggccgtcggccttgggg

SEQ ID NO: 9038 - DNA, 411 bp, Triticum aestivum
  Clone ID: PAT_TA_9038
cgcgtccgctaattcgctcaagacctcataaccccgaaccaacatcacgtctcagttgcgaaaaaatatcacgtctccaactccaaccatagctctcccctgtcccccagctgccacagaactcctccctgttcccatcgccgccgcccgccgcttctcctctcctctgctaccccaggcgcgaggaaccaacctcccgaagcaatcggagcggcaaagcggcggaggaatgcagagatggcgtctgcgatgacggggaaaaagatggggcgggcgtcctacatccggatcaagcacgaggaggagcggcacgaggcgtcctggaaggagcccgagggctgggtcttctccggcaccacgcgcaccgatgtcgccgcgcgccttggcgagctccgcgaccagatcctcccc

SEQ ID NO: 9039 - DNA, 953 bp, Triticum aestivum
  Clone ID: PAT_TA_9039
ggggaggcccccgggacccgggaaaaatggcgaggggtctgaagaagcatgtgaagaggctcaatgcccctaaacattggatggttgaaaagcttggtggagcatttgcacctaagccgtcttctggtccccacaaagctagggagtgcttgccattgatccttatgctcaggaacaggctgaagtatgctctgacctatagtgaagttgcttcgatcatgatgcagcgacatattatggttgatgggaaggttaggactgacaagacatatcctgctggattcatggatgttgtgtcaattccgaagacaggggagaacttccgccttctttacgacaccaagggtcgcttccgtctccacagcatcaaggatgaggaggctaagttcaagctctgcaaggttaggactgtgcaatgtgggcagaagggtgtcccttccctcaacacctacgacgggccgcaccatccgctaccctgaccctgccatcaaacccaacgacaccatcaagattgacctggagaccaataagattgtggatttcatcaagtttgaggtcgggaattttgtgatggtgaccggaggcaggaacaccgggcgcattcggggtgatcaagagcagggagaggcacgagggcagcttcgagaccatccacgtcgaggatgccctcggccatcagttcgccacccgcctggccaacgtcttcagcattggcaaggataggaagtcgtgggtctctcttcccaagggcaagggcatcaagctcaccatcattgaagaggcaaggaagcgcattgctgcggcttgatttcagaaccctcctggaataaataaatggattagttgtgacttgtgaggagtcatttagaatgttagatgttcctattggagacgagccatgttttagttctgcgtttgacattcgttgaactgttctagttgttgcgttactt

SEQ ID NO: 9040 - DNA, 623 bp, Triticum aestivum
  Clone ID: PAT_TA_9040
gaattcggctcgaggctgctcggtgagttggctcgatctctcgccgcggcgcttccaattgagctgctccgccccccgaatcgagggttttggaggcctcctgctcttggcggccgtgcaataaactaacctctcgcttcggggggttagggttaggttttggctgaattgtggtggatttgggtggcccaggcggccgcattgcgctcgcgagcagactggtctgcgggttccgccacgcaatgatggggaagacgcagaagttctccaaggggcacccgctcggtttcgtgccggactaccgatatggggtggaaactgtgggggtgtcaaagggccttgggaatcctgcaagaagtgaagccaagagaaaatgcatcaacctcaatacggacgagggggctgatgctcccggatttaatgtgccgcgggtggtctttgagttgccgaggatgtcggcctcggataggaatgagctggagatgaggctccgtaacgagctcgagcaggtgagggccctccagagtaggttgttttcaagaggggctacgacgagcatgaatggtgggactgcgtcggctcccagaggtgatttcaacagcaatggttcatcaaaaaaaaaa

SEQ ID NO: 9041 - DNA, 1275 bp, Triticum aestivum
  Clone ID: PAT_TA_9041
tggcgccccgtcgactggcgcgtcattcgggcctggggggggctcgataccctgcggttccgccttcgcatgttcccgctggcgtcccggctgccctggcccccctggcgtgggcacccatctctcagctccttgccccactcactctctatcccagcgggcctcctgcgccttcttccggtgccgcgtgcccggtgcttccgccccctttctcgccgcgctttgtttcggccccgtttgttgctttgggatgccgtgtggctggcgccctgtgccgggaatctgtggggccctctggacagcagctgcacgggattttgccctgtgcccttgtgtcctcccctccgtctctgcctcgccctcttggtcaggtcccctctctgcctttcccatttctcgacctctgcgcagcggtgcggtgcctgtatctggcgttcttgctgcagtgcttgcgctcgctagtcctctcccccctggtgtgctagactgggatgattgcttgagtgagaagtcagcatgggatacactctcctggttcgcagttctagttgcgatggccggacagctcacagacccttggaattgtgtcgtggatgtcaacttctgtcgccaagctgcttgaatctttctcattgagttggcctgcagcttttgttgttcttgaggcctcctacttcctcattcactatctatttgcgagtcaaacggggcatgttggagctctatactctgcgtttctggctatgcatttagcagctggtgttcctggtgtgctgtccgcgcttgctttggcattcaacacaaatctgtttggcgcactaacacactatagcagtgggcaagctgcggtatatttcggagcggggtacctggagcttccagatatattcaggctgggctttgtaacagccctgattaatgctttgatatggggagttgttggcaccttttggtggaaatttctggggctttattgacagtagctgcactgcaagtcgaccaaatctttccttttggaactcattgaactgtccatggttccggagtgatcttcctttggtggtctgttgatgatagggaaatataacagattgtctgtgtcaagccttcggtcatttcctctccatcttgtacagttccccgtttttatctctcggaaatgtagatcagggctgaacagtttggtgctaaaatatgtcaatcttgttacagtattctctattgttagagtactgttctatttttaaactttcaatttttaagaaaaaaaaaaaa

SEQ ID NO: 9042 - DNA, 733 bp, Triticum aestivum
  Clone ID: PAT_TA_9042
gtcgggccccgcggccgccctcctgctccgcttgctgttcggccctggcactcaatcggagccggacccgacgccgcgcccccctcgcccgcccgcccccgcctcctcctcccgccgcggcggcgagagcggctcggacggcggcaccgagtcctgcgccgagggcccgagggcgcggcccgcggcgccgtccgtgcccgcgcccggcccctcctgttccgcctcccctctggcgcggcccccgcccccctgcccccgcgcccgcccgcccccccctcctccgccccctcccacctggaccagtccgtcggcgtcgcccatctcggcgcccggggctggcgcccgggggcccctgccccccgccggcccggtcccggcgcgcccgccgcccccgccgctggtgggggggcgccggcccccgtcccccgcgcgggctcggggctcgctcatgaggcctcttccacctggatcataacctctgcagctctcatcaggaagcccgaaagcgaccccgaggtgcacgaacctcacgccgtcaagatcgaggtgctcctgagggcgggtgcggtggcaacgggcggtggctctccgcccacctgccgtgttaggtcgccatggtctcctgggcgccacccgcccttttggccggcattctcgtcgtccgccccgtctcgtggttcttgacgcctggtcccttgggatggctgtcgccgatgagagaaccacccccttc

SEQ ID NO: 9043 - DNA, 1339 bp, Triticum aestivum
  Clone ID: PAT_TA_9043
cggtcccacgccaccccaccgccacaaggtactggccagcaactggcgcacagactgatcgaccgcgtcactcgaagaccaccccagctgcagcagcctgtcctgcaactgccatggagcgcgccatcatggccctggccttgctgcttgcgacactggccgcctccgctgtggccagccccgtcaacaagtcctgcgtcaccggcagcgccggcgcctccgtgagcatcggatacggtggagccggcgccagtgccggcgccggcgtgtccctcggcgccgactgcccccgtgcggaggagatcgtccgcgcggccgtcgagcaggccgtcgccgccgacccccgcatggccgcctccctcctccgcctccacttccacgactgcttcgtcaatggttgcgacggctccgtgctcctggacgacaagccgttcttcgtcggcgagaagacagcggggccgaacatcaactcgctcaggggtttcgaggtcatcgacgccatcaaggccgagctcgagcaggagtgcccggagaccgtctcctgcgccgacgtcctcgccatcgccgcccgtgactccgttgtcgcctctggtggacccagctgggaggtggagaccggccgcaaggacagccgcacggcgagcctgcaggccgccaacagcaacctccccgcgccgacctccggcgtcgccacgctcgtgcagaagttcaccaacgtcggcctcaccgcaaaagacatggtcgccctctccggcgcgcacaccatcggcaaggcacggtgcacgacgttcagcgcgcgactgcccagcgtgggcgagtcggccaaggacacggggttcctgcagtcgctgcagcagctgtgcgcggggtcggcggggtcggcgctggcgcacctggacctcgccacgccggccaccttcgacaaccagtactacatcaacctgctctccggcgacgggctgctgccgtccgaccaggcgctggcggcgccctccggcccgccggctccggggcggggcacgtcgcgccgctcgtgccccacctcccccgcggcccgccgctccgccgcctccgcggcccccccgccgcgctgcgggtggctcgcgcccgccccggcccgcgccgccggcgaggtccgccgtgactgccgtgtggtgaactagctagctagccaaggtcaggtcgattaagcagagaagcttatccgtgtgtagtggctttcagttagtttgatgttttccatcgcgttgtgaaataagctgctagattctcactaggatgatgtatgatgatatatggtgtatctggtgataaaaaaaacaaaaaaaaaaaaaaaaaa

SEQ ID NO: 9044 - DNA, 713 bp, Triticum aestivum
  unsure (1)..(713): unsure at all n locations
  Clone ID: PAT_TA_9044
ggcaactcacaccgcacgctcatgccagcgctcattatgagactttggtatgctccgcatattgcgcccccccgggcgggtactgctgaagggcgccacgctggtggcgatcagaccaagtgacgatgtgctgagggaggggggaggggttgaggctgctggtccggcaggagctagctggatctcagatgcctttgaggagccatatcgaacagcggcaaaggtgcttttcaagcggcggacatacagccttgaaatgaactcgttctgagcttcacagaggttaactttctaggaggatgatgggatgcccttcaggcgtatcagcgtttgcagtagtggtggacctgacgcatatgcagattatatacaccctgcttgtgctgggcttttcagcaatgtggaatggaatgtctcatctacagcaaaagtaccctgaagtgaagcctctagatgctaggttggttggccattgttgactatccgcctattggacatattcgatcgagtagcatccctttttcactgttactctgctagttctataccaaattataggctgaaacattctgtcgtttcgagacacattttagctgtgctgtggcatatgtgactcaaaactgttgaacctttgtgtgtatcagactggtaatgtctctagattgaactttttactacagaacagatgcataattatctatgtctataccana

SEQ ID NO: 9045 - DNA, 470 bp, Triticum aestivum
  unsure (1)..(470): unsure at all n locations
  Clone ID: PAT_TA_9045
cgaggcatagnagcatgcatcggggtaggaagtttcaagagatcctagaagaggctattgttcatcctcttcacatccgagggagagctatatgtcggaattcctccaggtgttgagtctcgcctggcaacgctgacggaggacatggaagaaattcagaagctacaagggatcaagccagggccagacgtcccaccggaactgctgagcggcattgcgcagatggcggctggcgtaccagctatgttcaacacgctgaacgttcgccgcgccatcatccccgccgccaacggccacttatccgcccgtgcgctcgctcggtactacgcggcgctggcagccggcggcgccatccccccgccgcactccagcaacgcctagccgctcctgggcagccacgtgcacacgcccgcgttccccaccgccgccacgtccaagaagaagaagagaggctccgcgaagaagagcag

SEQ ID NO: 9046 - DNA, 853 bp, Triticum aestivum
  Clone ID: PAT_TA_9046
tgcggcacggcggccgtgcgcctatccccacgcctccgctcgattcccctcctgctccccggactcgaccccgcagccgcagtccaccgtagcagctcggccaccgccgccgcgcgggccatgtcctcctcctcctcctccgcgtcctcaccccccaccccctacacgacgctcgtgggccgcgtccgctgcgagcgcgagatcaagcgcagcaagttcatagcagtcgccgcctccgtccccgacgagcgcgccgccatgtccttcctcaacgaggtcaaggatcctcgtgccacccataattgctgggcttacaaggtgggagaacagttccgttataacgatgacggagaaccttcaagcacggctggaaagccaatatactctgccatcatttcgtctggcatagatatggtcatggtggttgtaataagatattttggaggcataaaactgggaacgggcgggctggtgagagcttatggtggggttgcttctgagtgccttaaagatgctcctacttgtcttgtgaaacccaaggctcgtgtgggcatggaagtgccatttgacctcttgggaacagtatacaatcagctgcagcatttccatgccgaagatattaaacaggactatgacactggcaaagatggtacagttgtcgtcatgttcaaagtagaatatgaaaaaatcgagagtcttggaaatgcagtgaattcagcttgcagcaggaaaattgaattattacaataagcagaggggacaagcctgatttttcagtttcaatgtttaactagcagctagtacagcttcagtttgttgagtgtaagtatttgtacgatctaatcccaccatg

SEQ ID NO: 9047 - DNA, 444 bp, Triticum aestivum
  Clone ID: PAT_TA_9047
gggcggacgcgtccgaagctacctatgccctttcacagcgatttgacatcgacggccgttggatcaggctaatagacgttctcgatctagcgttcattccgtcgctcgcgcgtgcgcgaatttcgttctatcacccggcgtaacccactcggcctaccgtaagcgggctgctgctctgctggtcgacctaggctttctgtccttaattgggctgacaggtcgggagaaacagattaggcccaggaaaatggggtgaacaatttctcaaaaaaaaaaaaggaaaatggggtgaacagcaggccccgccccgtgctgacctaggcatccgttctcaagatttctccaccacactgcctgcgtctcgttcgccccgcgccgacgacgacttcattcctcgatgctcggtggttctccttgacatttgttattggcttcgtccctcct

SEQ ID NO: 9048 - DNA, 937 bp, Triticum aestivum
  unsure (1)..(937): unsure at all n locations
  Clone ID: PAT_TA_9048
gggcatatgattgatgagtgcattgtgctagaggaaaacagagaaatgatcaacatgtacctcttctctcgcaaggacgatgagcgcctcgtgcctctcgtcctgccggcctcatccgtgcccgcgtgcggtgcgcagttcatcgctcttgtcaatgggatcatcaccacaccaggttatgagccgagagcacacagcgtcggtcgatcctcagccaatgacctggaccagctgatgtttggcatcagtgtggaagcagggccgctggcaggcagaacagaggaagcttcagtgcccatcaaaagcaagcccttgcagagcatcgcggtaccgccagtgacggcaagtggtcagctggagaggacgcccccaagtacccagagacggatgaagctgaagataatgctgcaccatcaatcccagaggctgagctacgcgaaaccaagagcagtgaaaaatctctgcctgcaaatgcagtgttgggcagagatcttatgagtaatgtccagataataagcaacgacgacctcgaagatcttcgtgagatgggcgccggagcatttggaactgtttttcatggaaaatggaggggaacagatgttgcaattaaaccgaatacactcagtcgttcttccttccagccgtccccggctgctgatctggtggcgctattttgganggaaggccgctttcaactcaaaacttcaccatccaaatttcctggcactttacgggttttgaataacggncaagggggacatttgcttccggnaactnaattcaaggnccatggatcccttaagaaagtcccattcccaaggnccaattctcgattggcgcaagaggtacttnttgcaattganccgcctttgaaaggaaaactcactcaaaggaatttncattttgtttnaaagtgatactgctntgaagttaggtc

SEQ ID NO: 9049 - DNA, 902 bp, Triticum aestivum
  unsure (1)..(902): unsure at all n locations
  Clone ID: PAT_TA_9049
gaggaattcggcacgaggcagaggtgagctgggcctgatgcgttctccnagcaaccggcgaagctcgccatgcttttactgttggcactgctgctgctttgtaacggagttggcaacgtccattgcgcaaggatccacgagagcagcgtcgatctgcacgcgctgctagacttcaagcagggcatcaacaatcctcaggaagccttgagtagctggaacatcacaacccatttctgccactggcatggtgtcaactgcaccacggcaccaccgttccgcgtctcgtcgcttaagctcactgatttggacttagcaggccaaatcagctcctctcttggaaacttaaccttccttggaacgcttgacctttcttataataccttcgttggtcccttacctgtccttggccatctccaacaactccagacactttctctgaacaacaacaggttaaatgggatgattcctgattcacttaccaactgttccagcttggacactttagatctctctgttaactccctagtgggtccaattcctccgaatctagactttctttcaaacctcacttacttagatctctctagtaacatgctagagggtcaaattccgccgaaactagtttccctatcaaagctggacacattagatctctctagtaacatgctagtgggtcaaatccctccaaatctggatttgctttcatctctgacttacttaagtctctctagtaacatgctagtggggtcaaaattccttcgaaactagattctttatcaaagctggccacatttgatctcttcaagaacaggctagtggggtcaaattnctncgaaactaggattctttatccatgctggacacattagatctctnccatacatgctaggggggcaaatncc

SEQ ID NO: 9050 - DNA, 608 bp, Triticum aestivum
  Clone ID: PAT_TA_9050
atctcggctccggcaccacggccaatgctctgctctccttcagtgtaccggcaccacccgcgaactgactgcggcaaggtcctcgtgtctctcaagcaggactcggtgccgccgccggttccattaagtttcgcacagatccaccggaagcagtcaacacggaagggtcgaaactccagatccagtggcagggagaccgtcgtccacctcgcgagctccgatcagatattggatggttcttctcgataatggagatgttttcgaaagcaatgatttgaagggcgatgcatgcgggcgtattttccaggctggtctccttcaacaaacaaaatcaaatttggatagttggaggaagggatttcacttgcagatttgtgacgcgaccgtattttccaggccgaagccgtggcctttcggcgtgctattgcaggggcgagtttctttccggcgggttgtggtgttctggtgggtgtgcgtctgactcggggaagaagaacagtaattgttgggcggttgggtagaatagggagaatggagcgtgtcaatattggccccaatctgccgctgggggccaacactgtttccagactgtactgctacttgttaaa

SEQ ID NO: 9051 - DNA, 1259 bp, Triticum aestivum
  unsure (1)..(1259): unsure at all n locations
  Clone ID: PAT_TA_9051
ccgaaggacctgtccttcctcagaagcaagaagagctcgccgccttcacacggcggcgatgtggaccnagccaagaaatatgactacaaggtcgacgttaccggtgcagcagatgccaccccgatcaagacggtgactggggagaagcttctgaaagagggcaatgttagagcaaggcttgaagcacggaagatgctgttccagaagagtggtgaaaaagggtacaataagttagtcgggcgcaagtcagggtctagagttgttccatacaacaacgcgcgtggtgactcggaagagagcaccgaggttgaggatgatgggccggaggaggttcagtcggaccactcctccgaggagcttcagttggttcacaaagatgaagacctgtccaagatcaggatgcagctggttcagatagagaatcagcagacaaacttgctcgacctcctccagaaattcatggggagctcccagaatgggatacgttcgttggagacaagggtgaacggtctggaaatggcactggacgagatctcgcgtgatctggccgcctcttcaggaaggatgccaagcagcgaacctgacatgaactgctgcatcccgagcccaaaattctggagaaaaaatgaaggcggtagatacacttcaaggtaccccgtctccgacctagcaaaccactccgaggagagcagagcttcttctaagtgggagaggcagaagtttggagttcagggtgggttcgtcaccaacccattagcagagccaaacacctcatacgtaaggagcacgttggttgctcaggaaggcaggaggcagaattcagcccaatacaaggcgaggtcgcgttaggcgcaacaaagatgctccatctgaagcctgaagcacctgcatctacgaggcgggcgggagcatctgaaacatgtcacttcatcacattctaggaggccttttcttgttttctccagaattcaaagctgagtttgtacatgaatttatggagttcttttgcgagttggttcgacgattaagatttctgcggaacagagcctggactctaaagcatgaagacccccaccagccccactgcgaggtggggaccgtttgtattatacctccggccctgagacggcccctgcaggtcttgagctatgcatgtatcttgcactgtttatgtacatagtttggatacagcagctcctatcttcgcgagatgcattgaacaaatgtctctggagctctcgctagatcataaagcnaaa

SEQ ID NO: 9052 - DNA, 737 bp, Triticum aestivum
  unsure (1)..(737): unsure at all n locations
  Clone ID: PAT_TA_9052
atttgggctaaaaggcccnaggcccntngttggaaccnaatngaangggaaangaaggcggctggctgnanttcggtnttggtaccccaccccggntatgncgangggggtccatncnttagntggaatntggagggccccaggctactgctttgcttccaccaggtcctcctcctctacccagctcctcgctacagagtacagaccaaccggcaaggctgactgcagtgcgttacttcgccagggcctcctcctctacccagctcctcattgttgactcgccgtcaaagctgtgcgggcgctgctggtggttcaggtgctgcgcggcaggagcggggagaggtggtgttgcgcgcctcggggacggcgcggccgaccgccaaaggaaatcgcgagcggcaggcagcgccaagatcaactaccctgggggcggattcttgtagctttttggatcgccggtagtagctttctacttagccggttgcatctttttaaattgctttgttccagttttttctcaaatccctggtttttgcatctttgtaaatcaccggttccagctcccaaaatcaccaattgtagctttttgattagacggttgtatcattttggatcgcagtaccggtttccaatcaccggttgtagctttttgaccagaaaaggcaacttgtctaatcgccggctccagcttttttggatcgcggttctagctccaaaaaaaaaaaaaaaaaactcga

SEQ ID NO: 9053 - DNA, 437 bp, Triticum aestivum
  Clone ID: PAT_TA_9053
ggaattcggcacgaggggagcggtgaggacgattcacagctcaatgcgcttggcgaggggagacctttggacggcccacggtcgccgtgtcccaaagaggtgagccatctctgatccaccacacgaggtgcccaccgagtgcctccccaactcaacggcccccaacccaaggcgagtccctcttcccccatccatccttgcatattgtcgttgtcggatatgtgaggctgttggttgcatcgctaggccagactagaagtgaagttcgcctttgatctttagtttcgatggtggactcggtagcttatagcttgtagttgtccttgttggatcagagtattgctgcagttgcgccagtatacattgttttcctgcaactagtctttgggtcagtgaacatgagctagagacacaaggtgataacactaaaaaaaaaa

SEQ ID NO: 9054 - DNA, 519 bp, Triticum aestivum
  Clone ID: PAT_TA_9054
cgtccgcggacgcgtgggcggacgcgtgggcgtcgtcctcgccggcgtcgacgtcgtcaggtcagcagcaccaccaccaccagcaacaccaccaggaagccatgcagatgcagttcccggaggggtcgctgcagcaatggccgccgcggttggagcccgagccagccccgatgatgtcggccgggctgggcctcgggctgccatacgactcgaccggcggtccgatggggttgccggagctcatgatgggccagtcgtcactgttcagcgccaagccggccacgctggacttcctggggctggggatgagccccacgggcgcgaccacgagcaggggcctccccgtgttcatgcagcccatgggcggcgcggtcggcatggcccggaccggctccggccctccagacacgttcggctccggccggggcgctcaggccaagccgtgggagaggaacccgagcagctcgccgatcctgtaaaaggactgctgggaaagtagtaacacgtagcacagcagct

SEQ ID NO: 9055 - DNA, 626 bp, Triticum aestivum
  unsure (1)..(626): unsure at all n locations
  Clone ID: PAT_TA_9055
ggctgaggaattcggcacgagggcctcgccgcgtccttcgtggccaggcggtctaccacccggcgaaccccnggcgccattgtggccaccgtgcccacgctcggcaccgcggggaccttcttggtcgagttcctcaccacctttgtcctcctcttcgtaatcgtcgcccacgccaccgatcccaaggcggtgaaggagctgatagcagtggcagccggggcagcaatcatgatgaacgcccttatctctgcggagtcaacgggagcgtccatgaatccggcgaggacgctggggacggccatcgccaccgggacgtacaccaagatctgggtctacatggtggcgccgccgctcggagccatcgccgggaccggggcttacattgcgctcaagcactgatgcaccggtccatcaatgcttgcacgttaggatgaaaaactctaccagagaatgctgctaggtctaaaatttctaaaagaaaaatagaaattgtgaatttgctgattcatgcaactaaacaaggtaaagagtgatcagtgcatagctgatagatggatcttttttgttcccagtagcaaagattgtgtctgcactctgcaggccggccgcacgcacgaaaaaaaaaa

SEQ ID NO: 9056 - DNA, 829 bp, Triticum aestivum
  Clone ID: PAT_TA_9056
cgcgcccccgcagcagcagcaacagccgcgccgccgccgccccagatgtattaccagcccccaccgccgccgtatggcgggaacaacaatcaagcgccccctccaccaccgccaatgtctcctcccccttcggcaccgccaccacctcctgcccagccacccccacgggtggctctgccgccaccaaaggagcagcaggccaaggcggcactgcctagagtggagacggaggaggagcggcgagcaaggaagaagcgcgagtatgagaagcagaaggctgaggacaggaagcagcagcagatgatgcgccagtcgcaggccaccattctgcagaagacacagcaggtgcgcgctgcgcaacagcagcagcagccacagcctcagagccggcacctccagccatcaggcggtactcgggtggcgacaactgtgtctcgcccagcctccgcagcaaacactgagaggttcgagaatccacgcgtccggccgacaacgttcctctgcaagcacaagtttaggaatgaactgccagacccaagtgctcaattgaaatggctgcctctgaataaggacaaggaccgatataccaagtacaggatctcgtcattggagaaaaattatctgcctaaaatgattgtccctgaggatctcgggatacctcttgacctacttgatatgactgtatacaaccctcccgcttctcagctgcccctggctccagaagatgaagagctgctgcgtgatgatgaggttctcacccctgttaaaccagaaggtataaggaaaaaggagaggccaaccgacaaaggcatgtcttgggctggtcaaa

SEQ ID NO: 9057 - DNA, 776 bp, Triticum aestivum
  Clone ID: PAT_TA_9057
tgcccccgtcgcggtcgcctcctccccgctgctcagggccccgccgccggttcccccggaggcccggccgccgcagtgcgcggcgtggatgccctctccgcggtgcgcaaccccccggcccccccggctggcacccccggctcaacgcatcgcccgtctccctccggctcagctcgcttccatccgctcaccatgcgcctggcccgtcgcccgccccggcgtcgtcgcccccttcccccgggggtcgggccctccccgcccgtccgcactctgcgaccacgcgtggcccctgcccccgcacgacaccagagcgcgggggctcccgcgccaggaggaccacaaggtgcacccctgcgcgcccgccggccacccggtcccccgggtcggagccacttcatggagccggagcttcggccgtctcccccaaccgtgagtgacgtcggcgtgtacgcacgcccaaaggcggtggcgcgggggatgcccggagctgccaacatgcggtcgggtcctcagctgttgccggcgagcgttgctcatgtccacgcgcacgcattcccagccgccttggcgcaggtcggcctccgaaccaccaacgggcgggcccgcccccacgcgccggacccggtgctcggtctagatgcgccccccgccgcgcccgcgcggcacgctccggtcgcctccgggctcttgtccaagcttggtgcctctcctctttcttgattcgtccttgttacatctcgttttgtactcacattctcggacatctcaaggtttgc

SEQ ID NO: 9058 - DNA, 573 bp, Triticum aestivum
  Clone ID: PAT_TA_9058
gcgaccgcctacgcacatcatgataaccaccgccacccctgtcaatattttcacccaccttataccattattttcacagacgcagcagccgaacctgaggccgggttcgtcgttattttgcttgaagaagccgaaagaggggtggctcagttcgccatagctgggatgtaaacttggggagggggtggacgcggggtgttgtatatcttggatgtagctgcctagctggtaaatactctacacgttatagaaatggagggcggattcgttcattccacgaaaataatgaggagtcaatactgaagatactcttgtatagaagatggtgatagagtctactaccacgaagaggaaaggtaaatttgagtgagggagagatggccggacccacatgtctgtctctggctggtcttcttctggttgtgtaaaacatactagcagttgttccgtagcctcccccgtgcttcctccccgtcaggcagggcttaattttttttttgtcaatcaaagttgctgagagttgtatactacagtgtttattggatcgatgtggttacctgggccagaaaaaaa

SEQ ID NO: 9059 - DNA, 625 bp, Triticum aestivum
  unsure (1)..(625): unsure at all n locations
  Clone ID: PAT_TA_9059
ccctgcccgtctacagcgccctacagcctacagctaggcggcgactcgcctccgccaacgccgccgccgaggccaagccctccgactcgcttcctcatccgtggacccactcctccttccccttcttccgcgggacattggactgatcctcgccgcgccttaaaaccctaggttgttggtggcggcggcggccgtcggcaggctggtgggcggccctccatctccatggattccggcgacgcgcctgaacggattcgcaaggaaagaggttttcggaggagcgatccgagcagagatagcccacctcgtcgtcacgcaaccggagcaggctcagatgctcatcggcacgggagagacaggccgacccaccgcgtccccgccaagcgcgtcaaggatgaattgccagagtcgtcggagccgccgccgtcgtcgcggctcaaggctgtggtgccccgtcctcttcaggacagagatgagcaattcgtctggccatggatgggtgtgctggtcaatgtgcctaccgagtggaaaggcggccgccaggttggggaaagtggcaaccgcttgaaggagcagctctcgcgattttgcccccagnnnnttattcctttgtggaatcacagnn

SEQ ID NO: 9060 - DNA, 490 bp, Triticum aestivum
  Clone ID: PAT_TA_9060
gtgacagtgtgtgcaaagggggaggaagcagccactggaatgatccgattgaatggacggacgcagaacagagggcatgggagatggcattgaagaaaagaaggcggccgaggaccacagtgcgcaaaatgcccaacagtagggcagccaagctgtatggctacagctgaagaggagaggagatgagcggtggcataagaggagggagtatcgcattttgggttggaaactagcaaggggggttgatgcatgcatggtgatggccattgtgttgctgctaaaaaactgtggttggtttgcttgtgttggtattttttttggtttgatagactgagattggtggtgtgtatgtacttatgtatggaatgttgatgctgctgattcatcaaatcagacttgcatgtatgaactagttgaagaggatgcttgtctttccttataaacatgaatcaatcaatgtagtaacattatttcttctccaaaaaaaaaa

SEQ ID NO: 9061 - DNA, 804 bp, Triticum aestivum
  Clone ID: PAT_TA_9061
gggccaaatttgccaaacaaccgtacacgtccgcggacgcgtgggttccagctgtatctttcactggtgggctgaccctgtcagaggctggatttgacctgctaaacagaatgctgacgtatgaccctgaaacgcgcatatcagcagaggatgcgttgaaccatgaatggttctgtgaagtaccattgcctcagtcaagggattctatgccaacatttcattcccttaatgaacaagacaggcgcatgatgaaacgtatgaagagccctgatcctctggaggagcaacgaatgaaagaactagggagcatacacgaccgtggaatttttggctgagccctgatcttttggtttgctgcagatgccaatcttcaacatgaacctaatggaagtgcatgtgttccaaggtcagacgtccactggatatatgaagtacaccgtcttcttggtgtctggcgacaggcgtcagttggtggccttctttagcaggcatggatgcataatcagaaggggatacgatttctccttatattccgtgctaggcactatttcatttacagggttagctcttccccaacttctggtcacaatgaactcttactttacttttggtcacaatctaatccactgtgcattgtaaggtgtgcaaatatctcatacagctacatcgtatggtctggcctattcacagctattgggtacaccagtttcacataccgatcttctgtatgtaaagtactataaagtgtattccttgtaaacaacaatcaatgagatcttctcacttcaaaaaaaaaaaaaaaaa

SEQ ID NO: 9062 - DNA, 1508 bp, Triticum aestivum
  unsure (1)..(1508): unsure at all n locations
  Clone ID: PAT_TA_9062
ggctgctgcggctcgggcgcgcgtggcggacacctacgtgtcctgggtcgtgggcgtcggcaaccggaggggcgtcccggtctgctcgctcttccccatgcccgcctccttcttctccgcctactaccacttcgagtccctcccgccgcgcctcgtcgacgagcacgccccggccgccggcgccaccacagataaatctgataagagacttgagcactatatctcaggctttgcttcaagttcagtaaccttgtctgatctggagcccttaattcacaacaagaaaacagtaaaccatgtcctagcagctgtctctagcatcaagaacgcgcaatgcctcctattcaccaccatgtacgagcttgaggctggtgtcatcaactccctaaggtcagcactcccatgtccagttctcccagttgggccctgcattccctacatgacactagaagaccagcattccaagtccaatggagaagttaccaccagtccaggagactgcttcacctggctggactctcaacccgtgaactcggtgctatatgtctccctcggcagcttcctctctgtgtcagcctcccagcttgatgagatagcattaggccttgcatcgagcggtgtcagattcttatggattcttcgtgaaaagtcttcccgggtgcgagaacttgtcggcgacaccgacaggggcatgataatggcatggtgcgatcagctgaaggttctgtgccatccttctgttggggccttcttgacacattgtgggatgaactcgacacttgaagctgtctttgctggcgtgcccatgcttgctctgccactgttctttgatcaaccgattgatggtcgtctgattgttgaagactggaaggttggactggccctgcgcgaatgggccgataaggatggcctgattgggagtcaggacattgcaagggctgttaagaggctcatggcctgcgatgaggccgataccaaggcgataaggaggcgtgcccttgagtggaaagaggtctgtggcagagctgtcgaagagggtggatcttcctatgataatctcagttcattgatgcagatggtatgcgcgtcgcgatgtgctgaactcgatcagcaatgttccaaaactgatgcttgaaatgcatcttctcaaccgttgtctgcgtggcgctttgctgccagcgcgaccgcttccggccgtgcggtctcacgttcgcttgtcggggtcctgctctctccctgcccctgggttcccttgctcccgtttcgtcccttcgctcccctggcctctatgcgccattcggtgtcctgatcccaagccgccttgtgctttcatggctctgcatagtggctactgtgaagtttttatgataagaaaattttaatgcgcaaaccacctctaagacatgaatcaacagtcttttatgagcagtgtttatgagcaggctccaaattatgaaggtgcaaataggttcaagaatcaacagtcaagtaagcggtnaataaggagg

SEQ ID NO: 9063 - DNA, 435 bp, Triticum aestivum
  Clone ID: PAT_TA_9063
ggagagagcgatgaaaacaagtatgttgcccttgatgacaaggtgggatgggttaggaggaacagaagagatggcatgcctgacgagcggacaacaagcgccggaagagtgaccatgtgtgcatttgtctgcattttgcctcgttcccatgcatgcaaatcatagagaacgcgggctgatgctcaccggcgacggacaacaaaggagtcaacgggcaaagagatttctccaacttggtgctggcgatttgagattgactgtggtgttgcttccacaggtggtgtggccggtcaatttataagcggtcgtctactgcgtagccggcctctagaagagtcgttgcgttgatggagcattaaatgatagacgggtggctttatgatttgcagggcagatggaggaattgatttcattggcagtgagttaaaaaaaaaa

SEQ ID NO: 9064 - DNA, 758 bp, Triticum aestivum
  Clone ID: PAT_TA_9064
gctctggtgcgccgcctcccctcgtccctctcctccctcgattcgcgccaccggcagttcctctcccccatctgcacccccgctcgccctctcctctctggtgcgccgcctcccctcgtccctctcctccctcgattcgcgccaccggcagttcctctcccccatctgcaccgatttttgccggatgcgttcatgctaaactcaagatggcaaactcttcatgtgaatagaaaacagtatccatcaatggcgacctcctctcttgctccgcctgaggtgcccatggagctgcatgcaggcaaccgtgaccgcctcttaaccgcactgcacgcccacctctccgccgccgctagccctccccgcggccttgccctcctccagggcggtgaggagcagacacgacactgcactgatcatctcgagctgtttaggcaggagagctactttgcttatctcttcggagtgcgtgagccagggttctacggcgctatagacattgcctctggacaatcgattttgtttgctccaaggttgccacctgactatgctgtctggatgggtgaaataaaaccactcccttattttaaggataggtacaaggtcgatttggtcttctatgtcgatgagattgtgcaggttctgcaagatcgattcagtcagcatgggaagcctgtgttgtttctcttgtatggaaagagtactgacagcggaaattactcaaagcctgctagttttgaagggatagaagaagtttgaca

SEQ ID NO: 9065 - DNA, 1392 bp, Triticum aestivum
  unsure (1)..(1392): unsure at all n locations
  Clone ID: PAT_TA_9065
gcctcctgccgctgccccttttccccatcatttccttccccgcccgtcggtccgtccgtccggcccgaccgcgaccagccaccgccccgtcgttcgctgggttgcttcagatctcctcctccccctacctctccaccctccgccctggggcgccacctccaatcccactcccgccattgcgcaagatatataaatcccatccccatcagcccagtctcctccccacccgcccgcgacctcgccgtctctctcccccgtccagctcgctctcctgccctgctcgcggggcatggcctgctgacgactgatttggtacagaatcctctcccggatctgacccgcccgcgccgccgctgggatcgggatcgggatctcgcgcgggagggacgggcatggaggtcttcggccccgtcacgccaggccaggtgtcatttttacttggtcttttcccggtcctcattgcatgggtctactccgagatcctggagtacaagaaatcttcgttacatgggaaagttcactcagatgctactttggaaaatgaaacttccaaggaagatgagaaggctatattaatcgaaggaggccagttgaaatcaccatcggcgaaattccggaacatgtctaccaaagccaatttaatacggtttataacaatggacgagccttttctgttagaaaaccgcgctgtactgagagccatggctgaatttggcattgtgctggtttacttttacatttgtgaccggacaaacatatttccagagagcaagaagaactacaacagagacctgtttctgtttctgtacattcttctcatcatagcatcagcacttacttcacttaagaagcaccaggagaaatcagcattttctggaaagtccatactttatcttaatcgccaccaaactgaggaatggaaagggtggatgcaggtcttatttctgatgtaccactattttggcgcatcagaaatatataatgcaatccgtgttttcattgcttgctatgtttggatgactgggatttgggaatttctccgtactattataccaagaaagattttagcattgcaagatttgcacagatgatgtgggaggctaaaatttccttgggggctttccggtgcattgtccttgacaatgatttaagttgtactatancggccnaatgcacaccctatttcacttatggggtccgcacacttggccgggttaacaagtntaatgngatacatcagttatggntataanatgctggctgctctggnngcaactngaatggaantccngggnatccaatttgnggccctttagtccnctggtnaaagtcanngctcaancaactncctgtgagagggatccnttggtttcgtaaaggtatgaagtnngn

SEQ ID NO: 9066 - DNA, 467 bp, Triticum aestivum
  Clone ID: PAT_TA_9066
aaaaatcactgcaaaattattgcgagggcgagaggaagagggaagaggcggagaagcaaggggaggcgagcgaaggtgagatctccaatccttctggaagcttctggattcgtcggagtctccagcaattacggccgccgcggacgcgcgccgcggcgccgcggtggttttaggtggcggcgccagcttagcacgcggggggtggacgacgagcgccgtcgcgtgtctgcacgtaggactagaagaatctcccgagacacttgtgtcaaattctgaatctgcagaattgctgcgtctgctcattagcaagatgtccattgaagaaaggaaaattagtttgataaacaggacgacttcgttaaatcctaatgcggtagaatttgttccttcatgccttatatctgtgagtgatgcttcaaacagatcggacacaaccatgtttcctgtctcagagtcctccaaggaaa

SEQ ID NO: 9067 - DNA, 1984 bp, Triticum aestivum
  Clone ID: PAT_TA_9067
ccacgcggccggggaaaaaatcactgcaaaattattgcgagggcgagaggaagagggaagaggcggagaagcaaggggaggcgagcgaaggactagaagaatctcccgagacacttgtgtcaaattctgaatctgcagaattgctgcatctgctcattagcaagatgtccattgaagaaaggaaaataagtttgataaacaggacgacttcgttaaatcctaatgcggtagaatttgttccttcatgccttagatctatgagtgatgcttcaaacagatcggacacaaccaagattcctgtctcagagtcctccaaggaaatcagcgcagaccaaccagagtctgtaccaagcaaccctgatgaagaagcacatcggtattggcaacaacagcttccagatgatatcactcctgatttcaacgttcttggccaagatgagactcctggacctgacagtctttcactcacgggcttgtcagtgaatgatggctttggtgcttcactattttctccaaagccgacagcaagaatgcagcaccatgcttctacgtttgatacgggcgcaggaagtacagaagggacgttgagactttcgtggaacttggactgccgcaggcttgcagcatgagctcaacagcaagatgtacattgccgactgcagatccagggggataaaccggacgactaccgttaaaccctatcgcgctagaagttggtccgccatgccctagaactgtgagttatagcacagactgcccccgacacacccaaggctcctgtctcagagcgcctcccaatggaaatcagcaaaggccaacctgagtcccgtggaaaatcaaccctaaggaagaaacaacaccgatctttggtcactacaatttccagattaaatcaccccatatttaagcgtcatttgcccaagatggtactcctggacctaacacagtgtcttttggtcggcccacaagtaatgataggttcggagttagattatttcctccaaacaaaacattacgcctgcagctgcatgcgcgcttttatccctggatcctcctgagaggcagctccaagtttactaattcgcctcttactaggcttggttcaagcatgaggctctcatcttgttggctggctcatacaacggtaatcatgatatgatctcaaacaacacactgcaaaacattgcgggagttcaaacgggaccaacttggctccacacagatgctacggctagcatgtttttggagaaggatgaagttcatgattttgcaagtctaagacatgcacttgttgaacagcaggataggcaagcttttctaactggtggcaatcctttagcaaaggaactaaatattaaggagctgtactctatccaaagcagattagctcaggagaaggctagagaaagtatatatcaacagagattccagatgccagagttgcaaggcctcatccaggagcagaatcccgcgatcgatctttgtggccttcatgcaagtgaggcgatgcacgtcctgaacaacgaactcaacaaccggaggaagattgcccgttccacgggccgccggctccaggccatcattatctctaacccccgtacccctgcgaggttgaccgccgccatcgagcagtacctcctggagcacggccttcagtacacgcaggcacagccaggcctcttccgcgtcctgctgcagtgaactagcagggaccgcctaggtgtttgtggacacgatcagatgaaatgaaccaaaaaaaaaagaatgacctgtacttctgtatatggcagagatgagtagcagaatagagatgatacagcaacaatagttggttgtaatgttggtatatcagggcttttttgtcggcaaatacgttgtaaaatttgcggaattaggtgacgcgttgtccaacagtagtaggggaaatgttgcatgcacgcttttatgctgctgcgtgttaaaggccacatatgttgtttggttc

SEQ ID NO: 9068 - DNA, 561 bp, Triticum aestivum
  unsure (1)..(561): unsure at all n locations
  Clone ID: PAT_TA_9068
gatttaattcttttttgtttggtatttgtgaaagagtgttgtatttttttaatagtgatagaataaggtgtttgtttgggtataataagtttagtacttttgccttttgtataatgacttagtgagtataaacaatgtttaattggtacattgaagtaaggttgatttatttttagttgataacttaatagttgaaattttaggtttgtaagaataggagtgatatgtgaatcgaaacttaggatagctagttattattgataaagagtaattttgttacgtcggtttgatttagggacagcttaaatcaatggaaattatgggcttgaatttttgataattctgttttttaattttaagtgttggttggtattgctataagtagtaattataatgctaagatgagtataagtgtatttgatttaatggtaagttgaaatgtgttttattttaatttgtgggattgtcttantaaggaatttggctgtanatttgtgggttnactaaagacttagnttantgatgcagatagtaaacaacatcagcacagtggntagatag

SEQ ID NO: 9069 - DNA, 761 bp, Triticum aestivum
  Clone ID: PAT_TA_9069
ggaggaagaccaccatctgaatatgcatcacgtttttcttctgttccagcagctgagcaagggcccggtttcagcaaaagtaatcagagtcgtcaacatcaactagccgtgccaaacaaggtgtctatgcaaccggtgagcaggtacaatgaggtcagactggggcatcagcaaccagctgtggcaaatcaagttcagagtactgctaatcatctacaacctggtcctgcgcactgcggacgtaccgctagtgttgcaacaaagccatcttacgatccatggaacaagttcaaaaacattgcagaaacaagaccagggccatctcagttcagccttttccctgaaaacagcagcagcatgacacaaatgaccccaatatccaactgtatgtctggctactctgttcagagcactgctgcaccatcaacaactcaaacaaagtttacctcactccgaccattgcccccttcaatggtctcttctcatgtttttagcagtgaagctgcacggcctcatggatctactgcaccccggccactagttcccctgcctcgtgaaccaggtaaaagtaatgctccaggtggtgtgatctttgaagacaaggggagcatgaaacaggccaccgtagtagcatcaagatcgagtcttgagagttcgaagcaaatcaacaagagtttcaaaggaccggcagaaaaggatgatgtgttattgacatcaccaaaaaaaccttgcatagcagtacctcggccgcgaccacgcta

SEQ ID NO: 9070 - DNA, 643 bp, Triticum aestivum
  unsure (1)..(643): unsure at all n locations
  Clone ID: PAT_TA_9070
ggaaggcccacgggcagttctgtcgtgctgaccgtgggtatctccctacgtactgtacctctgctttgccgtggtcggggcgcgggcggggtcccctgtgcaggagctcatggcccgctgcttgcagcggtgagcgtctctcgcccccagtgcccgtcccgctccccccctccggcccggcccgtggctgcgccttccaaccatcgcttgcgctgccgcggggttgcaggctttgcgcccctgggtctcgctgcggcggtgatctcttcgtctgttgtttacctttggtggaaatgggttgcactggtaaagcatccaaatgcatgaggggagttcagttgtgcatagcatgtgaattagcctatgtactgtatcatatcttcgccgagcttggttgggggacatggacgcctgtacaggaaaacgcaccgcatagcgtgaagaggagagcagcattggtgtacagttcggtttactgtcaggattttagatctgtagctttgttttgtttcccatccatcgattgtaacttgtaaggaccactcagtcatcttcattcttcattcgttcgttcaaacttacttccatgtagtgctgccttgttgaatgagtaattaacacctgagngtccttnggaaaaaaa

SEQ ID NO: 9071 - DNA, 687 bp, Triticum aestivum
  Clone ID: PAT_TA_9071
gagccgtgggttcagctcgagtacgtgctcgagggaaaagacgccgtacgcgcggcgggtggagttccggcgcccggtcgctcgccgcccgctcctctcggtgctccgggcccgcccccccccctgctgctccgccggtccgtgcctccgcgagggagggcgaccgggagagacggagctacggcaacaacacaggctactacccgtcggcggctgcggagaaacggcaagccggcggcgggaaaaagtcgcaccgggggagcaccaaatccaggggcgagaagggattcatcgagggatgcctggcagcgctgtgctgctgctggatctgcgagatgtgctgcgactaacccggcgtggtcgctgctggcaaaagacgttgctgctagtgcctatgaagaacatacacatacagagagtcgatgcttaattacagtgtctgtctgtttgtttgttgttttaggttctgcgtaaataaccgagaacccgtgctgcgtgtgtgatgcccatgtaccatgcgtcacacctataatcaattttaaggcaccaaattatcgggctactcttgaagatcctctagttaaagataacgtctgctgtgcaaaaatgaaagctttcatttgtagagggagaagtcgtgcaggcgtaatcagtcagtcacttgtccagagttttttttttttttga

SEQ ID NO: 9072 - DNA, 622 bp, Triticum aestivum
  Clone ID: PAT_TA_9072
gtctgcacaagcaatggctaccgcaagaggggctagtggtgcctcaatgcccaccatcacccctaccacgagtggtggtgcagggtcaccagaaggagagaaacattgggaggcattggcaccggtggtggaggtgcaacaacacgatgatacaagcatggatgtggtgctggtatgcagcaaagagaggccgatcatgctccaccaggtgatcaccatcctcgaggaagaaggcgccgaggtcgtcaatgccaatcactccattgctggccacaaaatcttctacaccatacactcccgggccttcagctcgagaattggcatagatgtttcaagtgtttccgaaagactgagagcattggtatgatagtaaatttgtttgtataaaatatatatcccataactatatataaagagaaaatcccgcatatggtacatatgtctagttattagctagaagaacgggatgggaacacccttcagtagctatataacatcttcttcatgttgttttcacaacatgatcaatgtatggaaaaggatgttgactgatctgtgatttttcactgacttctgggctgtcacggcttgttgtggttgcggagtattttcagaataagct

SEQ ID NO: 9073 - DNA, 1489 bp, Triticum aestivum
  unsure (1)..(1489): unsure at all n locations
  Clone ID: PAT_TA_9073
gcggggttgcaaagtgcattgcaggcaggggacaacattaccttctggcattgcggatacaggcatttctcacgcgcataaagaaagatcatggaagctttgacctggattggcttagatgtctaccacgagaaagcgcaaaaaaatacctactcagcataaatggacttggagctaaaagtgtcgactgcatacgtcttttgtcactggagcataaagcattcccagttgatgtcaacgtagctcgcatagtcacaaggctacaatgggttgaactgcaatgctgttctgaggagtttcattcggttgacctatatccactcatgcaggatgtgcagagttacttatggcctcgactatgtactattgacaaagaaaaattgtatgaactacactgtctcatgataacttttggaaaggtaatttgcacaaaagtagatccaaattgcaatgcttgcccattccgtggggactgcaggtactacaaaagtaaacttaccagaccattactttctcctgcagaggagcatgtgcgtggtggtgaagagaaaacagtatagttacttctgaaagactgttgtcaaatggtagctgcatgccaagtcatcaaatcgaagaaaacaggactgctggcagacaaccctcccgcagctgtgagcccattattgaggtgccccctacgaccgtgtatgaattcggtgttcaaacaagcctatggtgagcaattgctcttggacaccaaatcatgngaaaagatttggcattgagcaattcacaacatacaagcaggaaaatgaaacacatagggcgtcttaggacagagcaccttgcgtatgtgctcccagacgatcatccattgttggaagagtttgaagagcgagttccagaagatccatctccgtatctcctggttcttcatccttgtcctgacaatcctcctcctggtgctgtcgagaactgcatggtgaaaggcacaattctgataccctgtcgaacagcatccagaggaaacttcccattgaacggtacctactttcaggatcatgaggtctttgcagatgactcatctagccgtcttccaatagacttctctagtgagtgtctcaacgatctggggaaatgcattgtatattttggctcatcaatacactctatcacaaaaggtcaaacaagacaagacattgaagactgctacaagaaaggatatgtgtgcataagaggatttgaccggcggacgagatccccaaggcgactatgtgccgcattacattccatcaatgaaaagaaagaggacaacagcaaaaacaaggaaggcgcggggctggggaagagcaacgagcagaaggcgcctttgacaaattaggaattattagatgttgcctgacaccgatcgtagctggggcgaagctaatgtggttagtctagntctctgggtgtcttttagncagggctaggtnagaagatgtagctaggatggaacggttagagg

SEQ ID NO: 9074 - DNA, 1079 bp, Triticum aestivum
  Clone ID: PAT_TA_9074
tccgcactttcgcctgcattatctcctccaccgctggcccgccgccctcccggcatcccccgcccgaccgcgccgcccccctgcgccccggcctccggcagccggctcagccaccgccccggccgctatgctgccaggatgctcccctgccggcctcccctccgccctctatcgccctctccacgaaccgctccccccacacccgcgttgcggcaggaaatacatgttctttctacagacaaacgttgccacccccattgtaatcacagcagctgcaccaggcaaaggtggtggtgtgcttgatcgaccagcagagaaagtttctcctggccgtcaatctgaattcgataagaagaaatcccggaagatgtcacctccattccgcgtcgtcctgcacaatgacaatgaaaacaggcgggagtatgttgtccaagtcctgatgaaggttatccctgggatgaccgtcgacaatgctgttaatatcatgcaagaggcacacgtgaatgggatggcagtagttattgtctgctcgcagccggaagcggaggagcactgcacggcgctgaggggcaatggcctccgaagctcaattgaacctgcaagtggtggctgctgaaaaaatggtttccttttttgccacttagtttgtaggtacccctgcatatccagatacaggcgctcgttgttaaagatggacatggttacctccatgcttctaaatcgaggccgctgcaaccgatatatcagtttgggggtctaccgtctaccgacatggctataacctatcattttgtaaatatcatttttgcacatatcatctcatatagaccgaaatttcgaccaatatggccgatgtcggaccctatatgtccactaatatagaccgatacctagatgtgaacatttcttttccagagaacagtgaaaataagattatgtattcacaacttcaccataagtcatgcatactgtttgtagaaacacttatataatttacagagtatatctttagtattaaaaaaaaaaaaaaaaaactcgagacctgcccgggcggccgctcgaaaatcactagtgaattc

SEQ ID NO: 9075 - DNA, 700 bp, Triticum aestivum
  Clone ID: PAT_TA_9075
gcggggccagcgccagaggcggcacgaggccatccttccgtccagccttgttggtttcactgtgccgtcgatcggcatggcgaggaaatgctcgagctgcggccacaatggccacaactcgaggacctgcggcgggcaccgaggcgttgagagcggcggcggcggtgggctgaggctgtttggggtgcagctgcaggtgggcgccgcgcctctcaagaagagcttcagcatggagtgcctgtcgtcgaccgcgtcggcctactacgcggcggccgcggccgtgggtgtcgccgcgtccaactcgtcgtcgtccgtgtcgtcgtcgtcgtcgctcgtctcggtggaggagagcccggagaagatgggccacgggtacctctccgacgggctcatgggcagggctcaagagaggaagaaaggggtgccatggaccgaggacgagcaccggaggttcctggccggcctggagaagctcgggaaaggcgactggcgaggcatctcccggcacttcgtcaccacacgcacgccgacgcaggtcgcctgccgccccccgaagtacttcctccggcaggcccgccgcgcgctgaactagcggccggccggccccttcgtcctcctggggttggatcccctccgcggagccgccgcgcgccgtcactggctcagcccccttgccgcgcgatagcatggcagctgactt

SEQ ID NO: 9076 - DNA, 770 bp, Triticum aestivum
  unsure (1)..(770): unsure at all n locations
  Clone ID: PAT_TA_9076
cccactgnatttcctcatcaggnacattcatcaactttatggtagccatgcgtgacccgatggggtcagcgttgtcgtggctcgtctacaacctagccacacatccacacgccatgcttgccatccgcgaggagttggcgccgatcgtcgccacacgcaaatcaggcgacggtgttgtggtgtttgatccagacgagaccaaagatctagtgtaccagcgagcggccatgttcgagtcgctgaggctgtacccgatcgcgcccatggagcgcaaggaggtcgtcgccgatgaccttctgcctagcggccacaaggtgcaggccggcagcaccatcctgatctcgacctacagcatggcgagattggagcaggtgtggggagatgactgccgggagtacaggccggagaggtggctgtcgtccaaccaagacgggagcggccacacgctgcggcacgtgccgtctcacgtgttcgtagcgttcaacaccggaccgagggcatgcctcggcaagaacatctccgtggcgctggtgacatccatcgttgccacggtggtgtggaactttgatgtggagctactggatagtaacaccgtgaagcccaagctgtcggttattctgcagatgaagaacgggctcatggccaaagttaagaggagaccagaggacgactgaggggacaccgatccaaattaattgtcactgtttttgtacaacttgtactaaaacaccaacaattattnaatcagagagtaacaaataaacaaataa

SEQ ID NO: 9077 - DNA, 662 bp, Triticum aestivum
  Clone ID: PAT_TA_9077
cgaggtccttgatcgctcggggccggacatggagctgctgtccgattgcccggtgcacgcctccgtgccggacaagtacgtgttgcccccggagaagcgtccttcgctcctcaacgacgaacccagctccgatgtcgccataccggtcatcgacctccacagcgccgacgattgccggcgccagctggtcgccgccgagatcatcaaggccagcaaggggttcggcatcttccaggtggtgaaccacggcgtggcggaggacgtggtgcaggggttccgcgaggcggcggcggggttcttcgcgatgccggcggaggacaagctgccgtaccgctccgatgacctgagcaagcacttccgcgtctcctccagcaccccctatgaccggaacggggaccgctattggctggactacctcaagatcaactgccaccccgtcaccgacgagcacgtccgagagtggccggacaagccgggaagcttcaggagctccctcgccgagtactccgcggcggtgcacgagcttgcacagacgctgctccggctcatcgcagaggggctcggcctcgacggtggattcttcgccggcgacctcagcggcggcagcacccagatgaacgtcaactactacccgccgtgcccggacccgagcctcacgctgg

SEQ ID NO: 9078 - DNA, 361 bp, Triticum aestivum
  Clone ID: PAT_TA_9078
ggcgcgtgcgcccacgcgtccggccccgcccatatccccaaaactcctccatggttagggaaaagagtggtgctagagagatggatggccgcaatctgctgggtgatgtcggaggagccgcgagaacgaaccagaacaagaccaaggtcatcaagatagcggtgccggtgctggccatgctgctgctgctcacgacggcggctgtctccacgacgccggacgaccgtgcctgcctccgcgcctacttccgccgcgacatgttcctggtgttctgcgtgttcgtgagcaccacaaccggttgtctcctggcgtggatggccgttatggcgccgacggaggcttcccggtgctcgtacgcgtg

SEQ ID NO: 9079 - DNA, 2069 bp, Triticum aestivum
  Clone ID: PAT_TA_9079
attcggccgagggaaggaggagctggggatccaacggaggcggaaatgagggaaacggagggtccccgatccgttcttgagccgattttcttgattttctgagccgcggaagcggggaagctttggatctcgaggccgcccgagcgtgaatcctcggtctctccggggcctcgttgctgcattgcctcctccccagatccggaccgccgggcgaggaaacgccggatcctcgccctcgccgtctcctcaaattcgccagaaaattccagtttcttttggttttctccggagccgcgtgcttcagatctttctcaaaaaaatgcccatttgtttagttggggtagatgcgggagtggcggcgactactttatgagctgtctcctgccatttttggagtagattcgcccgtaatggcggatcttgccatggagcagtaagggggcctctttccgcgagagcgacagcaactgcccacaagttgcaatgtctttgaagagcatcgtgcgggagctcaaggagatgagggacggcatcgggagcatgtccaggcgcggcggcgtctccgacgggcgcgccggccacggccgcggggggtcgcggcattcttggccaagcctgtggccggagccgcagccgcagcggccgggccaggagccgcagcagcaggggcagtgggcgaacctgccgccggagctgctgatcgacgtgatacagagggtggaggccagcgaggtggcctggccggcgcggcgccatgtcgttgcctgcgccgccgtctgccggtcgtggcgcgaggtcaccaaggatgtggtgaagactctcgaggagtgcagcaggatcaccttccccatctccctaaagcagccggggcctcgtgattgtccggtgcagtgctttgtgaggagggacagggcgacgtccacctatctcctctacttggggctcagcccatctctgcatggggaaaacgacaagcttttgcttgcggcccgcaagatcagacgtgcagccagaacttcttttgtgatatcgctcatctctgatgatttttctcattcaagcagcacctatgttggcaaactgaaaccaaacttccttggcacaaagttcacaatatttgatagccaacctccttgtgatgctgcggtgttgcctaacaacaagccaagcaaaaggcactcgaagcaagtatcaccaagactgccactaggcaattacaatgttgcgaccgtctcatatgagctcactgtcctgcgcaaccgaggaccaaggagaatgcagtgcaccatgcactcgataccagccgtgtgcatccaggagggcgggaaggccccaacccctactggcatggtccactcactcgacgaacaagtgtccaccctatcaactagtagcaaaggaaaggaaccaaacatcgaattcttgtcaacaagcctcagcgctgatttatccggaccgatctcgaccagcgaagcgcctctgcttctgaagaataaagctccccgctggcacgagcagctgcagtgctggtgcctcaacttccgagggcgtgtcaccgtagcatcggtcaagaacttccagctcgtcgcctcggttgacccctccttgggcgtccccgctgcggagcaggaaaaggtgatcctccagttcgggaagatcgggaaagacatattcacaatggattatagatacccgctgtcggcgttccaggcctttgcgatctgcctgactagcttcgacacgaaaccggcctgcgaataggcgttaaccgggccagcggagacgtgttgcctgcccccttggatgctgtaaattctgatatctttgcttcgactctcgggacgaatgcccctggggagatggtaggtggtagattgatggtagctttgccggatcaagatgtggcaatgatatccccgtatcttggcagaacccccaggatgatttgggccaactgttgtaagcgactggtatgtattattgttgttgttgttggaatgtttagcagtgacatatcactgcctttatggacattgttcatctcgcgaactctcctctgaaaaactcga

SEQ ID NO: 9080 - DNA, 387 bp, Triticum aestivum
  Clone ID: PAT_TA_9080
gggcggatctggagaaggcgaagctggactacctgcaggcgtcgctggtggtgacctcgacgaggaggctgatgatcccaagcctgatacactccaacacgcacgactttgccaaggacatggagtccctgctcaggtggatctgtgaccagctccccacatcttggtcgctcagaaaatccatggcggactgcttgagggggcatctgaaggtcgaagacgtcgtggaggtgatcccatacgactatgagtttcagtacctgctgcccaagtgaacacatccgctatttgtttcaagttaagtgtaccactacacaaatggcgtacagtacatatttccatgtatattgttgtcttagaggtaaaaatagtggtttaaaaaaaaaa

SEQ ID NO: 9081 - DNA, 567 bp, Triticum aestivum
  Clone ID: PAT_TA_9081
cgtccgcggacgcagggtgggaaccaaggcgcaggctataataacccgaaccgcggagggcaaggcagtggctatggcagcgccccgtatcctcagcaaggaagaggacctcctccgttccctgcagcaggtgctccacgcggtggtgccggcagtggctatggagtcggtggcccaaattacccaccaggcggtccgccgtatggcacgtctggtccaggccgaggaggccccaactatcctcaaggcggttctcgcaatcagcagcagtatggtagctggcaataatatttgtcatatcacgtcgcggtgatacgcccctccagttggagtatttttatttgtagaatctttgctgtccaaattctactttctgtgattgttgcgcaacagctcttaaggtacgtcctttatgattcaagctgtattttatcaatgtataaactgagattgtagcacaacaggctattgcagtgtctcgtttatgattcaatttgtatgttatgaatacacgaaatgtataatcaccttatgattcaagctgtatgttatgaatgtatgaccatt

SEQ ID NO: 9082 - DNA, 2103 bp, Triticum aestivum
  Clone ID: PAT_TA_9082
ccatcctctcccccctctctcttccgctttcgtctgcgcggccagttcccccgcccttaccacctgagtccccgccacaggccgcgggtcgcggcggctacgccccaacgcgccgcgagcagcaaagcgccccaagccatggcgacgccggcgccggggcagctcaacctcgacgactacccgtcgtggggctcccgcggcgtcgactgcttcgagaaggtcaagtagacccacgagggcacagacgggcaagagttcctggcagaggaggcggcgcccggggagaccgtcgagcgcaataagatccgcaaggacaacgaagcagcaggccgtccgtaaaacggcacgatgtcgaggagaccaaccacgccccgacgggccgcaaggagggtcatgcagctcacagcagtaggggtcaccggcaatactggttgcgcgtctcaggtcgcggaggtaaatcgatcccgaccgataatatttgtgcttacacgttgtggtggcgcagttctactatgtgtggtatgtgttccactgatcagcttgttattcgcttaccattctcccaggataagttcgagctgcagccagttatcaaaggccctaaatgtttcaaaatcaatcatgttatgctatataatgtttattgttgtaaaaccaggtaatacaatgttgttgacttaaaactggctgattatggtctcacaacattatattgtagaattccttaatgattcctcacaaacactgggttcgctccggcggtcggcccgccggcggtgcggcgtggttgcgctgagcttcgccctgcggtggacatgtggtcgggggggtgtatttttgcagagcttctcaatggaaagccaatactgcctggaaagaatgagccagaccaactgaccaaaatattcgagctttgtggtacccacgtcgagccgccttggccgggggtgacaaaaatgcaaggggcctttaaacattttgaccggcatgctctggacctgttggagaggatgtcaacttaacatccatctcagcggaccccggagctgccggcaaggatgttagcactggacccgtcaaagccggatatctgcaaatgaaaccctttcccctaaattcctcccgcatgatcccctaccatgtgatcctaaaagcttgccaaagggcgagccgtcgcagctgcatcgcgccaagaaatgacgcctcctcccccgccttcccgctggcccccctgccagccgccaaaagacgcatcatcctcagcctcctcatgcccgtttgcccccaatccagcaatcaggccatcaaataaggccagcccagcctaccaacaacccgcatccaccaatggcatctgggtcagatcatcactatggaaagccccgagggccaggagggccaaacaggtacccaccgggcgggaaccaaggtggtggagggtatccgaaccgtggagggcaaggtggcggctatgggagtggcccttacccccctcaacaaggtcgagggcctcctccgtaccctggcggtggcccaaggggtggtggcagcagcggtgaggatggtggtgctccaaactttccacaagccggtccttatggtcctggcggcggcccaggccgggggccaaattatcccccacaagctggctctcgaaaccagcagcagcagtatggaaactggcaatagtatgtagcatctcaacaataccatgtcatgtagatttctttttccttttcaagaaggccatggcatgtaggaattgcccatgataagtggaaacctatgcgctgatacttgtatttcaagtttaatttaactgatgtgccttttgctgggcttgatatgataagctaatttaaagtttttttatttgtagaatcttcgctgtccaaattctcctttctgtgattgttgcgcaacagctcttaaggtacgtcctttatgattcaacctgtattttatcaatgtataacctgagattgtagcacaacaggctattgcagtgtctcgtttatgattcaatttgtatgttatgaatacacgaaatgtataatccccttatgattcaagctgtatgttatgaatgtatgcccattaatg

SEQ ID NO: 9083 - DNA, 817 bp, Triticum aestivum
  unsure (1)..(817): unsure at all n locations
  Clone ID: PAT_TA_9083
cacgaggatggatcgccctcgacggnatacagacgtgaacaatataggctcaggtctgctatgaagcgaggcataacgcctgatttggtggcaaaatatcctgaattaggcagcgtggcggctaaagtgagggaacagcccaaggatatggttctggggacgcaacaacagcctaaggatatggcaaacaagtctggcatattggatggtggtggtgatgatagaggcaaatctcctgtcttagaggagcaggtgccaatagccgactggaaattcaaaccagagatggaggtggattcagtgacacataccaatgaatcaccgagggatttttccatagtactaaatacggatgagtcgcctatggattctatcatgttaaatacagatgagtcgccgacactagaaccagttctttcttgtgtccctgatatccagtctgaggataagtcgtccacactccagccagttctttgttgcggccctgatatccagtctaaggttcatgtccgtcctcgtcctcctcattgcaggaagcaggaggatacagttctccctcctaagcatctcttacaacagcagaagcaaccatctgtgcataaccaccatgagatttgtccgcaaggtaccaatgacgatgtggcgacaaccttgggggcccagttccagaatttggacttgtccgtatccaaattggtggaattggacagaggcgaatccctctcggagggaacaggtcaaatttctggagacccagcagctgcccagggatatggcaaacaagttagacatataatagtgtggggtaatttatcta

SEQ ID NO: 9084 - DNA, 923 bp, Triticum aestivum
  Clone ID: PAT_TA_9084
gctctcccgcctctcctcctccttccttccaccttttcctcttgagagtcgcctcctgtgcaggcccggctcgggcccctctcctctccgacggcgctgccggcccccggctcgggcccctcacctcccgggttgcgctgcagaacggaagtagggcagggagaatagcttgggttgctgtacagagtgcgtgtaaggtagtctttagaactggcgttatgccgatgggaggtgtgcggctggtgcaggcgagctgcgtccagcgcgtggcggtggtgatgctcctctttgtgctgctccggtggtcagagccagaagcagaggtggtgctagttgccgttcctcctcctaataagctcgcgtgtgtcccagatctgaagctcaagttccttcttctctacttcttcctgtgctgccatggtggtggacggaaggacacgggaggaaggggatcctctagcagacgaactatttttgttcgttcttggggccctatctctgcagcaaatccgaaggggtgcttcaacaacatgctgcggtttcttctggtcgaagggcgacctatccgagctccggcgactcatgccggctcttcttattcctcccggccgtcgagccaaaagggaggcagttcatcagagcttcgaactagcaattttcagtgtctaccaccggtgttttgctggtggtgctgcagccattcctctaccccaagtggtttcgtccccggcggtggtggaatagggccaggatcgaagcaggcggtgccaaggacgcgattgctttttactttcgtctactggggtcccatttgcaaagtttcagactttggatgtaatctctactttctgctgggtctggttgtaaaatgttgcatgctaatctaatagaggtctgggtccttcggggcccttcttgtgttc

SEQ ID NO: 9085 - DNA, 1570 bp, Triticum aestivum
  Clone ID: PAT_TA_9085
gcagatattgatcgcaccatgaagaaatatgctgataacgtgctacatgcaatggaaggggtaagctccagacttgcacagctggagggcagaacacaccatcttgaggactctggtggcgagctgaagttaacagttggtaactacaatggcagcactgatggaaaactgaggcaatttgagaacacactgcgggagggtcaagcaggtgtgcagattttgcgtgacaagcaggaaattggtgaggcccaggttcaacttgcgaagcttcaagtgtctaaagcagaggatgttgagtcagaaaatgccagtgctgggcaggtggactcaaggcagcagccgactgcgccccagccaactgttcaaccacaacatcaggcctatcctccttcccaaccaacggcactgcctgcccttcctgctccaaatgcgccacctccaccaatggttcacaaccaacctccgccgcaattccaaggccatttaccgcatcctcaactgcaatcagtcgcacctgctccatctgtgccgaccatatcgcaggaatcctactatcccccatccacacagacaacagaggctgcacaccagcaatatcaagcaccaccagcttcgcagccacaagcacctccagcagcaccacagcattatcagcacccgcctcagtatgctccatattctcaacctccgccgcctggaagtgttaacccccaaactccagccgcacccttgccccatcagccagaagaagcagcaccttatgggcctcctgctcagagctacccactgaatgtccgcccgccgtccccttacatgccaccacccagtggacctgttcctcctttctatgggccaaaccctggcatgtacgagcctccagcagtcaggcctaactctggtccaccaccgccctacagcgctggatacaagcagcagggaggaggcggttttcctgagcagtacggatacagcagtgggtctccgtctcaccgtgctaatgctggaatgaacccgccttcaccctttgcccccactggcccctcctccgctggaagtggcaactacggcaagctccctacagctcaaatactgccccaagcagcgccagtgagctctgccccgagtgcctcgtccggcaacagggtggcggtcgacgacgtggtggacaaggtttcgacgatggggttctcgaaggagcaagtgagggcgactgtgcgcaggctgacagagaacggtcagaatgtggacctgaacgtggtgctcgacaagctgatgaacgacactgatgcgcagcctgcccagagaggctggttcgggcgataaaagcccagctgctagccagggccgttgattgctcgtggagcagcatgtgtatatgatcgatgagcgaaacagctatggaaccaattcgtgcattcacgagggatttcgtatttgtcggatttctcgttttgctgcaggagaccgtacagttagtgttagctcttttcttcacctgttagtgcactagtgattgctatccatcgtctgtgtgactactgtgtactgcaagtgttattgtcgtcaagta

SEQ ID NO: 9086 - DNA, 895 bp, Triticum aestivum
  Clone ID: PAT_TA_9086
ctccggctcgccccgcctcccgcccccctcgccagcatcctcgttagccatcatgcagcagcagcagcacatggtggcggcgctccccctccccgggccgtcgctccgacgcccgctcctttgcaagccgccgcggccgggagcgccggcgtcgcggacggcagtgaggaggagatgccaggaagggaggcagcagcagcagcagagcggtgatggcggcgagaagaagaagaagcaagagaaggagaagaggacgttcctgagcctggaggaggccgggctggtggagatgtccgggctcagcacccacgagcgcttcctctgccggctcaccatctcgtcgctgaacctgctgcgggtgatctcgggagcaggagggggtggcgaatggaggagctcaacgccgggcgggatgtgcgaactggttcctcaaaggacaatgctcaagcgggagcagaacctcgacaccgccgtcctgcagtgggacgacccgccgcccatctgaccccgccgcctttgggtgtctgctgcccttttctttcctgtcagttccgtcgtcgacagatatctccctctcccacagcagaaaatactaggagtagtacgaacgaaggaccgatcgaggatgcatggacgctgggcagaccaggggaggagaggacagatcgttcagagttgagacaactatacatgatagatgatgcttcattgccttccatatactacttggttgctaaaacggatgtatcgagcactgaaatacgtccgtctaaacagggactatttgttgtcccactttgcccctaaaacggttgtcgccagcaccgaaattcccccgtctaaacggggactaattgttgtcccgtgttacccatgaaccctagaacgttttttt

SEQ ID NO: 9087 - DNA, 834 bp, Triticum aestivum
  Clone ID: PAT_TA_9087
ggaattcggcacgaggccgccctgtccccaatggcgattccggaggagctgcgccgctactggctgacgatcctcctcgccgccgccggcttcctcttccagctcctcgtcctgcccaaatcctttccgccctcccactacgacgcgctcggaatccagaggtttgcgccggtggagaaggtggtcgaggcatacgagctgctctccaaggagtggcttgctgaaacaaatgaccggtcaactgttgatattataaagatccgttatgcgtatgagctgttgacaaatccagtttggaagcgggactatgatctttttggtctggatcatcatacggatatcttcgagagagtcaaagaacaatatcaaaaagagcacttcctgaaaatagatctacctttgttaaaagattctttatctcattcgactggtcatgccttcaatgtactcacacgtgactcattgatgtctgccattgctgaagattacccgttgctcatacaggtttattcaaaggggagtcctcgctgcgctcaattttttgagtactggaagcaaattgacactcgactggatggcgtggccaacactgctatggtagaacttggtgatgtgcaactggcggggtattttgcagaaaaaaggttctctcaacagccatttttccgcaatggtataccagctcttgttgcatatcctgctaactgcagaagtccatcctgttatatgaggtacccaggtgagctaactgtggattctgttgtcaactgggtggcatcatcaattgttggtttacctcggatcttgtactactcaaaggagacactgggaccc

SEQ ID NO: 9088 - DNA, 801 bp, Triticum aestivum
  Clone ID: PAT_TA_9088
tcgaccccgcgtccgccgtcttctacccccctcccctccccctcaagccgccgcaaccagaggaagagagagagagagggagagatgagcctgcagattccggctaggtcacgcggcctccgccgcctcctcctgctgggtggagaatctcgcatccggcggtcatactccaccggtgaccgtcgccgccgggtgatccgcgaggcacgggatgaggaggacgacgaggccttcctccgccccctcatctgccgggctgacccagagaacaaccccctgcccccaccgccgagacgcgcagggggagcccctgacccctccgccgccggcgccttccctgctgacatcctccgacgcgccgccgggaagcagcagcagcagcagcgtccggaaagaagcgctcagaaagccatcggggagtcgctgatggagaagcttcagctgggcgacgccgcctcctccacgggaagcaacatcgaggctcagcagcctgagcatgaaccggggcagccaccgcagacggaggacgtggacgagatcttccggaagttgaaagagacggggctgatacccaacgccgtcgccatgctcgacggcctctgcaagaacggattggtgccggaggccatgaagctgttcggtctgatgcgcgagaagggcgctatcccagaggtggtcatctacaccgctgttgtcgaggccttctgcaaagcagccaagctggacgatgccgtccggatcttcaggaagatgcagggcaacggggtcattccaaatgccttcagctactggttgattata

SEQ ID NO: 9089 - DNA, 678 bp, Triticum aestivum
  unsure (1)..(678): unsure at all n locations
  Clone ID: PAT_TA_9089
gcacgccgctcaaaagctcacagcgcagagcagtacatctgcctcccatacacatttcgcacagcgcagagcagttccagtccgagtttccatggccgccgccgggaaccccatcggtggcgtccttctgcttctgctgctcgtagccgccttcatgtccaccgccgaaggcagaatcaagggggtcgtccgagcgcccttggcgtctgtcgcaccaggcgccggcgagcgtgacatgggaggcgagcgcgtgcccacgcactccgtcgtcgactgtttcatgggctgcgtcagcatggcggatgattgtgggagcttttgcatggacaagccgctcgacgaagcgaacgactgcatgacggaatgcctcaccgctgacctctcctgcctcaccggctgcggcccggcactcggtcccgcgccgccggctgatgcctgaggagctactccgagcctccgttcaccattcttcggttcttcctatgtaatcgtgtgagacagtataaactctgcattgtaccgtagctgatcactgtattgtcagctgtaccgcacaccccctcacttgtagcagttcatgcccacgatcgtcagaacgtgcatagctgcagttggtctacttatatactgtaactcgacgaataaataaatgaatcaagctttccagtnaaaaaaaaa

SEQ ID NO: 9090 - DNA, 693 bp, Triticum aestivum
  unsure (1)..(693): unsure at all n locations
  Clone ID: PAT_TA_9090
attcggcacgaggcccctaccttgctccaccacgtcgccgacctcctaccatggcctcctcctcgcctcaagtccttgccgtcaagcatcacatcgccaccctactatgttcgtcaccggggatcgccagatctggtcgcgttgggtcggatcctcccgtccctgcctagctgctgcccactagaggccttccgtcccgcgtgtgttttggttcagcaaggatgagacaccaagaaccgtacccggaccgtcaagcaccttctccgaggattttgccaagtaccatgacatgaacgaccctcgaacgcgtcaagtaccactagcgtcaagtacctcttcgcaagaccaagtccctctatgaaaatgttgtacgactacttccgtggccgaaggcccgtgtacaactaccgtcgccgtggacgactacttcctctacgaacccggaccgctcagagaatgcacttggaaggtataaccgccgagacgatgacccatggacgaaagcatgtgttgtatgagatgcatgtttagttgttgttttcgcccgtgaacgttagtcattcctcctcggttgccatgccgtcgacccatgggaaacccggtatcccggatcaccccaccatcctcgcatgatccgttcatccacattttctcttgcaccgacatctcaatagttgtngatcacccggaatg

SEQ ID NO: 9091 - DNA, 1054 bp, Triticum aestivum
  Clone ID: PAT_TA_9091
gcgcagcctagggtgcccgcctccccgagggggagagacagagatgagcgcccccatggcccggcagggggtggaggctcccctccccacctcccctacgtccccgtcgcccggcccaggtccgagcagcccagcttccgtaggggcggccccgcctcggcagctcatcgtcaccgcggcccgccctaaccatctgcaccaacctcacccaagagatcgacaaaacacgagcagccgctgagctactgcaggcttcacaccgaaggagcgggccataaggcgagctggctacaattaccagattgcaagcaagataaataccgaggaaattattcggagatttgaggacaggcgagctcgggtgctggtgccgcgcggcatccaaaggttgaggcaggggaaattattcaggagatttgaggacaagttatcacaggtgcatggaggagcgtgaagttcaaggatgatgaggaacggagatggttccgaaggcccaacttatgccagcatttgacaagccattccaccctcaaaggtcgaggaggcccctcaccgtccccaaggagccgagcttcctgaggctcaagtgctgcatcggcggcgagttccatcgccacttctgctacaattccggcggcggggccaaggccgtcaactgatgatgcgagaccgatcgatcgaccgtacgtgaagggggactgtatttttgccgctcggtcagttgatgtgcatgctgccgtgtcatgcacccatgcatgcatgcatgcatgcacgcgtagtcgtagtgccaatattcaaccgcttgctttgcacccgatcgttttcacgccacgtacatagccaatagtgcttcctttttctatctcttcttttcttgatttctcttactttgttcctttcaatttcgccactaaagactaggaggataaagaaaggccccatgggatgtaatgcatgcatgcatgcgtgctggctttacgtatgtgtgtctctcgatctggtgatgataatgataaaagctccgcatttgtaaccaaaaaaaaaaaaaaaaaaa

SEQ ID NO: 9092 - DNA, 428 bp, Triticum aestivum
  unsure (1)..(428): unsure at all n locations
  Clone ID: PAT_TA_9092
taaccacatcgccggctgacccatctctctccctatctctctgtctctctctctctcccaaggattccggctgttcgctcgagcttgtcgaagcagtttgctgcgctctctggcttgtccggcgaggcgtttcgagggagcgagcgagcgatttttagtatctgcgaatggcgactcagtggttctccaatatggtgatggacgagccgagtttcttccaccagtggcagtcggacgcgacgctggagcagtacacggagcagcagatcgccgtggccttcgggcagggggagatggaggcggcggcgctgatgcagcancagcatcagtacgccgcggcggcggcgggcgagcaccggccgcgcaaggcgggcaaagtcaacaccagctgggactcgtgcgtcacggagcanggctcccccggcgac

SEQ ID NO: 9093 - DNA, 1321 bp, Triticum aestivum
  Clone ID: PAT_TA_9093
tcggcacgaggcttgaatgtgtcagttggaagcatcgagctcccatcgatgatggatagcagtcccagagagaaacatgcaagtagtgatggtgttgacaaacttctaagtcattactttactgcggataaggtccaggaaaacatttcttcccttgaatgtccaactatcatagaccaacaacaaatggctgagagtatggacggtaagagcgtacagtcgccagactccggagttgcaacaaacagatcgatgtcgattccagaaactcctcaaggtcgtgactacgcttgtccaagattgagaccatcaagtaacggagaatcaaattctatgaacgcgcccatcacatatcaagttgtgacagaagatgagttactagcgtccacagcagctcagacactcgtttccttattcacggatagcgctgcatggatcacagacagccattgcagcaacaaccaggcagatgctcaggatggaggcgatgaaccgcatgtttcgctggactctttcgaggaaggcgtgatgaacctagaggctctgagagacgatggggattcagtcgccgtgagagcgccggacaaggacgggccttcgtgtgggatcaagctgaggagagggaggggaatgagagacttccagagagagatattgcccgggctggtctccctcgcgaggcacgagatatgcgacgacttgcatgctatagggtatgaaatcaggaagaccaggcagaggagggcgcccggggacaagtacggtccgtcgacccggtcaaggctgcctcggcgttgctccaatgcatggaactagtgagggttttttcatacggaagcgctggtgaagcgcaatgccgacgaaggaaatgtgggggagtaggagttgtgagggcaattctggccaggcctgtgaatatcgtcgtgtatgaactatgaagcctagctgaaaccggtctgctgctagcgccatcgttcggtcggtgaattccttttttcggttaatcgacaaaaaagcttggtgataatgccggaggggtggtaggttgcgccttttatttagtagctgcggatttatatttagcaagtgaagtgatgatggtaaagctcgacaattttttttgtttctgtaacctggaagaatgatttggatgaatggccccatagaacaaggctccctccctgtgtgtacattctttactgtatctgttgggttacttaccaattaccatgctacggtgtacagccctgcccagcatggctggtggtccaaatacctgctctgtgctgtgcaaaaaaaacatccaaatttggcacttgtt

SEQ ID NO: 9094 - DNA, 1294 bp, Triticum aestivum
  unsure (1)..(1294): unsure at all n locations
  Clone ID: PAT_TA_9094
ggccgcctcctccctccctccctccatatccccttgtttaattgctgctgctgcgttcaagcctcccccacaccaacccaacccagccgcgcctctctcttgctacgactctcttcccctgctgccgttgcgtactgctgggtggttttttcgtccgtgctctgcttcccgctgcctctctctcgcgccgtcccggggtgggaaggaaagtgcatgggaagaagaaagcaccgggccgcctgagtgagcgtcagacggacagacagtgaggtcttctgcgagggtgcgagggagctagaggctgctggagagggagcgagggagaagatgaagttcatgaagctgggctccaagccggacgccttccagtccggcggcgccgacgtcagatcggtggtctctgaccttgcaacggatgttattgtgcatattggtgaagtcaaattctacttgcacaagtttccccttctgtccaagagcagcaaacttcagaagctagtccttaaggctactgagaaagggacagatgacatccacatagatgatttacccgggggagcaaaagggtttgaaatatgtgcaaaattctgctatgggatggttgtcaccctcagtccccacaatgttgttgcagcaagatgtgcagcagagttccttggaatgaccgaagatatggacaaagggaacttgatattcaaaatcgaggtcttcataaactccagcatcttccgggngagtgaaagattcgatcattgttctcctgagcacgaaggcactattaccttggtctgaggagctgaaggttgtcggtagatgtatagatgccattgcttcaaagacatctgtggatcctgcaaatgtatcctggtcatacagttataataagaaaggagtagcatgcactgaaataattgagtcggcaggaaaaacatcgggcgcccccaaagtcggctcgggcgaggacttgtgtgaattggatgttgatctctacaagagagtgatggttgctatcaaatccaaggggaggatgtcacctgacttgataggagaagccctcaaagcctatgcagttaggtggctgccagactcttacgacgctctggtcgctgatgattacatgtcgacgcgcccgcgcttggtggagaccataatatggttgcttgccgtcagataagagctcgggttgctcttgcaggtttctcctgaagctcttgaaagttgctatattagttgggtctggggatcatgtgaaggaggagcctcatgagaaggatcaggtttccagctgcacaaa

SEQ ID NO: 9095 - DNA, 624 bp, Triticum aestivum
  Clone ID: PAT_TA_9095
cgagagggaaagggcaaagccggggcgaactgggaggcggctcctgccgccctcagccgacccccgcgtcctcggcgtcggcgagatgacggcgatgctccgatctgcgcttgggtccgcgctccggcctcccgcaccggcctcccgcttcttccgcaagggcgtctccggaagccgcgacgccacaaggcggaagttgtcctccagtggccgagatggatcaaacaacagcacacctgccgatctttttggtgatggttcctccaagacctggagaaggccagaagttgtgtttatcaccgcagcagccctctcaatggctacctacacatacattgtgaatgggaagaccgtgttagggtaccagcgtgaagtgatggagaaccaggacgaggtgaagccggagaaagacaacgccatctagttctcgtcgatctctaaaaaatacaaggccgagccgacctcttcgattgcaacatatttgggacccttgtactggcttgaaagcaaaagtgtcatgtaatttgagaggagggtcggtacaatttgatgtgctggtcttgggtctctgtctcctgtggttgtatttcgatatgcaagtgtcttccagttaaaaaaaaaaaa

SEQ ID NO: 9096 - DNA, 629 bp, Triticum aestivum
  Clone ID: PAT_TA_9096
ggacgcgtccgcttccccaatcatatcatatacaggtagtctatagttatttatccaagatggttgttgcacccttttggccagtatggtatgtaaggtcaggttgcattagtctatgttaggataaactggctaacatatcagtgatgtaaagtcgcttcatgtgtactttatgtaacctcggacacatgtacaacctatcacatgtccatgttgttctttccatacacaacttttccatgtgcggtcttaaatacaacttggtctcacacctatactcgagagctctctcaagtacaaataaacaggaaactatatgctgaaaagtgtggtgatatattcagttactaaatttactgaatttgtgatcccaatattgccagctgaatagtgaaatgacagggattgctctatagcaaatttgcagtgtccttgaactttgtgatgtttcctagggcaactggtctggtccaaactaataaatgcatgggttttcatgttatgttccatgtaagaagttgatctatgtttcttatgtatttgcctttagctctcttgttcattgcattgttgcttgctgatattcttacattattttctgatcgctttattaccgggttgagaatgac

SEQ ID NO: 9097 - DNA, 390 bp, Triticum aestivum
  unsure (1)..(390): unsure at all n locations
  Clone ID: PAT_TA_9097
ccctgttgtaagagaatctctagagccatctctagnaggtgaaaggtgtacaatctgcggcgccaaagaaatctgtattgttgtcaatttatgtttcactagctgtttactatgatgtatctgcacacggtcttctgagttcagaagggtggtttttggctgcaagaaaggttcgacacatcgtcaacttctgtagaatttaccaggtgttgccatccgagatgtaagttttgctgcgcgcctattccgatggtgatggtgtagagttgtaaagaaaagaaaacgtgtgctttccgagttgtctattttgtatctgctgtatcgttttcctttggattgtgcggatggagaataattattaatggtggacaagttgctataaaaaaaaaa

SEQ ID NO: 9098 - DNA, 676 bp, Triticum aestivum
  Clone ID: PAT_TA_9098
gccctatcacaaatgcatctctagccagcacacagttctccaggcgctggacgcaacgatgcacacgcggcccaaaccctcacaattcacatcgtggcttcgtcgagtgtccacatcatctccggatgttgggaacacacgatcgactctagatcctgccggaagtccacatcgtggcttcgtcgagtgtccgatcaccaacatcgatccgatcaattccaggtatgatgactgggacggaccgggaggcgatggagagaggataaaaaatgctaagagccagcgcatcaaacatgatgaggatttgtgcggcttcaggcaagatggagcaggactgaaggaagaggatcggtgcctgagctgggtcatgttaatctcgtcttggtcgtgtgccttggtcttgatctgtggtcttgctgctcctgtgtgagcgctctcattctgctcctgcatgagctcttttgctgtatcaaaacctcgctggatgatatcgtttagggctagttctgtgtttgggtgtccttgggttttcgccccatggtaagctgctcgaggacgagtgcttgcagtgggtttcccaagggatgcgttgaacttgctttcccctttctcgactccttagtaactgcaatggtgaaaactttgtatttccgttatgtcaaagtaatggaagggg

SEQ ID NO: 9099 - DNA, 628 bp, Triticum aestivum
  Clone ID: PAT_TA_9099
aattgagcactgccgtgcaactagggacttgagtagctgtggccgctatgtgcagcatgtgctcaactcatgtgggcatgcctcgttatgtgccgagtgtagccagagatgtgatgtctgcccaatttgcagaagtccaatacctgataatggaaaaagagtgcggctccgcctttaccacaagtgcttggaggtcggccttatctctaagcagcatgatgaaaggtttcaggaaaaggaaggccatggtgatcctgtgaacatggacgtccagcggctgcattccttgtttgatgttgcgcttcagaataatctggtttccctgatttgccactatataacagatgtttgtttggatgagaatgctgtctcaagtgatccacttctggcttttcttttggacgaggtggtcatcaaggactggtgcaagagggctgttaaggcactcatatcagagataggcacgatttatagatctggactagagacgatgaagtctaagttatcccagatgcaaaagtttgcagtgcagctgtcagggatatccactgttgttgaagctatgatcgcatctttcagagaggcagttcatgtaaatgacctgcatcgtctcatcgagaacacaatg

SEQ ID NO: 9100 - DNA, 677 bp, Triticum aestivum
  Clone ID: PAT_TA_9100
cccccgggctgaggaattcggacgaggctggagtccatcgtgaaccccgtccaagcccacgctcgccaccgagtgcaccgaggccggccgcttcacgctcaacatcacgcgcttcaacggctccgtcgccatcgacaccggcgtcgtgcaggcgtccatcacccgcacggtgttcgaccagaatcccgtggcggtcttcgccgtctccaaggtcctgctgcccaaggaaatgttcagccgcgggaacaccattaaccccggagctgccacccctcccgccaccatgaccccagacgtctccgatggcccgcggacgccgccgacgaagctgtcgtccccgccggccctgcgcggccaggacagcaagccatcatcagcaccagcaagaaacgcgaactggtggtgtacaggaataggattggtctgcctgctcctacctctgctatgagatccaggtggtgccttgcattctcaatttttccctcttcttccaccatttcctctctcgtctgatcgaaaccgaatgtgtacacctccggtcgccattggattggggagagggttccgtagaggccattgtagcagcagtagtagccattatttgctcgtttcttcacctgattagggcaaatcataataataataataataccatgtgtagaaatctaaaaaaaaaa

SEQ ID NO: 9101 - DNA, 582 bp, Triticum aestivum
  Clone ID: PAT_TA_9101
taactcacagaactcggaggaaatatgggcccggccccaacacattgtccttcaaccaccttttcatcgagaagggttggggtgcccatccgctggtggctcttggtgtaacccacagattcgagtccaaatatgtaacggtcgtcttgtataagcccatagaacgatagcatagcaaccgcatgaaagttgaagctaatgcttgacaactcaccgcgaaaccagcaatgaacagcaacagcgtggcctctctccctgtaaaagcacttcaggtacaggaatattttcgataacttgaaggagcttctagtcgtgatattgctccccttctgtatacctcctggcggatggccttatcgtcgtgagttcatacatatacttgtgttgttgttgttgttgtttccaacccctcgggaatgatatgtgtagaattgtcaccgaaaagtgagaactgagaaccgtgggactccgctgaatcgctaagcttcagagttagatcttgtgatccttattcttcattgtttttcattgtgatgatggtgttgtataataatacaaagctaccggttccgggtccaaaaa

SEQ ID NO: 9102 - DNA, 987 bp, Triticum aestivum
  unsure (1)..(987): unsure at all n locations
  Clone ID: PAT_TA_9102
cgggctgaggaattcggacgaggcctcgtgccgattcggcacgaggaacttaccggtccagacatagcaaggattgacagactgagagctctttcttgattctatgggtggtggtgcatggccgttcttagttggtgcatgcgaggacgactgttggatatggccctccatcacccagcgcgcctaccaggccgccgagatcatcgctgccgccaacagcatcaaccgcaggtgcctgtctatccacatcgtcgtgggctatgagtatgacccgcccgtcccggatccggcacggggccgcctgctgcctcctccgcagtaaaatcgtgccggagtatagcttcttggacgcgcgggggctgggtgcgtacgaggggaagaggttagaagcattgccagaggtgtatgcgtctgataatatttcgccggacatcaaaccacctcctacttatgatggtacacctaacgagagcgtggcggatgtatttgttcgggtaacacagctcatgtcaatactagagactcagtactcaggggatactgttgtcatcgtttcaccagattctgacaacttgtcaattcttcaagctgggttgataggactggacctgcggaggcatgacagcctgttctttcagccgggtgaggtccgagccgttgatcctgccagtatacctgaatataagcaaccagcctccaagtgtttttaagtgtacaaacccaccaagttgcaaataatttacatcttgttaccatacgtttcatatcccctgtacatgaaaagaatattcccaagggcattgtatagcttaatggctgtgtgtactgaaaatgcgttcactgaacacatctgacagcancaatctgatagttcaacangatactcgtataatgaancaantncatgtttgatacccgtacaggagaatgtganatttctgcanggaattacttgtcaggcaaaacattancattacgatttnataa

SEQ ID NO: 9103 - DNA, 478 bp, Triticum aestivum
  Clone ID: PAT_TA_9103
ccccgggctgaggaattcggacgaggcaacaccgagggggccagaagtggctcctcgaaggcgatgctaataccacttaattccaggtgatcgccaatggacgccgtcataagtgctccatcccgtgtctctgggagggagacaccctcctgaaacacccggatgagatgagaacccacatttactctttctataaggggctctttacggcggaaccccgtagggggtgtcattggcggagaacttttggacgcttgcggacagggtatctgataatgagaatgtggaattaattctcccattctcacccgaaggggtgggcagggctatcgcctctatgaaggcgggtttggcgtcggggcctgacggcctgctggtggccttctttcagaaattctggaatgttctcaaacctgtgatcatgccaatgttccatgaattttatattggaacttttgacatgtcgagaaaaaaaaaa

SEQ ID NO: 9104 - DNA, 695 bp, Triticum aestivum
  unsure (1)..(695): unsure at all n locations
  Clone ID: PAT_TA_9104
gncccccgggctgaggaattcggacgaggctaccgggaaaatgttgcgagcctctgcagaagtacaggctatacctcagacggctaagtgccgtggcatcacagcaagccagcattgctgctgcttttggaggcagagaccccttcttgcacatgggagcatttgaaggacttcatagttatcatcaaccctttgcccctcctgctgctcttccatctctcaatccacatggactgctgagtggtgctggtgcagcagcatttgggcttcaggaccttgcttctcccaaggcaaaccagtgttctagcagcaacggcgcagtaagtcattgcgccggcgatacggagaagttccacattgtgagcttacaagacaaccaacaggcagatttatcgcaaggcttgacctcgtcgcttgggcagccccagctccatcagaagtggattcatcaagaaaccagtgacttgtgctctgtcttttccgggggtgctctggctaacactatgtctggcacacttcaaagagttacaagcagttcactgccaccagaagatcttttggagtgcactgcacacatcaaagttggagcccatccatcaataggaataccaactgggagttcagggctgcttgaaaggtctgtcggagtttccgccgatttgcgggattcttgtatatctcagcagtgtgctctt

SEQ ID NO: 9105 - DNA, 744 bp, Triticum aestivum
  unsure (1)..(744): unsure at all n locations
  Clone ID: PAT_TA_9105
tnnccctcnntnaaggnnncnnaanctgnagnnccnnnncggtgncgnccgctctananctagtgnatccnccggnnngcagnaattnggcnnnaggcnccncnccaacaccgcgcgccccaccgggcctccccctctgacctcccccaccaggcccccaccccccttctctcccctcctcagctcccaacagcaagcatggacaagcagcaggtctttggttcctcctacgtggacatgcctttcttcgcggccaatggtgcagccacggcacctgggagccacggagcatccggcgacggcggagacgccgctggcgccgttggcgcgtgcggcgggagccctagctcgtccttctcgacgggaacctgccagcagcatccgggtttcagcggcgcagacgtgctggggccggacgatgacctgatgatgtgcgtccccgagtatggtggctacgccgatagcagcgtggtcgagtggtttagcctgtatgggcttatttgatattgagacgagctgggtatcactatcaactgcatgcagatcgattactattctagttagccatagtgttaattaagctggggtgatctctaggcgtgcctgtttaattatgtagatagtgttgattaatggcaaaagcttgcaagctagcaagtgtagtactggtagctctaatgaagttcagagatgatgtgtgttatcatttgattacaacttttacagtacttggcaaaaaaaaaa

SEQ ID NO: 9106 - DNA, 664 bp, Triticum aestivum
  Clone ID: PAT_TA_9106
gcacgagggggctgggcaaaaacaatgtagcatatgtgtttcaccaaggagagaggcactagcaaagccgttgtgtcttcttccttggtgcagtctgtgtgcgtgtgtgttctggtcatgtgtgtttaaaagagtgttcttgtgagaagaagatacaaactacaagagagttgtgagaggtagaagaggagcggcgctgcgaggatgctgcgccaacaccttccgcggtcccttctccggccctccgcactataagcggggcttcaccttctcctgccacggtgggtgggtgctcaccaacgacgaggtcggcaacccgtacctcctcaaccccatcaccggcgctcaggctgcgctcccgccggtcaagacggcctactaaagcgataccttctacgacgatgatgggaaacacgtctataagcctcgtaaaaaatgtgacgttccttggatcagctgggcacgacatatggagtatactcgggtcgccatctccaccgcggcttacgtgagggcatgcaccgtcgttatcatgcacatgccaatgttcaaggtttcttttgccaggccaggagacaagcgctggacattgctctcagaacttaaaaaaacatgtttacgacattctttataatgacaaggatgttttattctaaaaaaaaaa

SEQ ID NO: 9107 - DNA, 822 bp, Triticum aestivum
  Clone ID: PAT_TA_9107
aggaaaagaaaaaacacacccgtccaacccccaatctcaccctgctctcccgcaccactcgcctcggacctaagcctaaatcgaccgcgccgccgcccccgatctgcgcgccgccgcccgtccgcttgttccctcgtgccacatcaactccaaccctgaccttcctccccgcagggcaccatccacccaggagcagcagctccatccgtcgcgctgaggagtagcagtgccgtcaagcgccaccatacaggagcagcagcgccttcaagcgccaccggacaggagcagcagaaccatccaccagtaaggagaagcaaggccatcggccgccgaggatccagcgctggttttcctccacctgtggcctctgttccggctgatttccttccctccgcccggcctgaggtggtgggggcaagtgaagaatttacatcggttctgttacaggaacagaggatggtcctcctaagctgcttaatgatggttgctaatgacaatgatttatatttcgatgatgatgacggtgatgagccattgatgctcgaggatgaagcagggttagccgaggtcctcgaagcctatctctgacgctgatgggtggaccgctctgctgcctaggcatgatcagcctgggaagtagtattaaggacatgagaagcaatacttggcgctgtttggtctgaagagttggaatccctctagcccagctctagggcaggaggtcggttgggaattggatcagtatcaggattaggaagcaaccaagtcacccttttgatcaactaaaatagtaacaacagtcaatggtgacttgtgaccatg

SEQ ID NO: 9108 - DNA, 925 bp, Triticum aestivum
  unsure (1)..(925): unsure at all n locations
  Clone ID: PAT_TA_9108
cttgggctgtcgtgacttcttgagaaggtacagtcaagtatacctgttccagttcttggtgggggccgcccagttccaggaaggaacccttgcattgggaacccaaaggtttgctggcttctggcagctcccgccggcgctttcgccgcgctggctcttcaacggtcgccttcctagtcacccggtcgggctggtagggggagggcaccggtccagtcttcgccaggtttctagcagcggtcctccgttgtcgcgtcccgatccttgcccgggccatcgtgcctccatggaagtttcaccttcctcacccccagcattggcggcgtcatcagtggtggatgatgaactcttcctgacaaacaaactacaacttggacagttcatatatgttgaaaaggttcagtccagtgttcctgttccagttcttgttggggtcagagcagtcccaggaaggaaccctttcattggaaaacccaaaggatttagatgcaaatgtcaactccctctggggttttggaagcattggatcaacaacggaaaactaccaagccaactgaattgtctgagagtgaaaaggaaaactctcagaggaaggtagtcatcaaagagcaggaaggccggtgttgcttcccgttacatgcttgggcatatcaagcaacaatggtaaaattaccaatctaaactctagcatggatagtgacaaaagtagtaatgggaggaagtatgtttgcgatgcaaaccaaaagctggtctctagtgctacgaaagtgaaacaagatcaaaactcangaaaggcaaatattactccctaataatgccaagttactccacaagacaagaagttataaggaatacccagaatatggaggcaccaatcagacggtcgcgtatgaagacaatgcaagggcttaagggcncacnagga

SEQ ID NO: 9109 - DNA, 1285 bp, Triticum aestivum
  Clone ID: PAT_TA_9109
ctcgtgccctcactcagcccagctcggcccccccgcgctcgttcctcgcccgcactatcatagcctcctcccctctctcctctctccctttcccccctctcgaggcgcctcccctgccctctcttctcacgctcagacacgcgagcgcagccaagaaaccggccgatgcgagggctagcaggaggagttgggcccgcggcggcggcgttcgggcccggcgagccgcctccggccgcggaggaggtggttgaggagaactccggcggggaggaggacgaggagctcgagctggggctctgcctcgggtccaggaagcagcagctgctgcagcagccggcggcgccgtcgccgtgccgtatcctgacggccagggagactccgccggccgcgcccgctgtcgccggactcctccgtgtcgtccgccccccccgccccccccctcgccgggggtccgccccgcccccccccctccgccgcggtcgcgcgccgccggccacccacagagcttcattcaggatgggcagccccaccaataagaacattcaggatgaacagcctgttcggccaggcgaaagacaatgcctcggatgccgaaaccaagaaggccgccgccgatgagtccggctcgcagaaagacaaggagaccgagaagaaggtccgggtgcccgggtgggtgaaggtgaacatggatggggaggtcattggaaggaaggtggacctcaacgcccatcgctcgtacaagacccttgccttggcccttgagatcatgttcaccaagccgtccgccggcctttgcgcttctaatagcacgaagtcactgaagctgttagaaaactcttgtgaataccagatgacataggaagacagggatggtgactggatgcttgttggagatgtcccttgggaaatgtttgttggctccgtgaagaggctgaggatcatgaggacatcggacgccagtggtctcggaccacggtttcaagccaatcacagaacgagggcggacatgagatgagagcgctgaagacccaccgaccatgtcggagcgagcagccgttgtgattacctgtgtgcctagttgggattgcaggagcaaagatgtgctcctgctatctagtggtgactcgtttcgatctacgtagtatctattcttttcccgctcccttcttctgtctacacttggtgaagtgctgctgatcactgccagcatatgtgctcttttttcgtcatatatgttttttttttttgtgtgacacaagtgtgttgctctgttgtgttcagtttg

SEQ ID NO: 9110 - DNA, 843 bp, Triticum aestivum
  unsure (1)..(843): unsure at all n locations
  Clone ID: PAT_TA_9110
gaggaattcggcacgaggctgcactgaacccttacnacgtacatggacaataacggctcgggggtctgccaagagtcaggtcaagcactacaacaatgcaagaggtccaggcaaactcttcaactttgatctccgtgatgcacatggtggagaaattcgtgcagtatgctttaatacacagttggatcagttctatgacctgattgaggttgataaagtgtacttgatatctagagggtcactgaagcccgcaaataaacagtttaaccatttgaacaatgactacgaagtctctctggatgctgcaacaactatagaagtttgttctgatgatgatagcagcatccctaggcagcagtttgatttccgacagatcagcgaaatagctaacatggataaagacaccatggtggatttgcttggggttgttacgtcagttagcccttcttctccatttacacggaaggatggtgtggaaacccagaaaagagtccttcaactgagggacatgtctggttgcagtgtggaaataaccttttggggtggcttctgtaatgctgaaggacagcagctgcagtcgctgtgtgattctggttcaaatcctgtgcttgccctgagatctgtccgtgttggtgaattcaagggcagaaatgtaagcacaattggctcaagcttcttaaaaataagatccagacttccctgctgccgaaagtctgaggcacgggtaccataacctgaaggggaaaaacgctgttgccttcttatctatggggagggtcaggcatgggccggactgatgaccgaaaactgtggagcagatcacgtgaaagcttgggggagatc

SEQ ID NO: 9111 - DNA, 1467 bp, Triticum aestivum
  Clone ID: PAT_TA_9111
ggaggccgaaccctaacccccaaatccccaatctcgatccatcggccgaaccctaaccctcacccccccaaatccacaatcccggaccgcgacgatggccgccggcaacccccgcttccccgccttcgccgtcctccacgccaccgcctacatcagcgatctccccgccgcaaccgccgcgtggaccttgccgacggcgggcctcgcccttcaggtctccttcggtggtggccgctccgccgcgcccctcctgcttctgcgtctgctgcctgcggccgcgatcagaccaccttcaccggagctgcgccagatgtcgtctgctccgtgggggaaccacgccctcatccgggttggcttcaccaccggcgactcgacggagcacttcttcatctaccgggccagcggggcccgatcggacggccgtcgcttgatctgctccccggacttcgatgattatactgacgcagagaatctgctgctgcccctcggtttcgtctcccaccgcaagcacttggtctgagcggccctgagcgacgggccgacggacctgcagtactttctcctcgcccgcagcgccgagccgcactccagatggtccaagaagctgctgcgggtggagttcccccgtggagcagccaggaaatcggctatgaacgatcccgtaaaggtggtggcccttggcggtgggctgctcggttgcctcatcctctcggagggcatcctgatttgtgacgtgctcgatcccggggtgacagcgttgcgcttcgtcccgatgcccaagctgctgcccagcaacaatgaactctacgacaatgaatctcgcgtccgggcgattcgtgacgtcaccttcagccgtggctacatcaggtgcgtcgagtttgaggagctggtagaacgcagagccacaactggttcggttgttcctgatccctgggacatggatgagctccaagactcggaaccggccatcgatccaccccaggaggaggaggaagatgttatcgttggttggaggctcatcacatggtataggacattgacttggaactgttggcgcaaggggaacacagtccattccgatgagctcggcactgtctccttgcctcaaattggaggtggtggtgcgtgtgctctaaaagtgccactcaaggacctgaaaacagctgctcctactctgcgtggcgacggcgatgttgtttacctcgcgaccgaactgcatgagcagggtgaaactgcatggattgtcgctgttgacactaagaggaagttagtagaagttgctgccgctgcttcttccgacctgttgggtgtttgggtgcaggggcatgacaagcatttccgcttacctacctggagctttatctgatttctcaaaccaagatattcccgtcaagcacatacggatgttagtccggattcgttaaaagatacaacccctccaagaaagaacatggcatgggggggggc

SEQ ID NO: 9112 - DNA, 577 bp, Triticum aestivum
  Clone ID: PAT_TA_9112
gcacgcgtccgcggacgcatgggggaacaagtattctacaaaagcatatacatcaaatagatgtattaaaaggtgcaacagcggtgtcataactgtagcacatacataacgtcataaagcatgtactcataatggacgttgcatattcgtccatagtaaataacccttgtacatgggagaaaccaaaagttaccgtcatggtggttcaggagatgtggcgtgacagcggatgaggataattagtagctgcactacactcctgaagctttttttaactgttgggagacacagaagtttttcaaccttcattaagtttacatataaagaactcttcactttgaagatttgaaaagttatgtcatgtgatacaaccctcgtttctaaatgtgctatgaaagtgtctgaacctgcattttatctcagaatggcaaaatcacaccaatagatcatcattcaaactaaactggacttgatttcatccatgcgcaaaacctccgtcgggaatttagctcatggctaatcaaataggtgattatccttagactgtgtagagtacctgcccgggcggccgctcgaa

SEQ ID NO: 9113 - DNA, 556 bp, Triticum aestivum
  Clone ID: PAT_TA_9113
ggcagccggctctctgcggtctcggtctcgctcccgcgccgccgcctctcgggctccgcccggggctcgttccccctgccgcccacccccagcctgctcgccccggtgcgtgtgctgcggcccggtgcggcgcctgcgcgtcccgggggacccgcccgtgcgcgcggccccggggcggccgctctgtgcggccccatgctcagccgcgtccgcgcggtcctttcggccgctgctccccgcggctatttcggcctagccgcgactcccccggtccccgctgggcactcgggcagggggtgagaggcacctgtggtgtcgatctcccagcggcggctccgcctggcgggctcctcccagggcgcggtcacccccccggcctcccgctccccgcccgccggtgtggatgtgcgccgccccgcaggggcgcctgcgcttgctgggcttcgcgccggtgctccctggccggtggaggtgcttgggcttgggctgagtgtcacaattgttgtggatttacaagatgatagtgcagatggagaatatcttgttatttggctgt

SEQ ID NO: 9114 - DNA, 1088 bp, Triticum aestivum
  Clone ID: PAT_TA_9114
gccggcacgtcggctcgtggttggtcgtccggctgctcgatgctggttgctgcctcggcccccacccgctctcaaccacggccaccatcctctgtcttgtggctctgaggaggtgcccccctgcgactgctgcctcctcctagtacttgcctcctctccgatccggctgactagcctaaattgaattggatggatcatgctaggcgcacaaatacgtatatcaaagaggtcaaacaattcagacaactggcagcaagaatcctgcatgtgttatcggtgaagactgaagaggctactctaccgctaagtccacaaagggactcgaccgccaatgatgctcctactcctcaagcagggagcatggaatctgggagccaagtatcattggagaatggagattgggtctattttgcatgtagcaatgacatgggtctcgtggcagtattctaatcgttgagcacttgaaaaggagactacaaatggtcacagtataatgcttttgcatccacaagtttcaaggagcgtgatctcactgttctgtgagctaaaaggatcttctgcggaatctgtttctaattggatcctgatcatattttgcacttatcaataatgtattgcaagacatgtgaaccctgaatggcatgcctatgtatgtatgtagacgtgatgtggatcctggcgctcttggcctggccgccttcccccttttcatgtttgctgaagatggaactggtagtgaactaacgaatgtaaaaagttcctcgcatttatttaaacagctcaattagttcaaagataggataatcatggtgatttgatatttcctatggctgattacaaatgtatgatctgatagaaagtttgacatggcttctttttatttacaggtcacagtataatgcttttgcatccacaagtttcaaggagcgtgatctcactgttctgtgagctaaaaggatcttctgcggaatctggttctaattggatcctgatcatattttgcacttatcaataatgtattgcaagacatgtgaaccctgaatggcatgcctatgtatgtatgtagacgtgatgtggatccctgtgct

SEQ ID NO: 9115 - DNA, 1275 bp, Triticum aestivum
  Clone ID: PAT_TA_9115
ctctcggccccacttccgctcacgacctctcgccgcgcctgcagatggccgaatccgacacggcggccggcaatatggccgaacccgacgcggcggacggcaagatggccaacggtgaggtctccgacgacggccgcgccgtcgaggtctccggcggcggcgacgacaccctccccgcggtgctccgcggcttcgtggacggcgtctggccgccgcccggcgacggcggagatccgctcctgcggcgcctccgcgcggcgacctgcgaggccgctccgcggctgcgggacgcctccaggaactcggcccgcgacctgctcgcctggaccaagcagggcagcggcctccgcgccatcctcgtcatctcggtcggaacaatcacgatgatatcactgactggcctgctgattttcatgtccttccttctggttgcgaccgctaatgccattatcgtttcagttcttatgtccttggcagctgctggaggattcctggccttgttctttgcttgcttagttgcagtgtatgtcggagcagtatcaattggcatattcgtcgtttccgccactgttatctctgcaattgttggagtcatgattgctactggttggatcggattcttttggatgatttggtttgccgcaaggaagagcctggaccttaccaagcactcaatcggcatgacgacctctgctatgcagtcgtattcggcttcccggagtgtggggcagaagctcacagactgactgagatagcagcaactggtttagccccaatgctctgtatgttatcgcgtcgtcttgccgcctccctgccctgctgttgttgtgttatatgtgctgcctaaagcgtgccatatgtgtatcacttatttcgagtagaggacatgaatccgtgtatagttatcccggtttagcgtaaggtaccaccagtcgcccctgaactttcggcaccctgtgttgtagtatactcatagtaacgaataaggcaataatgccggctgtgttggcgagtgcgggctaggttgtggttttgtgctgtaaatgaagctattctgtctggctatgttgacatagtgataaaaaaagacagtagctgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgggcgttttaaaggatccaagtttacttacccgtgcttgcaacgtaataatttttttataggggcacctaaattcaatt

SEQ ID NO: 9116 - DNA, 784 bp, Triticum aestivum
  unsure (1)..(784): unsure at all n locations
  Clone ID: PAT_TA_9116
gtccacccccatncaccggcgagcagcgcctcctgcccattccgtcggagttcaaattcaccgatgatgtcaacggggctgtgctctgcgctgccagcgaccatggccatgtgcacggaagctgccactcgagccccttcaagcagagcctagctgtgatcaaggggcctcccattacagatgatttccgccatgccagccattggatcgtgcaggctgaggatggtgctgttggcttcgccatattgacttgcagtcacttacaaatgtggcagaggattataaatttccatggtgttgccacatgggtgttatggaagaccattgacatgcataccatccgtgggctccctccccagattgacatgatacgtatagcgggatgcattgaggatactgacggactatttctattcgtgggccatgatgtctatatggttcaacttaattcaatgcagtctaggaaactttttgaaaaccgtggttatacttactatcattcgttcaagagtttctatccgccaggcacaaccattgctggtgcatgtgatgcagctgaaatgttgcacgatacataggatgactgtctggtttgatgttctaatgtgctgaaacggttcagcaggttggatttcgtcgtctcttgtttctgttaggtatttgtgcctggcagctcttctcctgagccatgatagtttcagtcccatgtatcaccaaaacttgtgtgtttgagtgtgcttgtcagctgggtttgaaaagcatgtcattgccgtcgnattaaata

SEQ ID NO: 9117 - DNA, 1834 bp, Triticum aestivum
  unsure (1)..(1834): unsure at all n locations
  Clone ID: PAT_TA_9117
tcaagctcaagaccgtgcgcataggataggtcaaaagaaagaagttcaagttttccgattttgcaccgagtataccattgaggaaaaagtgattgagagagcatacaagaagcttgcattggatgctttggttattcaacaaggnacgattgtcagggcagaaaactgtcaataaggatgacttattgcaaatggttagatatggtgcggaaatggtgttcagttccaaggatagcacaataacagatgaggatgttgccggaattacgtcggcaggagaagagacaaaagcagcgctggatgcaaagatgaaaaaattcacagaggatgccattaagtttaaaatggatgacactgctgaattgtatgattttgatggtgataaggaggaaaacgaggctgattttaagaaaattgttgctgagaatttggtggtcgagctacctaggagagaaaggataaggaattacaatgagtctgaatacttcaagcaagcacttcgccaagcagcaccagctaaacccaaggaactacggattccaaaaatgccaactttgcatgatttccagttcttcaacagtcaaaggctaaatgagttgtatgaaaaggaagtccgacaccttgtgcaaaccaaccagaagaaagataccattgacggtgaagatgaagatcaggtggagccttttactgcagaggagctggaggagaagcagcggttattggaagcgggttttgcaacatggactaagagagacttcaacacatttattcgtgcttgtgagaaatatggtcgtaatgacataaagggtatatcctctgaaatggaagggaaaacagaagaagaggttcaacgatatgctgaagttttcaaggagagatacacggaactgagtgattatgagagaattatcaaaaacatcgaaaggggtgaggcaaggataactcgcaaggatgagattatgacagccattgggaagaagttggaccgctataagaacccatggttagagctgaaagttcagtatggcacaaacaaagggaagttctataacgaggaatgcgaccgttttatgctatgcatggcgcacaagcttggttacgggaagtgggatgaacttagatctgccttccgcatgtcacccttgttccgattcgattggtttgtgaaggcgagaagtgcacaagagctggctaggcggtgcgacacgcttgtccgcctagttgagaaagagaaccaagaatacgatgagcgagagaggcaggcacggaaagagaaaaggcttgctaagaagatgacaccaacaaagcagaagatgacgccaacaaagcagaagacgacgccaacaaagcaagctgcatcaagggtttcagacggcgagacggctccagcgaatccatccaagaagaataagacaccaacaaagcagaaaatgacacctacaaagcgagctggtgagacggctccagcgacctcatccaagaagcggcggcagtcccttatggatgatttcctgggctcgggaaagaaggggaaggcgtaagcgcgggtgatccgatgttgccttgtcaggagatgttttgggctcggcttcttccagcgcttgaagcctcctatcttagtgtaatatatatgctcaacggatctttggttaggttaatcactgtccaagtaagtttaatgcacgtgttgtggcgccacctgcagtgagtgcatcaggatcggtttgaacattgaatgttggccgggcctttttggtgtttgcgcatgaagatggtatgcaaacgactacaaaaaggttttagaaacgacatgcattaatttcaattgctccag

SEQ ID NO: 9118 - DNA, 1012 bp, Triticum aestivum
  unsure (1)..(1012): unsure at all n locations
  Clone ID: PAT_TA_9118
cctggnaagnaaatagtaatagcggtcgtggccaatcctctaacagagcggcggaggagaaggagtggaaatctatatggtctgttattgcacctaacaagatgaagatcgtcttatggcgttttgcacataactgtttgccttctggggaacagctctgtagacgcaaggttcctgctcctgctgcatgtgctttctgcggccggctggagactatcgagcatgccttgctcttctaccattttgcaagaaatgtgtgggatgaagtgaagaatttctttcatgtccagctgcgccgtggtgaattcaggtctccaaaacagtggatttttgatttcttatctcgatgctccgctcgtgaggcaactgtgatgactgtaaccatttggcacatttgggatgctcgaaactcggctcgaaacactcctgaaggtcctattccaagaagcaatgcaggcaaaattcgtagttatgttcagatgatttttgaacatgcttacaaacctgttcctgtgaatagatgtgagactattgcttccagctcaaattggtctccatcgcctccaggtacagttatgctattttctgatgcagctttatttcataactccaacaagtctggtgctggtgtagtagctctgaaccatatgggtcattgtatcaaggcgtgtactgatgtgttgcctggtgcactcacccccgagatggctgaagctttggctcttcgcatagcagttgacatggcacgtcaagaacacttttctcatgtgatctttgccactgattgcctttctttgatgcaaaggctgaaatccaaagcccaagatcgttctgtggttggttccatcgtggctgatatcaagctggcaactctgggcttctcctcattctcttttgtgcatgttcgtcggccatgtaatgtgttggctcatgttttagctaggtcttgttataattctactggtctttgtgttttcaactatgctccggagtgtatccgggagactttgta

SEQ ID NO: 9119 - DNA, 605 bp, Triticum aestivum
  Clone ID: PAT_TA_9119
cagggatggagggagggatccaacgaggtgccatgtgcagcgcctcccctacaccaccacacaccgcagctagcaccctatccatcaccctcttcctccccttcttgcttcttcttgattgatcgcccacgcccggtccacccttcttcttggtcctgcccctagccctacagcttagatgcgtgcatatgtagctgcattgcccaattgaggcgccaattcggagaaagatatcgctgccgcattcatgcgtgccggagctataccacccaccgatttggccgttgggggggacctgtggtcccttcgggtttagatttgggagcgctgcttcgcttgaccatttctcaagtgcaacgctgctgctgcttaccccgacacaaggaaggaaaagggaatcccccctccacgactttgctgattcgatgtcacgggcatccggatgtcattgccgatcgccgccatagtcggcattgccgccggtggcgccgccttgctcgtcttggtggccgtggtgatcgcgctctggtgccgggcgcgcgcgcggcgtaacaggacctccgacaccggctcctcggatccttccaccctagtggagtggggca

SEQ ID NO: 9120 - DNA, 484 bp, Triticum aestivum
  unsure (1)..(484): unsure at all n locations
  Clone ID: PAT_TA_9120
cagccgccgccctccgctgaaaagtcctccaaccccaaagctcccccctctccgtcggagagatccgggccgcctgcccccaatcccgccgccccccgcctccgaatccgcgcggcgtccacgggcgtcgggcggaagaagcctcgcgcgcgcgcgcgcgcatttcctccgtcgcctcgtctcgccggggattcgggagggggctggggcccgcgagggagggaggcgggatgccgattggggtgtcggacgagctgctcggcacgttcgtgccgatcgccgtctactggctctactcggggctctacgtcgcgctggacggcgtggagcgcctcgactcgtaccgcctgcaccccaggggcgaggaggccgccaggaacgtcgtctccaggggcgccgtcgtcaggggcgtcctcgtccagcaggccttccaggtcgtcgtcgcgctcacgctcttcgcggttattggcgatgagagtggtan

SEQ ID NO: 9121 - DNA, 911 bp, Triticum aestivum
  Clone ID: PAT_TA_9121
cgcccctgggggaccccgctgttgctgtggcagctgccccgtcacctgcggctcaggggcgggcggtgccgccaccacatgacagcactggtgaagccgaaggccggcgatgagcttgcgccaaaccttcccccgtcgaagccgattgttaggaagccacccaaggccacctggcctgcaaccagcaagtacaccaccagcatgcctcgtccatgggctcagttgagacccggaaagggaagattatgatggtgtctgccagcctactgcagattattgctcagcttgatgataactttctcaggtcttcggagagtgcacatgatgtgtcaaaaaagcctgaggccacgcggtggcgttacccccccggccctgctccctaagaaggcacagtttgaatgactggcatcgtaggtacacagaaagaaaggcatcccagggtgaggaagctaaccccgaagcagccaatactccaagcctagatcatgtcaacgagaggagaataaccattgaggaagtagaaatcaggctgaaggaagaggagaagctccaccttaggcttgcgaggcaggtgagggagaagacgctggcatacctccgggtgcacctgccagagctcttcagaaacatggcggacttttcgttcttctgccatgacatgtacagtagcttgagaaaatctgcagtgctgccaatgctcagagacgaggttcaaggttgatggcttgtgcgtgttagtgttactgtaattgtcctgccaccagaggcaggcaaatattattttggttgtagggagtagttgtttgctggcattaggccgctctgaatatgtatgttccaagtgcactgtagaagtcagccagcaaaattgagatcatcccctgataccatcaatcatttatcatgtcata

SEQ ID NO: 9122 - DNA, 870 bp, Triticum aestivum
  Clone ID: PAT_TA_9122
ctctcgggccgccggcacgggaccggatccacccggaggggaggaagcagcagcagcaggtcagcgagggaggagtagaggggatggcggacaagaagggcggagcgccgaggaaggaggaggtcgtcacgagggagtacaccgtcaacctccacaagcgcctccatggctgtaccttcaagaagaaggcacctaatgccatcaaagagctcaggaagtttgcacagaaggctatgggcacgacagacgtcaggatcgacgtgaagctcaacaagctcatctggagcagtgggatcagaagccgtgccccgtagggttcgctgtgaggattgcccgcaggaggaacgaggaggaggacgccaaggaggagctctactcactcgctcaccgttgccgaggtgcctgctgagggtttgaaggggctgggaaccaaggtcgtcgatgacactgagtagactcttttctttatctacatcgttagaatgagctgttattttgcattgcaccagcatgttttttgtatcccgcagaagttttggagtatggaatatcggaagctatctattttccttcatctaaaacctgatgatttgttttgtacttcaaactgtgctcgttattggcgtcaatacaggatgtgcagttgagcttgcaaaaagaaaaaaagaaaaccggtgggcctgctggaggttgtggtcgtcggtggcccaggcgaggccgcccacgaagcagcggtactccgtctccgccatggatctctccctttctctcctctccgaactacggaaaccctagactaggctagctactctcggacccgaaccgaaccagaacccgaaccggaaggggaggaggtcgacgcggccgcga

SEQ ID NO: 9123 - DNA, 984 bp, Triticum aestivum
  unsure (1)..(984): unsure at all n locations
  Clone ID: PAT_TA_9123
attcggcacgaggtatgttcggagcatgctgcaattccaaggnaaggctctacgccaccttctcggcttcaaaagagatcgtgcagctatatccaccgagacaaccacggcttgagaattcgctggtggttgctcgtattccagatatatttggtgagcacattttctgtcagtttttcctggtggagtctggtggacgaatgctgctcgttgtaccggtcccccctgcccggggcggcccgcgcgtccggtcacgacaagtaggcttcaggctctatgcagtggatttgtgcagcaaaggcattggtaacttgattccggtgagctgcctaggtgatcgtgcgttgtttctcaacagcgatcgatgcctggctgttttggccagggacctcccttctctgagcagcaactccatctacttctctttaccggacagccctgttgtggtgcactcattgaggactggattgtcggagcagttggcggagcactgccaaatacacaactcggtggataggatccgcccctctgtgcgcccatttagcattgttgatcatcttctcacctactgccatccttctcactggattgaaggactcatgtttcatgagtaccatcatatacctgattctttcaaggaattgaggaagaacatccaggcaaaagattcacgactgcggattccgcgcatcatgggccagtgaaaaatcaaggttctggagacatatgccaaagaagtggggagagtctgaagccatgctgagaaataggggcaccagcctgaatacaacagcctattattctaacagtctcatccggccactaccggtctgcaacgtccgcagcagtgtgtcataagagcatgttctgccacgtccgcagcagtgtatcataagagcatgttcaacagatgatgtaaaacggttgttgcattttaaaaaactgtccgcagcagtgtatcataagagncattttaaaaaattt

SEQ ID NO: 9124 - DNA, 732 bp, Triticum aestivum
  unsure (1)..(732): unsure at all n locations
  Clone ID: PAT_TA_9124
ccacgcgtccgcttccgcacaaggttccagatcgcctccgtcccccgtccgccgccgccgccgccgccaccgccgccgtccgggatggcaaagaggttcaggaaganngagcagccggaggccccggcagcgagcctccccgaggacctcctcgtcgaggtcctggcgcgggtgccctacagatccctctgccgcttcaggtgcgtgtcgcggccgtggcgcgtcctctgctccgaccccgcgctccgcaagaggtcgccgcaggccctgtccggcttcttctgctacacccgcgacgacgagagcgacgagctacgcttcctcaacatctccgggnagaggccggcccctcgtcgaccccggcctccccttcctccgcgccgtctgggacggaggncgtccgggccgtggactgctgcggcggcctcctcctctgccagtgctggacgaaatcatctatgctcgacgccctctacgaccccgacgccgaccccgacatcgcctccgattccgaagccgaggccgacgctgtcgaagatgtggcaaagtatgttgtgtgcaatccggctaccgaggagtggaccgtgttgcctgccatcgaggatctgcgcccgaggaacgtcatccgtctgggtttcgacccggctgctccctcccgcttcgccgtgtttgtgctcttgcaggatgtggatgatcacgacgccggagtgcagatcttctcatcagagaccg

SEQ ID NO: 9125 - DNA, 729 bp, Triticum aestivum
  unsure (1)..(729): unsure at all n locations
  Clone ID: PAT_TA_9125
gactggacctcccggaactccttgacctgagctgctcgccgtcacccctgagggcctcctagttctgctttacgaccacaaccacgtccgcctgctcaacccgctcactcgtcacctcacagagctaccgccgctcaccacgctgcttccctctaaagaccatgacatgctttcccatttcgacataggcaacttcatagcgactggctctggcattgctagtgatgactcaacagtggtgctctgtttcaataagctccacacgcttggcatggccaagcccggcgacgaccactggatgttgctggaatacagaactgatgggcttacaagaaggccgttaatgtttgcaggatgcttctaccacgttaacgttgatggtgtcatggtgctgcaattccgtccaaacaagccacctcgcctggaggtggctgccaagttgaagatgcatgtctccccaatttcggaaagtatgcacctcttcaacaattgtggtgagctgatggtcatccgccgtgggattgtaccattcacgtcgcggaataattcgggttttcaccatcggtacaacatgtatcgagtgaatttggataccggcacactatcccgtgtcaagagcttgagtggtggcgcaggaagagctttgttcttgggcatttattgctttttctcggtgtctccagaggttttcccctcggctccatagcgcnnacaccatcacccgagctt

SEQ ID NO: 9126 - DNA, 1039 bp, Triticum aestivum
  unsure (1)..(1039): unsure at all n locations
  Clone ID: PAT_TA_9126
gcttcgctcgaactccccttcctgtacgacaacgccgccacgcccagnatcggtctccggcgattcgtgtgaccccgaacccgtcgcgccaatccatgggcatctagcgatcctgcttcttcctctcgtccgattcccacatccatccttcggatccttgttcgagatcaaccacatggacctctccgagctccgctacccgaagctccatcgatcgtcgattccgtcaccaccagcggagcgaacacaccgacctccgcctgaacagaacaccgccgcccgagcctccctccacggccaattccggcgagagagctcagattcgagctatcccacccacaccaaagatcgttgctgccgccgttgctctagctgaatagagcgacgctacctgaaactcgctgtcgccgcctcctgttcatctgctcgtgcggtcgttgcaggacccaccagagaactcacgacgaataccctaagtccgtcgtgccgcgcttcatccgtgctattcccgaagtcgtccccaattttcctccgcagagacgagggcacggattcgattaagctccgccaccgagcacccttcgtcgcttgattctgatgactattgataccggagcaagctaccgacacaccctcgatcccatcggagtttggcggcaccaccgagcgacgacgccaccaacagagggcacttccttcgccgttttacgccaccatcaccacccccgtcgaacaccgcacccacaatgccgcctcaacttcgccggaggaccaccggagtagtgccgccgcccccgcccgtagtgccgctgtcgtccgttggctcacgattgctcggagcgtgacgagtagaattgtcaggaattgtgagtgcgacgatcttcatcaaatataccagattttatacgacgagtgagtgatacgatgtaggttatgatgtctatactcgacatttgcctgtggtgttgatggacttcatggagattttatttgcttttctgctgcattttgtttgtatgctagcttagcaatgcaggta

SEQ ID NO: 9127 - DNA, 759 bp, Triticum aestivum
  Clone ID: PAT_TA_9127
cgctggctcctcggcccggcgccccgccgcccccgccctcctccggccccccggccccccgctcgcggcgtcgccgtcattccccgccgccgtcatctgcgcctacctcgccacggtgctcctcctccaccgccgcatcctgcccctcccgcccctcccgccgcgcgccctccgcgccgtctccgcgctgcacaactgcgtcctcctcgccctctccgccgcgatggccgccggctgcgtgctctccgccgcggccacggcgccctcgccgcgctgggccttctgcttcccgccgggcggcgccacggagccgtcgggcccggtcttcttctgggcgcacgtcttctacctctccaagatgtacgagctcggcgacacgctgctcatcctcctcgcccgccgcccgctcaccctgctccacgtctaccaccacgccctcgtcatcgccatgtgctacctctggctcgccacgcgccagtcgctcatgcccgtcgcgctcgtcaccaacgccgccgtccacgtcgtcatgtacgcctactacctctgctgcaccctcggcctccgctggccgccgcgatggaagcgcgccgttgcccgcctgaagagcggaaaaaaaggtttagattacatagtatttctgattaagccctggccctttgattcgtgatgaaatgcattggccttccatttttgacaattctagtttttcaaattttccaaatcatcaatcaagacgttcatgcagaaggccaatcacaa

SEQ ID NO: 9128 - DNA, 1192 bp, Triticum aestivum
  unsure (1)..(1192): unsure at all n locations
  Clone ID: PAT_TA_9128
gcggcagaacccattctcagttattgttctggaatgcattgatcaattggacatagttgttcgtggaaagatcaagcgggcaatggagactggtcgtctgcctgactctcgtggccgtgaggtcagccttggcaatgtcatctttgttcttaccaccaattgggtacctgatgaacttaaagggccggacgttgagtctttactacaaggtgaactaagaatgttggagatggcaggctctagttggcagcttgagctctcgattggggacaagcaggccaagcaccgagcagattggctatgtgatgatgttcgccctgcaaaggtagcaaaagaattgtccagtagccatggtttgtcgcttgacctcaatttggcagttggtgccttggatgacaccgagagttcacataattctagtgatgtctcagtggagcaagagcaagagaaagggcagcttgcagtactgtgttcgacgcctgcccctgactgcgatctattggaactcgttgacgatgccattgtgtttcgaccagttgactttaatccatttcggaagactattagagattgcatatcagcaaaatttgaattggtcattgggagcatcaattcattcagaatcgatgaagatgccattgaccatatggttagcagtgtctggctcactgatgagaggttcgaggactgggccggagaagtaattatgccaagcattgaacgattgtggcgcaacgtgaagcatgattgcgctcgtgctgtcgtccgcctcgcattagttgcggacgaggcgttgccaaggtggggtgagggaagggaagggctaccagcgaccgtaacgattgccatcgatggaatgtagagggcatttgagaaagtaaattctttgtacggtagatatgtaaatactttggagatcttctgctataagctttgtttggggtggtggggggactatgtgaagcacataggactaccaaataggcaggaggttatagattttataacacccaaatatgtggtctatagtttcgatgatatttgtagctatgttccttggaaagaaaaaacaatattttattttacttgtctcctaatgttccgaaggtggatgtgtagaggcaatacaggaagtaaataaagactgaactcgctatgtttttctggcccnaaactaaatccgctcggatcg

SEQ ID NO: 9129 - DNA, 411 bp, Triticum aestivum
  Clone ID: PAT_TA_9129
tgttcttccacgcgtccgcaccactttgctccatctgcgtccgcggacgcgtgggctcctattggacggacggtcagagtcagacccctttgccttagcccgtaaggttacgtggacattggggttttccttggcctgcccttcttggcgcattgtttcgtccgtctcgatagtcgacagtctgaagctctcttgggactgacttgggaggtgaggtgagacggcgcggcagcaatggctcaccggctgctgcacggcaccctccacgccaccatcctggaggccgacaacctcaccaaccccgaccgcgccaccggcggcgccccccagatcttccgcaggttcgtggaggggttcgaggagacgatcgggcgcggaaggggtcgacgcagctgtacgcgaccgtcgacc

SEQ ID NO: 9130 - DNA, 747 bp, Triticum aestivum
  unsure (1)..(747): unsure at all n locations
  Clone ID: PAT_TA_9130
gcgcggggctcgccccccgaccccggggagggcctccgtcgctccaccgtggcgagcgctctccacccgcattgagcaagcatccagggcccccgaccgcctccgagctcctccgccggcgacagaatgtgactctcccgaccctctccctccggtgttaaggatccaactcccgcccctccagcgacggcgacggaccacggtcgtcaccgttctccttccccggatccaacctcccgcctcgaagctccagtccccttcggcgacggcgatggcgacggcgtcagttccgcggacgtattctatctcatctgatcaagggctttcaactcactatagcatcttgacgttgttgtctttatcggtcattgagaagaaaaagaaagttcaatcaacatgaagctgttggtacctgatgttgatgcggagcagagaaaagacctgagtagggctagtgatctgcgccttgcagttcatcttgttcgaaagtatctctgcctcggacatggcaattgataattcaatacattcctgtcgtgcacaaacttgaacgatgatggcacatgaaaatagtttaggccaacacacgatcgcaatgaaatatggcccggctgatatttgaaccttggtgaattgatggttatcagttgtaatatttcttaaaattccagtttataggaattttgaaattttgtattttttttgaattatttgggatcagagccctngatcttaatgctacaatac

SEQ ID NO: 9131 - DNA, 442 bp, Triticum aestivum
  unsure (1)..(442): unsure at all n locations
  Clone ID: PAT_TA_9131
agacagggnaggggggaagaggccgtctgcgaatttgaggattttcctctccctctctctcttttgttcgtagccgtctggatatgctaccgctggcacccgggagacagcacgaatcgggcgcggtcgccgctacctgagctggaggaggatgtttgattgcaacggggaatcccaacagcaggtaggggatggaatctgggctgaactcagggagaatgaagaccatataacaccttgccccaaggatacgaaggatagtagatcaatctgtgttcgagaccagaagaagaatgatgatgaagcagctagtgttgtgggccttactgaatgtacttcagggggtcaaactgaacatcctggtttggaaaagcaggctgccactgaggctagtggacattattcagctgcacaacttgacatagaatcctggcctgacctg

SEQ ID NO: 9132 - DNA, 709 bp, Triticum aestivum
  unsure (1)..(709): unsure at all n locations
  Clone ID: PAT_TA_9132
ggccgtcggcaaatactgcagnttgcacatgatactctcacaaaccagagctcccgcaccgagtatgaccgcgcgctctctgaggaccgtgacgcggcgctcacactggatgttgcttgggacaaggttccgggtgtgctatgtgcccttcaggaggctggggaggcacaggcagtgcttgcaattggagggcacttactggaggaccgcccgcccaagcggttcaagcaggatgtggtgctggcaatggcgctcgcttatgtggacctatcaagggacgcaatggcggctagccctccagatgtaatccgctgctgtgaggtgcttgaaagggctctcaagctcttgcaggaggatggggcaatcaacctcgcacctggtctgctctcacaaattgatgaaactctggaggagatcacacctcgttgtgttttggagcttcttgcccttcctcttgatgaaaaacatcagattgaacgccaagaaggtcttcgtggtgtgagaaacattttgtggagtgttggcagaggaggtattggtactgttggaggaggattttcgcgtgaagcctacatgaatgaagccttcctgcagatgacatcggcggagcagatggatttcttctcaaaaacaccgaatagcataccgcctgaatggtttgaaatctatagcgtggcacttgcaaatgttgctcaagcaattgtaagta

SEQ ID NO: 9133 - DNA, 698 bp, Triticum aestivum
  unsure (1)..(698): unsure at all n locations
  Clone ID: PAT_TA_9133
gaagcctaccgacctcaactacccgtccgtcacggtgccccacctgtccgcctccggcgagccgcgcacctgcggaaggcgggtgcggaacgtgggccccgcgccggcggcgtacgacgtgcgggtccacgagccgcgcggcgtgtccgtgtccgtgcggccctcgcgcctggatttcgccgcggcgggggaggagaaggagttcgccgtgatgttcagggccagggcagggcatttcttgccggggggcagattgttcggtcggacggtgtggggcgccggcgtcgggcggcgccgccaccgcgtcaggagccccgtcgtcgtcagggtcgctgcccataggacgagcaaaaccagtgtccccgtcgcctgacgagcttcgctgtttcgttatcagcaaacgatgcgctaaacaaaaaagttcggtccgtcgacaacaagtgtccatatgtgccagtacaaactgttctttgagcggttaatgaagttggacttggatatactccttgataaaaaagaagttcaacgtactttctctactcaaacaaaattaagattaggcgtcatctctactatctctactctttttttttacgggtaggtaaacctttccttttatccagggaccgcccggtttccgtccccatcccctaaaggaaaaagngggnaganggggcagnagcggncnaaanaaaaga

SEQ ID NO: 9134 - DNA, 745 bp, Triticum aestivum
  Clone ID: PAT_TA_9134
gctcctggcttgtgctagctagctaccttgctgcgcgctgttcttgcaatagcattagcaggggggtgcagccatggaggagctccgcaagtctatgcttgtggctctgatcctcgcggtcacctgctccgtcgccgttgcctatgatcccctcgacccgacaggcaacattacaatcaagtgggatatccagtcatggacgcccgacggatacgtcgccatggtggcgatgaacaactaccagcagtaccgccagatcatggcgcccgggtggacgctggggtggtcgtgggccaagaaggaggtgatctggtccatcgtgggagcgcaggccaccgagcagggcgactgctccaagttcaagggcggcatcccgcactgctgcaagcacacgccctccgtcgtcgacctcctccccggcgtcccctacaaccagcagatcgccaactgctgccgtggcggcgtcatctccgcctacggccaggaccccgccggctcgctctcggcgttccaggtctccgtggggctcgccgggaccaccaacaagaccgtgaagctgcccaagaacttcacgctcatgggccccgggctcggctacacctgcggcccggccaccatcgtcccctccaccgtctactggagcgccgaccaccggcgcaagacgcaggcgctgatgacgtggacggtgacctgcacctactcgcagcagctggcgtccaggtacccgacctgctgcgtctccttc

SEQ ID NO: 9135 - DNA, 1638 bp, Triticum aestivum
  unsure (1)..(1638): unsure at all n locations
  Clone ID: PAT_TA_9135
ggcgcgtccgcccacgcgtccgaccttttcgggagattgggagtgccgtcggcaatggcggagcgcaggtggtggcggacctccgagagaagtgcgccacgccgccgtcgctgctgtgcgacgtggcggcggcgatggccgacgagatgtgcgcgggactggggaaggagggtgggagcagggtccagatgctgctctcctacgttgacaagctccccacggggagagaggaaggtttgttctatggactggacctaggagggacaaacttccgtgtcttgaaggtgcagctaggtggcaatgataagcatgtcattagccgcgagtccagagaagtcgccatcccaccacatttgatgtcagggagctcctctgaattgtttggtttcattgcttctgaattagccaagtttgtggctgatgaagagcagggtactagcttgtcaaacgggaagacacgggaactaggattcacattttctttcccagtgaggcaacggtccgttgcatcgggcacccttgtcaagtggacaaaggcattttctatagaagatgctgtaggtaaagatgtagttgctgaactgcaaacagctatgcagaagcaaggtctagacatgcatgtggctgcactaattaatgacgctgttgggacattggctggagccagatactacgatgaagatgtcgtcgcaggtgtgatatttggcactggcacaaatgctgcttatgttgagaaggcaaatgctataccaaaatgggaaggagagctgcctaattcaggagaaatggtcattaatatggaatggggtaatttctattcatgccatcttccagtcactgaatacgatcaagcattagatagtgaaagcttaaatccaggagagcagatctacgagaagttaacctcaggaatgtatttaggtgaaattgtaaggagggtgttgcttaaactgtccttgcaatctggcatttttggtgaaattgaccacactaagctcaaaactcatttccatctccggactccgcatatttctgcaatgcaccatgacgacacgcccgatctgaagatagtggaagaaaaactgaaagaaatcctagagattgcaagcacgtccttagagacgcggaaaatggttgttgaaatctgcgacattgttgcaagaagggtggcccggctggctgctgcgggccttgcagggatcctcaagaagcttgggagggatggctccgtcgacaagcgccggtcggtcatcgccatcgacggaggactgttcgaacactactccaagttcagcaaatgcttggaaactactctaaatgaactgctaggggaggagtcatcgaagttcatagtcgtcaagcatgcggatgatggccccgggataggggctgccctgattgctgcttcccaatctcaatacagaaatgttgaataacagtaggcaagctaggttgccacacattttatgtccccatctcgggggtgtagcgggcccggcccctcattccccagcatgcccgctgaagtggggcccccggttgggtctgtggccggtccttgaccgaaatgaggcttagatgaggtcaccttgtacagttaaaataaaagggaacctgaggacncatgannctgcaact

SEQ ID NO: 9136 - DNA, 690 bp, Triticum aestivum
  Clone ID: PAT_TA_9136
ggttcccgactgctggggcatccagcagctgttcccgatgatgcccgtgagccggctccacgagaggccgaccaacatggccacgctcattgacctcacctgcgacagcgacggtaaggtcgaaaagttcatccgtggcgcccagacactgccgctgcacccgctggaccccaagctcggtggctactacgtgggcgtgctcctgtccggcgcgtaccaggaagccctttctagcaagcacaacctgttcggtggcccaagcattgtgcgggtcgacgaaagcggcggcatcgtcacagcggacctgggcgctacaacggaggagctcatcagtaccatgaggtacgatgtcaatcaggacatcctcgacgtgatccacgagcgggccgaagagcatggggtgtggaagatggtgggggagatcgtgaaggccgggcttaccaccatgccctacctcatcgaataccaggtcccgctcccaggaaccgcctagctttcgtgtttggacgagactatatatatctcaaataagcgtggcccctattcgtgtttgcacgggctgatatatgcatgagcattctcctgcagtgctctaaattatatcgactatcatctcttagcattcttctgatatatgtatttatatttaagaataaaggttttaaggcatcgatctatctaaaaaaaaaa

SEQ ID NO: 9137 - DNA, 574 bp, Triticum aestivum
  Clone ID: PAT_TA_9137
gcaccagccgcagaggccaaggagaaggagctgctcgacaaggccaggagaggcggcgccggcgtcttgtcaggctacctagggcgatggggcagaggggactggagcgagaccagcagcaatggggagaaccggaggaagagggggcaggcgcggaggctggccaaggcaagctcgtcgtcgtcagcatccatcgcatcttcctcggcctcgtgggcgagcagctcgacggtcatggactgggccagccccgaggaggccgagctgcaccgcggcgacggcttctcgctcctcgtctacgcctggaagagctagtaatggctgccacgacggcgtcggcggaagcggccggccggccggcattgttacatttgatgattggatcttcattcagcgggagcttccctcccgattgttgtaagttgcagctgtcctccgagcaatgttcgtgtgcagttttgcgtgctcggctgaccaaaaaattgttcattactacatcaatagccaaggattttcaacagctagatgaaccatattacgacctttgttccgtcaaattcaaaatttaggtggc

SEQ ID NO: 9138 - DNA, 1627 bp, Triticum aestivum
  unsure (1)..(1627): unsure at all n locations
  Clone ID: PAT_TA_9138
cccagcgnccgcccacgcgnccgctttaagcagaatgatgggatcattgnaattgcagcaacaaacttcccccagtcactagataaagcccttgttaggcctgggcgttttgaccgtcatatcgtggtccctaacccagatgttgagggccgacggcagatcctggagactcacatgtcaaaggggttaaaagcagacgatgtggatctgatgaccattgccaggggaacacctggattctcaggtgcagaccttgcaaacctggtgaacgtggctgctctcaaggctgccatggatggagcgaaatctgtttcaatgaccgacctcgagtttgccaaggacaggatcatgatgggcagcgagcgcaaatcagcagtgatatccgacgaaagcaggaagatgactgcataccatgagggagggcatgcgctggtcgcgatacacacggccggtgcccaccctgtccacaaggccaccattgttccgaggggaatgtctttgggcatggtcacgcagctgccagagaaggaccaggaccagcgtatctaggaagcagatgctggcaaggctggacgtctgcatgggagggcgggtggccgaggagcttagattcggggagagcgagctacaagtgggcgcgtggtccgacctcagccaggcgacccggcctggcccaaggccatggtgaccaagtacggcatgagcaagcgcgtgggcctcgtggcctacaactacgacgacgacggcaagaccatgagcacgcagacgcggggcctggtggagcaggaggtgaaggagctgctggagacggcctacaacaacgccaagacgatcctcacgacccacaacaaggagctgcacgcgctcgccaacgccctcatcgagcgcgagaccctcaccggcgcccagatcaagaaccttctgtcgcaggtaaacagcagcagtgacacccagcagccccaggccgccgaggttccacagcaaacacctgctgccccagcctcgccccagtctccagcagcagcggctgcggccgccgcagcagctgcagcacagcaagcggcggctcaagccaaaggagtcgcaggcatcgggtcctagcctcgccgggcaacaagagaacatcgacccagcaagtgccattaattagcatgccgtttttttatggacaacagggcaaattcttagctgccgctgaagagagcatctgtactctgtagtaatttagctagttgggagtacaatttatatgtgttcctggctgttggtatgatgcagcctgaagaagaagaagatccgttcatggcaggggatccgctgattcatgtcaaggagattttgtaatctctgcatcaattagacctcttatcatttgatcgttgcggcgcatctcgtatgtgtgtcgcaatcttggataagttgtaacgtgtcggttatacaacggtttagacgtccaccttgttcctgccgtggcaacattttccgatgttaaaactcacaaggaatggcatggcattgttgacattcgcctggttgccgctgctccctcccccctgtcgctggtgatcgcccctgtgacgcctcggcggtttgatcgtcatatcgtggttcctaacccagatgttga

SEQ ID NO: 9139 - DNA, 477 bp, Triticum aestivum
  unsure (1)..(477): unsure at all n locations
  Clone ID: PAT_TA_9139
ggcagggacgggtactgggtcgagctacggcgngccggcgagagcgcgtgcgcggccgttcaacgttgttaggatacaggagcacgtggcgctggggcagcgggtggagcggcacgaggtgtacgtggacggcgtggccgtggccagcggcacgacggtcgggcacaagcggctgcaccgactggccggacccgtcgttggccggacggtgaagatatggttcgccgcgcgccgtgggcctccggtagtgtcggcggtgggcctgcatctcgaccctcacgaaatcaatcgcccgagccaataagtagtattgtatcatgcactcaggactcgcaaacatgcttacatggaagataattaaaaaaaagagttgttatagtaacataggtagataccgtaacataataaatgtgatgctactatgtgtcatacatgacagtaaatgagaccacgtatgatactaatctaaaaaaaaaa

SEQ ID NO: 9140 - DNA, 1352 bp, Triticum aestivum
  Clone ID: PAT_TA_9140
tcggcccggggggccgccgccgccctcggcttcggcctgcaggccatgccgctggtgccgctcaacgactgcccgcgccacgcgcggtacatggacggtgtcttcgtcgccgccgacggccggccgtacgtgcgggacaacatgatctgcgtcttcgagcgctacgccggcgacatcgcgtggcgacactcggagagccccatcaccggcatggacataagggagtcccggccgaaggtgacgctggtggctcgcatggcggcgtcggtggccaactacgactacatcgtcgactgggagttccagacggacggactcatccgcatcaaggtcgggctcagtgggatcctgatggtgaagggcacgccctactcccacatgaaccaggtccggcaaaacgaggagatgcatgggaccctcctctccgagaacgtcatcggcgtcatccacgaccattacgtcaccttccgccttgccatggtcgttgagggcgccgacaactcagacaccgcgcctggcgagtccccacggaggagctacctcaaggccacacgtcatgtcgcgagcacggagaaggacgcccgggtccggctgaagctctatgagccggccgagttccacatcatcaacccgacgaagaagacacgtgtcggcaaccccgtgggctacaaagtcgtcccggccggcactgccggtagcttgctggaccccgaggaccctccgcagaagaggggcgcattcacaaacaatcagatttgggtcacgccctacaacaagaacgaagaatgggccggtgggctgttcgtgtaccagagcaaaggggaggacacgctggctacttggtcggagagggaccgtccgatcgagaacaaggacctggtgctgtggtacacgttggggttccaccacatcccttgtcaggggacttccccatcatgcccactgtgtcgtccagcttcgacctcaagccggtcaacttcttcgagagcaaccccatcctcaagcagcggcccaccatggagaaggacctccccgtctgtgccgctactgcctgagaccatgcaccaggatacatgtgtgctcgaagacaacccccgggcacactgggctgttgcccggggcatgaggccgtgcgtaggcttccggcagcaccatgcagtgcccctagccttacataatcatgcctccgcctctggctagccaatagtctagtatgtgtagctctatgtttgtgttgtatggtgctccccccttcatgaatatgaagtgtatttaggctgtctaagaatcttggaccgatggtaataaattgggtgccgtacgtgaaggaaaattaaaccaaaaaaaaaaaa

SEQ ID NO: 9141 - DNA, 589 bp, Triticum aestivum
  unsure (1)..(589): unsure at all n locations
  Clone ID: PAT_TA_9141
ggccgaccggccggnagatcgaccgagnatgcatcggtcgtcgagctactacctgtcatcctcttcgtcgtcgtcgtcttctgcggtggcggcgtcgtcggtgcctggtgggccgagcgggaatgcggggatggacgtggaccagctgccggtgtacgacccgcactcggacacggccaagaaagaggccctcgacgcctcccgtgccaacctcgcccacgcccttgtccacctcgtccccgtcgtcgtcctcctctgcgggctcctcctctggtcgctctccaccacccccgtcccccctccgccgaggtgggcgtgattgtgctaaagaaggagagactaatggcgctgaagagtgggcccgagcacagctcgaacggccctcgcatggtggctgcgatggaggatccggatccggtaggcaacactgttgggaaaagaataaaggacggatttaagaaatgaaatgtgtagatatggtcccgttattttttcttagtaaaagagcaaaactagttgcatgtatacccattttgaaaggaaaaaacgacgacaacgtataaaagcagatttttttccaaaaaaaaaa

SEQ ID NO: 9142 - DNA, 619 bp, Triticum aestivum
  Clone ID: PAT_TA_9142
gcacgagggagagagagaataccctcgagttctagccaggagaagaattcactggccaaggcagggcgagagaaagtgaaggaaaacagtgataccaaggataagctgttgcctgctgagctaaatgggaaaggagaccaggcagtgaattcgaagagtgacaggtcagagcctaatgtcgaccgtgcagaggaaagagaaagaagtagatcaagaggccgtgaccgtgatattaggggtagagattctgatcacgagagggagcgtgatagagccaagagacaccgttcgagagacaaaagttcaggatactcggacaaggagaaatcaaggcaccgctcgtcacgcgaccgcgccggctactactcgtctggagacaaagatcatcggcacaggcgccattgattcagccgagcttccctgttgtaagaacatccgcagagagagcatgaagctcctgacgaagcgcgagaagaatttggtttcatctggtgttacactgtctgtgccattagcgaatcagtccaatctgcatcactttgcaacagagaaacagagcgcttgtcaataatttacctgtagtttatcagagggaacaaagacaggtgtctccccgagt

SEQ ID NO: 9143 - DNA, 499 bp, Triticum aestivum
  unsure (1)..(499): unsure at all n locations
  Clone ID: PAT_TA_9143
gcctccgcttgaacgatcgaggcgccggcaggnccaaggtagtctggactggatacactccttctcttttgtcccgtgtgataaaagatttatagcttataatatcacaacaattgccatttagaagattttggtggccagagcacaaagcaagtcactgaaccatgctcatggtctgctggaatatcacactaaaacttcatgcttgccacaacgccggcaggttttgcagctggccattttctcattccgaattatgaagtgatacttcttcacacaaactgggtgcctgctccagcctatcagagttgaacaaattaatgacatcaatttggctccaagttgtaactcaaggtcatctatttgtcaacagatgtggctttaaattcccgagcaaacgtataacaagtagtatagatcaatttataatgaattacgtgttaacctatcagaggctattaggaataggctgctcatttgccagcctntgttccctntc

SEQ ID NO: 9144 - DNA, 1064 bp, Triticum aestivum
  Clone ID: PAT_TA_9144
cggcgggcgcccccgcgcggccagaggggtggtgtgcgtgtgtgtgtccgactgctccagccaggttctcccctgtccctcgacttcgctagggtgccccggcgtccagcgctctccctccggccgcccaaccccctcctgcttctccgatgtccgtgccagaagggcagcatatctcggccgccatacccaaccccggcctccatttcccccgccggcatttatggtcctgtgattggggtgttttatggatagttgcatgataatgtccgggaatagtttaatctatgggtagactcgggaagtgtcttcgtaagggtattcattctgcttgttccgaagagcaaggtgattcagatggtgatccttttgtgcccaatgattttgctgaggacgattctttccaagtttccgaggatggtgaaatggataaccctgagtgtgaaaaagcttatatgatttctatgtgtcccacatttcttcaggcaggagggagacgataggaggtgatgaacgcacaggagggggcgagaaggggtgtttacctatgttttcctgcttctctagccatgttgttgaagtttgtgtagcagatcttggaggaatcaccctctctggtggtgcttctccatgttcgtccacgtatatgtggttgttccagtgcattttgtcaatgcagttaacttttttgagtggattttacactgtaaaactgttgaaattacagtgtatttattagtggttttacagtgttttttataagtggatttgcactgtaatttctatctggatttacactgtaattcatatctgggtttacagtgtaattccggctggtttatagtgtagttctttgtcgatgttgcaacttcgatatgatttacactgtaaatcttagttcaattttggtgtacttttaggttattttacactgtaattctcattggattacagtgcatttttaagtggactttcctttgtaattcattagtgtattttgttagtgtaattttagtactttctcagtggaatttttactattatttaagcagtatttacagtgt

SEQ ID NO: 9145 - DNA, 1114 bp, Triticum aestivum
  unsure (1)..(1114): unsure at all n locations
  Clone ID: PAT_TA_9145
gcgtctccccgcctcgggaggttcgccggccagcggcganaacgaagcgacgcagcggccatggctcgcccgtcgcggctctacctcctcgcctacaactccgtccaggccatcggatggtccctcgccctgctccgcctcctgccctgcctcgcccctccggtctccgtccgccccgcgtacgccgccgccggcgacctcatatgctttctgcagacctgcgcggttcttgagaccgtccatgccgccgtcggattggtacccacctcgccgtttcttgctttcctgcaatggggagggaggactcacttcattctcgcccttctccggcaaatccctgaggttcagggcagtccctctgtgttcataacgtttatggcttggagcatatctgaggtcattcgatactctcactatgctctgactacgttaaaagtttgtccagcatggatgacttacctcaggtacactgcctttatcccgctgtatccaatcggggtaggaccaggagaaatgtggactatgtaccaagctcttccatttgtgaaggagaggggcctctactcaggattcttcgcaaagttctccatgagctaccattcatttcttgtgggtgtgctactgtgctatccgcttctgtggctgaagctgtacttgcatgtgttcaagcagcgcaagtccaagctgggaaaggggggcaggaagaaacgagcgtgaaagaaataggttcagctcagctgccattatttcgctgaaattcggtaggcgagcaggttgccgggggatcttgcagctgatgcagttgtggaggcttggctgagatgaacggcgaacttactatactactagcagtttacgggggtttgtctacctttggagcagcaatttattatactactagcagactggtgatctctatcagatttactgaatttgagtgaagatgctgcgcaactcatggttatgacatttgagaaaaatatgacagattatttaacgtatgaaaaaaagtactggactatttgtgcagctaaaaaacaatatgaaacaatttttttgctcttccactttacttaaattacctctgttaattttcaaaaaaaaaaaaaaaaaa

SEQ ID NO: 9146 - DNA, 1053 bp, Triticum aestivum
  Clone ID: PAT_TA_9146
ctcgcaccgtgcacgggctgatgcaccccaacgttgtaaacaagcgcttctcctgaacccacgtttggttgatgcacatagtaatctggggaatctaatgaaaacccagggtcttgtgcaagaggcatatgcttgctaccttgaagcaatacgaatagatccacactttgcaattgcatggtcaaatctagccggcctgtttatggaggttggggacctcaataaggctatgcagtattacaaggaagctgttaagcttaagccatcttttgctgatgcacatcttaatcaagggaatgtgtacaaggctatgggaatgctccaggaggcagtttcttgttatcagcgtgctttgcaggcacgccctgactacgccatggcttacggtaatcttgccactatctactatgagcaacgccagcttgatatggcaattcattgttacaatcaggctatactatgtgattctcggtttgtggaagcatacaataacatgggcaatgcacttaaagatgctgggagagtagaagaggcaattaattgcttccaatcgtgccttgtattacaggcaaaccatccacaggctcttactaacctaggaaacatctatatggagtggaacatgataagtactgctgcttcattctacaaagcagcaattgccgttacatctgggttgtcttcgccactcaacaatttagcagtcatatacaagcaacagggaagctatgctgatgctattgcatgttacaccgaagttcttcgtatagatcctactgcagctgatgcacttgttaatagaggaaacacatttaaggagtttggaagagtagccgaggcaattcaggattacatacaggctgtgacaatcaggccaaatatggcggaagcccatgcgaacttagcctcagcttataaagatagtggacatcaagaagcagctatagctagctataaacaagctctttgtctgcgtcctgattttccagaagtaacgtgcaaccttcttcatactctacagagtgtttgtgactgggaaaacagagatactat

SEQ ID NO: 9147 - DNA, 607 bp, Triticum aestivum
  unsure (1)..(607): unsure at all n locations
  Clone ID: PAT_TA_9147
gccgcctctgccgccgccccgccgcctccgccgccgcgtcctccccgacgaactacgggaccgagcatccgccggccccccgccgcggcccgtgccccggccccgcgccggccagggggcgcgcgggcgcccccggacggctgcttggcgagcgcccccggcgggcgccgtccgtggctgccccgccgtgcgcccacttggtctggaccacacccggcactcgacgggccgacggcggcctgccgccgtctcgccgggggcggcgtccctctggtacgcccgtcggggcgaccaccctgctgccccgccccttcgtcacccctcctgcctccgtcctggtggacttcgccatggttcaacttctggaagttggtgatggaacaacttctgttgttgttttggctggtgggctttcgtggggggccgtccggtggcttttcttgcacgttcccccgtggccgctgagtgcgcctcacaggctggccgctgagtgcgccagaaatgctttgttgaagaagaccatggacaacaaagataatacagacaagttcagatcanatctcatgaacatcgccatgactacacttagttcgaaaattctntccca

SEQ ID NO: 9148 - DNA, 487 bp, Triticum aestivum
  unsure (1)..(487): unsure at all n locations
  Clone ID: PAT_TA_9148
tgcagattggaggagaattgacagattttataattgtgcttcatgatcttaaagctgtcaaggcattcagcagccgcatgcatctttctcttggggcaggattgagtgcggcagcaggaccaattggcagagcccttgaagcagatgttcgagcaagtgaaaaaggttctgggatatgctacacttatagctgcagcaaaggtgcctttgttggggtctctcttgaaggaaatgttgtgacaaccagatcagacaccaatctgcgcttctatggggacgcctacttgaccacgaccgatatcctgtttgggagggtggagaagcccagagccgcgcaacccttgtactccgccctagatgatccgttccccaaaaaatggttgctaantctaaccatggtatcccaangtcaattggtgncatatatacacctaaaatatctnngaacatcccttgggaaaaaatacccaanaaaaaagtncaactg

SEQ ID NO: 9149 - DNA, 1432 bp, Triticum aestivum
  Clone ID: PAT_TA_9149
aggatgaatggattaatgttcgtaaatgtgtgaggctgcgttctcttccatgtgaagctgcagaatgtgttgctgtgcttcctggggatctcattcttgtttgtcaggaaggcaaggagcaggcccgcgagggtgacgcgcgtgttcttgccgctcagaggcgcagcccgcacgcaagtgggtgccgctgcaggtttcttgtccgttacgctcctgagccctcggacggcgcagcttcatccagggcctcgccgagaagttcaccgcctccgccgcccgcgccggcaagatccccgtccagtacaagcaggtctggaactggttccagaaccggaggtactcgcagcgggccaggacccccaggggcgcgccgccgccgcaggggaagatgctgcccacgggggccgaggaacaccacccggcctccttcagggctgaggggtcctcctcttccaaccccggatcccgctcaccaaagagtgcttcggatggtggccaagccgaggtgcatgcagggtcagccagagattgagcctggtatgatgttactggatttctggatgacagtcgcattgtagcagttgcgcctgaaggagaggttcgatgtgaacttattgggtccaagaagtttttttcttctgaacttccgatcatgtaaggatggtcgcccggtaactgttatgtacggatgttgggttgttggctggattgtggaccggttactgtattgtcccgatgtcgactggtatgccgtctattttgacgctcgttggttcttgatgctcaaaggcgcaggcatgatgtaagagggtgccgctgcaggtttcttgttcggtatgatcatgatcactctgaggagattgttcctctgaggaaggtatgccgtcgaccagaaactgatttcaggctccagatcttgcacgcatctagagcggcggcgtctgcagatgctcagaatgttagcccagttgagcagaaaccccaaaaggcacacaagatgatggacgtgaacactgccgaggtgaccgtggtttgcaacccagatcaaggagggccatctgataagccggctgctcccttaccagctgcggctgctggcacccgcggtgattcagtttcagatgtgcagatggggaatgtggaggttattccaaaagttgaagctgcaaatgaagcacatgacgacaagatgaacgtgggagcttagttgttttgcttccctgtgtgcctcgttgtgaacttattaagtccaaaaaaatgtttgcttaggaacttccgatcgaggaaggatggtcgcccggtaactgtaatgtgccgatgtcgacttgtttgctggtgtgtgtacagagtgttggattgtcggtatctatatagctatatcgtgagacgaatgtggggggccccggtacccaattcgccctatagtgagtcg

SEQ ID NO: 9150 - DNA, 845 bp, Triticum aestivum
  unsure (1)..(845): unsure at all n locations
  Clone ID: PAT_TA_9150
gcgcggtgctgtggctcgctggcttgccccggtcctgcgccgcgcccgccgcccagtttcgccgtgctgcaccgccggcaccccgtggcgcgcctctctggcgcaggccgggggttctctggggtgcctcggtccttcgccgggggctcgtccctgtcctggcactgtcccacacgatgtgctcctcgcgcgcctgcccgaggcatgctgaggttactgtgaagtacctcgatgacatggccatctatggagcgtttcccggcacagacacatacaatgtggtcctcaagctcttgctcaaggggaggaagctccgggaggcatcggcaatatttaaagagatggtcaagaacgagtgttggccaaatgaggcgaattgttcacttgcgctcagcgtgttcttggatactcgtgactgggagacggggatcaaggtgtggaaatgcatgacggcgaatagcctgcctccactggaggagggcggtaacatgcttgtatcaaagctgaaggatgagatgttgcctgaggcatgcaagtacgcagaggacatgatcgatcagggtatcaagttgagctcctcaacgctggcaaagctgaggcacagcctaggaaaggtcaagaaaggagacattcccgtccgcttgcttgcaaaatggaaggcgcactaggttcttctctatatcatatactgtatggtttgggttatgtaggattgggaataggagatgactctctccgtggtcggcttcttgacctctcgcgtcgccggggctttgtgactgaagagtgcagtctcctaccangtaataacctctttctgccgccanggtttcttcttagaaatt

SEQ ID NO: 9151 - DNA, 787 bp, Triticum aestivum
  Clone ID: PAT_TA_9151
ttcggcacgaggggacatgctgctggggcaggaagtagtgaatcatgaggagaatatgaggccctatcatgtatctgactcgttgctggaaaaggaagatgatatttcatttagtcgatctagcgtaagtaatcatcaacaaacagaaccaacatcagaggagcatggcccttatggaggccaaatggatagttgcaatcatggattacccccatgccttagcgagtcaaactgccaacataatgaagctgtatctgaaactgcatttggtgataattctcatcaactgggatcaaatatacatccgtttccaaaggttgaaagtgctgaaggtgctgggatatcggtactcttacaccagaaatcaagcagcaacaaatggcagatcatggaagggagggctctagctgctgctaatattgtttgttctgaaccatattatacaagagatggtataaatatgatgaaatgtagctttggacgtgacagctcttcagcttcttccattgatttaggatcttcaaggcaatcagatgcacgctttgagcgccatagtagcagtaagaagggtgacttcgagaaagctcaactaagtagtactatgagtcatcaaagcatagcttcggtgtcagatatgtcagttagtggttcttcagcttcactttgccatcagagtgatgcgattgaagacacttgttcccgaattgacacttttgaaagcagcgcttcaagaactgtggtttctaccatagaagatagctctagtaacgatgctgggtcaaatgct

SEQ ID NO: 9152 - DNA, 604 bp, Triticum aestivum
  Clone ID: PAT_TA_9152
ggagagaactagtacctagtttttttctacatttctgcaagaggttattttcagaaattgaactcctgacctcattgtcacaaggctaacaactttaccactgcatcaaggctccccttctatcaatggtggagtagtgcttcatcttacacattgattatggcggatctctgtggcgtggcgcagtggagactcgacgcccgatatgcggagatggactcacgcaggaggaggacgctgcctggcgtcgatggcagagaggcctggtaaggtcaatacatcagtatctgctctgaagatggatcgatggaagacggtgtcgacaacctatgagagtgcatcagacagatttgtgccccagacctgatgtctggcttggttggggcttccggctttagatgttaggcttaggtgagaggtctgggtatttggctcactttttgcaccccttcatcaatggatagcagtagcaatagatgttgccaagatggcggcttcagacatattgatgtattacttgtgaggtcgttgtaataattaataaagtgactgcatgcatctcccaaatgcagaggcagggggtcatcctcctttaaaaaaaaaa

SEQ ID NO: 9153 - DNA, 726 bp, Triticum aestivum
  Clone ID: PAT_TA_9153
cgaggtccctccctctcctcccccgtttcatcttcaccgagtccagcagctcgacgagcgctcggcagcggcggcggaaccccgacggcgacggcggcccagggaggtgagcaggaggaggaccagaggtcagggagtgtttggtttcagggagatcgttggggaggagttcatgaccatgttcctgtcagtttttagcagtatggttcagtgactcgtaattactttgtcaaacccacatattcatgtcttgatacgcattttcatttttggttatctgtgagaatgtttagtatatagagaagttgttccatggagcagctaaacaaaaaaaatacttttcatttgtgatagtttgcgatatgcagtgatagatatatcgaagtttgtaatggctcatggccaaacatatgaaactgttcttgatactcttttttctttttcttaatatcatcatatatatatatatatacaaattagaaactttctaacatctgcatatttcaggtttaggaggatgtagagagaacggtgttcatacaattcagtgcagcatcaacagacgtgttcctaaattttgatgattattagagagaaagagagatgatatggtgaccgaaagtctatgtgtttgtgtcgtgtacgtgtcgggcagtggtagattaaacatattatgtaatgggacttggcaagggatagagactggcatgattttttttctgagca

SEQ ID NO: 9154 - DNA, 888 bp, Triticum aestivum
  Clone ID: PAT_TA_9154
ttcggcacgaggcacctaccttcgttctatcgtgtgatccctgatccagattcctcctattcgtctccgtcctcgccgcctcaactacgccccgtgatctcgatgtcgaggacttccccatctctccagcacctccctccactcccacccagacaaatccaggatacgcccccaaatgccaaccctgcggcatcgacggagcgtgacaatgtcgaccgcccggcgaggcggcgacttgccggactagatggtgcggaaccttctagagcaggagagtcttcatcggaggcaagaccacctacagctccttcatctccatcctcgtagccgccgtcagcttgttcgtgcttgtccaccgattctgccagtaacacatcctcgccaaggacttctccaacctcaacgccatgcgccgcggcattggtcttcacaacagtgtgtttgctgcgcaccgtcttccacgacgcgttgatcttcagagtctttgaacctggcgtcacaactcatagttgagtgctatggctgggactgtaaagaagtgttcaaattatgatagatcaaagcccttcacaggtgatgacgtatgttggatgatggaatgattattctgttctggtgcttgctttgacttgggtgttcagagaagtaaaactttgaactaacatctttagtgaagcaacatattgtatctgaagtgaaactttctctttgatatggagatgcgagcatcaaactaacatccatctaaagataagattgccaatataaatcaatgatgcatggctcggaagttggttgcaaaatcacgaaggtggctactactcgatagttttagattaggttattagaatgtcattcaagtcaatgtttgaaacattatgttttaga

SEQ ID NO: 9155 - DNA, 865 bp, Triticum aestivum
  unsure (1)..(865): unsure at all n locations
  Clone ID: PAT_TA_9155
cggtgccgctgcccgtgcccgccctccgtcgttaacgtcacactcacgccccngntcatctcctggcaccttctccccctcccgcccgtgcctccgtccatgctctcgctctcctgagcctcctccctccttgtgtctgccgctgatcccctccccgtccgtggccgccattggcgccgtccgtgctcgcccaagagatggcgaaagtgaccctgatcttcaagctaccgtactacacggaatgggggcagagcctcatcatcgccggctccgcgccggcgctcgggtcctggaacgtcaagcaggggctggccctgagcccggttcacgaggggaacgcgctggtctggtgcggccaggtttcagtccccgctgtcttcacctgtgagtacagctaccatgtggtggacgaccacaagaacgttctcagacgggaggccggggagaagaagaagctagtggtgccggagggcgtcaaggacggcgacgtcgtcgaggtccgcgactggtggcaggatgcttctgaagctcttttcctccgaagtgcgttcaagaacgtcattttcagcgcaactgataatgctaaaaggcaactgcagcctccttccctcagcaaaactttggatcctgaagatattgtcgtgcaatttattatcagttgtcctcggctagcagctggctctactgttgtcgtcacaggaagtaaccccgcggtaggaaattggaaagcgcaaaatggcctcaagctcaactatgttggagattccatttggaaagcctactgtgtgttgcggaagtctgagttcccagtaaaatataagtactgtcaagttagtgaagcaggagtctcttcattggagtttgg

SEQ ID NO: 9156 - DNA, 548 bp, Triticum aestivum
  unsure (1)..(548): unsure at all n locations
  Clone ID: PAT_TA_9156
aagaagcctttggaagctcttttgaagggtgacaaaaaatcccctcaaaacagagtgaagaaaaggatgaagcccacactctagataatcaacaagagaaaagccgtccgctcaactacatgcttattggagaagcaaaagagaaccacgttcaaaatgtagcagagagtgccaaggaagacatcccaacagagctcattcagtccaaaataattttcatggaatcaaagcaaacaacattttctggttttcaaaacacatcaattcaggaattggacctgcagaggaaaaaatttagggggcgcccagataacctgagcatagacattaatgtaaaagcgcaaccagagagtgggacacatacagatgaggtttttgcaagaggatataaaatcattagcgactttctagacaaggcaagagaaaaatatttcttcgccgatgatagcaccccctcattcaggatctctgaagatgtggatgaatgtggaaatataattgaagaacatgaatngtggaggcctgtatggattaaagatgaatggtgc

SEQ ID NO: 9157 - DNA, 1162 bp, Triticum aestivum
  unsure (1)..(1162): unsure at all n locations
  Clone ID: PAT_TA_9157
cctcggcccctccccgctcgactccattagggccgctcactagtgagaggccgaggcagcccgtgcggatcgcggtacgcgggtagaggggagtcgagcggggaggggctcaaggttgcctaccagggcttccctggagcgtacagcgaggctgcagcaaagaaggcctatccaaattgccagacagtgccctgcgagcactttgatactgcatttcaggctgttcaaaactggatagttgatagggcggtactgccacttgagaatactctgggtggtagtatacatcggaactatgaccttttacttcggcatgagctgcacatagttggagaggttcgccttgcagttcggcattgcttgttagccaatcgtggagtgaagatcggaaacctaagaaatgtcatcagtcatccccaggctcttgcgcaatgtgagcatacgctgacagagttaggaattgaacatagacaggctgttgatgacactgctggtgcagcaaagttagtcgcagaacaaatgctccaagatactggtgctgttgccagttcattagctgctgaactttatggactcgatattcttgctgaaaatattcaggacgaaaaagtcaatgtcacccgttttatgatgcttgctcgggaacctattatacctcgggttgataaaccattcaagactagtattgtgttttcacttgaagaaggacctggacagctcttcaaggcacttgcagtttttgcactgagggaaatcaacctcaccaagatagaaagccgtccacacaagaaaaggccttttcgtgtagctgatgatgctttctccacgcgcgtcaagtacttcgactacctgttttatgtcgaccttgaggcgtctatggctgatccaaaaactcagaatgctctcagaaatttggaggagtttgcaacctttttaagagtcctggggagctatcctacagacgtgagcgaagcttgaatagcaagtgcttgctgcagatcacatgctagtgattaatcaattgtgtgcctttctcttaatcggataaacatccgcctttgagaaatactgtaacatagttcttcattatagaatctgtaacatgagctctcagagcatatttcctagtattggatnggacttagcagttatactcataaaa

SEQ ID NO: 9158 - DNA, 435 bp, Triticum aestivum
  Clone ID: PAT_TA_9158
ttttttttttttttttttttgatcaccacaagttgctattttcacagatctttttgaaagaaaatctcaactttacatagccggggaagtaacataggatggaaagttgatttcaacatataaacaatcccatattgtagatgatggccaatgaacaaaattgccctctccactggaaattacacttctgaatccgcagaaagaatgacgctccagatttcatggtacagaaaaagaagcccccggaaaatggaaaaaacaacagcttgcattgtatactctttactgttacataaggtacaaaactgaagagtcttggccagagaaaccttcactattgcagcaacgcctccaaatattcatcaacatatgccaaacatggccaatgatctgttcttatcctgaccagtgtggaggcatagcctacttccattg

SEQ ID NO: 9159 - DNA, 1965 bp, Triticum aestivum
  unsure (1)..(1965): unsure at all n locations
  Clone ID: PAT_TA_9159
acgcgccacgtgggggtctgccacggcctctccccggttccgcgctgcagccccttcgcccgccccgctccccggggggtcggggcggtcgcactgctgggcttatggaggcgaacttcatacgacctacacatgataagcaagattttgagaagacggaactttttcagagacttgagacgagattaaaagacatgacaatggagtattggaggcaccatgctcatttgattggctaccagccagtcacaaaatctcttcctccagcatattatacatctattgctgctaccaatgacagctcagtagcccaagctacagcaacaacttatgccaggaactcaagagccaaggcatctggagtgttgaactcccgtttcaatggaggtaactcattaaatcctttgcacgttggtgccttgagggatcaaatggactatggtgcatgttctttagcaaggagaaatatgaggacttcattatatatgccaagcacaccccagcaaactgaactctgcaaaagaagaaactctggctcgatgattgaaatgagggcccaaaaaaggcacaacacgaatggcgatgctgaccacgttggaagcgtcaatgttgttgagataggagaggaaaggagcagtctcttactttgtcagaacatgatgctaaaggccgagtgttctgagctggaggcggccgggcagactctccgaagcaaggcggacaggttgatgggtgaactccgcgagtggcaacggaagcggaggagcctgacggacgagttggagttctacaacggcctcagcgcgatacagcgcaggatccccatcgccagcacctcctccatgggagtgggatggatctgactgaatggcatgactgacagacaccacaccggcagcggaagtccataactacgtactaatactactaacccaacctatggggcggtttaagcgggagtttgacccctcgggatggtggatggtggtagaaccaaggcacctgcagtaagtagatgtatggtttggcactaggtgcatggtaagtaacatcagacgttttatgtaggaagaaacctcctttacggtagcggtggcgggtcaataactgaatatacacgtaaactaaaaacaactctccctctaaatatgatgctactgcacttgctcttcccctccccgtgaaccctctagctaacctctctcgccgccccttcaacatcagtgcatctgcggatcgtggcctcctcacaacattgctcaccctgtgcttcccccggggcggccccgtaccccacgcgccctacactgggccgtgtgacgtctctccgcccgccgttttcccacgtcggggctggcacaaccctcgcgctcccccacgccttcgcctcccgcactccccctctccacacctcccctaacagcgcagacgcccgacgtgcgncctgcccgccgcgcgcggctcaaccccatgcattacgggaggcccataatacagattggnannggttcngganacntnaccaaaagttnnaccacattgtgncccctgagcacnagtanctagaacaagaaacncgttctggtnagaacnnttgggnggnaaannccctttggactgtananccccaacactnatcaactncctgccccnttcgaccacgcaacaatcaccacnccccanaannagcacaaagccgtgggannnngtacacacacnacagaaacagagaagagaccccggcnacacacagagcaccggcccaccacnncagcncncaaaccaagnngngacagncccanacctngcaaacgtggggacgacanntggnggnacacnanacgnaacnangccnagacacnacaanccnnaggacacanacaaacnggcgncnaaaannngaanacnggcacacaancaccncnncacaacacccnaacccaanannggaccgacaaccgacac

SEQ ID NO: 9160 - DNA, 1213 bp, Triticum aestivum
  Clone ID: PAT_TA_9160
gctcaacggagtcgaccccaccctcatgggattcgtcctcatctcgggagcgcagttcccgaagatcaacaacgcgtcccagtacgccgccgccgaccccggaggcggcagcttctgcgtgctcacgagcgggttcgctgtcccgatgatccggctgagcgacgtgccgcctggaggcgccaccagcatcctgagcatcgacgaccccgacgagtacgcggtggtgttcaacaactgccaggagggcgcggaggtgaccatggacgtgcgcaccgagatgtacaacgtgcggggcggcgtccccgacgggctgagggactacctccccgtggggctccagccgctgcccaacatctacaccgtggtgtcggtggtctacttcgtgttcctggcggtgtgggtgtggacgtgcctgcggaagcgcgcggcggcggagcggatccacgtggtgatgggcgcgctgctgctgttcaaggcgctcaagatggcgtgcgcggcggaggacacgtggtacgtggagtccacgggcacgccgcacggctgggacgtcgccttctacgtcttcggcttcttcaagggcgtcctgctcttcaccgtcatcgtgctcatcggcaccggctggtcctttctcaagccctacctccaggagcgggagaagaacgtgctgatgatagtgatcccgctgcaagtgatcgagaacctggtgctggtggtgatcggggagacagggccgacggggcgggactgggtggtgtggaaccacgtgttcctgctggtggacgtcatctgctgctgcgccgtcttcttccccatcatctggtccatccggggcctgcgcgaggcctccaagaccgacggcaaggcggcgcgcaacctccacaagctcaccctcttcaagcgcttctacatcgtcgtcgtcggctacctctacttcacccggatcatcgtctccgccttcctcgccgtgctcaactacaagtaccagtggggcgtcaatgtcgccgtcgaggccgccagcttcgccttctatgtcttcgtcttctacaacttccatccggtggagaagaacccgtacctgtacgttggcgacgacgaggaggagtccgccagtggacagctcgagatggacgagcgtgctttctaagctttagttcatactgtagcagtactacgaagcatgcacgtttccaagtgttgtactatagcagcctcc

SEQ ID NO: 9161 - DNA, 665 bp, Triticum aestivum
  unsure (1)..(665): unsure at all n locations
  Clone ID: PAT_TA_9161
ggagacgcgagtgggacccgcgaggcgtggcgttgtgtggaggaggcggtcgtgggggcggcgggggtgcggccgtcgcgcgcgagcgcgggcgtcgccggcggcgccggcggcgcgggggcgccggcgctccgcgcccgcggcgaccgcgcggcccgggcctcgtgcctcccctccctcccctccgccaccaaggcgctcctcgtccgcctcggcgcctcgccccccgcccccgcggcgacggccgcgaggcgcggtacccactcggccgggtccccgtccgcccggtccgcggacgacctgatcgcgctgatggacgagagggaggtcctcggcgcggtgctggtggggcactccatgtccgccaccgccgcccgcagccccgccgcccgccgccccgtcctcttcccccgcccccccctcctctgcgcctccccaaggtacatcaactcggaggaggaagggtacgttgggggggcttcgatgggggcggccatccaccggcattgttgaagggccantggagtccgatttccaagcctgggtcaaggggcttcgtccccaaacgccgccggtggcgcntgccgancgacatggcggccccaactctggtgccccccccgcgtagcgtcccggccctggaccattggancccgnccanttcn

SEQ ID NO: 9162 - DNA, 904 bp, Triticum aestivum
  Clone ID: PAT_TA_9162
ccgatgagtccacaaaaccccagctcgagcacccggaaccatggccctcctcgccacgaccccactcctcgcgccgctcgccctctccccggccccgatctccgcctcccagagctccctcctcttcctgcgcgcccccgccctcctctcgctccgctctgcctcccccggcgcccgcctcctcgcggccgtcgcatccaaggagcccgagctcggcggcggcggagacggtgcgggatctgggagcggaagcggcggggggagtggcccgcagggaggcggggacgagggggaggaggggaagatgggggaggggctctccatgtcgcagaagctaaccctcgcctacgctgcgctcgtcggagctggtggagtaatgggttacatgaagagtggaagccagaaatcacttgctgcaggaggcatatcagccctgctgctgttcttcgttcacactcaactcccagtgagaccagtttttgcgtcggcgatcgggttaggtatatcggctgcactgctgtcggtcatgggatctcgcttcaagaagtccggaaagatattccccgccggcgtcgtgtccctcctttccttggtcatggtcggaggctacgcccatgggattatgcgtagctcgcatgcatgatgcagccagtgcggttaccatatgcacctccggacttacacttgcgaactctttttcctttttttgtgtttcgaagcagttgtctgcatatcttctgtgttttcggaccctttggtgactgactgactgtcgtgttacattgtcgttgaactcaagttgatgttctagtgaactaagtgaagtatgtatgggcggatggtggaaatcaataattttgagaagatcttgtctgaatggtgatcttatagcaaaagtttctat

SEQ ID NO: 9163 - DNA, 660 bp, Triticum aestivum
  Clone ID: PAT_TA_9163
ttcggcacgaggcagcagccggtacacacattcatacatacattcttcttcagcatccactccctgctagcttgtgaggggaagctctgtgtttgagcagacgaagctgggggagcagagcacggcgctagctagctagctggtgcgagatgaggagccgtggtagctttgctccaggccatgcggtggtgtttctcgcgtggtggatggcgcattgcggcggcgggcttgtcgccgccgtgcctcctgatggttggtacgattacactgcccacacggactgcagaggccgcccggagccggcgcagtacaacggcgggattctcaagtacggcaacggcgacgaccccaacgggtacaagacgacggagaccggcgtcctgtccccggcgttcgtggtctacaacctcaacaagtccacgatgtacaccttctcgggctgggtgaagctggagggctctccctcggctctcatcaccgcgaggctggccccggacaactccggcacgaggtgcatcgggacggtcctcgccaggagcaactgctgggcgttcctcaagggcggcttcgtcctcgactggccaactcagacctccgtcatcttcttccagaatgctgataggaccccgatgaagatcaccactgcgagcgcctcgctcc

SEQ ID NO: 9164 - DNA, 1547 bp, Triticum aestivum
  unsure (1)..(1547): unsure at all n locations
  Clone ID: PAT_TA_9164
ggccgccggccgccaggnacgggctgctgtggtacaaggacgccggccaggcggccaccggcgacttctccatggcggtggtgcaggccaacaacctgctggaggaccagagccaggtggagtccggcccgctctccatggccgaccccggcccgcagggcccctccctcgccgtctggggcggccatggcggcccggagacctcccgcttcatcaatgacaacatgttccaccatctcagaagatttgcaaccgagcacaagtgcatgtcggccgatgtgatccggaaagccttccaagcaaccgaggacggcttcctttccgtagtcagcaaggaatggtctatgaagcctcagatcgcagcagtgggctcttgctgcctggtcggcgtgatttgctccggaactctctacatcgcaaacgccggtgactcgcgtgcggttctcggaaggcttgtcaaggcgaccggtcaggttgtggccatgcagttatcggcagagcacaacgcgtgctatgaggaagttaggcaggagctacagtcatcacaccctcatgatccacaaatcgtggttctgaaacacaacgtttggcgtgtgaagggcctcatccagatctcaagatctatcggagatgtatatctgaaaagaccagagtataacagatcacctctacatagcaagtttcggctccgggaaaccttcaagaagccaattcttagttctgaacctgcgattgctgttcaccaaatacaaccgagtgatcagtttgttatatttgcttctgacgggctatgggagcacctcagcaatcaggaagcagttgaccttgtccaaagtaaccctcgtaatgggatcgctcgaaagctagtgaaagccgcgatgcaagaggcggccaagaagagggagatgagatactcggacctgaagaagatcgagcgtggggtgcggcggcatttccatgacgacataacggtggtcgtggtgttcctggacgcgagcgcggtgagcagggcggggtggagcaagagcccgccggtgtcggtgcgagggggcggcgtgagcgtccctgccaactccctcgcgcctttctcggcccccgccatggtgagcagcacctactgaagaaggggaagaagccgccgcgccgatgaagagaaactctatgacgggagcatctgcagagagagtgcttcctgctgctgtgaagctgctcaggctccacccgggtaattaaattagcgtactgatagcaaggtataaggttagatcaccgccattccgtggcgacgcaaacctacccccctccccctcctcccctttgttcttttatctatccctgttctcttctccaatgagggaggagggcatggtggctgtaaatttgtccggaacatcgccgtctcttttcgccgcaatagtccgtcttcttccaaaaaaaaaaaacgccgtcgaaaaccgggtgcctggcttgactgactctgttgggtcaagacaaggggtgcctccaattatttgcagcagattcattatgccatggaatcaacttgg

SEQ ID NO: 9165 - DNA, 1132 bp, Triticum aestivum
  Clone ID: PAT_TA_9165
cctcgcggccgatcccccaaaaccacctgacccgacagaacaggcggcggcggcggcggaatcgggcgagatgatcaagaggcgctgcttcaggcaagaccacggcgacaatagcgcctcctcgtcctcctcctcttcgggttctgattcggaccgcgaccccgcggaagaagaggtctcggaggaggaagtagaaggggagcaagaaaaagaagaagaagatgatgatgaagaagcggaggtggagtcgggggaagaacaggaaaaggaagtagatgagcaggccgaagatgagggttcaggataccaaagtgaggacagctctggacatcatgttgatagtccttgtgcagaagaaaatgagaacagcagtctggtgtatgaacaataccaagcaatcaggttgcctggtaagaaagcatcaagtggggatgctgattctgccgaaggtgctgttaacaaggatgactctgttggccccggtagcattcaggcaggcagcgacaaaatcggagaagacagaagaggtcgcagaatcgtctccaggtccttgagcagggacacggcccgggtacggaaggtgcaaggccgaacaatggaactgctgataagaaaatgccgaatgttgaatactgctgctaagaaaatgccgaatcttgaaactgctgctaagaaaaggcgcaagactgaaaaataagtcggtgctgcacaaatatttcttgcgcgtcatttcttcctatattgttgtaatttttaggagctttctgcggttttactgtttctgctttgccttccctttttatccgagtgtagttcatgaaagctgagagattaaattgaaaggaaagacgacaactagaaagtggacatctaatcgtgcatgcaacctgctatgagtttgctactcccgagtaatttgtagggtttgacacgcgtgacggttcaccctcggggccctccagaaatatttcttgcgtgttatttcttcctatattgttgtaatttttaggagctttctgcggttttactgcttctgttttgccttcctttttgatccaagtgtagctgatgaaagctgagagattaaattgaaaggaaatacgacaactagaaagtggacatcgaatcgtgc

SEQ ID NO: 9166 - DNA, 940 bp, Triticum aestivum
  unsure (1)..(940): unsure at all n locations
  Clone ID: PAT_TA_9166
gaatattggagatttcttctaatcgctaccagcacttgtgccccaagtatgttcggcttgttgcccgggcatcagaatgtgaggagtccagcagagtactagaccaattttggggagaacttggcgacaaggttgagcaaatcctgcagaaacaaaccagcgttagcagcgcacctgtgacactacagcctgatgttcagaatcttaagatggccttgtcttccatcacggatggcactgaatcagaaaatgttctggacatatcaagcagggcagtggcagaaacagtaaagaagaaaggccagaaaagtaaaaaccatccaagaaattgcgttgaaaagggtctgacaaagaagcagaaagtgcactcagaagaacctgcacttgtgcattatggtttggcagatggttcagcccagtctggaaatgccatgtttcagggcttggaggctcctcctaacatgtccaaaatgggtagccaaactccaacctatgtaccttacatggggactgacttttcaaatcccatggccatggggacactcaactatgaagagatgcaccgtggcgcaagtctggggctcactctgttaccttctcaggacccaggctttgtcgcctgtcacacttctcaggcgtcaagtgacagccaaggcttggttagaaatcaatgtctacttttaaaggtctctctttgggagcacaatccaaatnagaggttcctaatgatgtccaacgccanaaaaaaaagctccttnatgatgtcccacaactgtnntatggaaatttagaacttcacaaagttgacntttttccaaactggtagtgtgtgnttggattaaaattttcaaccagggtgtccnttttactttnaanaacttnggcatgcnancaggaatatnatncccctggactttnaacaattccgtaggccaaattt

SEQ ID NO: 9167 - DNA, 676 bp, Triticum aestivum
  unsure (1)..(676): unsure at all n locations
  Clone ID: PAT_TA_9167
cccgcgccgtccgcgacgtggtgcgcgtcgtgcctggcgtccgcctgcgcgggctgcgcctgcaacctctgctcgtcggcggcggcgtccgtcactcgccgctcagcccgcctcgcgtactgcggccttttcgcggcctccctcatcctctccttcctcctccgccagttcgccgcgcccctcctccagcacatcccatggataaatacgtttgatgatacaccgccagaagaatggtttcaaatgaatgctgttcttcgtctcagcttgggcaatttcttgttttttgcaatatttgctctcatgatgattggtgtcaaagaccagaacgataggcgagacgcatggcaccatggtggctggattgcaaagtttgctatctgggtcgttcttgttgttcttatgttctttgtcccgaacatcgtaattagtgtttatgagatattgtcaaagtttggatctggcttgttccttctggtacaagtcgtgatgcttttagacttcacaaataattggaatgactctggggttgagaaggatgagcataagtgggaaatagctttgctggtggtgactgtgatttgctatctcgccacgtttgccttctccggtgtgctcttcatgtggttcaatccctcgcatctgcattgtgggctctgcgcgttccttaattgcn

SEQ ID NO: 9168 - DNA, 684 bp, Triticum aestivum
  Clone ID: PAT_TA_9168
gttctatgatgatactgcactcccaaagctggtggctgattttgcttcccttgaactttctccagtggatggaagaacgatgactgatttcatgcatacaaggggactaaatatgtgctcattaggccgtttggtagagctaggagagaagctcccacacatccagtcaatatgcatccatgaaatggtcattcgagcctttaagcacgtcattcgagctgttattgcagctgttgatgacatgcaaaatatgtctgcggttatagccgagactttgaacattttactgggatctccaagattagaaaatgatcttgatacagatgctaatgagcataacttgcggctgaaatgggtagagagcttcctttctaaaagatactgctggacactgaaagatgaatttgcgcacttgcggaagcccatcattctgagaggcctttgcagcaaggttggccttgagttagtcgcaagagattatgatatgaatagcccaaacccgtttgacaaatccgacattgtcaacatagttcctatatgcaagcatgttgtctactcatctattgatagtcgaaacttactagaatcatcaaagatggctttggataaaggaaagcttgatgatgctgttaactatggatcaaaggccttgtccaaagttatagctgtttgtggtccatacca

SEQ ID NO: 9169 - DNA, 654 bp, Triticum aestivum
  unsure (1)..(654): unsure at all n locations
  Clone ID: PAT_TA_9169
tgccgcgccgcagtaccgggccgacccacgcgtgcgcggacgcgtgggacgcgccctgcttcatccttgcctcgcctgcagctcctctcctctgcgccgccaccgcccgtcctcctcctctcctctgcgccgccgccgcccaacctcctcctctcctctgcgccgccgccgcccgtcctcctcccctcacatcgcgcccgcacggccctgctacgccgctgtctctgttgccgtctgacctagatgcggctagagttcgtcggcgccgcacacggaggagacggggcgaggaggagcacgagccaccgcaaccacctacccgacggtgctgtcatggttgtcgtcgttgtgacctacagagatagagagagggatttttgtaaaaggagacagggagcaagatgagaagacgaagaagaagcactgccacctccgtccccatccactgctnggtctgcttttcatcccaaattttnactcacccccttcaaattctccatccctttctaacanatcttttggtgnaagcctacaattttttggatnaatttcangcaggaagtttgcaaggttattttaaaaggccctnanctctcaggaatcaccataactnggnnaaattattgaggnnaaaactaaagggcgggaaaactn

SEQ ID NO: 9170 - DNA, 948 bp, Triticum aestivum
  Clone ID: PAT_TA_9170
cggtccggattcccgggtcgacccacgcgtccgcacgccccagccgccatcgccgatctattcgctacgtggaggatccctttgccggcgccgaggtgccagagaagccgccgccgagttgttagaggagccgccgccgccgtggggccgccgcagccgaggtcctccatcgccaccccggccccggccatccaggtgccgccgacccacccacgccgccgccccgcgcgcgtggtctgcccctcctcgcctccatgcggctgccgcccacgcacgccatctgcccctgcaaacctccacgtgtcgccgatgagttcgtcgttgccgatgggatcgccgcaaggtgagttgaatcaacctagcacagaacgcggtgattgggagatgggatcttctgttgcccggggatgtacatctgattttaagaatattatctgagtcctgcgtccctttagcctcctcccctccaacgtctatggctctgtgatgtgccgtgttagttacccatttacaccgtctttttttcccgagattgatgcggtgtttgttctccgtatcgtgcatgaggagggagaagcacagggagaaaggggaccatgggcgatgctattgtgcactgatatgtgagaggatggatatctaataatcacttcatttttcctgttaaacaaaatcagccaaccatatttaacaaaatcccaatattaattgttgcatgatttggattaattatcagtggtctggcattttgtatgcctacagattgttcctttttgggttgcaccttcattgtagatgatacgaggtacgtgttttatctttctctctcagttttgaacaatgggcaggtttgaaaataatgttctgtcagtcaaatttgttggcatgagcatgaggcacatccatagcaatgatttggatctgtcattggtcgtcaactgaaatagt

SEQ ID NO: 9171 - DNA, 425 bp, Triticum aestivum
  Clone ID: PAT_TA_9171
aggcccgggccatctatgaggagacccgcggcgtgctcaagatcttcctcgagaacgtcatccgcgacgccgtcacctacaccgagcacgcgcgccgcaagaccgtcacggccatggacgtcgtgtacgcgctcaagcgccagggccgcaccctgtacggcttcggcggttaggggatggctagcttggcttcagtgtgtctatcagtgtggttttctcgtgaggatgctcataggtcatagctgcatttttctgaaagctgctactggaactgtgctctgacgctacgaaagcatttactctgtaataggcaacatctctgagacaaaacttcctgctgcaagactccggtggtggcatgaaaagttattttgtcacaagtgttataataaaataaaataaaaatccagtaaagaaaaaaaaaa

SEQ ID NO: 9172 - DNA, 1067 bp, Triticum aestivum
  unsure (1)..(1067): unsure at all n locations
  Clone ID: PAT_TA_9172
gggctgaggaattcggacgaggtgcgagccgatgccccatnacaggggcggtaaggagaagaagatagttgtggaggctggattgcgagccagatgccccatcaacaggggcggtaaaggagaagaagatagttgtttaacggtgactttgctcaagtgacataccagacccatcttgttaatcttcattatcttcgccgaagaaggaaaaataaaattgataacctcatcaggcagtgaagattgcatggccagtctctgttttgtgcatgctagtagcgacccacacactggcgcaaggatgtgaagatggggacatcaagtgcataccagacagaagacctcacctcatttctccaaactgtctgagcagtgtgcaagaaagctgaagacatttgaagaaagcattgtcggatatgtggtatcctgatcctcttacttgggactgggataaggaggcacaacatttaataggttactgaagatttgcgatggtgaaaaatgccaatgtcagctaggtaaagcgaaggatgttttccccaccatggatatcttattatgtcaacctgctcttgcatggctagagatgaactcggactcgcaacttcaccaccatttccgaatggaagtttgtcgggaagtcaaagtcatgcgctaggtcgagaggaggggaggcatctggcagagagaaagagtatcaaagagatggagaggtattatgtcgatgttcaaaagagtcccaaggcaatgtcattggaaggggccaaaaaatttccgagctttatacaacaatattggatatgcaagcagaaaaaaaaggctaagacccactttggttcataggaatataaaacttgtaggaaatgagatgtcatgtatctcaaatcctatgaatagtaatagaaaaagagatgtcctttcattcatatcatttgatttttctattgagtctaggtaaatattattttcatatgaaatgtgaaggatagaaagaatttgttccataggaatatnattctattcctacaaaccaaaggaacatttttttctatagaaatcatacaaaa

SEQ ID NO: 9173 - DNA, 605 bp, Triticum aestivum
  Clone ID: PAT_TA_9173
gccggcgtgacccccatggtcgccgcgccggcgcaccaccacgggcgggcccggctccaccaacaccaccaccacccggagccgcacgctgaggagctgcaccgccacgtgaagcagcagcggacggcgtggaacgggcgcgccaagaacccggatctcaaccaggcgccgagcccggacacctccgacgccgagtgaagcagccaagcagcgagaagaagcagcggcggcttccagtcatccacaacccgtcgcccatgcagcttgtctccggagagcggccagccggcgtatgatcaatcagattcagcacaaccaactcaatcgtgtccacctgtccccctagcgagctccgccgcgtcggtgagggcggcgaggtgccggtggtcggtgggtcggtggccggatttttcaatacgtcgttctggataagaacaagggagggaggggaagcgggggacgccacaagtggcggtctttccaaatgtcaaaaaagacagctgtaacagttgataaaacaatcgccaccatcttctttttcttcgcactacaactgtctgcgagttgatcggccccgatggcccgtacaatgttctgttaattcc

SEQ ID NO: 9174 - DNA, 743 bp, Triticum aestivum
  unsure (1)..(743): unsure at all n locations
  Clone ID: PAT_TA_9174
gtggcggcggcgatccccattcttctcctcaccttcctcctcgcggcggcaacgccatcggccgggccttcatacgtcatcaagacgacgtgcgcagcggtgaccaatgccaccgtgggtacgccctacagatactgcctccgcacgctctcggccaaccccgcggccgccgccgccaaggacgcccgcgggcttgccatcgcggcgaccaacctcaccgccaccaacgtcacgtcgacggagctaaccatcaccaggctaatcgacgccctctacaactgcctcgtcacctaccaaagcatgcaagaatcaatcgccggggcgctccaagacttgaacgccggccgctttgacgtggcgtcgcccaagctcagggacgcttcgtttcagccggacttctgtgaactggcgatgatggaaagcgacaccgacaaggaccccatgtcggacgagaatagtgcaaactatttggtgtccggcatggcgtataacatcgctgaactcatcgcccgccatgccgccaaatgaagaattaatgccgcacgctggcagtagttgattcttgtcttccttaataatccttattattaggtagtactactcacgttaatcatgtcttgcgttaaccaagttaatatttcaccattttactttgtcagtttttctcattacttaattatgcatcagtcatgtnatcgagtgctgtaaacggaccatanatcaatcgaattgtgttgcgattc

SEQ ID NO: 9175 - DNA, 546 bp, Triticum aestivum
  Clone ID: PAT_TA_9175
gaggccaacacccaccacacaacagccagccgctgccgtcctcggtgctcccggcggtcggcgaaggcaaccctgggcatgctgctgctgctgctccggaggaccgctcacctggagcaggagctcgaccttcgcttccgcctcttccgctactgggactgccgtgccaacgcgcatgcctagttccttcacgccaacgcctccgccatcggcaccgtcattggcaaccccgatgtcgcatcgatgcaccgccgtccttctttgtggggatggactgcgtccacctcccaagtactgggagcgccgaatccgcgtcaccaacatctccaacttcctcaccgacgacgttgccggcctcgccatctctgtgccatctaagaccacacatgctgaccgctacatgcgcgccggcttgtgtaaggcaagagggactacacagtgaccacgcgggttggtatccgatgcttttccgttgacttctgttcatatttgtttccttaatataaatgaaacttaaatacaatatatcttaattgaaaaaaaaaa

SEQ ID NO: 9176 - DNA, 1191 bp, Triticum aestivum
  unsure (1)..(1191): unsure at all n locations
  Clone ID: PAT_TA_9176
gccgtcgccgacgaagctgctgcctccgccgccgagaggagctccgagctcttccacgacctcgcgtccccccccctcccctcccgccgctccaacctgtgccgtccccgtcacccccgtccgtgacgagctccgcatcctcccgtgcagggactccgacccgtgctgccgccaccaacctcccctcaagcggcaagtgcctataaatttgggtgagaatggcaggacaatcgccaaatcaactatcatcagctgaagctatcttggtgggagccttgtcctctggtgttaatgctcccacgtgggtcgtgctccagatcacatttttgctgctggcattctgcttcaccgcgatgctttacctagcctttttctcaagcgactttgtgatcgtcgggcacgtccttctgctcataaccatcggcgcggttctatctgtgctcctcaacagggtcctcgcggagaccggcttcgtcccggtcgaacagcagatgcaggagatggggatccgcaaaccaagaagccacacagaaagacaagagcaaatgagccctttgggcccaacttttttacattacattatgatgattaaacagagcgcgcctcgctgtacgcaacggctccacacatagtatacacaaagttcagatagacgctaattgcacaggtgcacatccgtttaagtgcagcgatactttggagcggggcagcttcttcagccatacgctcggccgcttcgtcagtccttcggtttgccgctcttcttcttcttgacgtagcagaagcacgagcagcaggggaactggaacaggaacttcattggtctgggatgggactcgccgatgctgttgtttgttgcgtgcgttgagttggtgtgttgctgaaggcgggtctgcatccggccgatagatatactagcgtgttgattccttgcttggctggttgtgttatcacaggacggtggagattgtggtgctttcttctgtgtggggtggtttgtgcgattaatttcatccgcttggcgtcccgtgaagcgaggccaaccagctatgccacatggcgcaagttggttgnccgcggtaagaaatcttttagaaattttttagatgaaagtgtgaattattttttaaatgtatttttttagatggaggtgaggnccnctgatattttttaaatggagggttatgtaaa

SEQ ID NO: 9177 - DNA, 462 bp, Triticum aestivum
  unsure (1)..(462): unsure at all n locations
  Clone ID: PAT_TA_9177
gctccatctccttcctccgtccggccgtccccctttcccctttcacaccgcaaaaaaccctcgcccaaatctacagcagccatcccccccgtggcatctacgagagctgcgagctcacaattccgcggagcagctcggccatggcgtcctccgtcgccggcgggttgccgtcgaggtccgccatcgtggccgacacgaccagcgggcaccaccttctcaccatccacggctactcccgcaccaaggacatacccaccggagagcgcgtcaagtctcaccctttcatcatcggcgggccatcgctggcggatcgactactaccccggcggcgtgcgcccggaggtcgcggactacgtgtccctctccctgatactagaggaagatggcccggcgccggtgaaggcccagtacgacatctgcctcgttaccaaggaggaggaggngggtgcaagccccgttcnn

SEQ ID NO: 9178 - DNA, 554 bp, Triticum aestivum
  unsure (1)..(554): unsure at all n locations
  Clone ID: PAT_TA_9178
gatcgccggtgcccgaggnaggcagaggaggaggatgcgtcccctcggtcagaggtgacgatgggctatgaggcgaaagtttcctcagcgtttgatgcggcatctagatgcatggataattctggagccaaaccttcatgtaccaagggtgcctctgtagtaccgacgcttgttggagaaaaagtatctacaagagaagaaaatcagaaaagacttcagcaaaatatggaactgctcagggaagcaggatcacctcaacagggcttctccgtaatgtttgtgctgttagtcttcatgtcatctgtcttcatcggacacttgatgaagcacataaaggtttagtcacataataagtaccgcaacacaggcgctaggactagaaacggatccagttcttgtcaatcttacgtaggaagaacatacaccaagttcatgtatatatggttcatcagttgcagagttgtgtctaggagtttcagaattacttatcggtcaaatgaatgtacctaacatagaaatacatctatatacatccatttcagcgaaaaaaaaaa

SEQ ID NO: 9179 - DNA, 898 bp, Triticum aestivum
  Clone ID: PAT_TA_9179
ccctcgtccggtgacagggagtacatcattgctcgccggatatggaaactgggaagcgcttactattgtgttacaaagggtgtgccatgttcatccatcccgcggcgcagcaaacctcgcagagtagatttgtattactcaagctggtgcatccgtgcagtggagtcaagacgaggcaacggtggctcgactgcctgcgagattctcttgttccaccatgaggatatgggcatcccatatgagatagcaaagattggcattcggcagggcatgtggggatgtgtgaagagaattgaacctggactccgggcctatcagaaagccagggctgctggggagccaccttcgccgagcgccttgatggcccggatcaacaccaaggtcggcgacaattttgtccgaggactggagtccaacagtgaccaagacatcatggaggccgaagagaaacctgtgaaaaaccgcatggcgaggttccttgtgctcggtggggccgtcgccttggcgtgtcctctcgaccaagggctcctgacaaaggctctcatcttcggcgtggcacggaggtttgtggggcagaggaatacattgtaggatctgacatcttcctcacaatcctctgagccaatttgcgtggagagagcggagatgatctggctaactgtagcacgtgccgttgacggcagatgaaggacattggtgtatatatgctgccggcagttgatgagagagggggaggcaacggggtaaaaagatgtaatttacattcggaaaagggattccagctatatatgaattttttttatctttgtttcatgcgatcttctatgtgaactggatatatgagaaaccgtaaatcagaatgtaattacttttttggttctttatggagtatctatgc

SEQ ID NO: 9180 - DNA, 771 bp, Triticum aestivum
  Clone ID: PAT_TA_9180
gtcaagtcaaccgatcatagaaatatctcctttcttctttccttttgctttgcacacatactagtgggcagtggcaccggcagcaagtagtctattcatctcagatctgaagttcactccctctcccggtgttctcttcccagcgtggatcctaaatcgcggacgccggacgaggagcgttcctctccaagttgtaatcgatcgcatcggcagcttcttacatcatcagcaattaatggccaccggaggtatgaccctggagagcctaccgaacgagctaccattagacttcttgagcaaaatcacaaataacttctccggtgagctactacttggtcagggcgcgttcgggtcagtttataaggggatcctggacgatggagtggttgctgtgaagaagctcgcagaaaattcgcctgtaccacgtgacacaatattcgcgaatgaggttcagaatattatggtgctcgagcatgagaatatcgtcaagttggttgcctactgccgggaagcacaaaacaaattggtgcagagcaacggacgatatattactgcagagatcactgacactgtactctgctatgaatacttgcctaaggggagccttcacaagaatctttttggtgaatccagtagcattgattgggatatgcgctttaaaataataaagggagtatgtgaaggtctacattttctacataccttgcctagtcccgttctccatttgggtctgaagcctcaaaatatactactgggtgacaacatgacacc

SEQ ID NO: 9181 - DNA, 1379 bp, Triticum aestivum
  unsure (1)..(1379): unsure at all n locations
  Clone ID: PAT_TA_9181
ggctcttcgtagcgagatttccccacccgtcttcttcctccgaaaccctaatccccaaatcggagaatcggacccagcccggcgccgcggagagcatccccccatcgaccggcatggcaattgctcgcactggcgtgtacgtggacgactacctggagtattcgagcaccctggccggcgacctgcagaggatcctctccaccatgcacgagctcgacgagagggcccatggcattttgggtcagacaaaagggcagatcaaatatctcctgggggtgccatcccatgggttcgacaggccaaacgtggtgcatgatgaaaatgcctcggagaagatgacgagggatattgaaaatagccaggacaacgcgcttagtctctgcacggagaaagtgttgctcgcacgccaagcttatgacctgatagagagccatatcaaacgtcttgatgaagacctaggccagtttgcagaagatttaaagcaagaaggaaaaatacctccagatgaaccgcatatccttcctccaatgccggtgggtggcagggatgaaagacggaggtccagttttagtacaccccaagcagcaaggaagtttgtcagagagaaggaatgggagagggatagggagagaggtatggacttcgacttaatccccctccaggtagcagcaacaagaaggccgttgcatctatggatgtggatcaaatgattgatccaaatgaaccgacatattgtatatgccaccaggtttcatatggtgatatgattgcttgtgacaatgagaattgtgaaggaggcgaatggttccactactcgtgcgttggtctgacaccagaaaccagattcaaagggaaatggttttgcccaacttgcaggaatcttcaatgagaggttctcctaaattgtgttgatgaggggagcggttccagtcggcccagactttccccaacatgcaggactcttcaacacgaggctctcagaagcttttcttggacaggaggataccaaatggtacatgtttcaatttgtaaggaggcgtttacttacagcgtgctcttattttggtaataatgtatatgctggagaggacgcaactgttctggagaaggataaaaacgcttggcgtgttctgttgttgtatcttgtcgccgcaaacaatctatcatagttccaggtgttggtaacctggtaaccattttactttgatcgtgatgtctattaagcgtcatcgcaacctttgctcgcatgattctgctcctgagcaccattgtctgctgcatctcctctgctgagctgaaggtgcggcagcatatgcacttctccggcacacattgtattaaattattgtgaactacaactacaaagcctgcnatcccct

SEQ ID NO: 9182 - DNA, 778 bp, Triticum aestivum
  unsure (1)..(778): unsure at all n locations
  Clone ID: PAT_TA_9182
ggccgctacagcctcatgcccggcgcgtccctgggagctgcatcacaggagaggcgccgcaaggagtctctcccgggatcgacagggggcgcaggccagaaggaggaggagatcaaagcgatgcccactgagcctgtcgacgatgacctctctcctgaatcactggacaaggttgctgaactgctcccgaggatcaggaccatgccgcctcccgacgagactccccgcgactcggggtgcgcgaagcgggccgccgatctggtcgggaagcgatccttcttcgcggcggccgcagccggcgattgcagtgccatttcctcctaccaggcgcgggtcctcgaagctgaagcaccggaggaggcagcagcagcagcagaggccttgggcgatgaggcagcctcagcaggagaggccttgggcgatgaggcagcagcatgattttgatccattcatgattggtcggagcgcttgcttaacttgagcatttggtgaggctttttgcagcgtgttacatagtcagtctactgttacattcctatctcatgctttgtttgccgatttaattcgtttaaggccctgctagagtgtgaagaagacctttatatgggtgctcttgtgcttaagttttacctgtcagtcaagtgtgctctgtttgtgtaagtagtgtcatggtgcggtctgaaaccttttgggtgggaaatgccaagaggataatatctgctccaaaacntgctgaattgaaatgttttcctaatgtgtatcaaataaaaaaaaaaaa

SEQ ID NO: 9183 - DNA, 614 bp, Triticum aestivum
  Clone ID: PAT_TA_9183
cgtccgcccacgcgtccggtcgtctacccggtcctcttcatggccatcctctacttcatggccggcctccgccgcaccgtcccctgcttctgcctcaccctcctcgccaccctcctcatcgtcttcaccagccaggggacgggggagctgctgggggcggcgatcctgagcgtgaagagggcgggggtgatggcgtcgctggtgctgatgctgttcctgctcaccggagggtactacgtgcagcacatacccaagttcatacggtggctgaggtacgtctccttcatgcactacggcttcaacctgctgctcaaggcgcagtaccacggccacctcacctacaactgcgggagccggacggggtgccagcggctgcagtcctcgccgtccttcgacaccgtcgacctcgacggcggcatgcgcgaggtctggatcctgctcgccatggccgtcgcataccgcctcctcgcctacttctgcctcctcaagaggatcaccctcacgcccttgtgaaaagagaaacaccatgggggtttggcacggcgtgtgctttgctagttaggtcttccgaattatatcctttgtcacatgtaatggcatgtttgttaatgggt

SEQ ID NO: 9184 - DNA, 1369 bp, Triticum aestivum
  Clone ID: PAT_TA_9184
gctgctctcccgcctcaacaagatcagggtcatcgaaaggccgcacgggcagcactcggtggttctcgccgaggacgccgccaagtactcggattgccggagcgacagaggaggggagatcccggcgagctcgcatcagatatacctcacgtttccttccgacagtaacttcaccgaggacgacgttgccaattatttcgggcagtacgggccggtgcgtgacgttcggatcccatgccaagaccagcgaatgttcgggttcgtgagcttccagaacccggagactgtgacggcccttctcatgcggcgcaacccgcatttcatctgcggatcacgagtcctcgccaaagcctacagagagaaaactaaatgcatcaatgagaggaccaacaacaagtcgacgacgcattgctatcctccacgctggatcgagaccgatccagagttctatccagaccagtatgattctccaaggctggagaggaggcaactggcgcgcgacaggcagcagctgctcgaactcgagaggaggcacctggccgggctccgagtagttgagccgcagtgcgccgcctacttcgattgcagcatcggggacgtcgcgcccttcaactcccactcccagtcccaatcccaatccgcaggttccaaggaagtgggacggaccatggatcccctctccacggctgatcaacttgatgatatcgtctcaaccagccagagccaggcccctcccatacaggcaaacaacaactacgatgaccaagagagtaaccagatcgaactcctcccggagagccctttcgcatcgtcggcgcctactggaaacgccatatgaagaggcaggcaaagaaaagaaacacgaactaccactctggactttgggttggtatctatgttcaggtcccggcgatggatgacagacagacagcattgtagtacacacaggaatcagcaaagcaaccgtttgtttttctgtagatagaggcggacagagtgcaaaggagacacaggacacagtttcgaaagaacgaacaaaaaaaaggtgacacgcgaaagagtgagatcttttcatactttactagcacattcaaaatggtgaggacagttacaggatagacacagatacaaatgtgtagtctgaccacaatgaatagtcatatgccaaatagctgtcctgaaataagacaagagatgatgatacaggttatcttttagtgtttttgccatcattttgaaagggcatgaaaaataaacaggaacattagctagctagcatgtggtgttacttctgtaataaatacaaacacaggtgatctgttcagctttatatgttacagtactattgatacttacaacactccttttt

SEQ ID NO: 9185 - DNA, 1256 bp, Triticum aestivum
  unsure (1)..(1256): unsure at all n locations
  Clone ID: PAT_TA_9185
gaagaccctgacataagggaggtccaaggctctactttggtggaagacgatttctggtcctgcaattccgacgacgacgacgcttgatgattggtcgatgctgctccctttgttcagatccattgctgcttctcgaagactcccgtgcgcacaggccgacgcctgcgctggtacccataggaggttctactacggatgattttcccttcgcgttgcttctgaatttctgattgctcccgcagtcttctgatgccatgaggaaccggagcaactctgctagatgaggaggagcagggagcttcgcaaccatcctgtgctgccaagggatactgaataatatcaagcgaagtcggaagtcatgggatttctttctgatccaggagggagttaacatgctcaacactggacagtccgactctgaagtgtgatagctggtcaattaagcaatcggggagggaaatgcaatggactatacaagaaaatataccactatcaattaaggtgcattgttatgatgcaattggtcattgtgtttaacttccttgttcgctgccaatgtcagagcagtagtcttttgttgtctcttacagcaaagatgacattggctgtagcctgcaggaaattagaattttgcaaatctgggagaagatggaacgtcgcatgatcaaactcatgatgcaattactgcgacttatggcggcgcattacctgattttctgccaaagttgtataatatcaaagagacaactggaggaaggtataagtataacccaatggaagtactagaggcatcttgatacttaggaggagctggagcaactctgacagatgagatttgagcgtgatgcatacttctgcaactgatgaaatgttctgaagtatggactgtgatcgacctgataactgctggggagaagtcgtggaaaatgcaatgggctacaccacgcaagatgctgctactgcttaaggtgcatatacgtacagttatgccgcaattcgccgtcgcgctcagctctccaagttctctgctgggtggtagcttccgatatggtgcaaggtgaacctgagaggcgtcttgacatctctgaactacgaatggaagagaaacgcattgatctcgaggcttcagtgtaatggagaggagtagcaagctgcactgctcctcaggagtttacgagttgttactgttggcctagatgagaaaacgcttcttgaggaacacaatcgaatcgaaggcnatccaccnatcagagcct

SEQ ID NO: 9186 - DNA, 668 bp, Triticum aestivum
  Clone ID: PAT_TA_9186
caaactcctccctagctcctccgccggcgcgatctcctccacctcccctcgcgtcctgggtcgaggcccgggcttgaaaaatctcgattgccctccctgctccccctaaacctcgcttcacgcaggattcgacactgatgaggctcctcatgtccaggaagcggcacaggctgcgctgccgccggcgaatccgagaccgtggaccggttgctttggtggctaaaagaaagagtctgcgctgccagcaagatgataactatcatgtggacagaggaatatcttgtcccgatcttccaagaggatatcttgcggcatattcatgccaaaatgacacttaagagatgctgcccgtgctgcttgcgcatcgcacgcattccgacgcaactgggatatgccgtcccaaccttacattcagtctggggaacacttggcttgaatagaaatgcgtctagggatgttataacaagagatcttatcagcaagattgacctgattatgcaaaatcactcaggcatcggcgtgaagacactagacattgatctctatagttgtgacaacatcgacttcgcctatcttgatagttggcttcgtattgctgttactccagggattgaagaactgatcctgacgctgcctctacccagcattgttttcgagaatgctctacc

SEQ ID NO: 9187 - DNA, 686 bp, Triticum aestivum
  Clone ID: PAT_TA_9187
gggggctaccagtgggcccccctcccgcgcccggggtctctctcccgtcgttcctcggctccttcccgtcacgttcgctgggcgttgcggcgctgctggtccgaggcatcgggatgcccactgccgacggtgctgccttgctaccaaaggggcaccctgccgcggccggggactccctgccgtcgaagcacgacaccttgccgtcacgtatgttgggtgttgtggtgctgcaggtccttggggttgggtgcggcaactcgagactcgaagacgatcttctgtgttagggcgtcgccgccggcggcggcacctgtatagaccgtctcggtgtgacagaagagttcggagttcactccgagaaagaattgctttgcatgtacatttgctgaaagactgatgtgctgaactttcgatgatttcgattggtctccaacctcaccgatctcctatttttggagtggtcctatcaaccgcctgtgtgcacgttgtgggtctgtggatcccgcttcaggcgctgcagatcctcggcgtcgacctgtcaagactgctcccgcgcgaccgccgtctgacgactcggacctctgccgatagccgagcgccgacgcggcctgaccactgccatgctactgcagcatcggtcgccgctctttctgatgttggtggtgattttcttatccggggatatg

SEQ ID NO: 9188 - DNA, 253 bp, Triticum aestivum
  Clone ID: PAT_TA_9188
ggacagttcttgcctgggacgacgggtctctctgtgtggtcttggtccaaaagctaaaatagggaataagatgtgccttgccatgtggagtgttgggtatcttttgcacttgctccatcagctgcagaaactatagcccaaatgcagcatactgctactatttcatatcattgattgatgatttgttttttcataattgaattggcgaatgatgaaaaggtgtaatgttcagggatttttgctaaaaaaaaaa

SEQ ID NO: 9189 - DNA, 531 bp, Triticum aestivum
  Clone ID: PAT_TA_9189
acatcccccaagccggccaagcgcacccacgtcgtcttccctcccttccttctcctccccaccacatcgatcgtttgccgaaacccacggcaagctcggcggagcaaggctgaaaagatctcgagcgccgatatagaccgacatggtgcttctacatggggctgcctcgtcgttgctcctcctcttcctgctgttcgccgcggcggccgcggcggcgcccatggagctctacttctcgcgggcggagctggcgcgcattgccgggtacggcgaggagccggtctcgacggtgctggtgtccgggcaggtcgcgtgccaactctgcctccggccaggctctgacctgctcaccttcgacctgccaggtagtaaggtggcagttacctgcacaactgaaggtcccaacacgatggctaactctgcatttgcaacaacaaatgagtacggcaatttctctatagagctcccatcccggctccacgctataccgagcctagagaatgcatgctcagtcaaggtgctggagcttcc

SEQ ID NO: 9190 - DNA, 855 bp, Triticum aestivum
  unsure (1)..(855): unsure at all n locations
  Clone ID: PAT_TA_9190
gaggaatttctgtttctaccgaattctatctgctgctgcgttcttgtcgagtntcttttccccttagtatgtgcactgcaactccgcagtctgcaagtgccaggtgctgtttggtnaatatgattgttgggggtggctattttgaaggttcccatgatcataatctcatgccgggatctttaataaaacctgactttgcaaatgagaggcacgaggagggaatggatgaatgtagcgttctgggctttaagaatcctcctccccgatcccaaggacgacagggtctcaaatgtagaggatgccattgaatacatacatgagctgaaccggacagtgaaggaactgaagatcctagtagaacagaagaggcatgggactaataggaaaaagatgataaagatggacgaagaggcagcttccgatggcgagaactcatcgacgatgccagtgagggatgagcaagacaatgagctcgattgggccataaggagctcctgggtgcagaggaggtcccaggaatgccgtgttgatgtccacatagtggaaaatgcagtaaacgtccagctcactgaatggaaagaacgccaactccctgcctcatgccgcgaaggttctcgaacgagttccatctttgagatcatcaagcgtggtcgggccgagaattgttggcgatcaccgcaatattcatcttcaacaactaaanggtatctgaaagggctggctcggtgtaatgcccctttcaattgggccgagaaggctctttcnaagcaagttnattgcanaagcaaccaaggccctcaaacaataantccgggccanggctctnnccaaccaaaactgaattatctgaaagaa

SEQ ID NO: 9191 - DNA, 808 bp, Triticum aestivum
  unsure (1)..(808): unsure at all n locations
  Clone ID: PAT_TA_9191
cctnnncgagtcccgnattgagntcgcccaancaggcggngcgctntctngatgtttgngtnagccaagcccccagntganatttggacanggcggaangncgnaaaggggancgacgagatcgcggcggagctggcgccgggatagggtntcgagatcacacccgagcngaatcagatcgtcgacagcccacggtgcatgtgcgccggagacaggagcggcacgctgttgatcactgaccgttgccggtgcatgtacattttacatctggagaatggcgccatggaggaggtgacggaccacctccgtggcctccgcgactacaagaccgccatggccgtcgagatagattggccggccttcttcgtctgtcggcttcttggtggaaaggcacatgtttaatttggagcgaacatttctatctcatcggcgtaaactggccgacctgtgtattaagtcgtgttaattatgttcaagatcgcaactacctttgtgcgaccggaacaaaaacctcaacatctatttctgtactccctcccggaacgttttttttgttttaaagagccctcgcaagcaaaaaaagcaaaggtttaaaattgcatgcagatgcatatggataagaagagaaaattaatgtcatcaagactactccctccgtttcaaaatagattactaaagttagtgtaaacttggatcatctattttgaaatgaaggaagtactactttaaaagcttaaagcttacanatgttaactccttaaactgcantcaattagtcttatggttnngagcttanggctcnttcata

SEQ ID NO: 9192 - DNA, 1826 bp, Triticum aestivum
  Clone ID: PAT_TA_9192
tccggcacccgctggcgccctcggacgcgacgggcatcgtgcggagccgctgcctgcggatccccaggccggtggccgtgcccgagactgggtccggcgccgcgaccgcggccactggctgggggaggggccggcgtggtggttccgatgtggtggacctgcgcacgctgctcatccattgcgcgcagtctgttgccacagatgaccgccggagcgctacagagctgctgaagcaggtcaagctgcatgctcgccctgatggcgatgggactcagcgccttgcgcattgctttgcggagggcctgcaggcgcggctggcgggcacaggtggcctcgtacaccagtcgctcatggcaacacgcatctcagctgtggacatgctcaaagcttaccagctgtacatggcagccatctgtttcaagaaggtgtctttcctgttctcaaatagtacaatctataatgcctccttgggaaagaagaagatacatatcatcgattatggtatacaatatgggttccagtggggcgtgctttctgcgacggatatcaacaaggcctggagggccgccgaatgtaaggatcactggtatcgatctccctcagcctggggtccggccatctgagcggattgaagagacagggcgctggcgcaagaagtatgcccatgagtttaatgtgccgttcgagtaccgggccatcgcgacggcaaagatggagtcgctccgcaaagaggatttgaagattgatcctgatgaggtactcattgttaactccttgtttcaattcaagaacttgatggacgagagcgttgtgcttgagagcccaagggatgttgtgctcaagaacatcaggaagatgcgcccccacacattcatccatgcaatcgtgaatggctcattcagtgccccattcttcgtgacacggtttcgggaggttctgttctactactcggccctttttgatgttctggacacaaccaccccaagggataacgaacagaggatgctgattgagcagaacatccttgggcgtgctgccctgaatgtcattgcctgtgagggtacagatagggtggagcgtcctgagacgtataagcaatggcaggtaaggaatcaacgggcaggtttgaagctgctgccattgaatccagaggtcattgagctagcgagagacaaggtcaagaactgctaccacaaggactttgtgattgatatagatcagcactggctcttgcaaggatggaaagggcgcatcctctatgccatctcgacatggacggcaaacgatgctagctcataaattttagctggcgttttcacttggcaatgcttatagctctagttatgtcaatataatgtctgtgtgttgtgtatggaccatggtctagttaagtagccttggatcagtggatgcagtttcttgaggtacgcctttcctgaatttggtgcatatttggcattccgacatgcaggtgattctgctcacagggccaatttgtgcgatgcaggtcatgagagagatgggtagcccaagatatatgcatgattttatgtgttgtgaattactatgttgcagtcatgttgctgcctaatgcctagctatgtagagtttagactttggtgtcctgatctggatggatgatgtttgctgaattgtgatatgtgcctgtgatcaatccagtcagttgatcaggttgtaattgacactagtcactgtgttcggggtgcatagtgcactgtggcaggcagtaacatttgtatgaaaaacttgttgaaccttgctttggctagtctattatgttttgtacctcggccgcgaccacgcta

SEQ ID NO: 9193 - DNA, 620 bp, Triticum aestivum
  Clone ID: PAT_TA_9193
gccgagatcaaagtggagaagctcttctccggcgatgtagagaaggtgtggacctatgccggaaacctgagcgcgcggaaagaagccggagacgctcctgaaagggactgagtttttggcgtaggtcgacaggtatcgtcgttcaacagatactgattccggtcggtagggctagaggcttccctgtacagaagcaacatcagtcaatttttttgtgctttcttagcgcgatcgatccgtggaccatgtactacccatccatgctcacctagtaatggagtaagtgaactcttgatgccgtctagtttcatgtgtcagtcactcagtcagctgtgtgtattaccccttgttcatgtctatactagcttagctagcaggttgggttgggcagcaagacagctagttgttgaacttgagatgttgctgctgctgctgtaggttttttgtgtccctgaagccgccagtagtgctgtgacaaattaactgcagctgcagtgggatgtttgttgtacttgtactccggtggccgtgcattctcatgtctgacaattgtctgtacttacatgttcctgatgaattgatccgacgcttagttcttcaaaaaaaagaagaaaaaaaaa

SEQ ID NO: 9194 - DNA, 713 bp, Triticum aestivum
  Clone ID: PAT_TA_9194
cagctctccgccgaccccgcgtccctgcccgcggtgggcgtcgccgtcgtgcgccgctccctctcgcgcggccgggccgtcaccctcgccgccgacgtgctgcttgggcgtgcacggcgccggactgaccaacatgatgttcctggcgccgggagcgacgatggtgcaggtggtgccgtggggcgggctgcagtggatcgcccgcatggactacggcgaccccgcggaggccatggggctccggtacgtgcagtacgagatcggcgtggaggagagctcgctcaaggacaagtacccgaggggacacaagatcttcaccgacccgacgtcgctgcacaagaagggcttcgggttcatgcgccggacgctcatggacggccagaacatcaccctcgacctcggccggttccgcggcgtgctccagcaggcgctcggcaactacctcgtgcagtagtccgacatagctagaatgaatgaatataccgtatatgcatcatgtatatgtatacacacatacttccattatttttcatttttcagtctgccagattaaatgtctcacgcccgtcctccttacctctctcgccatcctacagcggaagatcgccaagggggccccgccccatgcccccccgacgttcgtggccccccccacggcgcccgttttcctcgatttgcgtttccgaccactatccatttttaaaaaaaaaaaa

SEQ ID NO: 9195 - DNA, 743 bp, Triticum aestivum
  unsure (1)..(743): unsure at all n locations
  Clone ID: PAT_TA_9195
cccgggctgaggaattcggacgaggctcctctcgccgcagcctcatcgaagccagagaggagcagggcgaaaggaggccgtcggcgatgtcggagaagaaacgcgccccccgattttggatcgagcaggaggcaagcccgctcgaggggaagccggcgctcagagactgaatcccctgagcgggagcagccctagcagagctcccgagcaaaagcaggcacgcccaggcagagaccaccgagcgggagcagcccccgatcgaagatgcagccaagccggagatgggcctggggcggcggcgcctgtacgagacaaggagacgaacccggggcagcggatggagaggagggaacccagggcggcggcaggccttgagcgaccacgcacgcgctcggtgcagcggcctgtagaagaggaggcagactgggagcgaaacagggccggggagcgaggaggaaacggccggagacggccagcggcggccggagactaggtacgaggcgcacggagttgcagcgtgcgggaggaaggggctaacctagcatcntgataccatgttggataatcagccactaacttcacaggagggtcaaaggccaatacatatataagtgtgtggtaaagtgcaagagaccccttatataatgtggataaaccgaaaagggctatacacatctaacacttgtcagtattagtttgacatatttgttttgaccttggatgtttttgtaatcaggataaac

SEQ ID NO: 9196 - DNA, 426 bp, Triticum aestivum
  Clone ID: PAT_TA_9196
cgtccgggccaggccgactccctttccccctccgctccgctagctctgctctctgttgccgccgccagccgcccgcccgctcaaccgccgctccccgcctcctcgtcgccacagccggccgctccccgccgggccgagtccgtccggccgcgagctgccccgacccgacccggcccggcgcctctgccgtgtagctctcctacacggcccttggtggtaagtgacgggagaagttacacggcaacgtgctgatcgaccaaaatttgggtggaattcacagtgtagctgcacgctgcacgccatgtcggcgaggcggcatttcgctgtgttcaccaccgcgagccttccgtggatgacggggacttccatcaacccgttgttccgtgcggcctaccttgccaaggatggggggagagacgtcacctt

SEQ ID NO: 9197 - DNA, 680 bp, Triticum aestivum
  Clone ID: PAT_TA_9197
ggagagagagagagggagagagattgcggagacgggagagagagagagggagagagattgcggagaggagagagagattgtgccggttctcggtgcccggcggttcggcggttgggattgggttgcttgcgtctattgcagaaagagagttgaatccatccagcaaacctatgggagctggctcctgagccgcggcggcgggcgggcgtatctgctgggagatgaaactggaagataatcaaggttttgcattatctgccgttccaaattttcctgctagtagtagacatcatggggtctggatcagtgactctgaagcaaaagaaacgagtgaaacatacaaagaacaagtacttgaagcctggtgccctggctcaaattcgttatagtaggagcacaagcagggatatagggaagaaacggattctgttgaatgtggagaaggacgatgagctggagacatcaccacatgccgaggttgtgtttgaaagcagtacaccaattatgtctccagcaagactcagttttgagacatttagtggcatcaagggacagttgttgccaacaactccaaagactcctcaagcagctgaatgtgatggccattcaaggcttgagtcacttccacttgatctgttgatcaagatcgtctgttacttgcaccatgaccagctgaaggc

SEQ ID NO: 9198 - DNA, 816 bp, Triticum aestivum
  Clone ID: PAT_TA_9198
gtcaaatctcccagcttgccgcgcatccggtcgatctcccacctctcgacacctcgcgtgcgtccacggcggcgcgaacaaggcgtcggcagcgaagcgaaggcaagggcgcccatcgagcgacggtcggatctcgcggccccccgcgcaccccccgcccctccccccccccgccaccccccgcccaccccggcccggccccggcgcccgcagccccgtgcccgcacccgcccccggcgggcgacgctcggatctcccagcttgccgcgcatccggtcgatctcccacctctcgacacctcgcgtgcgtccacggcggcgcgaacaaggcggcggcagcgaagcgagggcaagggcgcccatcgagcgacgggcggcggagctctcagccgttcccacatatccgacctgaaccaccctccttggctctccagctttccatctcatccgactcagtccacggcgtcggggaatggatcaagcccaagccttcgtcttcttgcattggattggcgcccaccggacccaaatcggcgcccaccggacccaattgaccgaattttgtgctctttactttggagacgctgctgtcatatgcagcgacgttggtcgcaactatctgaagagtgcctaccggtttgtcattgatactttcaaaggaggacattgcttggcgtggaatgttctcggtgaggaatttcatggttgttaatgggttattcatgatggacatacctgcaccattcacgactattggtgattttcaagacctcatgactgatgttggagccctgagcaatgctttgctgaagtacta

SEQ ID NO: 9199 - DNA, 498 bp, Triticum aestivum
  Clone ID: PAT_TA_9199
ggtgggaggcgtgccgcagcaaaaccaagaccacctgcgctgacaagtacgctcaggagagtgcggcgctcgcctgcgacgcgtacaagggcgtcaagcaggactccaccttaggagatgagtactactccgcggcgctgccggtcgttgagaagaggatcgctcagggcggcgtcaggctggcggccatcctcaaccggatcttcagccggaacggcaggccgcagagcatctgatggatgcaatctcgttgaaattaatgaagaagaatgtcatcctgtgctgctgtctgaccatgttatagcttcgccagaaatcacgaattcgcgattatatttgttatatatccatccagcaaagcggctccgagtcgctgctgcagcaaatcgttgtatctgtatgaacgtacgtgtatggtggtgtattgattaacaccattgtattgtattgtaccctctttattttcagtataagtacgattgtgatctaaaaaaaaaa

SEQ ID NO: 9200 - DNA, 1240 bp, Triticum aestivum
  Clone ID: PAT_TA_9200
ggcgccgcctcgcccgggtcctgaagcctctccgcctccccccggctcctccccggccacagctgccgcccctttcgcgccagcctgggccctcgtgccagatcccatctcctgctccccatggctcctctccggcgagaagtgcggcgcccttcggttcgagatgggctggcgcggcagctcggatcggtggagtcgactcggcagtaagactgcctgccggaactcgatccgtcggcgggagctcggggaattccagtttgtcgttccgcgggcaagacgggaaagtactctgccctacttcctctgccctccgtggggaggatacaagagagcgtcggcatcctcgaaaagagagagcgtttacgtaagaagctgtcttccgcgcaaatacaaaaggctaaggactatacaaaggcatagaatttgtatgctgcgattcggtgtttcaacaaaaagaagttgtctggaacacagattgagcagctatcaaattttcagttgcgagttcatgttctggaaatgtatgacataggagtatttaaatatatgcccacccgttaaactgataggagatttttctgttgcgagtacatggcctgattatacgaaggcaacatctgacgctgttaatgcattccgttgttggtttgcgctctgggtcatctgctgtcaatgctagtctaccgtccccgtggagtgttcactcggagaggccaatggacgtgccgaacgtacgtaccggatacaggacgcacttgctacaccattcggtgcttcggctgaatgcgacgaggacgagttagaggcggaactggaagacctcgaggaggaagaactggacctggagctgcctgaaccgcctcgggggacacgcgtggcgccacccgcgttggcggcgagttcttctcgactggcggccagcgatctcgctggaactgaccaaacttcaggcagagatggcgatttagggatcttgcgataaaaatactgcggtttggaggggatgctgtcattgaaacctctgaggctcattgccatccttgcggcgtgcatgtaacatgttgtaaaattcaggcttatgttgaggagcaccaacaccgatccctcagaggctcactgccatccttgcggcgtgcatgtaaaattcaggctatgttgtaagagcatccacccccgttgattccctgcaaatttttaaggatttgggccccaaaaaaaaaaaaaaaaaaaaaaaaaa

SEQ ID NO: 9201 - DNA, 628 bp, Triticum aestivum
  Clone ID: PAT_TA_9201
gaattcggcacgaggccacagacacgtccgcccccgcgtccgcccgttcccgccatggccaccgccaccgccgcgctccacctcctcctccccacccgccgccggggccgcctcctcattccgcgcgcgtgccagcccgactcctccgccaccacgtcccgccgcggcctcattgccgacaccgccaccgcggccgtggccgccgccgccgcgccgctgctgctgccccggctccccgcggcgcgcgcggaggacctctccgagtgggagcgcgtcgggctccccatcgaccccggcgtcgtcctgctcgacatcgccttcgtccccgacgacccctcccacgggttcctcctcgggacgaggcagacgatcctggagaccaaggacggcgggcgcacctggttcccgcgctccatcccgtcggcggaggacgaggacttcaactacaggttcaactccgtcagcttcagcggcaaggaggggtggatcgtcggcaagccggccatcctgctgcacaccaaggacgccggcgacagctgggagaggatcccgctcagcgcccagctcccaggggacatgggttacatccaggctaccggggagcagagcgcggagatggtgaccgacg

SEQ ID NO: 9202 - DNA, 1195 bp, Triticum aestivum
  unsure (1)..(1195): unsure at all n locations
  Clone ID: PAT_TA_9202
cgggctgaggaattcggacgaggggctcgtttgttaccttttcctgtgtcgctttgaaccgtcgcccacctgtctcatcatccctctcgctgtcctctctgaagcatagccctcttcgtccgccccaggcccagcaggcgatggggcgccgccctggttgcgaggaagccgctggaggaagatctcaactggacattgtcgaccggaggaggggatcgattcgatctgcagaaaagagatagaagatgagaggaggagaaggattatatctgcaagagagcgagaagatgagagggaaagagatatggaaggagaggagggagaaagagagagtaaagaggggagggaggcgcgacaacggacatgagagggtcaacggtcggcgttggcctgccccggtgaggtagggcgtgacctgaaggttggtggtggctcgatccgctcctggatcaggacctacgaggagggtgggcctcgggcgcgaggtacggcaggctgcgctccacctcttcctcgaggagcatgtgcagtgggcggacagcagctcacgtggtggtgccggggcctcaacaggtgcacaatggggactccatgcatctcctgcgcaccgcaaccctccccttccggacacagcagaaacaaggatgtcgaggcggttcagtgccgtgcttttctttccatctgcagttgcgacgaagagtaggaagatcgggcggatagggtttcacatacctcttctacacttacaagtcttcctttccaggattgccatggatgagaagcagctggacactgagattcaccgcaactacatttatgaagatcatgttgcagactacatgaaggttactgaatcttattttaacttctgccctaccgttatttcagtcaatagctgatgcggtacctgagaagtaacaatttcactttagtgagtacatcaagaaggggattgcggctgatgacatggaagaactgcacaagaaggtaaatgctacattcgtgctgatctacatggnaaatcaacaaggaactctgaagaccacaaagangtataactcaagaaggttgaggtagtgcanacttgcaagcantaagttnaanncaaaattaaatgtgcaatcataganagcaagngcattgcatctntgngctacggntagaattacntagtgaangggnacaagtttcaanc

SEQ ID NO: 9203 - DNA, 1278 bp, Triticum aestivum
  Clone ID: PAT_TA_9203
ctgtccccccccctccctcccgcccccctccctcccacgcaaaccgcttactgcgagcctgccgtgcttccgccccctccgcaccagccgcaatccctcccgctcgcttcctcctcccgtcatacagttcttgaatcgctggccgcccgccgcggactccccccggtcggcctcccccccggaggagaaggacaagctggtggccgaggtgatgcgctacgcgctcttcaagacgcaccagaactccggctgccccatcaagcgggaggagctcacccagatcatcaccaagaactaccgccagcgagcgctccctgcgctcgtcatcaaggagactggggacaggcttgccgcgaccttcggctatgagatgagggagctccagaggacccgcgccacgtccacccgctccggacccccctccccccagcacccccgtattcaggacgcaaagagctacgtcctggtaagtaagctggaccctgaggtgtacagcaagtatgtcgaggataaggagcgtgcccatgtgtctggatttgcttttgttgtcataagcattgttcatgtcgctggtggcaagatctctgaagaggacctttggcgtcagcttaaacggctgggcttaaacgagactgatgagaaccaccctgttctcggcaacaataagcaggcgcttgaactactagtgcaacaaaggtacttgctgaaggagaagattgctggtccagaaggccattccatggtttatgagcttgcagagagggcattggatgaatccatcagctcgaagcttaaagaatacatttcacaggttgtgggcgtcagtacagctacagcagaatgaagtgcatatgatggagcaaccatcaggctttgctgtccaatctaaactcatcagtacaacggcgaacttgagttagggtggaaagccattgtagagacttggtggaggcttcatctgagggctgtataggagaggaggtagtctgtgcgcgtgcgcgcctctcaactaggttagattgagacgcctaagacgtgtctttctggtttgagattggaaaaaggaaagacataccctttggttgcgggaagcgggtgccgcggggcccggtcgcacttctgcgcgtttcctcttccggagccggagctgcataagtccacgtgcattctacgtggctttgttcgttcaggtttgctcgcctgagcttcaggaagccatataagtgatgcgttgtctgtcacgattgcagccatctcaactcaaagtttagcataaac

SEQ ID NO: 9204 - DNA, 514 bp, Triticum aestivum
  unsure (1)..(514): unsure at all n locations
  Clone ID: PAT_TA_9204
gggggagtacaactaaacctntgaacagacncggttcccaggcgggtttgtcgggcggcagcgggcaacgtcggcttcagcgccgtcatcctcgtccatggccgcggccggggtccccagagcctaccgtttcgccgcgccgggcgccgcagacgcgttgttgatcgatcgatcgacgcccttgggtacctggttctcgaggcgcgggtggacggtatatttttgcgaaattaacgaggatactacgtacatccttcgcaacctcgtttatatgttgcgagggccataataatcaatacgtatcatgtatacataacgaattaagcattctatgcatgtttcccgcgtttagacgtggatgtaaaacgtattgatgttaaggaggacaacggcgaactatatgtatgtgatgcttttatgtatcatgcatgtataatgaacaaactggcatgaggtccattttcccttcaaaaaaaaaacctcggccgcgaccacgctaatcactagtgaattc

SEQ ID NO: 9205 - DNA, 964 bp, Triticum aestivum
  Clone ID: PAT_TA_9205
cgggtcgaccgggaaggagaactcgccgctcaaggccatcgatttcggcctctccattttcttcaagcccggtgaaaagctttcagaaattgttggaagcccctattacatggctcccgaagtattgaagagaaactatggaccggaaatagacatatggagtgccggggttatcttatatattttactatgtggagttcctccgttttgggccgagaccgaacaaggggtagcacaagctattcttcgtggaaatatcgattttaagcgggaaccctggcctaatgtatcggaaaatgctaaagatttggttcgacgtatgttggaaccagatccaaagctcaagttaactgcaaagcatgttcttgagcaccattggcttcaaaatgctaagaaagctccaaacgttcctcttggagatattgtcaagtcaaggcttaagcaattttcgagaatgaatagattcaaaagaagagctctaagagtatgcacctagctcttatgtgtgtggagctgctgcaccaacaccaaattagaaacaagaatgcccaaaagcagagcaagaacaccacccaagagaagaacaggggcatcactcacgtgaacttgttggatccatctgtaggatgaagatgaacttgataccatctggcgagagggagacgaggaagccgtggagctcagcgacgtctgctcgatcgatcatgtcaaggagggtggacgtcgatggcgacgtgggggtcacggatctggccggagaagcgcctccccttcctcctcctttgacctccatggagacgacgagcacagctggatcctgtgagacttcatggcggcggcagcctcccaatgatcctcgtcaccggcatccacgcgcacgcggtggcggcaggggcacggacccgacggcaacggaaagagagagcacaggagagggaggggggcaaggaggctcaagaagagc

SEQ ID NO: 9206 - DNA, 1620 bp, Triticum aestivum
  Clone ID: PAT_TA_9206
ccacgcgtccgcgacctgcccaggcgccaccgccgccgccgccgtcgtcgccgtcgccgacgagccccgggccagcgccccgccgcagatcccggcacacccactctcccgcctccggctaccggccggcgactcccccctccgcctgggtcttgcccccgcgggatccgagcggggctagggtttacggggagcgaggaggaggaggcgcgatgagcatcgtccccaaggagacgatcgaggtgattgcccagagcatcggcatcccctccctccccgccgatgtctccgccgccctcgcccccgacgtcgagtaccgcctccgggagatcatgcaggaggccatcaagtgtatgcggcatgcaaagaggacagttctgactgccgatgatgttgacagtgctctgagcctgaggaatgttgagcctgtgtatggatttgcatctggtgaccccttgcggtttaagagagctgtgggccataaagatctcttctatattgatgacagggaggcagacttcaaagagattacgtcagctcctctaccgaaagctccactcgacacagcagttgttgttcactggctagcgattgagggcgtccaacctgctattccagagaatcctcctatcgatgcaatttcagcaccaactgaaaataaacggacagagcatgccaaggatgatggactaccacttgacatgcagcttcctgtcaagcatatattatctatagaactacagatgcacttcgataaaatagcacaccttactctgacacgatcacgcaccctaattttcagagaagcattagtgtgcctgtctaaagactaagggcttcatccccacgcgtcttacttttcgtacttcattgcagatgaggttaccaggagtttggccgaccttcctgttctatttgctctcatgcgtgttgtccaaagccttctccgtaatcctcacattcatattgaaccatatcatattacttctaaaatggcaacacttgtttattgccagttgcatcagttgatgccatcaatgatcacttgcatcgtcgcgaaaaggcttgggcacaggctttcagacaaccattgggagcttagagacttctctgccaatttggttgcttcagtatgtcggaggtatggtcatgtgtatcacaatctccaaatccggttaacaaagacactggtccatgcatttcttgaccctcataaagcattgacgcaacattatggtgctgttcaagggatatctgcattggggcccagtgcgattaggcttctgcttttgcccaacctccagacgtacatgcaacttttggatcctgaattacaacttgaaaagcaatcaaatgaaatgaaacgaaaggaagcatggcgtgtttacggtgccctgctgtgtgctgcaggcaaatgcttgtatgagcggcttaagttatttcctaatttgctctctccgccagctcggccggttctgaggagcaatagcagagttgcaaccaaccacccagatgaacggaagtctagtacagacctctctgcgtctcagccacctctgaagaagatggcgtcggacgtatcaatgagtcccatgggttcagcagctacagtggcaggaa

SEQ ID NO: 9207 - DNA, 941 bp, Triticum aestivum
  Clone ID: PAT_TA_9207
gagggggagcatgtctttgcgaacctcgttggagaggcgagttctcccactagctgcccgggccagcccgatgtttgcttatacggggctcgaggattcgatgtgtgtcaccgtggaggagctcaacaaagatgaagcgggcctgtgtccacgctttgacggagttggtgctagacaagttcccttcgatgtcatcgtggagcccttccactccggcaacgcgcctgccaatggaagttttcaatcgcatttcctttcgtcgttaagtgtctttactttctacccccttctgacttctcgagaccatttaggagcttgcgggcttcatcgctttcatgttggagcccctgttgccggggtaggcttggacccgatgatggcgaagatgctagagccagagccgaagagggcccccgtagcccgttgctcgcctaccaagaaaaggaagatcgtcacacacccaaggaggaagagggcaatgatgacgatggtgacgaggaggaaggagatgacaaggaggaagaccaaaaagggccctccacagaggaatgtaactctgagaaagaagtttggtggcttcactggcatggggtcggaagaggggccgcagagaggaaacttttgcaggcccggcgttgctggagcgagagcctcagctaggttcttcaaggatccgtgatcccatcgaaggggccaatgtgcctccggtgctagcagttctcctcattgtggcgagcccctgaggaagcacaatactatttgtgtcgagctggcctgcttgctccatcaaggaggtcaccacgactgggacctccaccccgcgtccactagtgacggatgcccccacgaccggctcacaagggccttgagaggcgatcagggttcgacgcctgaagccgtatctcagaggcatgtaagtgtagagtttgtacctccttcat

SEQ ID NO: 9208 - DNA, 699 bp, Triticum aestivum
  unsure (1)..(699): unsure at all n locations
  Clone ID: PAT_TA_9208
gaggaattcggacgaggcgnaatcnctgcgtgccgccgcctgtgcccgtgccctcttcatctcccgtcccgagctccacctcctccagcctcatatcccctgattttctcgatttggatctcgggagcacacgggagggagtccccgagcggtggcagcgtcagatccctccgtctcgcggggcagggcctcccgtccgtgccacgatgacgccggcatggaggctcgggcacgggcagccaccgcggtgtcgggtgcgccggcgaggtctctggggaccgcgcagtaagggactggcgcagcttctgatcgttggttccggcgatgccaagccgaagatctgagtcgccgagccgcaagtagcagctggacatccatccgccggccccgacagcgagctccggccgtccaccgccccgagctccatccgtccgctgccccctaccccatccgcctgccccgtagtcgcagccgtggatagccccatcagccgcaaccttcagcaagccacgcacaaaccttctgaagacaaattctagggatggaggggctgccgaaatccacctcgaggcagaggggtaaggcagaaggatggcgagcgttccactcgacggcgagccatgggtgatggcgatcgcaacggcaaagttttccgatctgcctgtcttcaagggcggggaccgacggaggttgtctccc

SEQ ID NO: 9209 - DNA, 1100 bp, Triticum aestivum
  Clone ID: PAT_TA_9209
gcaggatgaagaagaggaagaccaacaagacatggctccggtgaagatggcgctgggccctcaggttcccctcaaggaccttctccacctccacaaggaggaggaggagggggaggatgagagcctccgtagatggaaggagcagctcctcggaccagatgctgtccacaccacaaacctcctccatgcccttggagcagagaccgtcgaaccggaggtgaccatactcaacctcaccatcctcgcaccagggaggcctgacctgcttctgccgatacccttcgtgcccgatgacaagggccacgccttcgcgctcaaggacggctgcgcatacagcttccgcttctccttcgccgtctccaacaacatcgtgtccggtctcaagtactcacacaccgtctggaagaccggagttaaagtggagaaccagaaggtgatgctggggacattcagccctcagcaggagccctacacgtacaaggctgaggaagatagcaccccgagcggcatctttgcaaggggttcctattctgccagattaaagtttgtggatgatgatgggaaggtgtacctggacatgaggtacagctttgagatcaggaaggactggcctaattaacagacaacaagaccgactcagtcagccagtagaagtgagaccacctaacctacccagggttcgtcgcaaagatgagatgagatgagatgggatgaatgaatgttagtttaggttctgcggtgtcatggggatgttgatagctgttaggtgattgatgtttcttgtgtggtatctttcagggatgttgattcactcgctcgcttcgcttggcttgcaatgaagaaggtgaaagacttgagtacctgacctggtttgaaagtgtgtgtctgaatttgcatgcattagttagttattcttcatggcccgtagattccctcgaacgctgatagtgatagatgtgtctgtttcctgaatggaatgtttgggtaatgtgaaccaaattgtttcctgaaccacttaacgtgcagacttttgtagaggagaaggaatcagcaatttttagtacaatatcaattgtagtaaaaagttactgtttgttccc

SEQ ID NO: 9210 - DNA, 505 bp, Triticum aestivum
  unsure (1)..(505): unsure at all n locations
  Clone ID: PAT_TA_9210
ggcgttgcaacttttggaaatgggagaacaagtacatcgactacctgcgcgctcgttgggcgcatgtgtttcttcctgcacctcctcctgccgttcaagcccccaccatgatcctccgtgagatttagtcggacatgaagattgcacttgccgtctcccttggtactcttgctgctgtgatgatgatccttgtctccaaaatgtagttccaatgatgtaataggtttagatctaatatctaattaccgtttttagaatgccaggaagtttgcttactcagtctcccttggtactcttcatgtaatttttacttatgaactcattccccactaagctaactccgaagttccctgtgtaaattttcaatcaaggcatacagaggctcagatgtaaattttggtgctataattagtattattctaaaaaaaaaaaaaaaaaaaaaaaaaaaaaaaaaaaaaaaaaaaaaaaaaaaaaaaaaaaaaaaaaaaaaaanccnnaaaaaaaa

SEQ ID NO: 9211 - DNA, 1771 bp, Triticum aestivum
  unsure (1)..(1771): unsure at all n locations
  Clone ID: PAT_TA_9211
ccaggggngntccgccccccctcttgaaactccgncgcacttccaggacctnctcgcaagcctcggccccaccatcgcctccctcttcttcccccgcggcgcctccgaggacgcgggggcggggggctggctcggcttcctcaaggggttcaactcctgctgcgcgcgcgcccgggcctcgctgccgctggcggtgctcctccgcgtctacgccgcggcctgcgccgccgcgggcgcgccctgcggcgtgcagttccgccccggcgaggacggcggcggggatgaggagggcgggaaggtcgtgggggagctcgcccccggggagatcgccgtgctgctgtccatgtgctgggtcatggcgtggagcggcttggcgccgagggtttcgggcggcgaggaaggggggaagggggaggccgtgctgctcccggacgtttcgcacctggtgctgtcggcgctcgtgtccgcgggcgccgtcgcagatgacgagggtgtatggggctgggaggtttctggtgccgggaagggggtttcggtgcaggagttcacgtcctgggtcatctcgactgtccccgggcttggcaactgcctctcgcggtatgtgcaggacaggttccggtcgtctgagtctgatccagcgaaggaaagctctgtttcaactggtaacacaacttttgatacttgtgatgcatatctattaacacgtgggagggcatggtcaatctctctcagcgtcagaaacacattgagtgaaaagtttttgtcagcatctgtcattggaatggacacaggagaccttctttataggtcatcgcttcatggaaaaggtctgagccggttttggtcttgtgttgaggggtataagggaccagcgctaattcttctctcggcattctcgaattctggtagtgagaatgttgatgctggccgaaaatggggacttggtgtattaaccgaggatggatttgagaacaaagacactttctacggtagctctgggttcctatgtgccacatatccgatattccgcatgcttctgccatcgggtaaggagaagaacatcatgtattgccacctacatactcaactaaagacgtatgaggcaacaccaaagcctcttggcttagcattcggtggatcaattggaaacgagaggatctttatcgacgaggacttctctaaagttacaattcgccatcatgcagttgacaagacttaccaacatggttctctcattcccaatcagggttatttacctgttgaggcttcaatacttgacttcgaagtatgggggcttggtggacaaacaacaaagcggcaacaggatattttcaagaagagggaggatattttctcagggcagcggagaaagattgatctcgcagcttttggcaattgggaagactctccagagaaaatgatgatggacatggtttctgacccaaacaaggcccgtcgggaagaacgttgatttagttttatggcaagctcatttgctagtgttcagcagctaccatacaaaagtggacacagaaatgacatattactttgaggtatatagaggcatttgcatgtatcgcccctttgatgttaaaggcatttggcaggaccacccataatttagtctgaattgaccagagcctgtgtaaagacgtacaatgtgcccagtcctccccgcctttctttctcagcatccaactgtgtcacgggaggcaagagcaaacgatttgtacatctgtgttgtaaattagatatcatcatctgtaccata

SEQ ID NO: 9212 - DNA, 900 bp, Triticum aestivum
  unsure (1)..(900): unsure at all n locations
  Clone ID: PAT_TA_9212
cgtccgataagatctgagatatgcactcttataagcttgctatgcccgtcaaactcttccagacagtgtcagttactgaacttgctcatgtctttacttcctcggacactgtcagctggtgagagtgcagcggagtactttgagttactggggacaatgattgattcagaggcttcacgtctgttcttaactggtcgaggctgcttagccacactgggttacatggttacaaaataagcgtacaacgtttgatcgcaggagagaagccttagcattgacatatcacaaggattcattcttcataaacttgcggagctcctgaataaatttctcgaaattcccaatattagagcaagatttatgagtgacaagttactgtccgaggtgcttgaggccttcttggttattcgtgggctagttgtgcagaagacgaagttaatcaatgactgcaatcggcttttgaaagaccttcttgatagcttacttatagagagtactgcaaacaaacgccaatttattcgtgcttgcatctctggattgcagaagcatgtgaaggagaaaaagagacggacatctctgtttattttggagcaactctgtgatttgatttgcccagtgaaaccagagcctgtttaccttttgattttaaacaagtcacatactcaagaagagttcatcaggggttccatgacaaaaagtccatactccagtgtggagattggcccactaatgagagatgtgnaaaaacaaaatatgtcggcaacttgatttgattggacttatagaagatgaatatggtatgggattacctgggtgctgggaatataatttcacttgatcttancatctcccagggctatgagcaagggtggagaaagcaccccagcccaactcagcatt

SEQ ID NO: 9213 - DNA, 898 bp, Triticum aestivum
  Clone ID: PAT_TA_9213
ggcctgtttatcttcgatttgaggctctttgctcttgctgctggctcattccagctgctctatccgccgccagaagatgagtctgactgggatgactttgtgtgtacgtggcacaccctcccggagccgccttttttgcacgaacttgtaacttgctgtgctgtgcatagcgatcaacacaccatctttgtcagcacaggagagcatgaccctgccaccttcagctttgacacggagatggaaggtgatggtgagtggaagcgtcatggccgctggaggatgccgttcattggccgtgcttactttgtccctgagttggatctctgggttgggcttggcaaacacagacggatcttcgcaattgatgtggtatctgaagaacctgatgctgtgcatgttgagcgttatgtggaccttccctttaaggtgtgcgtggacaaaccgagctgctgccattttacagatcaggagcccatcggagccaccctccttagcatgggtggtgggagcactttttgcctccttgagtacttcggtgtgaatgagatggagcgtatcatgcgattgatgacattttctctcaaatatgacaagtatggagacctgacgatgggcaaaagcatccagactcggtacaacagggtgccatctgaagttagtttgtcgacgcttaagactccggtggctttctggatgtaaaaaccgtggtaatgtttggttgatgtaaccccaggttgtagttgtgaggagttagtgatcttgttgttttggtgtgtactaccatctcaattagtagttatgtaacttagactgagatattgctgttattttctagtacgtcttttgttgtttgggtataatttccgtgtgtacttttattttttaaaggatttctgtg

SEQ ID NO: 9214 - DNA, 695 bp, Triticum aestivum
  unsure (1)..(695): unsure at all n locations
  Clone ID: PAT_TA_9214
ggataccctgcgagnactcgtggtgcggcgatcatcggacctcggctcttggggccggtggcccatcgacgggttggtggccagttctgggcgctggctggatctgaagacgacgaggcggacgaggatggggatgagccgacgtcctctccgccaacgccgacgccatctgatttattctgtgagttattccattcaggctatgatgaggatgaggtcgcctctacggtggacaggatcttgccggtggacgatccggcgagggttgggctacacgcggacgaccgaaaggagatggtgcatcgcgtcattcatcggagaacggcggcgacagctgtccggccatggaaaggaccccttccgaaggttttattcagggctactgcgctgatccgtatgtggtccttactcactccgatggaggccaggaagcgtttggttactggatctgtccggtgggagatggtagcgcgggatatcttcaaccggtttggatggcggtcatgtaataggataggcgattagtttacctatctgttaatttgccagccggttgtggcttgttaggctttttgttttggcatggaggctctgtgtgagcttgccgatccttttgtctgcagactttaacaccttgtttactctttttaataaatgtggccgtatgcatcgttctgatgcagagaccggggaat

SEQ ID NO: 9215 - DNA, 829 bp, Triticum aestivum
  Clone ID: PAT_TA_9215
gcgtgtatgggcgtgcaccgggcgcgttgggcgcgtcgggtccacggcgggtcgtgtgtgtgcatgcgtgtggtgtgcacgggcatgttcgtacacgagtccagcgtgtgtgcgttctgttggcgagatcgggggagcgtggagttggtcctaggcgagctcgcgtgacccgaacgtgtgcttgcatgtcacgggagtggacagggcgggccggaccaggcgctcggcgtggactggggcgtggggtacgtgccctggcgcgccccagggtataagaaccccccgtatgcgttgtaacaggtgtggctcgggtgcgtcctgctggaaatcgtccgttgttgcggctgggggcgtcaatgcgccgggaagagaagttacggcgtgtgtcatcggagcttggcgtttgtcgccaaggaagaagatggagtccacgtcaaacttggtggtggtcgtggtggcggccatgacaaagacgatgactggagctgcaacaactccggcaacggcaacgggtgtcaagattagggtgaaaattgttagcactaatcttggtagttaggtgtgtgcgtgtgtgtcaagccgttggcgtagacggagtgcttgttagttaggtgtgtgcgtgtgtgtcaagctgttggcgtagacgcataggtagtgggagcaatactcgtggccattggacgccggccgcgtcgtgcgtgtatgagcgcgtcggcctgggcggacgaatcgcgagctaggtgggcagtcgtgtgtgcgtgcgcatgtgcttagcctgggtataaatacccccatgtactgatcgttgtggattgaagtgtgaagtgag

SEQ ID NO: 9216 - DNA, 447 bp, Triticum aestivum
  Clone ID: PAT_TA_9216
cgtgcggctggctcaaccccttacgaaaccctaccgcgcgcaccctcctctcggcctccagtctcccaccctctctggcgttcggcggcggcggttgaacggcggctggcagcggcgtatctgcagttttctgaagaattgcgtctgtccgcccttgttgcagagcaatccgagaatggcctggggtcagggtgctagaaggcccatactagggcttctgtctcgtgctcaacgacaagctgctcgagggtatacttctgcaacgttcgaaactcacctgtcgagcaatcattttgccccaaatggcatgatttgtaggagatttagctctgaggtgcctgcttcggagcaaatgaatcttattaaacgactacgcgaaagaacatgtgctccgatcaaagatgtcaaggcttcgttagtcagatgcaactgggatattgaggatgc

SEQ ID NO: 9217 - DNA, 1619 bp, Triticum aestivum
  unsure (1)..(1619): unsure at all n locations
  Clone ID: PAT_TA_9217
naaaggttttcttttcctttttctgctcctggttcaaccccttacgaaaccctaccgcgcgcaccctcctctggtctccggcgctcccaccctctctggcgttcggcggcggcggttgaacggcggccggcaccggccgatctgcagagcaatccgagaatggcttggggtcagggtgctagggaggcccatactagggcttctgtctcgtgctcaacgacaagctgctcgagggtatacttctgcaacgttcgaaactcatctgtcgagcaatcattttgccccaaatggcatgattcgtaggagatttagctctgaggtgcctgcttcggagcaaatgaatcttattaaacaactacgcgacagaacgtgtgccccgatcaaagaatgtcaaagcttcgctagtcagttgcaactgggatattgaggatgcacagaaggatctaaggaaaagaggcgtgatatctgctgccaaaaaatcatgaaggactgctgctgaaggtttgctagctatcgcacaagatgagaaaagggctagttgtggttgagctaaactgcgagactgactttgtggcaagaaatgatgtgttccagtatctggcttcctccttggctaagatggctttgtcagcacaggatcccggcaaattggtttttccttttgctcctgcatatttggagaacatgagtattaacctagatcatcctaaactcagtggtgaaacaactgttcaaaatgctgttacagaagttgctgccatggttggggagaatgtaaaactcagacgaggtttcatgttgtccacgactgcacatggtgtcgtttcatcttatctgcatacctgtcctcagccaggtttgggccgcattgctggattgattacattagaagcagaagatagcagtgcttcccttgatgctctcaagagagttgggtcgtctatcgcaatgcatattgttgcagcaaaaccattattcttatcaaaagaattggtttctgctgcagctttagaaaatgaacgtgacgtgctccgaactcaggctgaaagttcaggtaaaccccaaatggccatagagaaaatggtggagggccgattgaggaagtattttgaagatgtcgtgcttttggagcaaaaatacgttgttaatgatagcacaaacattaagactctgctgaatgatttgtcaaaggaggttggttcgaaagtaacaattggcaattttatcagaatggaagttggagaaggaattgagagcagacctgaggaaacagctaaaaaagaagctatggcttgtgctgcgtaaattgcgagctgagatgaatcaaatgcattggttcctttctcctgataattaacatgggctctcatcttttgtccaaggggatgttttttctgcaaatgtataaatgcccatcaatcaattagctagatgttggcaaacaagttaaagaaacattgtggtaaattgaatcaaactgaataatgtacgactgaaacgaaaggccacgcgtgctgagacctgcaaggctgcaaatgttggggtttgctcgctatttgtctgattgaactgcggtgtgatcgaataaagattgcaatagctcaaagaaaattttaaaa

SEQ ID NO: 9218 - DNA, 353 bp, Triticum aestivum
  Clone ID: PAT_TA_9218
acgaggccgacatcatggccgccgccggcgacggtcggaagatcaaccgcggggtggccatctgtcaccttgacacgtctgactggagcccgagccacggcgcgttcgtgctcctgggcggtgagcccggcaagacggaggtctgccattggatcttcgagggcgacatgacatggacggtggcagattgactgattggtgccaaagcatgtgcttaagccaaactaaagacaagtagcggtacatttacaagttcccattcatcactggtggtcttcacgtgtgtatggaccatcgtccaaaaagaacaaagagttgatgaaagaaagggggagctgagctgaaaaaaaaaa

SEQ ID NO: 9219 - DNA, 599 bp, Triticum aestivum
  unsure (1)..(599): unsure at all n locations
  Clone ID: PAT_TA_9219
gattgacagacttccagnagccaaagtgaaatttagccagccgggaacacatccgactcaaccatgacctatccaaggaagcttgctcagctggccaagaagtgtcagcggatgttggtggccagagccggtgcccgccatcggcgtgcctcagacacggccgacgacgagtgctgcagcacagtgtcatctgtggttgccgatgagggccactgcatgatgtacaccgcagacggaacccggttggaggtccctctggcgtacctcgggactacggtcttcgctaagctcctgaggatgtctgaggaggagtttggcttcgtgagcagcagtgatggaggcaggatcatgctgacctgcgatgccagtgtgatggaatatgtcttgtgcctggtcaggagagaggcccctgaggaggttgagaggcgttcttgacctccattgttgggcattgtcacaactacaatgctagctgcatgataccatcaatgggactcggccatcagtttgctctttgtacttagctactagcttagcttctgaaatatttttaattaggactgagaggagctnctgtagagagcctcatgtaagattca

SEQ ID NO: 9220 - DNA, 1799 bp, Triticum aestivum
  Clone ID: PAT_TA_9220
agtcagcagcaagaaaattgcaacggagcagacggctgaacactgggctcgacctggcaagccctccgtgaccccttcgccggcgagtttgccccagactccgagctcttagccctgcctccgcctgatgcggcgtagttgggaatgacggactccgggatctcccggtcaagctccgccggtgaggagaacctgccggggatcgagaaggtcctcatccgggaggaggaggcggaggcctcggagcccggggttgagctcactgccgcagaattctcggtattcagcggtgtcgccggctttgtggcagacgagaagcatgacgggagtgggcgtgaggctgggggcagcactgatggggactctaggaggggggaggccggggtggaggtggtgacgccggagacggaggcggtggtggtgacgcccgagacggaggtcgatggcgatgatcccatcagcaagaagaagaggaggcaaatgaggaatagggattctgccatgaagtccagggagaggaagaagtcatatgtgaaggacttggagacgaagagcaagtatctcgaggcagagtgtcgccgcctcagctacgcacttcagtgctgcgcagctgagaacatggcactgcgccagaacatgttgaaggataggcctattggtgctcacacagccatgcaggagtctgccgtactttcggaaaccctgccgctggtttccctgctttggctagtgagcatcgtgtgcctattcctaacgcccggtctacccaaccgaagtctggcggctccaaggagagccgaaagaggtctcgcaatggtagccggaaagccaagcagtgatcaaccagagaccttggagcttctactccatggaaggcgctggaggggcacaagggagaggatcaagctagatactccgccattgcgtgcagctgccgcttgctagactagtgccggcttattcgcaagtttccagtatgtagtgtagttagcaatgaatgtctattatgtgttctcttgctgccaccgtggctttatccatgactatctttcttctctctctgttccctttgttctatgatcatctaatcagatgctagttttgaaaactggcagtgtctttccctagacgttgtggaggagcgcctcccggcgagccgtgtcggcgtgggcggacagcccgaagtcggcgaccttgagattgccgtgctcgtcgacgaggaggttgtcgggcttgatgtcgcgatggtacacgccctgcgcgtggcagaaggtgagtgccgagacgagctgctggaagatgcggcgcgtctcgtcctccttgaggccgccgttggcggggatgtggcggtagagcgggccaccgcggacgtactccatgacgacgaagatacgggacttgcacgccatcaccttgtgcagctgcacgatgttggggtgccgcagccggcgcatcacggcgatctcgcgcttgatctgttgaacggcgcccaacttgatgagcttctccttgtccatcaccttgattgccacctcctccttcgtatccatgtgccgcgccaggtagaccttggcgaaattgccctcgccgagcagcttcacctgctcgtaccgggcagggagctttggccgatcccccatggcgccgtcgccgcttcttgggcgggcgttcgaagtttgtttccggacgcgtgggggaaaaaaatcagtccaagcctcagtacctcccacgcaggcccctgcccgggatttcttagatcgctctctagcacaaatctcaataaagctggcatattctgt

SEQ ID NO: 9221 - DNA, 1178 bp, Triticum aestivum
  Clone ID: PAT_TA_9221
gcacacatgcatctactagtagtaagttgaaaaggttgtgcgcatgatttcagtttcgaagacatcaagctagcttgctaccaggcaggaaggtagatgctagcaatggaccagcacaaccatcaggaggagtcgtgtgtcccaccggggttcaggttccaccccactgaggaggagctggtggggtactacctcgccaggaaggtggctgcccaaaagatcgacctcgacatcatccaggaggttgatctctaccggatcgagccatgggacctccaagagaggtgcggcggcggcaggggaggacggggagcgcgtcaggtggcggcggaggacgagcagtcgtcggagtggtacttctttagcttcaaggatcgcaagtaccccagcggcacgcgcaccaaccgcgccacggcggccgggttctggaaggccaccggcagggacaagcccgtgacatcgtcgagcagccgaggggtcatcggcatgaggaagacgcttggtgttctacaggggccgtgcacccaacggtaggaagactgactggatcatccacgagtatcgcctgcagaccagcgagcacgcgcccacccaggaggaaggctgggtggtgtgccgggcgttccagaagccaaccccgaaccagaggccgtcgtacatcttcccggcatacgccgccgctccgggcctcgggggctactacgaggcgcggccatggctgcacggccaaggcggcgacctccattacctgcaaagcgccacatgcgctgccggagccggcggcctcggcttccccggccagggcatccagtactctgacgacctgctggagtccaagcagagtctcttcggcaacatcccgcagctcatcgagagcccgccgacgaccaccgccgttgccggtggcggcgacgcgggctatgatgtcgtgcagcagggccgcgccgccgccgccttcgactgctgcttccgggtcaccccgcctgcctcgtcgcggctgcgcctccacctgcgtactagtctttcctgacataccgcagcagcatcgctttctttgtatactggtcttccttatgccgggttctctcattgagcgccgttagtccttgacgtccacgcccttctgttgcactggacacttgtacctagatagacactctgttccacttaccaagtcc

SEQ ID NO: 9222 - DNA, 1416 bp, Triticum aestivum
  Clone ID: PAT_TA_9222
cgtccgcccacgcgtccgcccacgggtccgctggaggtgcacgcgaggggagcagtaggtggggttggggttacccacgacgtccaccggccgtcgcgatggccggcgccgcctggccgctctccgccgccgcgggcctcctccccgcctccctctcgctgaccctcctcctcggctccctcgtcgtcgtcctcgtgctgggcgtcgccgcggtcttcctcgagcacatccgcaagatcggatgcatgcactcgattgagaggaccgccgtctcggacgccttcttcgaggaccctggctcgctcaagaaggttccctgcccgtcgatttttgaccctgccgagaagtacatttcgttgatcgttcccgcttacaacgaggagtgtcggcttccggaggctcttacagagacactcaactacctgaaacaacgctcatctgccgacaagtcgtttacttatgaggtcttgattgttgatgatggaagtactgaccgtacctcgaaagttgcctttgagtatgtaaagaagcacaatattgacaatgttcgggttcttctactcggaagaaaccatgggaaaggtgaagccgtcagaaaagggatgctccattcccggggtgagctactactcatgcttgatgctgatggcgcaaccaaggtcactgatttggcaaagcttgaagctgaggttcgtgcattggcggggaaagctaagtccagtctagcaccctctgctagttcatcgcagaggctatctgatgctgaaattgctgtttttggttcccgtgctcatctggagaagcaggctcttgccacgaggaaatggtagggtaacttccttatgaaaggtttccacttggtagtactgttgactgctggtcctggaatcagagatacacagtgtggcttcaagatgttcactcgatctgctgcaaggaaactctttacaaacatcagacttaagaggtggtgttttgatgttgagattgtgtacctatgcaagcacctgaggatcccgatggcagaagtatctgtcagctggacggagatacctgggtccaaagtgcgcatgacaagcatcctgcacatggtgtttgagctcctgctgatcagagtagggtatgggctgggcatatggaaaatttactcatagaccctgttctgggtaactcattagagcttaggtctcgatcgctgcggcgtatacaccaaacttagttcgtcactttgaaacacagctaccaaattagttccaaggagaattgtaaaaccttgtgagattttcggctggagagaatccagttcgacgtgtatgttggtgtttgatcatagcaagatcttgacatatgctcacagctcacatgtatttttgctccttctgataaattctctgatatttttgctgtctttaaaaa

SEQ ID NO: 9223 - DNA, 541 bp, Triticum aestivum
  Clone ID: PAT_TA_9223
ccgccagccgcggcatcccttctcccccttcctcctccttcctccttcccgctggcgccgacagcgcgaccacgccctcctccggtccttcctcccccccgcagccaggagtcgagccctcgtcgcgaggaaaccacggaaggaggagctcaaccgggcgtcaccggccggagaaggaggacagtcgcggatgcctgccaaggaggcggatcggctcgcctccgtcgtcaatacagccgccgccccccccccctcctctgccggttctttcggcgagatccaccgtctcctgaggtccttatccaccccagctcgcgaggaagcctcgggaggaggcgagccctcgtcgcgaggaagccgcggaaggaggagctcaaccgggcgtcgccggccagagaaggaggagaggcgcggatgcctgccagggaggcggatcggctcgtctccgcggctggaaagggctcggtggtatgtttggctttttctcatatctcagcgagccctgctgggattatttgtagacttccttgctgaaccctac

SEQ ID NO: 9224 - DNA, 652 bp, Triticum aestivum
  Clone ID: PAT_TA_9224
ggtcgagggagttcttctccggtttcatggattctgtgttcaaggcccccatgctgttcttcgactctaccccgaccgggaggatcatgacccgggcttcgtcggatggcacgaggttggacttcgacatcccgtttacgatgacctttgtgatatccggcacggttgaggtggcggcaaccgtggtggtaatgatcatggttacatggcaagtcgttctggttgccgtgcctgctgtaattggtgttctgtacattcagagatactacattgcctccgccagagagttggtgaggatcaacggtaccacaaaggcgcccgtgatgaactatgccgctgaatcgatgctcggagtggtcaccataagggcctttgcggcgacaaataggttcattcagacaaatcttcagctcatcgacatggatgcgacaatgttcttctacacaaatgcagcgctagagtgggtgcttctgcgtgtcgaggcgatgcaaatcttggtcattgttacatcgtccattcttctcgttatgctaccggcaggatcagttgctccaggatttcttgggctatgcctctcatatgccttgacgctttcttctgcgcaagtgttcttgacacgattctactcaaatctggagaattatatgatatc

SEQ ID NO: 9225 - DNA, 1179 bp, Triticum aestivum
  unsure (1)..(1179): unsure at all n locations
  Clone ID: PAT_TA_9225
gctcgagncggcggagggggagggcgattccgtctgttcatggcgattctaagctcatccaccacaggattttgatttcttctccttttcttcttcgtcccccagctcccctggttggttgtccttgtctctcgcgttttgctcgtgctctcgtggctgtgtagtcccagatctaggtgatttttggtttcgcggatcagtggtaggtgaacttttttatccgcggcgaggtgcatgttgctgccgtggtgttctagtccgccatggttgtgcgcctgagtttttgtaggagcttgcagcgcgccatagtcctccatgccgtggtcttgtgttttttgttgcggacgtaggccaattcccgcccggtttggattccgtaggccatttccctgggcagtgttctgctgttgatttggacgtacgcgtagacgtaagctctctgttgttgatgtgtaggtaggcgtgtaggcattagttttcagcggtggatcccgtggcttgacttctgaagatcgagttctggttgttctgtattgggttgtagttgtagttgtagcccctgattttactcatgtttttgttccatgttgttttatcccgctggttactgaatttctctgtttcgacgttccattctctgtacctacctgaattttatgcttcttttttcagtgttcccccataataagagtgtatgttacactgagatttacctagtattgtattgtaccctattagctgcagtatagcttcattgtaccttgtcatgtatagcttcactgcaacctcatgcttttcagtgtttttgccatagtttcagtgttgattgcatgaggattcctttttcttgttgattgtttggtccagtagcactgatatagctctgaatttacagctggcattggtgtgttagtagcattggtcctgtagcattggactagctctgaattcactctgtatttgtaactctgatctacaatgtagttcaactagttctacttttgtttttttagtctgtattgtgtctctgaatttgactgcaatggccccagttgtgttatactgtatctctgaaattactctgtaatgtgtatctgaatttcacttgtaatccatcaagttgttattacgtaaattatctcgaagtacactgtaatgcgccagaactacagtctaatg

SEQ ID NO: 9226 - DNA, 411 bp, Triticum aestivum
  Clone ID: PAT_TA_9226
ggccgcagttcaacgcctccgcgcccgtctacgtcaacatcggcgacggcggcaacaccgaggggctcgccaacagcttccgctcgccgcagccggactactccgccttcagggaggccagctacggccacgccacgctggacatcaagaacaggacccacgcctactacgagtggcaccgcaaccaggacggcgtcaaggtcgtcgccgacaaggcctggttcacaaacagatactacatgccaacccacaccaactagattttagatacctaccttaattggtcgattattagtagtgtagctgttgagaaattaattagcaacaaacgtgtattcgtcccttaggtttttttattactatatgttacattagttaggagaaattaaagagaggttctcaaaaaaaaaa

SEQ ID NO: 9227 - DNA, 616 bp, Triticum aestivum
  Clone ID: PAT_TA_9227
ggcaagcactggtcgcctatgtcaacatcggatcctactacctggtcggggtgcccatcgggatcatactgggctggccactcggcttcggagttcgggggatctggtctgggttgattggcgggactgctgttcagacgctggtgttagtctacctcaccatgagatgtgattgggacgatgaggctaagactaccagtgcacgaatgagaaaatgggccagcacaaaatgaaagccactcgacaatattgttgtcaactttcagctccctttgacacaggggaaaaggagctcagcagcacaaggatcggaagcaaacgctcagaatatgggacggaggaagtagttagttcagaagaaaatgtgggcgtttatttgcctagcaagcaagcatgcggcctgtttctcaagatatccgctggtcaagaaaattcagtgtgctatcagtgggctcaaaactatgtatttctacgatatctaaaagcatagcacagagagaaaaaggatgaattgatgtgctagaaattcaaattccaccgaccaaagcaaaacatcgagacattgatttgatggatcttgttctattagtataatccttggatgataaaaaaaaaa

SEQ ID NO: 9228 - DNA, 214 bp, Triticum aestivum
  unsure (1)..(214): unsure at all n locations
  Clone ID: PAT_TA_9228
gaattcggccctnggtttcaaagcccaagcttctgtatctagcctataatgttgtcctggccttctacttcacttagtgatggaatgttttgtggcccactcaggattttaccaggacaacaaggtggtgtgtaagctcaggcttcgaatctgaacctgtgtaatctattttctgttgaattgcgcttgaaggggttcctcagtaaaaaaaaaa

SEQ ID NO: 9229 - DNA, 677 bp, Triticum aestivum
  unsure (1)..(677): unsure at all n locations
  Clone ID: PAT_TA_9229
gccggccggttcggggctttcagccccagccgtcgccgtctcccaagttcctccgcaggcccccgctccacgcctctgaccctctccccgtcttcagccgcgtcccggctgtcggcgacccgccgacggtcccgtcgtcgtcgtcgtcgccatgactacctcaagacgtgttgctgataggaaaattgcagtatttgagaagaatatcacgaagaggggttctgttcccgagacagtcaagaaaggaaatgattatcctgttggacctatcgtgcttggattttttgtcttcgttgttgttgggtcatctctgttccagatcatcaggacagcctcaaacgccggtctcttctgagtagattggtgctatgcttatagtgaccatgaacagggctgtcatatgcagttggttgtcggtttaaaactagaactgaatgagatagctggtactcttgtgatgcttgttatacctcttaccattgtacttggtggagtttaagttatatggagatagtcataccattggactgctaatctgtgttgctcggggcctcatgccattggaaatgttccaatttatatccagttataatttgctttgcnnnnnannnnnnnnnnnnnnnnnnnnnnnnnnnnnnnnnnnnnnnnnggaaaaaaaaaaaaaaaaaaggccccta

SEQ ID NO: 9230 - DNA, 1142 bp, Triticum aestivum
  Clone ID: PAT_TA_9230
cgtccgcccacgcgtccgctttcagacccagccgtcgccgtctcccaattcctccgcagggcccccctccactcctctgaccctctccccgtcttcagccgcgtcccggctgtcggcgacccgccgacgttcccgtcgtcgccgtcgccatgactacctcaagacgtgttgctgataggaaaattgcagtatttgagaagaatatcacgaagaggggttctgttcccgagacagtcaagaaagcaaatgattatcctgttggacctatcgtgcttggattttttgtctttgttgttgttgggtcatctctgttccagatcatcaggacagcctcaaacgccggtctcttctgagtagattggtgctatgcttatagtgaccatgaacagggctgtcatatgcagttggttgtcggtttaaaattagaactgaatgacacagctgggactcttgtgatgcttgttataccccttaatatggtacatgggggcgcaaaatctgtaggttgtcggtttaaaattagaactgaatgagatagctggtactcttgtgatgcttgttatacctcttaccattgtacttggtggagtttaagttatatggaggtcataccattggactgctaatctgtgttgctcggggcctcaggccattgaaacgttccattttatatctggttctctgcatttatgttgttatgtttgagttgttgatcgtacactccagttgttcggtatgtcagcttaccaaccaaaatatctctgaacaattttcttcaaataactggaccaactaaaacacaatcctgataagtttttactcgtaggaaaatagtccctccatcgcataatagttgtcactcaaacggatgtatttagtattgaactatgtctagatacattcatttcagcgacaactaatatgggacggagggagtaacatgcaagtcttttagtaaatgcacagagctcttatgttttatggaaatttgattgtgctaaactgctactccctccgttccaaaatacttgacttccatttggccaaaaatggatgtacctatatactaaaacatgtctagatacatctatattttgacaaatggaagggctgtattatggaacggcgggagtctgttagta

SEQ ID NO: 9231 - DNA, 993 bp, Triticum aestivum
  Clone ID: PAT_TA_9231
gccccgggggaaaacagcacaacacacaccagaccagaggaagagggaaagagagaggccaggagaaggatgaggcaggcgagcaggttcaagaggatgtgcgtcttctgcggcagcagccagggcaacaagagcagctaccacgccgccgccatcgacctcgccaaccagctcgtgggcgggggcatcgacctggtgtacggtggcggcagcatcgggctgatggggctcgtctctcaggccgtctaccacggcggcaggcacgtcatcggggtcattcccaagactctgatgacccccgagatcgtcggggagatggtgggcgaggtgaggccggtgggcgacatgcaccagcgcaaggcccagatggccagcctctccgacgccttcatagccctgcccggtgggtacgggacgctggaggagctgctggaggtgatcacctgggcgcagctagggatccatcacaagccggtcggcctgctgaacgtggaggggtactacgactcgctgctcaccttcatcgaccaggccgtagaggagggcttcatcaaccccgcagcccgccgcatcatcgtctccgcccccaccgcccaccagctcatggacaaactggaggagtacgttccttactacgaaatggtcgcggccgggctggactgggaggcggatcgcctagacttctgaccgtcgagcagacattcgccatttctgtcggcgtgtggcatgcggatcgaacgaacggtgtgctaaagattagcctaagataatagctagttcagttgtactcgatcggtctcgatggcctatattcgggcgtcttcatgttagggcgcgctcaatatgaacttccggtagcaggtagctagtgcccaacctttatctgtctcattaagtcagtcatcagtattagttctgaagatccagcagccgagattcactgaagcagggtgcacttcttggcaatgaataatactccaaagattattcggt

SEQ ID NO: 9232 - DNA, 315 bp, Triticum aestivum
  Clone ID: PAT_TA_9232
ggccagatgtgagaagcacatatatgcttacagtgagttatacatcatttccgtaagaaaatgtaaggcattcttattagagcatgaatccgctatgtcactaagtgtgtgtaatttgtcttgttcaagttgatgacctgcgctagtaatgttgtgttgtgtgtggtccggggtggtagctccaaggccactagtagcaggacgcagctgagataattacatttgtatgtatggcaaaatttgaataggcctttcggccggagtgaaggtgtgtgactatatatgaatgaatgataccgctacgtaaaaaaaaaa

SEQ ID NO: 9233 - DNA, 760 bp, Triticum aestivum
  unsure (1)..(760): unsure at all n locations
  Clone ID: PAT_TA_9233
atggcgaagaaacctcatgctccccggtaacaaaccgctccgtaaaggagtcaactcgctactgcgcgatctgtgatgtacgccaagcgatacgctttcaaacatcgcaagaatgtcaccaaagtagaaaagaagatggacgtcacccataagcttaaaactattggtggagacaaaaatggttcaacccgatttgtaccaaccaaaaaaatgccaagatactacccaactgaggatgttcctcgtaagttaagatcacacgggaagaaaccattctccgaacacaagaggaagttgcgatcatccattactcctggaaccgtcctcatcctccttgctggtcctcatcgagggaagagagtcgtcttccttaaacaactcgacactggtttgctcttggttacaggtcctcataaattgaatggtgttcctttgagaagaattaaccaagtttatgtgattgccaccaaaacgaaggttgatgtttctggagtaacgatccccaagcgagtgaacgacgcttactttaaaaggaaggagctttcaaaacctaaacatggagagggagagatctttgagactgacgaacagaaatacacggtctctgatgagagaaaagaagaccagactgcagttgataaacaagtccgtgcagttctcggtaaagatgaanacagaagggntacttgaccggcaaattnagccttcnaacggccaatacccccncaacaggtcttctnaacgtnggaaggcgaaanaa

SEQ ID NO: 9234 - DNA, 1316 bp, Triticum aestivum
  Clone ID: PAT_TA_9234
gcttcagttgcatcgtcaatatcgtatcttgataatggtgttgtctatgttggttctcgatttggtgcgtcacagctggtaaagctgaatctccaacctgatgcaactggttcattcgtcgaaatccttgaacggtatgtgaatcttggacccattgtggacttctgcgtggttgaccttgataggcaagggcaaggtcaggtggtcacttgttcaggagcattcaaagatggttccattcgagtggttcgtaatggtatagggattaatgagcaggcttcagtagagctgcaaggcatcaagggattatggtcactgaagtcttccttcagtgatctgtatgacatgtatctggtggtgagctttataagtgagactcggttcttggctatgaacatggaagatgaattagaagaaattgagatagaagggtttgatgcacaaatccagactttgttctgccaaaatgccatcaatgatatgcttatacaggttactgctaattctgtccggttagtcagttgcacttctcgggagctagtggatcagtggaatgcaccggaaggattttcagtcaatgttgcatcagctaatgccagtcaggtcctgttggcgaccggtggtggccatcttgtttacctagagattagggatgctaagctggttgaagtgaaacatgcgcagctagagcatgagatatcttgtgttgatttgaacccagtaggggagaatccacagtatagctctctggctgctattgggatgtggactgatataagtgttagcatattttcacttcctgaccttgaattaatcaggaaggaaaatttaggtggagaaattgttcctcggtcagttctgatgtgcaccttggaagggatttcatatttgctttgtgcacttggagatggtcaccttttcagttttcttctgaatgcaagcacaggtgaactaaccgatagaaagaaggtttctcttggtacccagccaattagccttcgtacattctcatcaaagggcacaacccatgtgtttgcttcgtctgatagaccaactgttatctacagtagcaataaaaagctgctgtacagcaatgtcaatctgaaagaagttaatcatatgtgtcctttcaatacggctgcttttcctgacagccttgcaattgctaaagaaggtgaactttcaattggaactattgatgatatccagaagcttcatatccgcacgattccgttgaatgaacaagcacggcgcatttgccatcaggaacagtccaggacactggcgttctgcagtttcaagtacacccagaatag

SEQ ID NO: 9235 - DNA, 503 bp, Triticum aestivum
  Clone ID: PAT_TA_9235
gcacctgctcacgtatccacctcctcacgacatccacctccaagtaatcatggccattctccccatctcttttcattgccgctgatgaacccattaaaatcgttcagctgagcctccttttcgtctccttgccatgtcttgttaatcctaggcgatccagaagatctaggaggagcagaaagaaaatgaatctgacactgccaatggcgtagatgaattagcagacaggagtgatggtccactgtaatatatagaagcatcaggaggggttgtaatcaccgatgaagactggttctcattcaaataaagatggtgtccagattaataaatattatcttttctagttatcttgttttccagaaagatttgagcaagtacattgatcatataaggagttcttttgactcaattttctaaatgatattttaattctagaattgtatgtcaaatatttgtactttgattaataaaacaggcgatgtccattcaattcaaaaaaaaaa

SEQ ID NO: 9236 - DNA, 357 bp, Triticum aestivum
  Clone ID: PAT_TA_9236
attcggcacgaggtcgggatgctcaggatggactcgtcgttcgcggagctgatggcggcggcggggatggggcgggagctgcggcacgtggcggagacgacgtcggagctggagtgcttccacgtgttctccggcagcgccggggtaagccggcacgcggtgagcctctgcgcgctcgtcagcgaggcacgggagctcatggacatggacttccgcagccagtagccgaactccacgtgtgtttgccgttgcgtatgtatcaacgtgagctgaagaccaagattgtcgtgtgcatatgattctttcgtttgccaaagttcacaccgattgatgattaaaaaaaaaagaaaaaaaaaa

SEQ ID NO: 9237 - DNA, 659 bp, Triticum aestivum
  Clone ID: PAT_TA_9237
gcccgcggcccccccggcaggtctcgtttcgggcgccccctcgctcgcggtgtgcctcggccggggccgccggccacctgcccacatgtccctcgtgtggttgcgattcgggccccccctcaaacactgggtctctccgtgctgccttccggccgtctttgtccaccttccttcatcggctcctgtcaggcccggccttctctccgtcggcctcgccgcgctccgttcctcccgccttcggcttccttcctcctcctgctcatggctgtctcattgtgttcgccgtcggcttcgtctctctcggcgccgcctgcctcctgtttgggtgttccccgtgctgattcctgccgcacggtggtggcggttggctttgtgtgcttggccggtgggtggagccttgttgccatggccccgcggggtgcccccccccccgccgccgccgccagcccctgcccgcggggctttcgccgcgacgcttcctgccctgcccctcgcgggctcccccgcttcgcacccagcgcctccggtcgcctgcccccgccggttggtcggactggcccgggtgcccttcccccggcagctggttgggcggagcggggtgccggttggccggtcgccactccagcggcctgggggggctgttgggccttaatgtcaaa

SEQ ID NO: 9238 - DNA, 995 bp, Triticum aestivum
  unsure (1)..(995): unsure at all n locations
  Clone ID: PAT_TA_9238
gaggacctccgtgtgtacactcagctgtctactgccaacattactcagcggatagctgtcccgtattctggttcttttgaggtgatcaagtacagactgaagcaaatatacgagagcgtggaatcatcagctgaagaagatgttccaacactgactgttcacgagagggtggccatccgcctggattcagagaggtacgtgacgctgcagtggtcgtctgatcccataagcgacatggtgtctgactcggtggtggccatgatcttgaacattggccgtgagggtccgaaggttgttccgatcgaagaagcggtgaagacggaagaagaaacagagaaggtggcgcgtaaggtggtgtattctctgatggtatcgctcttcggcgacgttaaagttgcagaggaagggaagcttgttataactgtggatggagacgtcgcgcacttggatggcaggagcggtgatgtcgagtgcgagaacgctgggctgaaagaacggatcaagaccgcgttccggcgcatacagggtgcggtgagaccgatcccgctttcggcctcctgagctgaacgtatgagactgcctttaacttttcctagggctcatgattaaacaaagcactagcaggctgtgttactgttgttacgcggccgttctaatcttgagcgaaatgtaattctactgcctgttgtgctttactggatgatcagtagtccctagacgttatctgatgaatcctctcacttgcactaaatttgagctgctgtgctttgctagatgatcaggtaggcccgttttactgcctctggaacatgatcgagttgtagcattgtggacaatttggcgagtgatactgtaacatcacatcacagggtgacggtgttcggccgagctggtcgatcgacacggcggccagcatgaaggcgtcctgcttcctggtggtgcttctgctcgccgtggccacggngagcaggctctcgctcgccgcccgcgagggc

SEQ ID NO: 9239 - DNA, 2299 bp, Triticum aestivum
  unsure (1)..(2299): unsure at all n locations
  Clone ID: PAT_TA_9239
accagatggtgatcaccccactcggcgccggcagcgaggtaggccgctcctgcgtccacatgactttcaagggccgcacagtcctattcgactgcggcatccacccggcatactccggcatggcggctctcccatatttcgacgagatcgacccctccgccatcgacgtcctgctcgtcacccacttccacctggaccacgccgcctcgctgccatacttcctggagaagacgacgttcaagggccgcgtgttcatgacccacgccaccaaggccatctacaggctgctgctctccgattatgtaaaggtcagcaaggtgtctgtggaagacatgctgttcgacgaacaggacatcatccgctccatggacaaaatcgaggtcatagacttccaccagacattggaagttaacggcatacgcttctggtgctatactgctgggcatgtacttggcgctgccatgttcatggtggatattgctggtgttcgcattctttacactggcgactactcccgtgaagaagaccgtcacctcaaagctgctgagataccccagttctcccctgatatttgcattatcgagtcaacttacggtgtgcagcaacaccaaccccgccatgtcagagagaagcgcttcactgatgccatccacaacacagtttctcaagggggccgtgttcttatcccagcatttgctcttggtagagcacaggaactgttgcttatcctggatgagtattggtctaaccacccagagctccataagattccaatctattatgcctcccctcttgcgaagaacgtccgggctgtctaccagacatacataaactccatgaatgaaaggataaggaatcagtttgcacagtccaatccgttccatttcaagcatattgaccctttgaatagcattgacaacttccatgatgtgggtccgtcagtggtgatggcaagtccaggtagcctccaaagtggcctctccaggcagctctttgacaagtggtgcacagataagaagaacacatgtgttattccaggttatgctgtggaaggctcgcttgcaaagaccatcatcaacgaaccgagagaagtgacactagcaaatgggctcactgctcctcttaatatgcagatcttctacatctccttctcagctcacgctgattttccacagacgagcggcttcttggaagagcttcgcccacccaacattattcttgtccacggagaagcaaatgagatgggtaggcttaagcagaaacttatcacccagtttgatgggacaaacacaaaaattgtgtctcccaagaactgccaatcggtcgagatgtatttcagctctgagaaaatggccaagacaattggcagactggcagagaaggtaccggaagtgggcgaaacagtcagcggcttgcttgtgaagaagggcttcacatatcagattatggctcctgaggacctccgggtgtacacgcagctatctactgccaacattactcagcggctcgctgtcccgtattctggttcttttgaagtcatcaagtacagactgaggcaaatatacgagagcgtggaatcatcaaccgacgaatccgatgttccaacactgattgttcatgagagggtgaccatccgcctggattcagagagctacgtgacgctacagtggtcctctgatcccataagcgacatggtgtctgattccgtggtggccatgatcttgaacatagggcgtgagggaccaaaggccgttccaatggaagaggaaacggagatggtggcgcagaaggtggtatacgctctcatggtgtcggtcttcggcgacgttcaagtggtgcaggaagggatgcttgttataactgtggatggagatgttgcttacttggatgggaggagtggtgatgttgagtgcgcgaatgcagcgctgaaagagaggatccagactgcgttccgtcgcattcagggtgctgtgagaccaatcccgctgtcggcctcctgaggtgaagccatgatgtaggatgcttttaacatggtgactgtttcctaggtgattaaacagggcagcaggtcgtgttagatacatgagttgtatagcattgtaggcaatttctagtggttatctgaacagtcctctcacttgcagtaactttgagctgagctgagttgcagtgcagctgagctgagcttctccttttgtctttncgtgtgtccgctcatctcatcagttcctggtattggtgttatccctctgtaaaggaatttacaaccttagtgatctaaatgcttcttaatttcttt

SEQ ID NO: 9240 - DNA, 526 bp, Triticum aestivum
  Clone ID: PAT_TA_9240
cgtccgcccacgcgtccggtgccgtccggcaagtggtactgtaaaacatcacatcgtcgcaccgtgacggtgttcggccgagccggtcgatcgacacggcagccagcatgaaggcgtcctgcttactggtcgtgcttctgctcgccgtcgccacggggagcaggctctcgctcgccgcccgcgagggcagcaccctgggcggcgagctcggcgagctcatcgccaaggccggcagcttcctcacgtcggcgcgccgcgcgggagcagacggctggcactccgccacggccgcggaggtggacgcctcggcgaagaaggggcacggccatccggcggggccgaggaagcgtctgaagaagtcgtcggtgaactgcatcccggccgacatgtgccggaagaagaaggtgctgtgcggcaagcggtgctacaagacgtcgcacgctgccggcgccggcctcgaccacgtcccctccaaccggtgcgtcgtcaggtgcaagaagtgcgtgcccacctgctagatcgatcg

SEQ ID NO: 9241 - DNA, 2036 bp, Triticum aestivum
  unsure (1)..(2036): unsure at all n locations
  Clone ID: PAT_TA_9241
ccccgggggcgagggggactgtggcatccgggcagatggtgccgccggtgggccgacctggccgctcggcgcggcggcgtgccgcccagctggccaatccccggccgagcgcccgcgccgccgccccccgccccggaggccccacctcccggcacggccgcgccgccctcttcgacgccggccccccgcccgcctaccccggcgtggcggcgccgccacgccctcacgccatccgccccccggcgatcgacgtcccccccggcccccgcctccacccgctgccacgccgcctggctgcccgacttcgtcgaaagcgcgacgtcgcaggcctgcctctgcagggcactccccaccagtcgccacgagccggaggccgcctgcggtcccccccttctggtcagccatgtcgacggtggaggcacctgccggtgtgcagcgccacgccacccgccgtgtcagagggaagcgcttctctgttcccatccaccagactctttctctagggggccttcctctcctcctgtaaattgctgcaagtggtctgtggaagacattctcttcgtcggaccgggccgcgtccgcccttcgtgccctatgtgagcattcaagctacaatggcttccccctccaggcggcttcggtcccccgctgccccaccgacatttgctccatcgaggccacgttccgcgtccagcttccacggtccaatcccttccatttgaaaaaaaaaaaaaaaaaaaaaaaaaaaatgcaggagggtccccacgcggcccccctcgcggccgcggtgaagacggaagaagaaacagagaaggtggcgcggaaggtggtgtactctctgatggtatcgctcttcggcgacgttaaagttgcagaggaagggaagcttgtcataactgtggatggagacgtcgcgcacttggatggcaggagcggtgatgtcgagtgcgagaacgctgggctgaaagagcggatcaagaccgcgttccggcgcatacagggtgcggtgagaccgatcccgctttcggcctcctgagctgaagccatgagactgcctttaacttttcctagggctcgtgattgaacaaagcactagcaggctgtgttactgttgttgcgcggccgttctaatcttgagcgaaatgtaattctaccgcctgttgtgcgttaccgcggccgcgccggccccccgctgtgctctgctcttgccgcccaccccctcgctgtctgagctgctgtactttgctagatgatgaggtaggcctgtcttactgcctctggaacatgatctgagttcgcgccgccgcccgcaagtggcgagtgatactgtaacatcacatcacagggtgacggtgttcggccgagctggtcgatcgacacggcggccagcatgaaggcgtcctgcttcctggtggtgcttctgctcgccgtggccacggggagcaggctctcgctcgccgcccgcgagggcagcaccctgggcgagctcatcgccaaggccggcagcttcctcacgtcggcgggccgcgcgggggcggacggctggcggtccgccgccgccgcggaggtggacgcctcggcgaagaaggggcacggccatccggcgggggcgaagaagcggctgaagaagtcttccgtgaactgcatccccgccgacatgtgccggaggaagaaggtgctgtgcggcaagcggtgctacaagacgtcgcacgccgccgccgccgccggcctcagccacgtcccccccacccggtgcgtcgtcaggtgcaagaagtgcgtgcccacctgctagaccgttcgttggctgttccttcccttccctcttctgggttccgtgtcgtgtcgtgtcgtcgtggtcgatccatgcatgttagctacagtacatttgctttcccttccatagggttcatgcaccggttgaataagcaggcaagcttcccgccatcatggtcgcatgcagtgtaggtagtggatgggttctacgtactctaaaagaaatgtaccacggttgtgtgccaagtttgaacgtgatctnn

SEQ ID NO: 9242 - DNA, 303 bp, Triticum aestivum
  Clone ID: PAT_TA_9242
ggtggaagaggtggtggtcgcggtggatttggtggccgtggtggattccgtggaagaggtgcaccaaggggtcgtggacctcccaggggtggagggcgtggtttcagaggacgaggcagattctaggatgtagttttaagtttgctgttttttgaaacatgatgctctacattatctcttcagctggaaacattatgctaagtcagctgccagcgcactttgtgtggaagttgaattctctgtggaacaaagtctttgtatctcttccgaagtcatgcattgattgttaaacgcttttccgtt

SEQ ID NO: 9243 - DNA, 771 bp, Triticum aestivum
  Clone ID: PAT_TA_9243
cggacgcgtgggctcgtcgccgaaacccttactcgcccccgcccccgcctcccgccgccaaacacccatcgccatgcgatcaccgataggcggcggaggtttccgcggacgcggcggcgaccgatgtggccgcttcggtggaggcggccgcggcggcggcggcaggggccgcttcggtggaggcggaggcgggttccgcgacgagggccctccatccgaggtcgtcgaggtgtcgacgttcctgcacgcctgcgagggggacgcggtaacgaagctgacgaacgagaaagtgccctacttcaacgcgcccatatacctccagaacaagacccatatcggcaaagtcgacgagatcttcggccccatcaacgaatcatatttctcggtcaagatgttcgagggagtcattgcaacatcttacaacgaaggtgacaagttcttcattgaccccatgaagctgctgcccctctcacgcttcctgccgcagccaaagggctcgactccaagaggtggtggtcgcggtggaagaggtggtggtcgcggtggaagaggtggccgtggtggattccgtggaagaggtgcaccaaggggtcgtggacctcccaggggtggagggcgtggtttcagaggacgaggcagattctaggatgtagttttaagtttgctgattgttgaaacatgatgctctacattatcctgttcagctgggaaacattatggcctaagtcacgctgccaagcgcacctttgtgtggggaaggttggatatcaa

SEQ ID NO: 9244 - DNA, 905 bp, Triticum aestivum
  Clone ID: PAT_TA_9244
cccggccggcgcgcgcccccgcgcgcgccggcaaccgccggtcgccccgcggtcgacgcggccgctcggctggaggcgggcacgggggggggagcaggggagccttcgggggggcggcggccgcgttccgggccgcttccgtggcggccgcggccggtgccgcgacgagggccctccaggccagctcggcgaagtgtcgaccttcgtgcacgactgcgaaggggacccagttcaacagctgacgaacgagcaagagcactacttcaatgggccaagttaacgagaatcttcggccccatcaacgaatcatatttctcggtcaagatgttcgagggagtcattgcaacatcttacaatgaaggtgacaagttcttcattgaccccatgaagctgctgcccctctcacgcttcctgccacagccaaagggctcgactccaagaggtggtggtcgcagtggaagaggtggtggtcgtggtggatttggtggccgtggtggattccgtggaagaggtgcaccaaggggtcgtggacctcccaggggtggagggcgtggtttcagaggacgaggcagattctaggatgtagttttaagtttgctctttgttgaaacatgatgctctacattatctgttcagctggaaacattatgctaagtcagctgtgagcgcactttgtgtgggagttgattcattatttgtatgaataaaatgttgtcaagttattgtgttaatgaaactttatgctaagtaacctgtgaacgcactttgtgtggaagttgaattctttgtgaaacaaagtcttgtatctctttcttagtcatgcattcattgtggaacaaagtctttgtatctcttcctaagtcatgcattgattgttaaaaaaaaaaaaaaaaaaatcgagactg

SEQ ID NO: 9245 - DNA, 583 bp, Triticum aestivum
  Clone ID: PAT_TA_9245
cgtccggccacgcgttcgaccacgcctccgacggcgtcgccgaaaccctctccgccgaacacccccgctgctccagcccttctcccggcgaagcacgggaacctcgaaggcagtatacgacatggcttcgcatgcgtacccttccaagagaccattccagaagaagtattcagaacacaatggtcgggccaagtggcaaaagacaaaacatgctccttcacagcagcctcagctgacaatacagcctggagttcctcttatccgcattctttgccctactgagaaatgtgggaatgttattggtaaaggtggtagcatcattgcaaagataaggcaagaaaacggagtgaaaatccgggttgatgaagcagtccctggttgcgacgagagagttattgtcataactaccgctgagaaggacaaagaagctagccacgagcaaggtaaagagaatgatggtggtactgctgtttctgctgatggcgagcatgagaaggagaaagaccacagtaaggaagaaaaagatgattcagataatgcccacggcaaggaagaacaagatgatgcagagagagatgacagc

SEQ ID NO: 9246 - DNA, 718 bp, Triticum aestivum
  Clone ID: PAT_TA_9246
tcaccgctacgccctgaagcacttgtgtgtgatgaaaatgagggacagttaattgacgacagaaactatgtctggacctacacatctccagaatttccagtgctgcaggaagatgttctgcaatctttcaagttaccacgccaggttctttgtattggtggggtggtgaaggttgagcttcttgggagagctcagaagcaggcaattgatggtctctactacgtgtgtgtgtctcatgtccaaatactggggaagccactgtcacgagagctcggggttgttcctcgtggaaacggcctagtcctgaattactatctggatccccgtacatgcggcgttccccgcagcgagtcatcaggggatgatgccgcagcaggtggcatagcttggcgtcgaggatctggcattctagaactgcgcgagggattggagggctgaaccaaacgctgttgagcagcctgctcggtgctccattgctacttgtggtcgtagccgacgaatcagaggaggtggatcttccttagaagaagagcaataattatatatttttggatttgatcctcgagaaaagaaacatatgatagttactgctacatacatataaacaccttgattttcatcccacatatcgagacaagacaggttggccttcctgccgctgtgtgaaaagtactttgcttgtaacagaagacaacacaattttccgaaaaggaggaat

SEQ ID NO: 9247 - DNA, 760 bp, Triticum aestivum
  Clone ID: PAT_TA_9247
gtgcggcgctcgaggcgtccgcccacgcgtccgcccacgcgcccgctctcgacaatctgtccgactccggccatctctgcggcaaccaccgtacacgcgcgtccaccgttcgtagcgacgagaagatgagttctgctggcggcgggaggggcaagggcaaggcggtgtccaagaccgtctcgcggtcttccaaggccggcctccagttccccgtcggccgcatcgccaggtacctcaagatcggcaagtacgcccagcgcgtcggcgccggcgcccccgtctacctctccgccgtcctcgagtacctcgccgctgaggtcctggagctcgccggcaacgctgcgcgcgacaacaagaagacccggatcgtgccgcgccacatccagctggcggtccgcaacgatgaggagctgagccggcttctgggcgcggtcaccatcgccgccggtggtgtgctgcccaacatccacaccacgctgctccccaagaaggtcggcaagggcaagggcgacatcggctccgcgtcccaggagttctagagtctcgcagatcaaaccagcatcatcacagaagatttgaggactctgttctttttctagtatggcgatgctttaggttgttagattagttctcggtcaatgatctggttggtgtatcaatgatgaatctggttggaatgaaatactagcaatctggttcttgttattactcattgtgatatgtcaacgtgaaaacatcttattgatctctatgatgcggg

SEQ ID NO: 9248 - DNA, 946 bp, Triticum aestivum
  unsure (1)..(946): unsure at all n locations
  Clone ID: PAT_TA_9248
ggatttgaacactgtcccaccttcgaaggaaaaatnagaaattctcaaagaaatatacctggaaatgatgttgatggtgatgttgcaaagatagtgagtggctcacctgattacttgttggacgtagctgccagttcttatttgaaggtgcagtatgctttgtaccttcatgaatatcttacaaggcaactgcaacttgagtcaccagatttgaactcggcaactgatcttttccttgatccgcaagagggtaaatggaaactagcagatcaaatggacaatgtgcaaggtgacatttctatatctggaaaatatagcttcgttaatgaagggatcaagcatgcagattcttcccaagctccacctaggacaggcaatgttattttgccaccatactcagctctgcgaaattttgcagactctgaaaccaaaaggaaggtaattgagaagttgcctggtaatgctttgagacagacactcacatactttattagtgatgagttaacaaatactctcaaaactgaagttggtcgcagactggggataacaaaagctgagaaacttcaaagaagtcttgcacatgatgtagaacgactcgctactcaagtttctagaactattgtccatgactctgagttatacagagcaacatctgtgcagaggaatccaacgactgtgaaatttggtgtggtccatggcgaaaatgttgttgaagctatatcaactgcagttctgcaatctcatgatctgaggaaggttcttccagtgggtgtgatagttggcgtaactttagcgtccttgagaaactacttccatgttggtgtctctaagcatgacaaccttacaaaagctgcggtcaagtcaggaattttggatgaggatcttattgttcaggatgctgacgaaggaaataggataatctttccacacagaaagaggcaaatgc

SEQ ID NO: 9249 - DNA, 631 bp, Triticum aestivum
  Clone ID: PAT_TA_9249
agatttgccggcgcttcgtcgaaccaaaacagcaaaaaccacagattagtcccctccctccacttttacccagcctaaatttccctccgaaactcaaatcttctggcctgctccctccctccgacctccgatacaaatacccatcgattcttccctcccttccccagccccacccgattaacctcccggcctggtaccaccaacctccaatccgaagagcctctgctcgtatgagctccaagatggcagctgacagcggcgaccaggagaacctgccgcccagtacaacgcctccgactgcgacggctgctgtcgtccgccctcgtcattttggggtcaagaaaggccagatgaagcggctcggcagggcgcggaggcgggcgccgctcaaggacatcaccaaccacttcgccgtggagactgcatctgccgaggtgcaagctctgcagcagccggaggaggggtcggaggggggcacagcgaaggaggagctggcggcgcagacgaacgcgcttgccagtgctgcggctgttaaggcgaggaggaactcgctccggaaggagtttagatagagttcagttcattgtacagtgggattgggtaatggacggaattcattatttgtactatt

SEQ ID NO: 9250 - DNA, 983 bp, Triticum aestivum
  unsure (1)..(983): unsure at all n locations
  Clone ID: PAT_TA_9250
gccccggcggcgccgggcaggccaccgggcgggccgaggaggagaccgcccactgatcccgcggctgtgcagggttttagtcagggctagggtttcttcttccccgtcggcgcggattgcttccttttggggtcaatttccatggttcctccggcaagaggaaaagattactgaaagtgttcatcagacaaggtggtgctggtggcgtcagtcaaaaattcagtgcgaattaagctatgctctctgctctctctctctctctctctagtcagttcagttgtttaggtcaggtcaggtcaattgggtctctaaatttctgccggtagcaacagcaattacttgctcctttttccatgtaaaaatcaatcaccagggggcctcggcctgtgcggtcctattaaagcctaccccgccgctccctctccggtgagtgcagtggggctgctctcgtctggtctgggcttttccgtctcggtttgcctgcggctgccgactccaagtgtggctcctgttctcgtgtaggcttccaccatctgcggtcgggcccctgtgcggccccatgccggtcgagccgctcgctcggtcgtcgttcccttttctctcttggtttgctttgtgctgctgattccaaagattgctcgtggtgtcttggcttccccggatcgcatttggcccctggtctgcatcatagttggtggctgtgcgtgcctcgcgttcgccaggtcccgctcctctccgcggctgcttgaggcgcctgccaacgtgtgtctccccgcgatgcctttggtctctgggtcgaatttaaccctcgggagaatattgcccagccacgtgtaactcaaaaaaaggaatctaaactaacaaccgcacgctcgatctnaacatnatccatctgaatcggggcgtcggagctcccaaaaatcacaagnaanaggggttcancaggacgganaaagcacataagatccnctgtnatcaatnta

SEQ ID NO: 9251 - DNA, 1078 bp, Triticum aestivum
  unsure (1)..(1078): unsure at all n locations
  Clone ID: PAT_TA_9251
ttcggcacgaggcaggaatccaaagtgctttaatatctcaggctcgtgaacctacccagtggcgttcttccctaccatcagaacctcttgcttgcttttacatccccatcttgaacgcgggcaagatttcaacaaagaagacatcaccaccatggcaggggattatctcaaagtttacaaggggttgggttccagaaagaatggtttttttgatgtggaagtatgggacaatcctgcagaacatagcgatcatagccccatcactaacctgcacaattgcaactatactactggtggagtcacagtcgcactaatggcctggcgagggagtgaaaacacttccatatccgatgaacaatatacatttcttactaggctcagagaccacccntaatgctttggttgtggagaaccacttcaagatcgaagatataggatgtcttgtggtggagccagtgagggggacattcttgaagtggctgacctttccacgtcaaagtaaagctcattaccgatgggagaatgagcccaatattaaggaaaatgatagtcacaggtgtttgtggcctcgtaagccttgtactgcgggcagaatttgtatcttgagcacctccgtgctgacgatttatatatcaaggcagcgtggtaatggtgaacctacactgaaagtcttgctatccggtgtcagaaaaaattcgggtacaccgagagttgaatctagctggcatccaacaatctggacatccttgtatcaagctgttggttgtctttgagtggcaagtgggcgtattgctgaaaaatcgtatctgatgcctattacttattcggtacttctgcttggaagaaccgttccgaactcctggagaggaaacaaaagatcaggcatcatttgttatggactgtaatgagaagtgtttacctttttacccccacaactacccttgttcttaattagaccgggctgagacgaatttcagtgcatgaaccataacttcttggtgcaccaaatatgttgttgcttgggcagtttttgtgtttggagtattgccagtataaattaccgtaagaattagaaaca

SEQ ID NO: 9252 - DNA, 422 bp, Triticum aestivum
  Clone ID: PAT_TA_9252
gcgcagcagtgcctgggtaagacaaaggccgggtgcatgaagagggtcaccgaactcaagcgtgactttcggagcagcaaggagccataggaggcagcgccatagcttgaacgttgtcttccttgcctggtaccggacttgatgcagcaaatcattgtgatcatttccctttctgaagtcaagaagaagcgaatcaccattggtctcgctgaatcgggaatcatgatgatgttgtatgaaggaaacaaatagcgttaaacaacatatggtgtagttttattgttttatataccagaatcaagattcgccaaacagaacaacactagacctgtagaaaaaacggtccatacggaaaaggaacagcagtccctgatggttttgggtgttaatgtcaagctccaaattttatgctaaaaaaaaaa

SEQ ID NO: 9253 - DNA, 944 bp, Triticum aestivum
  unsure (1)..(944): unsure at all n locations
  Clone ID: PAT_TA_9253
gcccaaccccaanacgacccacatcttcggggactgcattctggagccccagacgacggtcgggaagagcgacgaggccgccgtggaacccaaggacggagcttccgccaagtcctacctggtggtcaagcgcgccaccgaggccgccgccggcccgggcgaggacttcctgagctcctgcttcacctgcacgaagaagctggaggggaacgacatttacatctaccgtggggagaaggcattctgcagcgccgagtgccgggaccaggagatcatgatcgaagaggaagccgagaaatgcatggccacgggaggctcccctcgctcctcctgctcgtccctgcacgaggacatcttcatggccggcatgatggtggcgacatgaccccccgcgacgatggcccgaccgagatgccgtcttcttcgcctcgacaagcacgcacgcactcaatttttccccttgctagctacaaccaggggatgggggtgatcagttcacagatcaatcgatccatcaccagtgcgtgcacattgccgttgctgtttttgattcagcagctgaagaggagtcgacgaggaagaaggagcggcgttcttggcgggtcattgtcacttgtgggggttggatcagccgagctgatcagctgagctgctgctgccatttttaccagccctgggaaacttactcgcagggatctgagtttttttccctttaggaacgagatgaaaaaaaagaggtggcctgcctgctggcctttggtcctgtagttttaatctcaaggctgcctgcgtgcatgcaggccagagccacccatccttttcttcttcttcttcttcttcttttttcgtttgctcctgctggcagcagtgaccatgtctgcacatttgctactacaccactgtttgttgagaaanaatgacattgagcngcttngcttngggtc

SEQ ID NO: 9254 - DNA, 920 bp, Triticum aestivum
  unsure (1)..(920): unsure at all n locations
  Clone ID: PAT_TA_9254
gagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcagtgctggtaggtccgacctccatcgatccagagcttcggccttgtgaatagccaccactatagcagcgctcttccccacgcgcggccatggccgctcaccatagattttttgttacggtgacccaaccatgcgtctgtacatgtaaatccccacctctccttcttgatcttctgaatgttcagtcatcttcagaatcaaaaattaacctgtgttaatatgcaaaaaaaaaatcaatctgatactgtacatttcgggtcgacattgttttccggcgaccgaagccgtctctgtttcttggctggcaaaccaggattgacgacgacgtgctaccgtcgggttgtttattcgatgccagccaacgattgccaattgggtgggtggcctcaaatttccctcccctgtcaaggtcaaacgtgatcatcgacaaccgacgcctctgtcggtccacctcttcaatataccactagcaattggtccacctcttcaatataccactagcaatttggataaggattttactgatgcgttggcctctgttaagatcaaaatatgtgtctagggcatatctagatgtgctctagttattgcacatctaaatgagtgaatcaagcagaaggctgcctgtaatggaagtatcataggtagtatcatgcatgccaactaagcaagtttgataaggtggcgcagaattaaatgnnnaaaaaaaaaaaa

SEQ ID NO: 9255 - DNA, 2134 bp, Triticum aestivum
  Clone ID: PAT_TA_9255
gagccccaccccccccatgcccggaaccctaacacccaaatccaccactccccgcctccgccccctcccatggcaaccgccaacgccgacgctgccgaggtcgagcggctctacgagctcggcgaccgactttcctcagccaaggacaagtcccagcacgcggcggactatgaggcgatcatagcgtcggtgaaggggcaaaacgttaaagcgaagcagctggcggcacagctcatcccccgttacttccggagcttcccagccctcggtaccttcgccatggaagcaatgttcgacctcgttgagatggaagagctcgcgatcagaatacaagctattcgtgggtttccgcttcttggcaaagatgcagagttcatctcaaaaattccagatattcttggtcacctccttacaagcgaggaaaatgtggagcgtgatgctgttcataaagcactcatgtcccttatacgacaagatgttaaaaattcgttgcagcctttttaaaagcacgtagagttagcatgatagagacgtgaattggcccgtctgtacctcggatgcagcggttggccattccaagtagagctgctaaacccctttgcagaaatggaaagatttagaactgatttgataaagaaaagtgtattagatgttactgggctggaatttaaatttttcaaggatttcctgcggagtttgagcatatttggggatactgctcctcgagaatcctttcaagaattaattgaaatcattcaagcacaagctgatcttgatgcgcagtttgatgtttctgatatcgatcacatatatgcggtggacctcatgcatctatatggctcttcctatcttcacgagaggtgcatcaagcagcaagtttctcaactattttgctaagcaaatcgttccagttttcgataagattccggaggagaagaaactggatttacttaagacagttgctgctagctcgccatatgctgtagcacaagattcacgccagctgcttccatccgttgttcaattgctcaagaagtatatgcctgggaagaaggtagatgatattaatcacaattatgtcgagtgcttgctatacacttttcaccatttggctcataagacaccaaacactacaaacagtctctgtggttacaagatcgttactggacagccatcagatagacttggagaggatttctcagaacattacaaagattttattgagaggttaactggaacggaagacacggttcgagcagcctcgaagagactaacccagggaatggcagatttcaacaaggcaatatcttcagcaaagacagaagaagagaaaactaaaatcaaagcggatcagcaaaaatcgacgatgacaatgcggtcctataataatatattggcaatgtcacagccattgcatgggaaatctccgttattcattggagataagaaaattactctatcatggatggaacaaccaaagaaaccagcagcttcaacagctggagggaagaggacccaacctgctagtaatgggaatgcccctttaaacaagaaggggcgaggagatggaggaatgcacaatcagcttgtgaacagagcttttgaggggttaccccgtggtggtggtagaggcagtggaagagggcggggcagaggaggccgaggaagaggttggggctaccgctgagatctttcagaaatcgacattccaagggagaaagggatcagttttctccttcattcgagagtagtggcaagagtctgtttatctgggttagcttttctgtaccagcaaggtgcgtgactgttgggtgcacaagggaagcacaaaagctcatacaaaggatcctaaccgtctgcacatgctagctttcttggtttgcggattgttgtttggtggtccgaacggtacattttagtcatagtatatttatctgaggaatttatttttcaaatcacccggctgattatagctctcgcatcagccgagctcagggagccaaacgcaatttccgtccccgtgccccgcgtcgtcgcacgtgcgtggtctcctcctgtctcttgttgcgccctgacgttctcccgagtaattctgtcgcagagcatttcctgcagcagcagtattttaggcata

SEQ ID NO: 9256 - DNA, 739 bp, Triticum aestivum
  unsure (1)..(739): unsure at all n locations
  Clone ID: PAT_TA_9256
aggtgaggagcgcagcccctacctcaactgctcccagctctgccattaaacgcacacatacgcgattggagaggagatcgatcccctcctccttccctatctgcatcagccgctgttccacgagcttcagccatgtcccacgacgatcccccgccggctcccgccaagaagaaatcgcccgccgaggaggcggccgagaagaggagggagaagcttactcctgggagtttgatgaaggcggttatccggtcaggcaggggagacgcgactcctgcagatggagatcaggtcatacttcattgcactattcgaaccatggagggcattgttgtgaattctacaagaagggaacatggaggaaaaggaatcccactcagatttgtgttggggaaaagcaaaatgatccttgggctttgctgaatgcttttccaacaatgctgaagggtgaaattgctttgttttaaatggagcctaaaatacactatgcagaggatgattgcccggttacacctccagatggcttcccaaaagatgatgagcttcagtttgaggttgggttgggggctttaaaacaagncctgacgangattagggttgtaagaaatantnataaggaagggtggaacactaagacattgaatgcacacgtaatgcagacacanntgaaagaatctcataagatgcanattctacttgtaantattaagacnaggctnaatgaatgnatgacaagaaacat

SEQ ID NO: 9257 - DNA, 573 bp, Triticum aestivum
  unsure (1)..(573): unsure at all n locations
  Clone ID: PAT_TA_9257
ctacgccgggcgggccgacatgctcgcctcgtgctacctcctggagcggctggacgtgtcggggaacaggttcgtggggcctttcccggcggcgctgctgtcgctgccgtccatggagtacctgagcatcgccgggaacaggttcacggggcggctgtcgggcaacgcctcctgcggcgagaacctccggttcgtggacctgtcgtcgaacctcctgacggggagcctccccggctgcctggccgcctcctctgactccgggaagacggtggtgctcttctcggcgaattgcctttccagcggcagcggcgacgagtcccagtcccagcacccgtcgcccttctgccggaaccaggcattggccgtcgggatcgtgcctgagcagagcagggacgcaagaagaagagtggcgccaaggccggtgtggtggccgtcattgtccttgtgggagcattggncgtgagcgcggcggtggtgtttgtggtgaggaaggcgaggttgcccaaggcgaggcctgcacggagactggtggagcacgcgtcgggccagcaaattcgaagggtaagcgctcgn

SEQ ID NO: 9258 - DNA, 1546 bp, Triticum aestivum
  unsure (1)..(1546): unsure at all n locations
  Clone ID: PAT_TA_9258
ccggcgtgttccttccgcccccagcgacgacgcctcgccagccccccctaatccgacgcagttgccgactgttacggttctccagatggcctgccggggagaagacgggggcaacgaggtgttcgtcgtcgacctcctcgccgtgcggctcgccgacctgtgggcgccgctgagggagctgtttgagcggcccgaggtgctgaagctggggttccggttcaagcaggacctcgtgtacctctccgccaccttcacggctgccctcggaggcgactctggattcaacagggtggagcctttcttggatgtcaccaacgtttatcactacctcaaggggcatgacatgcaaaagagacttccaaaggagaccaagagtttggcttcaatatgcgaggaactgctgaatgtctctttatccaaggaactccagtgtagcgattggtcatgccgacccttgagcgaagggcaaatacaatatgctgcatcagatgcctactacttgctatatatatttgatttgttccatcagaaggtcagcattgaagaaaaatgttcaccaacagctgaagcttcagatgaacattgctcacaaagggcaagtgaatgttcatcgtcaggaaatgacatttgctttgatgggtattcgacatccatcatcacgaagtacagcgacaggattttgttgacagagtcagatacaaaagcccgttcctcaagacgaaaagaaaagcaaaagctgtcgagtgatgccaagtgcaaagagaagtttgattacaatactgaatggatgggtccccctccatgggatccttccgttggtggagatggatacccaaagtttctgtgtgatgtgatgattgagggtctagctaagcacttgagatgtgttggattggatgccgccactccatcttgtaaaaaacctcaaccaagggaattattagatcaaatctacagggaaggaagaatattactaacacgagatgccaagctcataaagtatcagtatttggcgactaatcaagtatacagagtgaaaagcctgctcaaacatgatcaactggctgaggtgtgtgcttattttgatattttccgtcttcaggttgatctgtctgcatgaacttttgaaaattagtgtaaattggcctttatggatgaaaacatttatttccttagtatttgcccactcctttttagattttgtgcacaaagaacattttaaaacctcaaccactaatattcaaaaactagcccaagtgtttgaagttggtatttgcgtatgatactactagatttgtcataaaaatgcttttgtcgcaccgtatttttgagaacatttactagcatgttaatacagacgccctaggagaagcgaatgcgaatacagaaagtaatgggcaaagcgacaaaccagcatactcgccacctatgccctcggacaaatcccagtcgccgtgtttctgtagtgtgctgaaanaagtggaaangttatgccataacacnnacatgctnagtataancaagttacgttaangaaccgnattnn

SEQ ID NO: 9259 - DNA, 645 bp, Triticum aestivum
  Clone ID: PAT_TA_9259
ccgccgcctcccctcccctctccagcgccggcccctctcgcggccagcgtgctccccgccccgatccacaccgaggcgcgcgtgccgcctccacgggaaggaattcggccgtctctctcgcaagcggcgccctcgacggcggcgacccggcgcgggactccttttgccggccgtgctcgtccaaggggcggggccgaggaatgcgccgccgtgcctgtacctgagccggcgtctgcggcaactgaattctccctaaatctgcgatctgcgatctgaacctaaccgccaatcgctgcccacaatggaggctggcggtggcgctgctcgccccgaaccccctggcggcgaaggcgccaggttggggcagtcgcagatgcagcctgacggcccggtcgtgctcaaccgatctgccgagctcgaatcgagcgatgcgatggatatcgatgcgaccccagcgcaagccccgagccagacggtgccgccgcccacgcagtctcccgctgctacactggcggacaccgtcgtccaagtgcagaagcagctgaagcggaagagggcttccaacggccctgtgattgctcctgcagagaaggaggctcttgctgacgggtgccgcctggagctccagggcttgttcgagtacta

SEQ ID NO: 9260 - DNA, 1177 bp, Triticum aestivum
  unsure (1)..(1177): unsure at all n locations
  Clone ID: PAT_TA_9260
gcaccttatatcctgganagaangttcatngntgaaaantgcctcgtctggttgaggacaggacctnctgatcttggcactgcagcggntgcaccccatgtcnaccgtgatgcacaacgtcggcatcttgtgcacatcaagatacatctcggctcaggaacggctgcgcccaccatccagcgtcatgtctctnttggttctggattcagcaaagcagaaggggaaagggctacagaagtaagctcacctttgcagaagaagaagaagtaagctcacctttgcaattctttcaatatatttccttaaacgtcttcgagcttaatgatttctgtcgaataagtgagcggtgtatatatgtggcgggcttacttcttctgcttctgcaaagaagatgccgacgctgagcatcacggtggacatggggtgcagccgctgcagtgccaagatccagagggtcctgtcctccatccaggaccgaggcaagtttgtcatcgagaagatcgtgtccgaggataacagggtgctcgtgtcggggcccttcgacgccgacaagctgacatgcaagctctggtgcaaggccagcaacgtcatcaagaacattgaggtcgtcaagccgccggtggtagccaagccgaaggacgaccctcccaagcccaagaaaaaagaggagaagcccgagaccaagccagccccgtgcaaccagctggtgccgtacgcgtacccgtacccgctgccgtacccatcggcgtggccgtgtggctgcggtacgtcgtgctgcgagggccactccaagccacctcctccggcgccggcgcccacgtgccagtgccactcctacccgccgtaccagcagccgatgcccatgccgtgcacgccgatggtcatctgcgaggagagcccgcccgcctgcgccgtcatgtaactgcgtgtacgtccctgctggacggtgtacaccacctctttgaagcctccatgtatccagtccatgagtgatttgtttgtaattctttcaacatatttccttaaacgtcttcgagcttaatgctgtctgtcgaataagtgagcgttgtatatatgttgcttaagngaatcaggaagtcccaagcagcntagagcaattttcaccttgttcaaaaatcgnttactcntagaatttgaaaatacaatgngttgttct

SEQ ID NO: 9261 - DNA, 1670 bp, Triticum aestivum
  Clone ID: PAT_TA_9261
cgtcccgggacgcgtgcgctccgccagaggccagaggtaggacgctagggtttcgccgaccaccaccgtctaccgcgcgccatggccgaggcctcccggtaccagatcctggtgcggctcctcgacggccgcacccactgcctccggttccccacgcccaccgtctccggcgcggcgctcctcgacgccgtttccgcgctctcccgcgtccccgccgcctccctccgcctcgtcaccggccgcctcgacatctcgccttcctccgtcctcgcatccttccccgacgggcaattcccctccgcgtccgcgctcctacgcctccgcggtggcaagggcgggttcggctccctcctccgtggggccgcctccaaggccggccagaagaagaccagcaactatcgacgcctggccgcgacataaacggccgccggctccgccacgtcaacgccgagcgccgcctcgaggagtgggagggccgaggccgcggatcgccagctcgagaagcttgccgaggacttcctcaagaagaaggccaaagagtcaggccgcggcggcgcccgagctgccgaggtcgacaagtaccttgagaagtaccgcagggatgccgagagctgcgtcaacgccgtggaggagtcggtacgtgcctcccttgggaagaggaaggctgtccccaagccacgtgatgcaaagaagcttaaaatttggatgggcaagaagaaagtagcagatgatgagagtgacagtgacagtgacagtgatgtggatgataatgagggtgcagatgcaaaacccatagctcttgatcatgggaattactcaaatgaatctgacaaagtgaggaggagaagggttgatctggcttcagtttctgggtcacattcagaaggagagtcctcaggtgagaagtcccagagcagtgattcagagaaaaatggaaatgctcttcaggaatccatggaagtaaagattagatcaggatgtgattttgagtcggggggtagtttggagtgtgaggggggaatggcagttcagcctgctcctgagaacacttctgcaaatggaacttctgagaatggtaagagtgctctttcagaacaagttctgaaatcagatgctcctgagaacacttctgaaaatggaacttctgagaatggtaagagtgctctttcagaagaagttctgaaatcagatgataaaacagatgtggataacaccggttcagctacatcatcactccttaatgaccctgtggtgcctccagtagaagaatctgctgatgtaaataacaagccacttctttcagaggagcctgtggacctggcaacattcagttcagcagcagaattggaggcacttggcatggagaagctaaagctggagctccagactcatggactaaaatgtggtggcactttaaaagagcgcgcggccagactgttccttctgaaaacaaccccactggataaactaccaaagaagctgcttgcgaaacccaactctggagggaagtgagatatagtagcaaataacgattactatcccaagaaaacaattacgaatgtcaagttcatctggaatactgtacttgttgtaatgtgatcagaaagctttcgcttggcattggaaattaacgaaatctctgtatgtagtaaaaaaaaaaaaaaaaaaaa

SEQ ID NO: 9262 - DNA, 657 bp, Triticum aestivum
  Clone ID: PAT_TA_9262
gggctgcaggaattcggccgcggcgcgtgcgagacgccccgacggtagggttcccttcgccgccgcgccgccatgccgccgcttccggcagccctcgccaccatcttccgtccccaatcgccgttgtagtcctcccccgcctgtaaatagccttgacagagccctagccaccgtctccctggagcacggcgcccgccgatattcacgatggagcgccggtggacgtcctgatcgtgggcgaggaccccgccgaggcgactaacctcgccaccgcgcgactcccccagcatctctgccatcgcctcgcgctgccgtgtgcaaggaccaaggataccaccggctctccttgatatctctgtctccactcccccgaggtgcgaggacttcgccggcgtcaaagccactgccgggcgggacgcgcaggcgcccgaggggcgcggcgctcctctcctggtgcggcgcacaagggaaggaggaggggatcgagctgccggcacaccacccaccgttcgcccctggtccagactttgtcggaactccatctgtcggttctgcacttaggccaagttgagcatatgttagatggtctagatgacatggatggtgtcgaggatgtgcgttttgatgagctcataggcatgcaaggcgtagtatttc

SEQ ID NO: 9263 - DNA, 953 bp, Triticum aestivum
  Clone ID: PAT_TA_9263
acggagtccaccttcgagaaggaggtcggccaggaccgtggcgcgctcgtcgagttctacgctccctggtgtggccactgcaagaagcttgctccggaatatgagaagcttgctgcaagttttaaaaaggctaaatcagtcttgattgctaatcttgatgctgacaaatacacaagcttggctgagaagtatggagtttctggttttcccacattgaagttcttcccgaagggtaacaaagctggtgaagagtatgagagcggtcgggagttagatgactttgttaagttcattaatgagaaaagtggaactagccgtgattcgaagggtcagcttacttcagaggctgggcttgtggcaagtttggatgctcttgtcaaggaatttcacagtgctgctgatgacaagcggaaggaaatcctctctaaaattgaagaggaggctgcgaagctcagtggtcctgctgtcaagcacggaaagatctatgtgaatgttgcaaagaagatattgcagaagggctctgactataccaagaaggaaactgagaggcttcatcgcttgttggagaagtcgatcagtccttccaaagccgatgaattcgccatcaagaagaacattctttcagccttctcctcttaatggtgatgacccacgtgccccagccctgccattgttggggtgtagtcagtagtgcaacagtaccacctgccacaagagagaagcgaagaaagacaggaaaatagagatcagagaggtggcagtgaaagtttagcggcaatagattatctgtttggttctctgttggacaacatgtgacatctgttttctctgccatttacttctatggttatacatggatttacttagcactcttaagagattactcaacaacaaacagcaccatctggtgatgacatttgcaacacaataaaatttgccatttgagttttttc

SEQ ID NO: 9264 - DNA, 1582 bp, Triticum aestivum
  Clone ID: PAT_TA_9264
tttttgacgcgtgggcggacgcgtgggctgatatctgttttctaagccgtttaccttttcggttacagggatttactttagcagtaaaagggtttactcaagaacaaacaggcagtccacccgaccagtctcacgcgtctgcggaccggtcatggcgacccctcagatctaccgcaaaaccctcctccccgtcctcctcctgctcgccgccgcggcgctctacccagccgccgccgacggcgacgaggtgctcgccctcacggagtccaccttcgagaaggaggtcggccaggatcgtggcgcgctcgtcgagttctacgctccctggtgtggccactgcaagaagcttgctccagaatatgagaagcttgctgcaagttttaaaaaggctaaatcagtcttgattgccaaggttgactgcgatgagcacaagagtgtgtgcagcaagtatggagtttctggctaccccacaatccagtggtttcccaaaggttccttggagcccaagaagtatgagggtcaacgcactgctgaagcccttacagaatatgttaactctgaagcagcaaccaatgtgaagatagcagcagttccttcaagtgttgtggttctgaccgaggaaacctttgactcagttgtccttgatgaaaccaaagatgtccttgttgagttctatgccccatggtgtggtcactgcaagagtcttgctccgatatatgagaagggtggccctctgttttcaagtaagatgagggtgtcgtgattgctaatcttgatgctgacaaagtacacaagcttggctgagaagtatggagtttctggttttcccacattgaagttaatcccgaagggtaacaaagctggtgaagagtatgagagcggtcgggagttggatgactttgttaagttcattaatgagaaaagtggaactagccgtgattcgaagggtcagcttacttcagaggctgggcttgtggcaagtttggatgctcttgtcaaggaattccacagtgctgctgatgacaagcggaaggaaatcctctctaaaattgaagaggaggctgcgaagctcagtggtcctgctgtcaagcacggaaagatctatgtgaatgttgcaaagaagatattgcagaagggctctgactataccaagaaggaaactgagaggcttcatcgcttgttggagaagtcgatcagtccttccaaagccgatgaattcgccatcaagaagaacattctttcagccttctcctcttagtggtggtgacccacgtgccatagtcagtagtgcaacagtaccacctgccacaagagagaagtgaagaaagacaaagagagatagagatcagagagatggcagtgaaagtttagcggcgatagatttatcttattttggttcaatgttgaacaacatctgatatctgttttctctgccgtttacctttatggttacagggatttactttagcagtaaaagggtttactcaagaacaaacagtaccaactggtaatgacattaataaatttgccatttgtgttttatagcttaaacacaaaaaccacccgtgttctccagactgct

SEQ ID NO: 9265 - DNA, 336 bp, Triticum aestivum
  Clone ID: PAT_TA_9265
ggaggctctggtgctactgggcggcagcggccctggtggtactcgacggcggcggccccgcaggcggagcgatggcggaaggagagactgcagtactaggggcagcggcaacaggccaagaagggctagcgaggagcaacaagggccgacagggagtagcaagaaggttcaggagaggagtgcagcaagagttcatcccttcccctgtgtaatgtttggtcaaataggttcatttatgttgtctattatttttaaagtttgtttttgtgttgaaaagtggcaaaagatcaaagtccaaaataaagagtgtcataaaatcaatttttaaaaaaaaaa

SEQ ID NO: 9266 - DNA, 1374 bp, Triticum aestivum
  Clone ID: PAT_TA_9266
gctcggaggggtatgtatggcagctttgttcagattgcgacctgtctgggaatcttattctctcttctagtcggtacccctgtcaaggacattgatagatggtggagagtgtgtttctgggtttcagctgtcccagcagttttacaagctattgctatggagttctgtgttgagagcccccagtggctatataagtgtggaagaacaaacgaagcagaaatgcagtttgagaagcttctaggccctcttcacgtaaaatctgctatggcagaactttctcgatcggagagaggagatgatggggaaagtgtgaagttctcagagttattttatggtcgtcacttcaatgttgtttttattggcacaacgctctttgctttacaacagttatcgggcataaattctgtgttctatttctcatcaactgtgttcagaagtgtgggggtgccctctagccttgccaatatatgcatggggattgccaatttgttaggttctattatagctatgcttctaatggacaaactaggcaggaaaatgcttcttgtaggaagcttctttttcatggccttctcaatgggacttcaggctattggagcgaatcgtcaccttggttctgcaagtgtgtatctttcggttggtggcatactgctgtttgtcttggcattttcattgggagcaggcccagttccaggacttcttttacctgagattttcccaaacaaaattcgggccaaagctatggctctgtgtatgtcagtacattggggcgtcaacttcttcgtcagtttgttattcttgcggcttctggagcaacttggcccacaagttctgtacacgatgttctcgtcagcgtgtgtggtaggagcaatatttgtgcggcgacacgtagtcgaaacaaagggaaaaactctgcaggagatagaagtttcactgttgcaaacacagtaaaggtttcaccgaggcagtgccttcttatgcacgctgggaaggaatgaattcagcggcgtttttgtcgctgaacaccagccgggcgggcggtctgttcccagatcaagtgatctgatcatctcttgcggacagaatcgccctacgctcggtgtaagttcccggccgtgcacgaacctgtgaccgctagagcagtggcatactatcgtaggaatacatacatacatgacagactggcgaggaggctcttgtctgtataggctgatagttggccctatgtactataattgtgttgtgttgtgcttaactgtttcgtcagtaagggcagactggattttggatactgatgaacgaacgctgtcgaaacggtttactattgtttggaataaataacagcagtgacatgcctcgtcgaaaaaaaaaaaa

SEQ ID NO: 9267 - DNA, 157 bp, Triticum aestivum
  Clone ID: PAT_TA_9267
gggtaaaagtctcgtttgattctgatttccagtacgaatacgaaccgtgcgtggtggccggacgtgatggctggctagtgcgtgtgagtcctttgtataaatacttcctttgagtaatgagaaggaggctcagagggctggaaaaacaaaaaaaaaa

SEQ ID NO: 9268 - DNA, 245 bp, Triticum aestivum
  Clone ID: PAT_TA_9268
ggcgacgtgcacctccttgtaagcgacgccccaccgtggtggcttgacaagtaccgaccgctgctccgggggctctcccaccacgctgtcattgacatggacaggcaaagcgcagaggtgctctgctaccctcatgtggtcgtcggcctcagcttccacaaggagatgagtatcgacaccgcgaagactgtcggtgggcactactccatggctgactttgcccgccttgcccggagatcctacgg

SEQ ID NO: 9269 - DNA, 723 bp, Triticum aestivum
  unsure (1)..(723): unsure at all n locations
  Clone ID: PAT_TA_9269
aatgtcaagaacagcaagaccacaggcttttaactcaattccagaaacaccacaagcagcagtcgacgcaactccagatgtcagagggaagtttagaagaatggagtttggcagcagcagcaggttctcaagccctccaacgctgtccatgcggaagtcaaggaacaatatctcgtctccgcagcagaggttgaggatgcagtcgggctctggaaatgccagcaagctatgcttcagcatccagaaaagagtagctcttggttcacctgctccagcaagaacgacttccatgacgtctggtactggcatctttgatccagctctgcgtgaacaaataatggctgggagatttggcaatgcgcagcgggtgttcaacggcaagaggagaatgtctgtcctctaaggtgaagaagatcggttcggaatgttgcgacagcggtgcggaaccgggatgctgaaggaatgtggtggtacttttgcttcctcggagaagaccaaccatggctggctggggctgggaacttgtgttgataagaggacttgtaacttgtgttagggttctcttggcgatgataaatgtctactttgagggttgtgtataattttataccctgacgggttggttggccggttttgcctttcgcttctgtctggatgctctttcccgcctcgaagctgcttgcctattatgctacttacnaataagaaaggcttagggttcca

SEQ ID NO: 9270 - DNA, 914 bp, Triticum aestivum
  unsure (1)..(914): unsure at all n locations
  Clone ID: PAT_TA_9270
ttcggcacgaggctgcgccggcgtggnacaagggcctgtcccccatcgtcgcggggctctccggcctcggtttgtcagatcccgagatggtgcgcctcctctcgctcgccccacacaaattccgctgcagatccatcgtcgccaagctgcactactacctgcccctcttcggcggctccttggagaagctgctccgggccatcaacttcaccaacctcctctgctgcaaggggagggtggagcccaacgtcgcgttcctgcgcgagtgcgggctgggtgatggcgacattgccaagctgtgcagctcgaggatggtcaccgccaacatggagcgtgttcggacaatggtggcattgaccgaaggcctcggcgtgccccgggggtccggaatgttcaggcatgctctgagtgccgtcgcattcctcgacgagaagaagatcacagccaaagtggatcacctgaagaagacggtcgggtggtcggatgctgaggtgagcattgctctccctaaggcaccgtttctgctcgccaagtcgaacgaatcgctgcagcatgggtccgagttcctcgtctctgaggttgggttggaaccggcgtacattgctcgtcggccggtactgctctgttacagcctagagggccggatgagaccccggtactacgttgtgaagtttctcaaggaaaatggattgctcaagcgcgaccccagctactatactgttttcaaggagaccgacacgtatttcgtggagaagttcatatgccctcacaaggaagctgctccgtacctcgctgaagactatgccgccgcttgcggaggggaagtgcccgctagcatttagatttacatgaaccaagaattctgagtaatatatgtagaatacgcgatgtagttcctgaagccagctatgttt

SEQ ID NO: 9271 - DNA, 636 bp, Triticum aestivum
  Clone ID: PAT_TA_9271
cgcaacgtccccaaagctgatgtacttctgctgcaagagctcagctctgcaccaagctcgatcttgtacatcaatggagaaaacctaaccaaagttaggatcgatgagatggagtactgctcctgctgatgtatcctcacctttcatctgaccgggagtcaaagcactgctgctcctgatgtatttgtaacagatgcacggcgcgtaccgcgtgagatcggtgggcataaaaacatgatggggcttttgcgttcatgcccctactttcaatatgaagttcatcaatggtgatttagctcctaaaaccatactggcaacagcagcactgagcactcagccctgctcttacctctccatatatacttgcttctctcgcttgcttggccggccaagtagcaagctcgctcactcctcggtccctagtctggcaagagagaagagagatggctcgcccctaccacctgcccctcctctccgtcttgtccttcctgctcctcaccggccttgtgactgctgatctgtctggagggaataaagtcgggaagattgtgaccatgaccgtccagtacccggccgcgggctcgcctccgggggagaagaccacgatctcagcgcactacgttgatgagcacgggg

SEQ ID NO: 9272 - DNA, 966 bp, Triticum aestivum
  Clone ID: PAT_TA_9272
ccgcccgtccgtggacgcgtgggtcgtcgggaagagatggacggatccaccgtcaaccgactcgtcatcctcttcctcctcgtacttgtcctcgccaccagcaacagcgagcatggacacgcaggagccgttgatgcgggcaacgtcgtcgtcgtccgggtccggctaatcggccgcggcccggatgacaagaccaccgtcgccgtgcagagacacgacctctccttcgccggcttcaccgatggcagcggccattggcacgcctttcctggccttgagcatctcttccccacgtccacgacgctcccgttcggcagcagctacagcgacctcatcggcggcctcgcgaacctgccgggcgtgccgctagggcgggaggccatgctggaggccatccgcgtgctctccgcctaccgccccggggccgacgtggagccggtcaagcgggcgctggcggcgatgaaggttgtgatgtgcgaggcccagcgggtgaggcccatcaaagagaccctcaacgacggatgggacaccggtgcccacgtcgcccccgagcacctgccctacaccgagcactgggacaccatgtcctacgagatcctccgctccaacattacgggcaagtgggacgggcccttcaccaacatgctggagacggaagccaacattcacagcaaggaagaggcgctcgccgtcgtcggggtgctccggagcgttgacttcgagcaagtgattgaggctcacgcttccccgatctaacctagagtgaaccttcgtgctaatgcatgcaactcgtctaccgcggcttttggagtccatgtttccttcacgttcgtcttaattagctggtgggataatgtgcatggtttcggcttgcttactcaagtatgctgtttgaggctttcagcccaatgtctcaagtaatttatattttcaaatctattcagaaatgctaaaaaaaaaaaaaaa

SEQ ID NO: 9273 - DNA, 208 bp, Triticum aestivum
  Clone ID: PAT_TA_9273
ggagaagcaacgcgtcatccgcgcgtggagacgtcgttaagactagccacaatggaggggaggggagcgtctcatgtgtagattgaagcgtccttgtgcttttgtactacctctgtaccaaaatatacgatgtttctgtagtttaatttaaactgtaaaaacgtcttatattttggtaggaagggagtatatgtgaccaaaaaaaaaa

SEQ ID NO: 9274 - DNA, 1344 bp, Triticum aestivum
  Clone ID: PAT_TA_9274
cgagctccgccgacgcctcccacgaagagcgccgggaccttgctgctggggtcgccgccgcggcgcccgccgctgtctctttcgacacgtcgctcttgtgggcacgcctaccgcggggacacccgtcgggtcgtcgggcctcgccgccacggtacgcgcggctgctgtcctgctccgcctccaccccgactgggactggttcctcaccctcaacgccgccgattatcccctcgtcacccaggacgatttgatccatgccttgtcgtatgttccaagggaatttaacttcattgatcacactagtgacattggacggaaagaatccgaaaaagtgcaatcgatgatagtggatgctggaatatacttgtcagggaggaccaacttcttccgagccacacagaaacgaccaagtcctgatgctttcaagttcttcacaggttctccatgggttattctgaaccgacggtttatagagtactgtgttcttggttgggagaatcttcctcggcttcttctcatgtacttcaacaatgtaatgctacctcaggaaggatatttccactcagtcatatgcaactcgcttgacttccgtaattccactgttaacaatgacttgaggtacaaggtgtgggatgatccacctcagacagagcccctttttctcagcatggcacattatgataagatggtggacagtggacagccttttgcaaggcggtttcaagcgaatggaccgttgctggacaagatcgatgagaaactacttaagcgtccgggccatgggcctgttcctggtgcctggtgcgcaggaaggaagagctggttcattgacccatgttcccagtggagcgatgtgaatgttgtgaaacctggtcctcaagccttgaagttgcagcaatatatcaatcggaccttggaagaagcagattctggcgcaaaatcatgcaggctatagctgcatttgattccaatagcctcacatcctatggctgaaagcttcgaggtttccattccagcatcaaggttctctgctctagtgctttgcagaataagcagctatttcctcccttaactgaaattaggacttcttgcatatcgagtgctctttctagacccccaccccccctcccccccttaatattggctcctaagtttcagttaggtctaggaatctatatttgtggctccatcataacattgaaggcacagagatgagagcatgctaattgaaccatattggttgtattgtatgagctggtcacttattgaatgacctatgctggcgctgagttcatatttgacagaactggagaggaaaaagcagaacatgtggtctgttactag

SEQ ID NO: 9275 - DNA, 535 bp, Triticum aestivum
  Clone ID: PAT_TA_9275
gagggaataggagcgaccgcgtccatccaatcaagtcccgatgcgacctgcgaggcgcaaagaggagcgacgcacagaggagaggagcggccggtgttcgtcggtcgattggatccacgggggtgtgtgaaagagatgggatgggatgtgtcggccgttcccagaccgatcgatcgctgtcgctcctgaaaaatattcgctcgacgcgaggggggaaggggatccgccgccgcacgcgattctgatcgacgccatggccgctcgttcgagcgaaagtgctccggcgaagttgtgccgccgccggcaccgccaccacaaccactaccgctcgaggtcggtggatctctgaggcaaccccatgctccgatccgaacggggcggctggactgcctgcgtggtggtggacggcgtcgcccaggccaacaacatcatccagcgcctcaacgacttccccaccatggcgcacatctccgcgatggggcctcaaggtcgtgtcgatgatcgcggccttctccaacctctgcgaaaaaaaaaa

SEQ ID NO: 9276 - DNA, 902 bp, Triticum aestivum
  Clone ID: PAT_TA_9276
ggttggatacaacatgagcacaccgcaaaacaccggaacagcgtgtcccattcacatgtgaaaatcaaagtataaagcaaaccaccagacttccccatagagctccgagctccattggcccgtcttctcgccccgcttcgccctccgggagaatcacccaatggttgtgagtgcatcatctccagcaaatataacttctttctcgccgtcctcaccatcctccagaacgtccctttttcaccaaagaaaagcatccatatctcgatgaagcgggctgatactacaatagaccagggcagcatgtgtcagatgccttcgccaactgaagctttgcatggccacgcttctgcttccaagcatctacattcagctcagctctaaagacagagacaaatcatccatgcaagaaacctcctcaccagcttctcgctgctcttcttcctcaacgacatatgtctcatgtaagcctccaacagaacgaccatggctatgctccagaacggcataaacacaaatgttgcagccacgacgagcatcgccaccgcaactttgtttgtgctctgaggaaaagctgcgagcacgaggaaccgaagcttgaggagaaaaatgttcccagcttggccgtgtgcctcaagctgcaagatggcttcctgctgagcaaggggatgctcgacggttcgccaccaaggaggggttgtgacttcaaatgctccaatgagctgcttgttgccatggtgcttgttccacagcatgaaggtggagccgaccaaaaagccggggaaaatgtaccatatcaagcctcttcaggacagcaacattggtgtctatatcctccaccttgacctgatcaagcgtcatgcgtgcagccaccactctactagaataccccaaagatctccact

SEQ ID NO: 9277 - DNA, 1732 bp, Triticum aestivum
  Clone ID: PAT_TA_9277
gtcaatcgatccatagagatcgagatatatatgcgtcctccatctcgaaaaactgttccacaaatcccagccctgccgaacttcgatcatggagcgaaacatcatcgtcctcctatcccttcttctctgcctcctctcgtgccatgtatccgcagccggcgccaccgccaagcggcggctctcgtcgccgctgtcgcgtccccatcgtgtgatcacggcggaggcggcgccggccacgacggtgccggcgatggtgcagtatgaaacgcggtaccacacacagcggctggaccacttcaacgcggcgccggcgagctaccgcacgttcccgcagcgctacctggtgaacggcacgtactggggcggcaagacggcgccggtgttcgtgtatgccggtaacgaaggcaacatcgagctcttcaccaacaacaccggcttaatgtgggagctcgcgcctcgcttccgcgccatgctcgtcttcatcgagcatcgatactacgggcgatcggtaccgttcgggagcgaggaggcagcattcaggaacacgagcacggcggggtacctgacgacgacgcaggctgtcgccgacttcgccacgctcgtccaaagcctcaaggccaacctcagcgcaccgaccgcccccgtcgtcgtctttggcggctcctacggcggcatgctggcagcgtggatgaggatgaagtacccgcacgtggttattggggccgtcgcgtcgtcggcaccaatcctcgccggctacggccccgccctgccctacccctccgctgacatcatctcctgcctgttctagagtgaaagcaagaattgccacgacgtactcatgaactcgtggaaggagctggacaaggcgctgtccaatgacgccggccgggcgcagctcaacagtacgttcaaaatgtgccgaggtagtacagtggaggcgataccggacttgctcgacaccgccatcgtctactccgccatgacggactacccgacggagtccggcttcctcacccacctcccggcctatcccgtcaaagagatgtgccgcgcgatcgacaacccaaagtcgggcaaggacaccttctcgaggatcaatgaagccttgatggtctactacaactacaccggcaacgcgccttgccttggcgacgccaccgagcatgacccttacggcatgttcgacggctgggactttcaggcgtgcacggagatgatcctcatgagctacggcgtccgcaacggcagcgttctgccgccggagcccttcaacttcaccaagctccccgacggctgtcccgcctccaccggcctgccgccgcggccatactggttccccacagagttcggaggattcgatattgcaaatgttttgaagaggtcagctagcaacatcatcttcttcaacgggctccgagatccatggagcagtggcggcgtactgaaggacatctcaagaagcatcatggcactggttgagccaaaaggttcacaccacgtagacttgagattctccagcaaggacgaccctgattggcttaagcaggtgcgggaaaaggagacgagaatcatagggcattggctcaatcaatactacaaagatgaagccataaagtcctaggttaaatgcatgctttgtgtaggaagggaatttatgttgtgttcttccctttttgttcattgctatttgttttaggactattattaagaacacaaagaaataacagattta

SEQ ID NO: 9278 - DNA, 520 bp, Triticum aestivum
  Clone ID: PAT_TA_9278
cagcacctaaagcgctataaagagggcatgttttaacaaactaggaaaaaaaagaggattgtagcaaagccaaggaaaacccgctgtccttgcctgatcatgatcatgttcatgaccatagacatagactactgggcaaaaaacctggcgcaccatgctatcctatcattacaaaccaagtagtaggaattataagcagttttaataacatgtctaacagaagtagtactgcagtttaaccggccattcagcagagcaacactatcattcagggctgggctttatcatcctctgctgcctgatccgtcccctgtcctgaagctgggaactggtttgaacctgccgtggcaggtgcagcggcactgctgctgcccaagttcaggcaagggaggcacacccactgcctccacgtccgtcactgcacgcgcaccggaggagatgtactggcggcgtcaatgctgctctctgtcaaatgagggacgggatggttggagtctgattcttcttccttgtcgttgct

SEQ ID NO: 9279 - DNA, 885 bp, Triticum aestivum
  unsure (1)..(885): unsure at all n locations
  Clone ID: PAT_TA_9279
gcctcgttctcagccgccgccgctgcctccgatccttcctcctcggctctacccaccccatcctctgtcctctcttcactcctcctcctctcacaggccctgccgccgcacaccgctgctccccgttggcggtgaaggccctgcagatccagccgggaggaggcaggtgactcgagcagggctggtcaccgccgtgcgcccgctccgtcgtcacgggttgtcgccatgctcccctcctctgcacgtcatcgcctgaaggtcaccgttgccgccgccgatttactccccattcccctccaccatcgggtgtccattgtgtctgtctccagggatccaactatggccatcgctttgtttccttccttttctgatcatctcgtccacaacggtggccgcggtgcggacaatcggtggaaagtaggtagggaaggcccgacagtggtgccacgcgggatgaagcaacggcggcacaggagcttcccggggcagttcatcttcctctcctttgtcctcccccattcccctcctagatactcgttgattaagaggtacaagtgggtggccagctgcaatttctagatggaagacatctggttaagattttccttgggttcttgattccattttctcaatggttattacttatatgtaattagtacgtagaataacaatttttgtataccatgtttgtggctgaatgcattgagttgctggaattgttgtattagatcacatgcattattcagtgcactcttgattgtcttaccaatggtccaaataaatacacaaccagtgaaattgacccggggntttgatttacttttnttacaatagagtaaattcattatttttcantttggacatacttntatngggttggtttaa

SEQ ID NO: 9280 - DNA, 643 bp, Triticum aestivum
  Clone ID: PAT_TA_9280
cccatatcatcgccgaaaagttacaagaagggttgccatgtatttctgagagctctactatctgcggtggtttgcgtgcaatgagacccataactgaagattacatcgcaacttttatcctgaggtggcaattcatacaatcagttcaatcagcaacttcatgtgtgcagtgggatccaggaggatttgattttgttgaactagcggcgaacaggcaccggctcggcagatatacagaacttcaagactcctgttctccttcctggctagctgatggcacctcacatatgctcaaattgcatctgcaagacacaaacttcgaggaactagcggctaactggcaccggcttgagggcaagccggttgttaaggaggaggggatgtcagcgacccaaagtaccgccgcggccacatcaactgaaggcgctaccatggtagcccaaactgctgccatggcagcgaaaccaacggcaacacaaactggagagccaaggcagcgagcccaccaacacatgggccgggccggacaagttgttactcccagggcaggcagactacaagtacccagccaagacgcagcgaacgggcatccgggcttggatcacgaacggcaacggcggcttcctcttttccctgtcatctc

SEQ ID NO: 9281 - DNA, 344 bp, Triticum aestivum
  unsure (1)..(344): unsure at all n locations
  Clone ID: PAT_TA_9281
gcagaagtgtgtattatgtcatgcagagcatacccaagnacaagcaggttcatcgtgacgacgagtactatgaaggcgacaacgacaatgatcacgatgacggcggacattgagatcggcatcttgacgatgtatgtaggtggaagctgaaagtctttcccgcagcagctgctgttcagtttataacatcgtgggatggggaatagttggctgattgacattttaggatctgacgctaggctggagagcattgtgggagaacgtaacacttgctgacttgtacagcattgtacgatctcacatttgtacttacttaaaataccatcatttcagtaaaaaaaaaa

SEQ ID NO: 9282 - DNA, 610 bp, Triticum aestivum
  Clone ID: PAT_TA_9282
ggcatggtgctgatgcttatatcgatgatatcaatgcgctcataccgttaactgacggaaacatcagaactgcacttgatactggatgtggggtggcaagttggggtgcttttcttctgaagaggggcatcatcaccatgtcatttgcaccaagggattcgcacgaggcacaggtacagtttgcgttagagaggggagtgccggctatgattggagtgatggcaaccgatagaatcccataccctgctagagcattcgacatggcgcactgctctagatgtttgatcccatggaacaagctcgacggtttatatctggttgaagtggacagagttctaagaccaggaggctactggatcctctctgggcctccaatccgttggaagaagcactacaaggggtggcaaagaacagaggaagacctgaagcaagagcaagatgagattgaggacctagcaaagcggctctgctggaagaaagtagtagagaaagatgatcttgctgtatggcagaagcctatcaaccacatggagtgtgctaataatcggaatgccgacgaagctctgcagttctgcaacaacagcgatgtggactctgcttggtacaagaa

SEQ ID NO: 9283 - DNA, 796 bp, Triticum aestivum
  Clone ID: PAT_TA_9283
gcagcctcccatgccccaccttctaatcccacgcaccaccgacacatagggccatggccaccccccgatctcccaccttcttccccgcccggggccccagacccctaccttcttcctcgccggagccccacaacccaccaccttctccatggcctcctcccccaccggtggccgcgctcgtcaggcccgacctcgtcggaaccccgcggcgagcccctaccccgacgggggcctatcctcctccagtggctcggaccaccatggctccgccacaaatctgaaacaagactccggcgggggactgccccccgcgctggccagggtcgtcctctctgtccatggccagacgaagactacaacaagttttatcaaacttggtgaggtcccagccacccacggcatgcaatacggatagtgacgacgtgcagtttgctgtgcgaatgctgtccaggatttgccattggagattgtctaaatcctagtggtggtgttccttcccgccggtggtggtgctactgcgagctggagtggagctctaccctgacgcgtggcgctacagtccctcttggttgtccctcaccgctatactcctctctcaagtagagagcatcagttcgatttgtaatgcatgcgtctagttccagcggccgaggtagaagcagtttagtggcagcgtgcttgcagtttggtgcatgttgtcttacatttcggttgcaaaaaaatgatgcatataagatgcgtccagttgcggtttagttgctgcgctgatgtagttttgctagggtactaggtggtg

SEQ ID NO: 9284 - DNA, 898 bp, Triticum aestivum
  unsure (1)..(898): unsure at all n locations
  Clone ID: PAT_TA_9284
gggggcttatnatctgcttcagctccttctgatccgagcagagctggagatacaacgcctgccaggtgacacagtacaagctctccagtcgttggatttgataaaatcccggatgaaaaagatcttccagggccgcattgaaggcatccaccaccagaatacttcagcgcaggagttgcaggatcaacatccagggcgcggcgagatatttacacctaagcatccccattcggggaggagcaagtttggcgaagtcagatacagaggcgactggatgaagaggcccatctcggagactgaagtggcctggctcgcgaggatccttatccacatatctgaccgactgaacgacgcccttcgacttggctgtgacggtgctgctgatgatagcgttgctaacccgacgtacattaagtttgacaggaacgatctgacgacaatagggggaccgaaggacgccgctaggatggctctcgtggctatctgttcgctgctggcggttgtgggacaggcggtgctgaggttcatgagggcgcacagggtaaagatcaatcttagagtttttgcttcgaagaagctgctgactggcctcgtgttgctgtacgcgatggtggcggggacaaagagagctttttattgagctttacatgtgttgcttccagcaccgacaccgtcgctaatgcttccgtgatcttcactgaagctcccaagttggagatgatggtgcatgtgatgtacaaaacccataggaaggaagaggtggaaactcacaaagggatcgacttgttagtgtgtgccatggagactgagagcaagggaatggtgcccactggctgggttcttgttttgctctttgttagagaagtggctggcaacggcactcatgttaaaaaaaaaa

SEQ ID NO: 9285 - DNA, 769 bp, Triticum aestivum
  Clone ID: PAT_TA_9285
cctcggcgccctcccagcacagccccggccgcgctctcatccggagctgcaaggccctgcgctgcaccacgagaccagctcgctctgtcgacgccgccggccgccatgctcccgctcgccacaatgtccgcgccgagctcgcttctcctgcgtcccgccgcgcgccagcggacggggggagagccaggacgaagctggggagaacaatctatctcgggttcgcagtcccggaggaataagctcagcaactccatctgtgtgaaagcaaacataacgtgctgtgctaaccagacgcaaaccgcgaagcgcaaatcgttctcagggcccacctctcctccgtcaggttcagttaaagagaaggtgaagccgaggctcgacgacgggggcgtcgggttcccgccgtttcggttcggcggaggaggcggcggcggtggcggtggcggcagcagctcctccggtgggttcatcctcttcgtgatcgttttgctcctggactacctgagggagttcgagaggaacctgcagaacgggccgcggaggggcagcgactacgacagcgggctggcaccgcagtagcttcgttttagtagcttgtcgtcgcaaacagtccggtgatggccggtggttaatgtaagccccttgctaagctgagttatcagattagaattgctcttgggaaatgagatgaggagtagcaactttggccgttggattggacgtggagggctgagattgaacgccaggagtcactggcactaacgtgtccact

SEQ ID NO: 9286 - DNA, 860 bp, Triticum aestivum
  Clone ID: PAT_TA_9286
ggagcttcggcgaggtctaccaaggagagctcaaatccccgcggcggcgcctcatcgcggtgaagaggctcatcaactcgaacgagtacagcgagagggagttcagcaatgaggtgcagtccatcgggcagatccaccaccggaacctggtccgcatgatcgggtactgcaaggaaggcaagcaccggatgctggtgctggagttcatgccgggagggtcgctccgcggattcctcttcaagccggagcggccgccgtggagctggcgcgccgaggcggcgctcggcatcgccagggggatcgagtacctccacgacggatgtgtctccccgatcatgcactgcgacattaagccggacaacatactcctcgacggcgcttacgcccccaagatcaccgacttcgggatctccaagctgctcgggaaccagcaggtgcacaccacggtgaccaacattaggggcaccagggggtacatcgccccggagtggttccgcagcgacgcgcggatcgacaccaaggtggacgtgtacagtttcggcgtcgtgctgctggagatgatctgctgccggaagtgccaggacccgttggtcgaccagggcggggacgagacggtcacgctgtttgggtgggcgatccagctggtgagcagccagaggactgagctcatactgcctgacgacgacgatgcggcggcggatatggagagagtggagaggttcgcgcgcgtggcgttctggtgcatcgagcccaacccgtcgctccggccgacgatgcaccatgtggtgcagatgctggagagcgcggttggtgaggctgaggtgctacctgaccctcccgcttgttacatggactcggct

SEQ ID NO: 9287 - DNA, 855 bp, Triticum aestivum
  unsure (1)..(855): unsure at all n locations
  Clone ID: PAT_TA_9287
tttcccttgtctggaacagctctatgtcatttttcacaaacacaatgagcaggataagaaaaatgggcctcggtatgacccactacatccaattgaatgccttcaaacccatctcaagagagtggtgtttctccgcaccaggaagagagagaaacagtatgagttcgccaggttctttgttttgaatgcagaagtgttaaacaaagttgaatttgaaggattcggtggctacaacagtgtatctgtggcttatcaacacagatttctacgagtggaaaacagagcttctcaagatgctcaatttgaattcaggagatatatccgtaccgagcaccagctcgtagagcacatccatgatttgtcagtggctgaccccttccgcagccatagacaggattgatgcctgaagattgcactgtcttagtgtcttgtgctcatctgtagacgttgttgatgcctgaaggctgcatcatcttctgcataagtctgctcaatttctagtctgaagttcctctcttattccggtaacttatgaagttgcccctgttaaaactgaaaaagttgtttctggatgcaaaaataagtgcactgaagtaaatttctgatgggcagggatgcaaatattactgccgaaagttgtaactgtgcagttatggctttgttctgcctatgctgggtgttggatacttaattgtcttttcatttgtatgaagaagcacgagacgtttgatgcttatgaaaggtcagcctgtggcttaggcccctatgattttctagctaggaaggagatgcctctctgtaattttaagatatatctgtgtatgttatcagctagaaattctgctaanatcatca

SEQ ID NO: 9288 - DNA, 659 bp, Triticum aestivum
  unsure (1)..(659): unsure at all n locations
  Clone ID: PAT_TA_9288
gccggcttgtatcgctggtaaatcctaagnctcccatgggtttcccttgatttgttgcccttagcggctgagcctgctcatcctcagctgtgggcacccccgcaactcgaaatcactggtgcgaccacagggtcactggcggctggtttggctcctcgtatgcctcctctatttcctgggccagtaaattgtgacagatgtgtagcagggcccgagaaaccgctgcgcaagaagggaggcgagatcgtcgatctgtacattgtcattattgtcggcgtccgtgcaggtgatgtgggcgtggagctcgtctcccgcatccagcatggaaacagcttgagtatgaggatcctggcaacgttgttgtccccaagcacgcaagccagacgcctcatcgctgttcccactcgaggcggccgagttgtggttatcctggacaacagcagcattcttcgacctacagacagtacgcatgcccggtgatcctcctgaggcttgagcctacgtccggctactatggaacatggcaaggtttacaccttggcttcagattcagttcacgtggatgtactttgtaaccactttatcctttcccttccctttctttggaatatatggattatttgtcatacatccanatccaaaaatggatgggtgcttac

SEQ ID NO: 9289 - DNA, 849 bp, Triticum aestivum
  Clone ID: PAT_TA_9289
ttcggcacgagggtccacctccggctcctgtgccgccacatacgggtgatggaaaattttctgccccagctcagtctggagtctacgccatgtcaacagctgtgtcattgggtaaaccagacgtgatgacgcaacgggcatcttcagcccctcatcctcctacggcatttctagcagctcaccgatcagtcacaggacagtatcatcaagtgggtgcttctcagctgcaaccggcatcttcagcccctcgtcctcctacggcagttctagctcaccaacctgtcgcaggacagtatcatcaagtgggtgcttctcagctgcacctggcatcttcagcccctcatcctcctacggcagttctagctcaccaatcagtcgcaggacagtaccatcaagtgggtgcttctcagctgcatccagcttggacatttcctccggggtacttctggcaggcaatgcagcttctcctgcagcagcgccgctcgtgacttccgtgccgccctggcgttgcagcttgtcctgcaccagctcactccagagtctaccccatgctcttcccctttggcaggccatgctgacaaagtgacaggtatactcctattggattctttgtatgcccttctcttcaaccgcccgagaggaggaagagaggaaggagggctatgatgaagaagaggtggaggaggttttcactagcttttctagtaggtatttctttacctaactcaagttactgtttgaaaatgtcggcctccagaggatttctttgattatgtttaagttattaaattgtcacttgagcaccaacataatcaattgtgcaatttagatttaaaatcggacccaaca

SEQ ID NO: 9290 - DNA, 891 bp, Triticum aestivum
  unsure (1)..(891): unsure at all n locations
  Clone ID: PAT_TA_9290
gcacctccccccccccccccccccacctgtttgacgcaccgacgaagcggccatgatccagctgctgttcacgctgctggccgccgaggcagcgctggtgctcgtgctgctcttccgcacgcccgctcgacgcctcgcgctgctcgccgtggactgcagcaagcgcggccgcgggcccgtaatggccaggaccgtcgcggccaccatgttcgtcgtgctcggctccagcgggtacagcatcgccaagatccggcgccgcgaaggcgagttcgcccagctcacacccacagaccaggtgctcgccagccgccacctcctcgaggcctcgctcatgggatactctctgtttcttgggctaattattgatcgactgcatcactatattaggcaaatacgggcgatgaagaaaaacatggaggctgtgacaaagcagagcagggtcttggaagaaacaaagctcggagactctgaggaaattcaaggatatcagaaaaagattggcagtttgaatgaacaggtgcaagtactcaaacaacagtcagaatctcaaacacaggagctaaaaactgctgaaacgaacaatttggctttaagaaaacaatctgaaggcttgcttactgagtatgagcgtctaattgcggagaatgaggaattgaggaataagctgcaaacaatggaactccgcttctcccgttctgacagcaagaaaaatacatagtgaagtgtacgttttacctgttgaacctcggctactgtaaatttttgtcctataatgttattatgtgcatatacttataggtgtactctcattgtcagatccaaagaacataactatatctgttgggtgtattgttttgagtcgaancgggtggctaatcactgttattnacc

SEQ ID NO: 9291 - DNA, 484 bp, Triticum aestivum
  unsure (1)..(484): unsure at all n locations
  Clone ID: PAT_TA_9291
cgtccgcggacgcgtgggctccaccaccaccacctcctcctttccccctcctggccctcccgcggccaccaaccggccccgatcccggatccggcgcggcagatccggatcccggcgatggcgtccacggcggcgaggcggctcagggagctgcaggggcggccggggaacaagacgtgcgtcgactgcgcgcagaggaacccgcagtgggccagcgtctcctacggcgtcttcatgtgcctcgagtgctccggcaagcaccggggcctcggcgtgcacatcagcttcgtccgctccgtcaccatggactcctggaccgagccccaagctccgcaagatggaggccgggggcaacgaccgcccttaaacgcctttcttcgcccgcgcggggggcgcccaaggagacgccaacgccccccaagtccaccaaagtanaaactnccaaacgccngccgcccgcatnancggggaaccggaattnttt

SEQ ID NO: 9292 - DNA, 885 bp, Triticum aestivum
  Clone ID: PAT_TA_9292
gcccgtccccctgacgccgaggataggattttgctcctcccccaaatccctccggccatggcctccttcccgctggcatccgccgcccgttccctccccaccatagcgtcccacctcccggcagccgcgaccacccgcagcgtctccatcccggcctcccccgtccccgcggcgaagaacgccgcctcctgcagcctcagcaccaggagccgccgcaggccagccgttcgacggaacgccgcggagacctacgtgccaggctccggcaagtacatcgcgccggactacctcgtgaagaaggtgtcggccagggagctggaggagctcgtcaggggggagcggaaggtgccgctcatcgtggatttctacgccacctgggtgcgggccgtgcgtgctcatggcgcaagacttcgagacgctcgcggtcgagtaccaggaaagcgccttgtttctcaggctggacacggacgagcactacgagttcccaggggatatccaactacgggtactgccacccctgtattactcaggcccgggtacggccagcgccctatttcttcaggccggatcagggcaaggacgccattaggaccgaggggctttttccgatacaaagggtcagaaacatcatcgaaaacgagctgtgagttctgtctaggcagcgtagtgtctgtagtagctacattatttagctgattcttgtagtagttcttagtatttatttaggtgcagcctgcggtggttgatttgagctttgtgttgctgctcggccgcaggttcgcgtatgcaagatctgcatgagcagaatgtagcatcattgttcgaacctgagactaacagattggttctctattgcaccattcttgtgtgctttgtcaaaaaaaa

SEQ ID NO: 9293 - DNA, 919 bp, Triticum aestivum
  Clone ID: PAT_TA_9293
cgtccggcgacccctacgttaccatccaggtctcctatgccaccgtcgctcgcacctacttctcttgcaatatcctgaaccccgtttgggcgcagaacttccatgtgcctgttggccatgaggctgctgaggttgagttcgtcgccaaggacagcgatgactttggagctcactcatgggaactgtggccatccctgcccagaatcttctttctggggataggattgagggcgtctacccagtgctagagcccaatggcaagccatgcgctcctggtgctgtattacagctctctattcagtacatcccagtggctcgccttacaatgtaccaccatggtgtcattgctggtccggactgccttggagtgcccaatacttacttcccgctgcgccgtggcatgagggtgaccctctatcaggatgcacatgtgcccgatggttctctcccagatatctggcttgatcatggattgcgctaccaacacgggcaatgctggcgtgacatgtacgatgccataagccaggcgcggcggttgatttacattgtgggttggtcagtgttccacacgatcgacctcataagggatggagctgagaaggcaccatcacttggggacctgttgaagatgaaatcgcaggaaggcgttagggtattgcttcttgtatgggatgatccaacatcaaggagtattctcggctttaagatggatggtttcatgggcacgcgagatgaggaaacacgtcggtttttcaagcactcttcagttcaagtattgctttgcccaagatctgctgggaagcgtcacagctgggtgaaacagcaggaaacaggaaccatttttactcatcatcagaaaacagttattgtggatgctgatgccggcaattataggagaaaaataattgcttttgtcgga

SEQ ID NO: 9294 - DNA, 465 bp, Triticum aestivum
  unsure (1)..(465): unsure at all n locations
  Clone ID: PAT_TA_9294
gcacaaggccgccggngtagacgcgctccggccactccccctcagatcccgccgccgcgccccagcccccattgccgcggggttgcactggacttgcatatgaccggcaacatgttgcctcagtgatatccaggcatgatttgggtactgttcataatgcagttggcttctcatggcacccgagatgaagaaggaatgcagctggtgccccgttgtgatcaggaagaagtgtcagattcgcaggagatattttcacaatctgacaccgcaggaagctccaccgagtatctgggctcatgtgaaattaagccattaattgttgaggatgaagatcacaatatcgatgaggagtggaagaaacccatcttgtcattcaagactttccacaatgccggatttgccttgataatgaaggtgatgacttaattgcaccatgcaactgcaangggcacacaaaagtatgtc

SEQ ID NO: 9295 - DNA, 993 bp, Triticum aestivum
  unsure (1)..(993): unsure at all n locations
  Clone ID: PAT_TA_9295
gcggtccggcggccccgcgaccagcccgcgaccaccgccaccgagtcgcccctccttgcgccgctgccacaccgagtgggccgctcgctccctcccggtgtcccctctgggctctcgcgcgcgcgtccccgcacgcgcaacaccgcgagggagccgcccgccctctcggtcgggatgcggcgcatggagggcggcgtcggtgctggcggttcctctccctcccgccccccctccgtctcccctcccctctctttctctctctaccccgaccccgcaccggcgccgcgcattcctcctccgcctggatccagactccgatcctggagccgtggcgtaggaactgtcgaatcctgccacccccagaatccttcttcctctccttcccttctttatgcccaacacatgtacacccacctgtagcagctcctctattcttcgcatgttcaattgctcctctactctttccctctgtgtgtgcttttctttgtatctctactcaggacaacggcgactaggcggaccggcgactggcggggcgacggaaaagggtgggcgacgccgtgacaagatgagggcatgaggcggagaaaccgagcggacaagcaaccggcgcacctacaggtacatccatacaggtgaatcgatcgatatttcttttttttaacaggcacacgtacatggaaaagggatcgattaatcgatcgaaccgatagctgctaggcaggcgtggatgcacggtgtgctggccggtgtccagatccagatcttacaggtgcccagcccaaaaagctggactatgtataagcacaaaatttacctgctcaagcttccttccgtaactcctacattggtgtttaaagacttggcggtaaaccgagtggtggtcttactatcttaatactcaactgcctactatgagaattgtatttctgtttttatgataactatggagctatgactaaaaatcctatggagttatcatccaanaaagaa

SEQ ID NO: 9296 - DNA, 514 bp, Triticum aestivum
  Clone ID: PAT_TA_9296
gcacagctcgagcctgaatttccccacaagcagggtgctcgtctctaacccgaatgggagcaacatatcctctcgttttcttgatcctcttacttcttcatggaaccaaggctgcttcggatcctccagtaccgggatggctgactctgagtggtcgtcgtcctctagtcattgctcgtggggggttgtctggggtagtgcctgagtcaagccagcttgcatacagcatggcaatgggaagtagcttgtgtgaggtggttctgttctgcgacctgcaattctccagcgacggtgtgggcttctgccatggcagcttgagacttgacaattcgtcaaatattgctgagaagttcgctgacaggggctcgacttatcaagtgaatggacgagaggttcaaggatggttttctctggatttcaaatcagaggagctacatagtgtcctattgcttcagaatgttttgtctcgctcaagtacatttgacagaacacaggaactgttgtcgcttgacaa

SEQ ID NO: 9297 - DNA, 512 bp, Triticum aestivum
  Clone ID: PAT_TA_9297
cgtccggagggaaaattgatgtaacaagccacttcaaaagctcgaagagtagtaaaaaggaaaaaagtgtaatgaaactagtgggagagacaggagtacagcaaagaagtagccttttgggagatctgggcacctccaaaaagcatgcaactggaaaaaggagcagtgctctaatttctgggatggaaaatgcaagtgaaagtggaacaagaagcagatcatttggacataagcaacctattcccagtcagctgacagagagccagggcactgcttcatttcctgtcaacaactctcctgacagcttaaagccctcgttgcttaaactcaaatttaagcgtccacatttggagcagccaagtgcccaggtttctcaaccagaggagccagccacctgggcttctcagcaagaggacttaaatgttgctaaaggccagagatcaaagaggaaaagaccttcgacagacaagatggatggctcagagggcagtacctcggccgcgaccacgcta

SEQ ID NO: 9298 - DNA, 853 bp, Triticum aestivum
  unsure (1)..(853): unsure at all n locations
  Clone ID: PAT_TA_9298
ggggcggcgttagtcttgttcattcccgcagaccatcctcgttttctcgcctccatatgatgcccatgacgaccacattttgcaggtcacgggtctgcctcctccccctcgtcgctgttctcgccgtcgccgcctctcttgagccactcacaccactgagcaaggtcatggccatagacgtcagtgcagtggcaaagggcgcttcggtgttggacgaagccgctcattcttcggtggacaagaaattgaagcatgtcaaagaagggatcgagcacgggatggaagttttccgtttctgggatgatcacaaggacgatatcaaaaagcagctgcagcttcttacgcctggagcccaagggagttctccgtcgggttacgtcgtcgacaccgggaatctcaagtccttggtttatggcatcgacatcaacagcccggtcacacggaccggcccgtgcgagctcggcgcacgcgcggtatcgtgcagcgccccggcatgccggcaactatacggcgggcagccgtggccgaactgtgcccacggcccggggagaacttccctgtccttacccttacgccgattatcactccctgtaccagggcaaagccaccttgttcacaaggcccaccgccatgccagtaccctctcactcccactatatgcgtgcagtccctctgcgcggggccgtcctcggctcggagattaggcacctggcacgcacactcgggcctttctcctacgacctctccgaccgacagggcgcccccctgcgggcgcgcccgccaggggcgcggggagtccaaggggaaccatccggtcatctccnaccccctgttccccaacggtactaagtgc

SEQ ID NO: 9299 - DNA, 835 bp, Triticum aestivum
  unsure (1)..(835): unsure at all n locations
  Clone ID: PAT_TA_9299
gctgatcggcgccgccctccaacctctggccgcaccagctctgttgtgctggatggccggcggctcacctaccacctgtggagatcggatctcgggctgggagtgggcggcggccccgcgtgtgcccaaggaggctggatccccacgcgtcttcctgtcgtaatgtggctgcgggcgaccatcacctcccctcccgtgagcaccacggagaccacgtcgtcgaccacctggactccatcctacgacggcggcgtccttccttcccccctccaacaacggcggcgaggtgcacaggggggtgcaatactgcccccggtagcgtgcagctcgaccaaaccggcgtgtgcagttcgctccactcctccgaacactgatggggggccacgggctccacccccaacgccggcggccaccagttttgcccctgcaaaccaccacatcctcctgaccacccatttttagcatccttttctctatgtagtgcggtgcgtgcatcaggtgcagtgcgatagcaccggtaggcaaaacgaagatggtttgtgccttttggtttgccggttgaagaaaaagacagaaaaagtcatacacactcatcatggagttcagtgtgcagttttgtgtgagactgacgtgtgcgttgttttgcatctcactctttttttcttctggaaatcatttgcagtgtactcagtaagaaaagagaagataacatcaatggtcattagaagtccattttgttgtttatgagaaacgcagagagctgtagtagtaagaatggatggtcattttgtatagtctttgtctagtacagttcggntgggtagtgtgttgttgt

SEQ ID NO: 9300 - DNA, 890 bp, Triticum aestivum
  Clone ID: PAT_TA_9300
ctctcgatcggcgcggggctgccacgcccgcgcacctccggcgagtaatccggtgagctgagcccgcagcgcctcccgacgccacgcatctccgaccggatcgaggtcgacagctacccatgggcggccgagcccaggcccgacggcgaccagatccccggtgagtagcgcatcacacgcccaagccccgtgcagctcgtctccccgagctcgcacccgaggaacctccatcacctgcccccttccgcgcgcttgccatcggcagtctcctccctggcgaccaccatctcgacggcgagagagggaagggggtggcgctgcttgaggaggtctggaacggaaggggaggagcggagccatcgctgtcgtagcgctgctcaaggttgcgttgcgcggaagggcgaggagcggagtcatcgccgaagcgtcgcagctcgatgaggcggggcgcggaggtggagatctgtgacagagcctacgccgacatgttgatgctcgggggtgccggcgccccatctggcgccagtgggagatgctcatgcgcaccagcaagtgatcccgacatcacatgccgccgccgtcgaggattcagtgtctgctgctccgtgagtagtggagcaactacaccgtgcaggatatacacgacggccggacgtcaaggcgtggctgttgctagagtagctccggtcatgtctcagagggattgttggcaggcggtgctgatactgaagataatttttgggcaagttggactgattcatgtgttatgctgctgcagaagctcataattcagtatgtgccttgacccagccatatagccagttctcatgtgagttaatcagctagtgtactcagttacaggactacctcgaatgcaattcataagggag

SEQ ID NO: 9301 - DNA, 697 bp, Triticum aestivum
  Clone ID: PAT_TA_9301
cagagcctcaaagcgactccatctcttccccctcacgtctcctcctcgtgtcccttctacaagatagcttggcgttgctatttcatctcgtctcccggctggtcagtgcacgcacgagcagggcggccgggggagagagctcagcttagggtctcgttcatggggtggctgcggtcgctcatggcgcccatcaagaagctctggattcgcgtgcattccgcgcagaagaagaagagagggatctacatcctgtacgaggacgtcaagtcgtgcccgtgcgaggacgtgcagatcctctggtccatcctcgtcgagtcccacccgccgccgccgctgcggctgaagcagtgatcgaccggacggccggtcccctgccgccgtccgtcgatcgagcacggcgctccgacgtaccgatggcctcccggcggcagcctaccgaccccggcatgcttcgacaggctgtcggtggctcggtgtagtgtgcataaagatgatggagcgagcagcagttccgtgtcgccatgatagtagaaaagtaggtgttccctcggcctctcccttgtgagccacggaaatggcgtccgtgcgtgcatggccggtgagctcccctctcgctcgcatcgcatgtgtccttcaccgacactgcggttctgtgaagcaaggtttttttttcttttctcttctttcttcttttcct

SEQ ID NO: 9302 - DNA, 526 bp, Triticum aestivum
  Clone ID: PAT_TA_9302
cgccaatatttgcccagagggatttcgggcgaggagagggtgtttggcgcccacagtgtatgaacgaggctgacaggtagggcgcttgtatcacgtgtgagtgaagttacaaacctgcccctattgaaaatatgtcgacagatctatttcggccgaggagagtttgttttgccgcccaccgtgtatgaatggggaatggagggagaaacagaggtctttcggacgagcttgaatcaaatgagtttttctgccatgtttgacacccaccgtgtcggaatgggctcagaggtggtcgtgtcacgtctaattgaagttactaacctacccctatttagagtagtggaaattgggccgatggattgtccgtgtaatgggtagacagtaatttccatctcccaaacacttggcttcaggcagccgatgtgggagtggacattttgccgtttctttcgaaatttgggacaataagcatccacgtttaccctggcaactaaattcgaatccattttatattcctatatgaatc

SEQ ID NO: 9303 - DNA, 574 bp, Triticum aestivum
  unsure (1)..(574): unsure at all n locations
  Clone ID: PAT_TA_9303
ttcggcacgagggtccccttcgatttgccgtcgttctcaggnacggagacctagccgccgcctcctcccgcactcgctcgtccctcctcctcctctacgtctcctccacccaatccctaacccacgccgccgccgtctccttcaccagcccaccggaagcccgccgtccacttccccggcgtcgtcgccgtgtcctcgcgtgcacacggcaggaggagcgcccccaccctctcctctcctcctccccttatcaagagccaggacaaggagggccaccgtggccgagcaggtcaggtgttgcgtccagatcgccaaggagccgcctgcaaggtcggccatggcgtgactgagcagagcagcctcagcatggtccggttgctgcggattggtgagctatagaaggtacctcgtgtggcctggttgaggtaccatgcttgttgtggattgcagcctcatgtgtgcgtggagcacatcttgggtgttcagggtttaggcaaccccaacaactctggctccatcgtccctgagctcagccgtcttgtgaatctttagtacctggagctgtacaggaaca

SEQ ID NO: 9304 - DNA, 1512 bp, Triticum aestivum
  unsure (1)..(1512): unsure at all n locations
  Clone ID: PAT_TA_9304
gtcgacaagttggacgccctctgatgcctcggcgcgttccccggcgggcccttcgcggccgccccgcccggccgccgggcccccctggccttgtcgttcccccgggccgccggcctgccgctccggctgctccttcctcatattcatcctcgccacacgattcatcgggaggaagtacaagaagctcttctggctgtcggcgatctcgccgctgctctccgtcatcctgtccacggccgccgtctacgccaccaaggccgacaagcacggcgtcaagatcatccgcgaggtgcacgccggcctcaacccgagctccgtcaagcagatccagctcaacggcccctacaccaccgagtgcgccaagatcgccgtcatctgcgccgtcatcgcgctcaccgaagccattgccgtggggcgatctttcgccacgataagagggtacaagctcgacgggaacaaggagatgatcgccatgggcttctccaacgtcgccggatctctattcttcttgctacgtcgcaacaggctccttctcccggaccgccgtcaacttcagcgccggcgccaggtcgacggtgtccaacatcgtcatggccgccacggtgttcatcgccctggagttcttcatgaagctcctctactacacgcccatggcggtgctggcctccatcatcctctcggcgctcccggggctgatcgacatccgagaggcctgcaacatctggagggtcgacaagatggacttcctcatatgcctcggcgcgttcctcggcgtgctcttcgggtccgtcgagatcggcctcggagtcgcgcttgccatatcgtttgcaaagatcatcatccagtcactccggcctcaggtggaggttctgggcaggctgcaagggacaaacaccttctgcagcgtcaggcagtaccccgtggcgtgccggacaccggccgtgcaggtcatacgcatcgatacgtccttcctctgcttcatcaacgcgactttcatcaaagagaggatcatggaatgggtgagggcagaagtggacacatccaatgagaaggtcagggaaagggtgcactcagttgtccttgacatgtcaaatgtggtgaacattgacacttctggacttgtgggactggaggaaattcacaaggagctggcgtctctgggcatacagatggctattgccagcccaggatggcaggcaattcagaagatgaaagctggcacaccttgttgacaggataggggaagactggattttcctgacagtaggtgaagcaagtggaagggtgtctaactggcacacaagggcagtgctaccggagtggttgagtgtattgctagttaagaaataaacaccatttgctggtgggatttggtatcaagggggcacgttggctttgctccgcattccctttacaagctgtaccaaacgctacaccaaaaccccnacnaatngnccagnnttgtnntgntttnccnntnanaaaaacccaaagggncttttaaacttggga

SEQ ID NO: 9305 - DNA, 714 bp, Triticum aestivum
  Clone ID: PAT_TA_9305
cgtccgcggacgcgtgggatcatggaggagcagcagcgcctgagcggtgtgctgtgcgaatcaggtaaaccgaacgcgctcgccctggctgaggaggagctccaccatgatttcagcaagactgagccatcgaccccagtgttgacctcggagccctcattccgggacaaggccgttactgcaagtggtggtctggaaggaacagacgagctgctcaaggttctttcttcacatgatgactgcctctccttggaccatgagctttcgaccccggattccagttgtgttgccggttacctcctaaacagccccagagatagcaagagggcttgcatcagcaacagccttggccacggaaacagcgagttcacacttcctcacatcattccggagtcgagctcgggttccgatttgcaactgagaagctcggtgttctcatacggcacagggcgatctggttcatcggcggctctggatgccagtgaagatggttttaccaatggctcaggcagtgatgtttgattaggattcactagttgtatccatcagtcagtagagttattggtcttagaagagagttgatgatgtggaccatgtcttcgatgtgtgttgtattgcatcacttgtgtttattcagtcagaggttccataatattctaacagattgtaatgtaacgatctagagcttcatcaccggtgaaattgctgttattg

SEQ ID NO: 9306 - DNA, 691 bp, Triticum aestivum
  unsure (1)..(691): unsure at all n locations
  Clone ID: PAT_TA_9306
cgccgcccgccccccgcaggtatcacgccccccccttgattcctggcgccgctccgccttgccgcccccccagtccaggcgaaaacaggtttgcttttgtccccccaccgcgccctcgccctcgcctcaccgccacccgcaccgcccctctccctcggcctctgctccggcgaccgctccgcgtccccagccaccccccacctcgtccccactcgttacacccgccgccgggttccaccacccccgccagttcgtccacaccgtcgcgccgcccgtgcccccccgctaccacgcccaagattggatcccctctgccgcgattccgcagctccccacacacctggaggcataaggcagggcgattcagcctatccctgtccccaccgtttttgccaccgcattcttggcctcgcccttcctcgtgcgtgcccccccgcctctgtgaaaactccaatagcgatgctacatacgctctgggagagactctcaccgggacttaatcggagcagcggtgggttgccagtggtgggcagggcggtgcttactgggcggggcataatggggaagagattgctgtgaagnnncttcatcatttccaaggacttgatgatcagcaatttcaaaatgaattccgtcacctcagcaaggtctctcacaaaaatgttatacgnnnaattggctactgctatga

SEQ ID NO: 9307 - DNA, 532 bp, Triticum aestivum
  Clone ID: PAT_TA_9307
ggttcattaccgagccacgccaccgtgcggtgattcttcttccacttagacgtctccccttcctgttgctctttttccgttccggcatatcatagctccactatactagtcgccgtcgccgtcgccgctgcctgccagtccgatttgagtcgtctccggagctctgctgggttcctcatttgaacaagggtctctttcgatgcttattcttttccagccaattcttttcaacaagggtctctttcgatgtgatctccctgctggatgtttggctgtgtctccttgagaaacttggttatgcaacaatttggttgcaagttaattgtaatatatgctgttttgttttccaatcttgcatcaagttgttattttgggtcatatggatgttgaacagctcgaatcctgcaactgttgtgtacttggtttcaaattataggttctgtgagcaaaatagaatctagtggaatattgaatatatctgcaaaatgaaggctcttttttatttctgtgtttgaaaaaaaaaaaaaaaaaa

SEQ ID NO: 9308 - DNA, 560 bp, Triticum aestivum
  Clone ID: PAT_TA_9308
ccacgcgtccggacggcacgaccctccgagggcgtccgccgtccgcccacgcgtccgcgatggcgtccctcgccgccttgcaccctaacctcccccacgcccacggccacccctcccatcccaaccccaccagcggcctcctccgtctcctgccttcatgccgccgccatcgtgcccctcgccggcggggcctaggcctcgccgtctccgcctgcgcctcctccgccgcgtcaccgtctgccgccgggcgaggcgatcgctccgaagcagcctcttcgctcgagcgttgcctcgcggcgtccgccctcagcgccgcggcacccgcggctgcgcctccccgcgtaccgccggcgatgaagggcgggaagcagtacggcgcgttcggcgccgtcacgctcgagaaggccaagcttgacctatcccaacgcaagaagaaaatcatgcccgagctggcgacaggtggtggtggtggagatattgggaagagaattggccatggtggtggcgatggcggggatgatgaccgagatgatgacaattactttgatgattttgatgat

SEQ ID NO: 9309 - DNA, 812 bp, Triticum aestivum
  unsure (1)..(812): unsure at all n locations
  Clone ID: PAT_TA_9309
gtaatcatttcttcatgtatatcatgtttcacttccttctacatgatgaggtggaaagaatacttccccggtaaagaactagtgcagtcaccacacttccaagtagaagttttctgttacccagaaccaaggatcgtttgtgattatttgtcctggaggcaatcagaatgtcacaacagaaatcaatacactacatgcttttggatgttggtgaaatctggagaaggcgaaaacaaagctaaggagatactgaaggacacattaccaaaggacaagaatgagttactttttcagcgatttcaaatgaactacaacaatgaaccggctatgtttcgaaagggttcgtgcgcttaccgtcaaaaggtggaagccagtgaagatgagcggtgggatgtggcggtggcccacgtagacatggggccacacttttgggcaaagcattcttatgttttcgacagaagatgatccttatgtattctagtaggttgatttgcttagtgtgtgccagattatcctcctcgtttctctgatgcatacatatttcgtgcaaggcccgcttgtcacggctgcctctcccggccccggcgttcccttctcggccgtgcgttgccggccgcacctcgtccgggacggagctgaacggntcaaaantggnaaaaagggggaaanggcaagtgggnccgcgtaatcaagnacgcgttgcgtgtgttggcctgcctgccgcgggtattaactangcgtggctgaaaaagtggtatcnaaaattattgtacaacattgattaaanaaactgtcttcccaaaaaaaaaaaa

SEQ ID NO: 9310 - DNA, 567 bp, Triticum aestivum
  Clone ID: PAT_TA_9310
cgtccgcccacgcgtccgcggacgcgtggggtcgccgtcgcacgcgccgccggccgcgccgcgagcccggtttccccacgccccgcggcatggcgcgcaacaaggaggggctggttctgctgctggatgtcggcccgtcgatgcaccgggcgctgcaggaggtcgagaacgtctgcaccaccctcgtgcgcaagaagctggtttttcataggagcgacgaggttggcgttgtcctgtttggaactaaagaaacacacaatgacctcgcgagggaacttgggggctataagcatgtgctggttaagcacgatattaaagttgttgacgaagaaacaaaagatgcccttgaaaatcttcctaagggaactgcccctggtgactttctggatgctattgttgttggtttggatatgctgataaagagattcggagataccaaagcaaagcaacgtctgtgtctaatcaccgacgcacaacatctgctaagggatccgccccaagggacaaaagaagatcaggtggacactattgcagaccagatgaaaaaacatgatattaagatggact

SEQ ID NO: 9311 - DNA, 907 bp, Triticum aestivum
  unsure (1)..(907): unsure at all n locations
  Clone ID: PAT_TA_9311
cattgctcttggctgccgactgcgccttcttcctgtcgccaacatccaagaaagcttctgctcttctctcagtaagcttctgcggacaaggcggccggaggaagccgagccacacgcggagcgcagccttgattgcttcacccatggacggctgaccctacaacagctcgaggtttctcgccgacgcacgcggccggccatggagagggcctggagatcgggggcgctgtcggagacggcgtcctgcgccgacacgcccaggtccgcccactcctcctgcaatctccagcatcgacactcacagagcatgctgaggacacgtgaggctgcagtggacatgtcgccgcgattctcctactgcaagcctaccatcaaccgggacagcaagatgctccacagaaggcactcgcttaacttgccagagcagtcgttgcctggccgtcactccaggaaaacaacggaaaggactcagaaggccacttcaaagtccatcgcagatttagctggggagatcgcggccctccgagcaggaagtcatccgcaaggaactgcatctgctgaccctctacagaagggcatttgattaagcagctatccgattcctgcagttttgttgagcgagcaagtggatntaagaagcaactaaaagtattgatgaaggcgcgctcccgtctaaagagatatcaagcaatcctgcagccttcaatttgccaactgnccccagatccnaagaatgangtatcgtcaagaccggcttcnaagcatccaacctaangnacttcttgaangtccaatttaanactagtncccaagatncctngcaaactatcaaanggaancctccggtgcattgctncggtcaacggaaaanttcaacaagcanctcagatccgatccgtgactnaca

SEQ ID NO: 9312 - DNA, 803 bp, Triticum aestivum
  unsure (1)..(803): unsure at all n locations
  Clone ID: PAT_TA_9312
gggtcgacggggggttctacacctcactcggcaagctaatcggaggagcaaaatcatccgttgcagagatcgtcggtgcagcattttccaggaagaagcgcccaaacgtccaccaataccagcagggcagagcaagcccctggccagtgcaagaaagctacgccatcccgcgtgatgagacgcctccggtggtggacacgaggacaccgacccctcgcaagaactacgctttcatgtccaaggagccggagaagatccaccacatccggcagggccgggccccatacaacggctggaacaacggagaatcgcctcagcagcagcaacagcagcaacagcaggtgcatcaccagcagtacctgcagcacaacaggcagtactccctggggccgcagacgttctacgagccgagctgcgaggcgacgaacgagatcgtcttcggggcggtgcaggaggtggacagcgcgcgccgcgccgtggagatcaagccggtgaaccactgcgacgcggcggcctacgagcagagcgggctgcgctaccgcagcggcggctacatgggctagacagacagctaaacgcaggctgttgttcctcctttcccagttacatggttagatttcggtattttgccgcctctgttgtactacctgtaagtctgtgacaaggagagaaatggagcagcagctccaggttgaatcgtggatggaagggaaagctgggtttttgctagtagaaggtggtgatncttggactaatatatcaccgaggaatatatgttatatgtatgtagatgaaaaaaaaaa

SEQ ID NO: 9313 - DNA, 736 bp, Triticum aestivum
  Clone ID: PAT_TA_9313
cgtccggcccagccagctagctagcccgcctgccatgcgcgccggatccgcggctgggatctgagggacgatggcggtggcggaggtgaggacgcccaggcggcgccacgggagcatggcgctcgccgacctgctgctgcgggaggcgtcggcggagcgggccgacgcggcggggggcgagcggcccggcgtcgccgcgggccaagccgcgcgggccagaccgggcgaggactacgcgctgctcaagcagggctgcgagcgccacccgggcgcatccttctccgcattcgccatgttcgacggccacaacggggccgccgccgcggtgtacgccaaggagaggctcctcgccaatgtgctcggctgcgtccccgcccacctcaccagggacgagtggctcgccgcgctgcccagggcgctcgtcgccggcttcgtcaagaccgacaaggatttccagacaagagcgcactcttcggggacaaccgtcacgctcgtcataatcgacggctccgttgtgactgccgcatctgtcggtgattctcgatgtgttcttgaagcagagggttcgatttactacttgtcggctgatcatcgttttgatgctagcggggaggaagttggacgtgtaacagaatgtggaggtgaagttggcagactaaatattgttggtggagctgagattggcccccttagatgttggccaggaggtttatgcctatcaagatcaattggcgat

SEQ ID NO: 9314 - DNA, 933 bp, Triticum aestivum
  Clone ID: PAT_TA_9314
ggcctactgcctactaagcctgggggacagcatcactaccgaccacatctctccctcgggggtcatcaagccaggaacccctgccgccaagtatctgctggagcgcggcgtgaagcctgagaacttcaccacatatggcagccgacgtgccaacgacgagatcgttgtgaggggggcgtttgccaacattaggattgtgaacaagcttttggagggagaggtggggcctaaaactgtccatgtccctacgggggagaagcattacgttttcgacgctgccatgaaatacaagtcggagggtcatgacatggtcattcttgccggtgatgagtatggagccgggagctcgcgtgatagcgccgccaaggggccattgctcctgggcgtcaaggcagtgatcgctaagggcttcgagcgcatccaccggagtaacttggtggggatggggatcatccctctccgcttcaaggctggcgaggatgcagattcactcaacctcagtgggcatgagcgtttcacgatcgacctccctcgcaagattaccgagatccgtccaggccaagatgtgaccgttacgacacaaaatgggaaatccttcacttgcacactttgcattaacacgcaggtggagctggaatactttaaccatggaggcatcctcccctaccttatccgcaaattggcatgaccgaccgaggaactgcatttaaattgtgttatctatatgcaatgtcatgattttttttataaattgattatttgtaccccttgattccgttttaactttcattttttaataaatttgtgatgaaacatttaaaaagacatagccggagcttcaacaataattaagaggggacaatttacttgatagtgtgttgataatttattagtgaagacatatgtttgtttggcgtaaaaaaaaaggggggg

SEQ ID NO: 9315 - DNA, 1482 bp, Triticum aestivum
  Clone ID: PAT_TA_9315
cgtacgcggacgcgtgcgcccgactctctctatacacacgaggccacacacccaaacaacacacgcacacacacacacacacccttccgatcttacatttgctctgagaaatcagataggaatcctgcaccggcgagaaagaaaccccgagcagatagagatggaggccgtgcatgagggcaatggaggagggagcggcctggtggtgacggagctgagccacatcaaggagctggtgaagcagctggacgtgcacctggggggctcgcccgacctctgcaagctactcgcccagcagatcttcgccgtcaccgagaggtccatcggcatgatcaggtccggccacttcaacggccccaagcgcccggccgccggcgccggcctcgactcgccgccgctgtcccccacgcccagccccctcagcggcgtctccaacacgcccttcaagcccaacaagaagaggaagacgtcggagaaaggggggcgtcagatcagggtgagctcggcggcgggaggggcggacgcccccgccgacgacggccgcagctggaggaagtacggccagaaggacatcctcggagcccagcacccaagggcgtactaccgttgcacgtaccaaaagactcagggatgcgcggcgacgaagcaggtgcagcgcgccgacgaggacccggcgctcttcgacgtgatctaccacggcgagcacacctgcgtccataagacggcggcggcggcggtgcagccggccgggcagaacccgggcgcggaaagccttctgcagagcctgagctcgagcctgacggtgaagaccgaggggctcacggcggcgggagcgcagggctggagcgccaccacgcccttcagcttctcctcgccggccgtgagcggcatgacgccgccggagcagcagcaccacccgttctccacgccgtcgacgccggagaactgcttcgtgtcgatgcccacgtcgctcgaaccctcgccggcgacctcgggctcgaaccacatgtgcatgaccccgttccatgcgcagtccgagctccaaacaatggtgtcagcgctcgtggaggcgacgagcatgccggcggccggcacggaggaggccgccttctccacatgccggtccgacgggaccgccgtcgacgctgccttcgacgtcgacaacttcgacgtttctgccttgcacgtcaataacttcgacgtttctgtcttcttggcatgagatgtttgaaaagagaagatgaggagtagaaattagagaagcagctggaggtgaccaccctctgagggacagaggagggaagaacacgccagttcttcctcagtgcaggtctgaaatttaggacataagattattgcctcccccttcaccccaattcttttttccccatttcctttttgccaccagggcgtcgcattgtattatattgttatgtcaaggaaaataaaaatctgtcattggtgttcaaaaaaaaaaaaaaa

SEQ ID NO: 9316 - DNA, 243 bp, Triticum aestivum
  Clone ID: PAT_TA_9316
ggagagagagagagagagacgtgggtgattttgaatttgaatttctgagaaggattgaggaagacgatcgcggggaagacgatcgcaggggtagaaacgtccttctgacagaaatcggtgctgtcggaattttgaaaatgctcctacatttcaggacggagtgattgagtgttggggacactatcatttgaagcacaagagcaaggagttcatcatcaacaacaccatctattaaaaaaaaaa

SEQ ID NO: 9317 - DNA, 1594 bp, Triticum aestivum
  Clone ID: PAT_TA_9317
cgtcggcagctataggcagcgccaacacgagctaagcgcgtctccgcgcctgcggcgccgcggctccggcgtctgtgcccgccctcgtcagggcgcgcctcgcgaggcccgcctccgcctccgccgtcgcctcctcctccgccctggaagagctcgccgccgaccgcaaaggtttggcgagggtggtactaaagaagggcaagactcagatattccgagatgggagtccaatggtctacagtggtgcggttgatagaataattggccgacctcccccaaaaactggtgatgttgttttggtagctgatgggtcagagaaacctatcgggtggggtgtctataactccgtgtctatgttttgtgttcggctaatgcaactagaagaagaggcaaaaagagatccagcctctgcactaaatatggaaagactgctcgaagaaagactttgttctgcggtggatttacggcgtagtttgggtttcccctcaactaatacaaatgcttaccgtctcatcaatagtgaaggcgacagattatctggtctgatagtggatatatttgctgatgttgctgtgattgcttcatctgctgcttgggttgagaaatataggcaacaaatccagtcccttgttagcaaagttagtgatgttaaacatataaagtggaggtcatcaactgatattctaaaagaggaaggattagatatgtcagaacaaaaagaacctgcaccctcttcatactctggaactgtgaaggttatggaaaatggcatcgtctatctagtctctatggaggggcagaagacaggtttttatgcagatcaacgggaaagtcgccacttcatatccacactctcgaaggaccagagggttcttgacctttgctgttacagtggtggttttgcgcttagtgcagccaagggcggtgcaactaatgttactggcattgattcatcaggatctgcactagatcttgccaatgagaatattcttctgaataagcttgatgctgagagaatttcgttcttaaaagaagatgcaactgcattcatgaaaggtgctatctcaagaaatgagctgtgggacttggtaatcctggatcctccaaagttggcacctcggaagaaggtgctacaaagtgcatccggtatgtacagaagcctgaatgctcttgcaatgcaagtggtaaagccaggggggttactcatgacatgctcttgttctggagctatgacccaaagtggtctcttccttaaaaccattcagggtgctgcatcaatggccggtcgaaaggttacagttttacgtcaagcaggagcagcttgcgatcatcccatcgacccttcatatcctgaaggccagtatctcagcaattacttactccgagtaatgtgaaggagcagacaaaacattctactgaccagtaaccatttctgaagagctgatttctgaagttgtgcctctagtttgatgccctattttagtcataaaggttaggtgtagaaattttccgaacaagaacatatgtatcttgtaacccttcaaagattatcttatcagcgtatattgcagatcattattctttatggagtttc

SEQ ID NO: 9318 - DNA, 593 bp, Triticum aestivum
  unsure (1)..(593): unsure at all n locations
  Clone ID: PAT_TA_9318
cggtagttnggaacagcattggtatttgcacagcccactgaggatgcaccatttgcgcttttgcacatatctctggactacttgtgaagttgtgatgcgtccacaacaatccagcatccttacaaacagcaatgttttacattgttttgcaaagttgacactgtaagacagatcaattttctcccacttgctgtcgcctgtagatcctccatctcagaaaaaaataagcaattcttataataaaaaaggttagcaaaccgaagaacgtagaaattgacacatctgttacactgttctagatcttgaaacattcccagatcaaacaatctactcccgcttaacctttgatcccacttggcgacatggatgcagcaagacatggatgcatagaagccagcagggaagatggacaagaaacagatacagatatgtggcgctactccattcccacaagaactccattgacgcccagaaatctccaaggtctaccgtccaggaccccttggacagccctttcataatcaacaatgcaataccatcaggttcatgtttaacaccacccacaaacatagggttatggtactgatttaacc

SEQ ID NO: 9319 - DNA, 955 bp, Triticum aestivum
  Clone ID: PAT_TA_9319
ttttttttttatatttatgcacagggacagccacagcctcaatggccttttttttcaagttggcgaatcgtcaagctaagtccgatgttcatttatgttgttttgatttctttaggagctttgataaacatacgctacgttatgactttatgctgaaagctggcgcaagtgacctcctgatcctcctggatcctgtttgcaatcctacctcctcgtctcctcggagagcatgttcttgaaccacaaggctgagtccttggggtacctcttcagagtattgaagtccacgtagacgatgccgaaacgggcagtgtagccgagtctccactcgaagttgtcaagcagagaccaagcaaagtatccaaccactcgggcgccattgtctatcgccttcttgagctcggttatgtagtctctgtagtaccggatcctgattgtgtcgtgaacaccgtcagcgatgctgacgttgcccggctggtccattccgttttcagaaagtatcatcgtaggatttccatatctttctttaacataggtcacagccttgttcattccccatggcacaatgtaaagccagtcggagtttgcacgaggtccaataggcacaccatttcgttcatagacaaatccaacatgccaatcatcctggtaactgaccggcgtctggttccacgccccagggtccttcatgtagtaagaagtgtactggttgataccaacatagtcaatggagcctttcaccatcctggcctcgtcggcactgaagcccggcaacctgttcccgacaatcttgagcatcgacgatggatagcgtccattggttatggggtcaaggaaccatccaatgtggaagtcccttgccctctgcgccgcaccttgatccgcgttgctgtcgctgtgaggttcgtaccacacgaaatccaggagaatcccaatcctccccttctgctgaggc

SEQ ID NO: 9320 - DNA, 643 bp, Triticum aestivum
  Clone ID: PAT_TA_9320
taccgggccccccctttttacgcaaatccgtcaaacggacggccccatgcattgcattactacaaaggaatctattacatccatcttggtttcttgaagacaaactaagctagctttagtggtatctaggaactccttaaccgccttccttttcgccggattgttcaaccctcgcacgttccagcatacaatagatgggtgtgtatccatggaaccataagcactccaacgccttgacacaacgcggctcaccgagcctccaccatcacccttgtctcctcttccatctcaaaggatggcaccggcttgccaaacaaagccgcaatgatccgaacatgttgatcacgcaaaggcgagtcgaataggtccttgagctcttgcacatcttcctcatgaggcactagattagccgggactaatccaagcgcccgcagtagcacattttcagccggggtggctttcgtcactgacactgttgaagatctctttgaggctctcgtggtgcgcctaggagtgcatggctctggctccaaccttagcgccgaggcctggacttccttgagcagaggtggggcgagtcgcttcacaatgttggagcaaaaggtcttgagtttggcgaacgctgctgcctcttgtcttgtca

SEQ ID NO: 9321 - DNA, 891 bp, Triticum aestivum
  unsure (1)..(891): unsure at all n locations
  Clone ID: PAT_TA_9321
agatatacattngaccgattcatgccatataatttccatccataaataaatttcaagtaaacatagtggcaagcaaatatacaccaaattctcagcaaatcaccagtacaacaaatttcccagaaaaatcagcatttaggttctgaagtacggattctagaacatgcatgcatgcctagatccagcatgcatcccttctataaagctagccattggcatactcccgaaataaagatcgggcatgcattgcttcttccaacttcatcctggagctcgcgacgaaacatgaatagacgccaccatcacgacacaagtcagagatctccccggcaatgccctgcttctccaggtcactcaaggctgaaccaactccatgtgtctcaaattttcgtcaacatgaagctacttcagtccttctatagcaatcacagactctcctgctcctgtcaatcttcagtacaacctcttcaaaccactactaaacattcactttggtctttgcgctgcattccagatagacatccatactccttggcaaggtcaatgccttccttcttggtgacagccctctcgctcccctacagtccaatggccatcttctccatggacatcttttacatcagtgttaggtgctatattcaaactgtgctgcagtttagttgagttcgcaagtaggactacagtggattcccctgtagctacagacacccagcagcagcagcaataggtagtagaataagaggtcagagactcccacggaaatgacaactccttccgagcggagcaagaattccccttttgattgaacttggtgacggggacgttgtgagcgcaatcgggccgcaggtagagccgcttcaccggacgctgcgttggctgggaacccgtctt

SEQ ID NO: 9322 - DNA, 1549 bp, Triticum aestivum
  unsure (1)..(1549): unsure at all n locations
  Clone ID: PAT_TA_9322
cggaattttcccgggtgcgnnacccacgcgtcccgcacttttcccccactttcaagggccccaagtgccgcccctccctcctccctcctcgccggagaagcttccttcttccgccgacggccggcgctgcgatggcgtgatatggatcttgtcaccgtggattgatttgattggatgattgggttttctctggttggcggggagcagcagcagcagcagcagagaggatgagcttcagcgttgcgggcatggagaaggagcgcggcgcggcggcggcggtggaggagatccggcggctgccggcggaggtcaactgggagatgctcgacaagtcccgcttcttcgtcctcggcgcggccctcttctcgggcgtctccgccgcgctctacccggccgtcgtcgtcaagacgcacctgcaggtggccccgcccccgcaggccgccgtcggcaccgtcagggccatcctcggccgcgacggactccggggcttgtaccgcggcttcggcgcctcgctggccggcaccgtccccgcgcgcgcgctctacatggncgcgctcgaggccaccaagagctccgtcgggtccgccgcgctgcggttcggcgtctccgagcccgcggcgtcggcggtcgcctcggccgcggcgggggtctccgccgccgtcgccgcgcaggtcgtttggacccccgtggatgtcatcagcacgaggctggccccctccgccgccagccccgtcgccacctaggacctcctcaggaagatcctcgcgaccgacggcgtccgcggcctgtaccgcggcttcggcctctccatcatcacctacgcgccgtccaacgcggtttggtgggcgtcctacgccatggcgcagcgcttcgcgtggcgcgtcgtgggcgccgaccgctccgagagctacccggccctgatggccgtgcaaggcgccagcgccgtcctggccgggggcgcggcggccctggtgaccatgccgctggacaccgtgaagacgcggctccaggtgatggagacggacgcggcggtggcgcgggcaacgctggggagcaccgtgcggggcctgctcaaggagggcgggtgggccgcgtgctaccgcgggctggggccgaggtggggctccatgtcgctctcggccgccaccatggtcaccacctacgagctcctgaagcggatgtcggccaaggagggctccctgggctagatcgatccttctcaccactaccattagcgtcgtcgttcaccaggtgactcaaaccaaggtagcctcgaagcgagatcgatccgtgaaggtgctgcccggccggtctcaattagttaggtttcttgtacatatgctcaagatcttttgcttcatttctcgtttgggttcgtcgatctggtgctatagaggggtggatggcgaagaacaagcactagaaggtggatggggttttaggatgccaggttttgctggttttatgcccgtggtggcggcggcgccgccgccgccgatgatgatgatgaaaaattagctgaagtaaaagattttcagtctgaacttct

SEQ ID NO: 9323 - DNA, 558 bp, Triticum aestivum
  unsure (1)..(558): unsure at all n locations
  Clone ID: PAT_TA_9323
ttgtccatatgcagaggccnggggtcctcntccatttaagaaaaaaaaaacagcccactacatatttcattatcctttccttccgttcctccggttcttttagaatcacgggcccactggaccgggcggctgttcgcagcccccgcgaaaatggtgaaaagaaagggagatggcgggcatccatcctttgtttctttcaacggccctttactcttctgtatcttgtgtgcaacactcacttggaggagccacgttggagctccgtttgaactagggagggaggctactgttggtgttgggtggaggggctggaagaggatgcgggcgtagaggaactggttccaggtgtcggccaggcccggcaggcaccagtggatgcagtcggcgtacgtcttggggttggcctgctgctccggcgtgagcagcttcccctgccggagcgtgtgcaccgacgtgtgcgcgtccttgcggagctccgacagcgccgtgatgtcgacgaagtgcaccggcacgcgccggaacgtcttgagcacgtcctgggcgcccgcgtagaggcgc

SEQ ID NO: 9324 - DNA, 690 bp, Triticum aestivum
  unsure (1)..(690): unsure at all n locations
  Clone ID: PAT_TA_9324
ttttttntttgtntttttcaaacatcaaaatacattcaacttcctttttgtatatcgattatttacattgtgcacacaatcataaaatgagactgccagcccaagctttctcatgcttactaccatggcaaattcatatctaaagcacaacagcaaagatctctgtaatttatggtatatgatgactaaatcctcatttttctgtcttctatctgtcatcttatgctggtatgcctaactttgaaccaaaaagccctcgtaggataggatatgccccatgctcacaaactgaagatgcaaaaccctacctcaacttggaaaagaacctgaccgcttgatatgatcaagggtacctctcaagccatatcgttcaactgctcgaatgccagctcgaaacccatctccatatattgcagaggggtctgtttcgatctggtgcttgaagaattctccaagttttttctcaaagtcagtcttttcaccctttttcaccaaggaagatggtgaagaaggtgtcgctgttgcttctgctgctactgctgcttctgctgctacagctgctgcttcagatgtggttgcaatgctactacttgaacctgatacgatttcagactcaagccagagatgagctaggacctgacagatgccttcttcaacctctggactacggattcggtatcctttaagccg

SEQ ID NO: 9325 - DNA, 1572 bp, Triticum aestivum
  Clone ID: PAT_TA_9325
tcaacagggcaagttgaaggggaattcgtgtagaagtcccacatatctattacctggggagggctggtaattgagatggagaaagggaattagagttaaactcccattccccttccattagtttgccaaacaggctgtcagtttcggctctcgtccctcccctcccactccggtcccgtcctcatcgctgttcgtcaagtgctatgtttttcttcactatcaaaaccaatcaactgaagagcagctttgtatagcctgatggctgtggagagagacatctttggtatctcagggccgacatatcttaatcctgttaattggaactgcgagaataataggagatctgtggctgcatgtttagttcaaggccgtgtatgttttgggagagagaccggcaactaaacccgttaatccgttgacgcccgcagcaccctccctggtggggagttccttccaattttgagatgatccgcaaagcttgtcgatgatgttgacttgtctatattcggtgcaatatttgaattcaaccctccttcaagtaaagaagcttctgcccaggatgcccctagatttatcattgccttcagaggcaccataactgagaaggaaactatttctagagatctttcccttgacctccagctcgttcaaaatggtctccataagacctcaagatttgcaattgcgatgcaagctgttcaaaatgtagcctcagctttccctggatccccaatttggctagctggtcattcactgggtgcaggtacggccatccttactggcagaaacatggttaagaagggcgctcttttggatagttttctcttcaatccaccgtttgtcgctgctccgatagagggaatcagggatgagagggtaaagcatggtttccgcattgcaagaagtgttattaccgcgggactaactattgcaatgaaagcaaaaaccgaggggaacaatcagaggtctgttgcggaagaatcattcaacattttgtcatcatggacgccatatctgtttgttaatccaggagaccatgtatgttcagagtacattgggtacttccagcatcgtaggaacatggaggatctcggtgctggatttattgagaagcttgcgacccaaaactcaatcggagacctgttttacaaggcattaggatgggaatcagaaccgctgcaccttcttccatctgcagacttgattgtaaacgtgagcccttcaccggacttcaaatatgcccatggcattagccaatggtggcaaccggatctgaacttgcaatgcaataaatatcggtactcttaggtacgcgatggtaaaatgaagatggaagatatcttcgcagtatcatatactccagctgtccgtttgatctctccatttgttcatatgattcattcagtttacatttatcagttactatactgtgacatactatcacttaacacctatgtttatgactgcactgtcggcctgcacaaaatctgttactttccgccgcaggcccacgcacctcacccttctggtaccccggtgttttgcttttccgcatgctgtgtgtcattgaac

SEQ ID NO: 9326 - DNA, 818 bp, Triticum aestivum
  Clone ID: PAT_TA_9326
ccgggggcctggggccaaaaaaggaataatacaccagtcagtacactttctctgcgagacaactatatcggacccgacgcaaataagaaactcagacaaaattacgcctgcggatacgcgcccttgtttgttccttttttcgccccctgagcccatgcggtctgctacaacatgtgccaacccaccagggctctctccctgccgactcacccacctcgcaaccgacgcaatttagttgcgcggctcctcttcactccccctgactcgctcttcgctggtccgcctcccgccccatgtgcgcccgctcgctgcgacagcttcggcccccccacctgggcttgccccctcgcgaccgtcccccccggcgtgcccatccacatgaccgtcccgctcctcgcccctgcccttgtattgagcttggcatgccaacctccagatagatatatgtcctgtgggtgtgacagcttcgatgttggaacatgcgtgtggcccttcgcgccccccatgctgcccagcgtgcccttccccccctcattcccggaccttccaccagctgggattgccgccttctgctgcactgtgcctcggcgaccccccctctgcttcgctccggcaggctgggcagccggagcaccaaatactggagcgccccccgtgctgcccggcggcccgttcccgcccgcggcctctaagctaccaccagttgggaatgccgggttctgctgcaccgagccttgttgaccgccaaactggaaagctccggcaggctgggcagcccgagcaccaaatactggagtggccggtgaactagctggctg

SEQ ID NO: 9327 - DNA, 2219 bp, Triticum aestivum
  Clone ID: PAT_TA_9327
cgtccgttccaatactataacggagtcattcgagcatcttatcaatctacgccagaatcgaccggctgaattgatcgcaaagtttctcgatgagaaacttctagctggaaataaaggtacttcagaagaagaattggagggaatactcgacaaagttttggttctgttccgatttatacaaggaaaagatgtatttgaggcattctacaagaaggatctagctaagaggctgctgctgggaaagagcgcatctatagatgcggagaaatcaatgattacaaagcttaaaactgagtgcggaagtcaatttaccaacaaactggagggaatgttcaaggacattgaattatccaaagaaataaatgattctttcaagcaatcatctcaggcaaggacaaagcttccaactggcattgaaatgagtgtacatgtgcttacaacaggctactggccgacatatccaccgatggatgtgaagctcccacatgaactcaatgtgtatcaggatatatttaaagagttctatttgagcaagtacagtggaaggcgtctaatgtggcagaactctttgggtcattgtgtattaaaagtagagttccccaaaggtagaaaggaacttgcagtgtcattatttcagagtgtagtcctgatgttgttcaacgatgcacaaaagctaagctttgtcgacataagggcagtccctctcccgcagccatccccacctcctcacacggggactgccagcggtcggctaaagcgccgacttagttgacacctttgatgcccgcgccagcgcattagcgaggatgtagaggaggacatgtagttgggtcccttacttctgggatgaatggcatcggtgcgtagaaccgtggaagcggcttttgccatgaatgaagaactctgcaatagtgccttggagccagtcgtgcgtcatcgccatcttcgcccgcaacgaccgtctgaatttatctcattgtgtctttgactataactatccgcatgaatcagcgtcaccaatcaacgccgtggccatagtagtatacgcacaccaaggggtactctgcgctttttttcttttgacgctgaattggtttccgtttctagttatggctcctgtaacatattaccatgtgaagctgtatatgaatcggaaacatcttatagatgttactgagatattccgacagttacatggagagaagaagtacaggatgatcaagcttgccttctacttcgcattatttattatatccatttacaggcttgtcatgacggctgtgctactatttattgatgaggatgtgaatctggtagaaactaggactatttagagcttgtcatcaacatctcacatgtggccagggaatcccaatgatgcagttggttaacttgtcgcacacatgtttcgacatctggctcctaatgaacacttaacacgaggaaccggtgagagtacattccagtcttccagaaattctgaaacaagacggttcatttgtacggtaggagcttatctggtgcctgggtgttgattgcaaccatcaggcagaactgaccttgtgctgtacattgtaatttcatgcgttttggttggtattgaggataaagaattgagaagaacactgcagtcacttgcatgtggcaaagttagggttctccaaaagacaccaaaaggacgagatatagatgataaggacgaattcgtatttaatgaagattttagtgctcccctttatcgcataaaggtgaatgcaattcagatgaaggaaacagtagaagaaaacacaagcaccactgagagagtatttcaagatcgtcagtatcaggttgatgcagccatagttcgaattatgaagacgaggaaaactctcagccacacccttctaataactgagcttttccagcagctcaagttcccgattaagccagcggatatgaagaagagaatagagagcctaatcgacagggagtacctggagagagaccggagtaacccccagatatacaattatctggcttgacagaagcatttccgtgaaagagatggtcatgttaattttattttattgtcagaaacacactgtgtaaagtaattgcgtattgctgttccttggtctctctctttgggagttgtagcagttgcatcttttctgtatacgaacgagttttggatataaaagttgggcatcatgcgtacatgaaaaaaaaaaaaaaaa

SEQ ID NO: 9328 - DNA, 709 bp, Triticum aestivum
  Clone ID: PAT_TA_9328
aaaatttgtctagttgaaaaatgagaatgcactatcctgaaggaaaatagacatgggtgatctggacataatttagagttacaattaaggaaaataaaacgatttttgtggtaccacaaaactacagtgatctgacctctccgacaacgtgcgcgggcatgcagcactcatcaaatgttttatttactccctattggcccctcacctcctccgtggtgctcgctagagggagcaaatatggcactcatgaacctgcatcagaccacctgatagttacaggaaaccagaattttcaataaccatgtgctgagcaagtcggagcaggggagcatcctcttgcaggccaagatggcggtcagcaaggtccgagcccaacacgacatcatcgtctcctgcaatggacatagacggaggagccgcatcaagcgcctccggcgagtgctccttgcccaacgcctctgccgcgccgctcctgggtcaaactgatggcacgcactggatggcccggggattccttacagcctctgctaccctagacgggtcaacttcaagcacaaattcatcatgcacctgcaaaaggtgacaacgccctctgatttgttaaaagttctgcgttagcccatccatagaatcaagtgtgttactcccattggtaattacagaatgactgttaagcatagccaccttgataatatcagcagcagaaccc

SEQ ID NO: 9329 - DNA, 802 bp, Triticum aestivum
  Clone ID: PAT_TA_9329
gggctcaatgcgacacccaaaacaatttgcatttcagtgctgccactcaaagcaactactagcaggcaaggccgaaatggagcaggagaatcaaattctttccggtagcagcggcaagttagctgctcagtcaagaatgttgctgggccttacttagacaagaggaaatagtcaaggcatgcaacatatatacatgattacatgctactgaatcctgatccctcccctcgcccctcctcaaatccaccccaatgcctaccctaagcagctaccataattttgcctctcgtgctcccttcctcattttccaatacagtaagaacacaaggtcccaagtacaaaatacaatccgcgccgcaagtaacattcctagctcacctatcatcgctggttaagccctgattatagcggccatatcctcttccgatgacgtttcaggtctgacaatctcttcaggcgaatcgtccagcagatcgtcctcagcctccggctttctaggcggctcagtttggatcaatctccttagctccatctccagttcttccgcaacactctcattttttgtaaggaaagctttaacggcatctttaccatggaactgctgttcgttgaaagagtagtacgcgcccccggtcttcttaacaagcttgtgctttaccccaagatcgaaaagctctgagctgcggcatattccttttccaaattccagctcaaactgtgcagtcctgaacggtggggcatgcttgtttttcacaatcttcacagtaacctgacttcctatcggccccgcgcctttctttac

SEQ ID NO: 9330 - DNA, 1686 bp, Triticum aestivum
  Clone ID: PAT_TA_9330
ctcgtgccgaattcggcacgatgaaccgggcaccgaggccacccacggctcggcgcagcggcgtgcgataagggagaccgcccccgcgtccgcgcgaacctctccggtgaggggacggggacgacaaggccggcaagattcgaggggccggcggaaccaagcggaaggcagcagagtcgtcgtccacgcggggcggccgccggcggacggagccggcagctccggcgcccaaggagatgggggtcgactactacaacgcgcgtccgcgtcgaccgcggcgccagcgacgacgacctcaagaaggcctaccgcaagctcgccatgcgggggcacccagacaagaaccccaccaccaagaaggaggcggaggccaagttcaagcagatctccgaggcgtacgaggtccttagcgacttccagaaacgcacaatatatgaccagctaggggaagaagggctcaagggacagccgcctccaggggcaggaggtcctggtgcatcttctttctaccctggtggtggccagtcaacctcatttcacttcaatccgaggagtgcggatgatatatttgctgagttttttggattttctgggccttccttcctgggtggcatgccgggtggcagcatgaggggggaaccaagatcttatggtgggggcgtgtttagcaacgagtatctcgctaagcgatttgcagagggttctgccggcaatatgccgcgcccatcacacaaaccagcacccattgagaatcagctttcagtgacccttgcggatttgtataagggtgtggccaaaaagatgaaaatctcaagagaggtcatagagaccagtgggagagtttcacaggtagaagaaattctgacgatagatgtgaagcccggttggaagaaggggacaaagatcaccttccctgaaaagggaaatgaatctccaagcatgatgcctgctgatattgtcttcatcattgaagagaagccccatgatgttttcaccagggaaggaaacgatcttgtcatgacacagaagatctccttggtggaagcattgactggctataccgtgcaactcacaacgctcgacgggcggagcttgtctagacaagttaactcggtaatccaccctagctatgaagaggtgatccctggagaggggatgccaatacccaaggagccctgtaagaagggaaatctgcgcgttaagttcagcatcaagttcccttccaggctgacatctgaccagaaagctgggatcaaaaggctgttgggttcttagccctgtgtgccattttctatagactgatgaaagcgactgtgaatatctccagcatgtggctaggtagatttctatctgtccggtttggacaatgagcggaattggtcttggttattccgtttacatacctgtagaaatgatgttgtcattctatgtgttgtttttccccataacttggtagaggctttttcacatatgtgaccaggctggttgtttgtcaatgttttaatctgttcttcctcgggatcgcaggaaggttatacagattttgttccctgtcatgtcgggataattcggctttgttatatatttgaactagctatattgtcctgtgtacaaatgacataggaactctggtgtattctcagtaccaatttagtacaaatgacatgggaaaaaaaaaaaaaaaaa

SEQ ID NO: 9331 - DNA, 1063 bp, Triticum aestivum
  Clone ID: PAT_TA_9331
ccgggtcgtcccacgcgtccgagtcatcgaagtctgggattatgtcaacggcatgctgaaaaaggatcttcaatatcaaggggatgaaagctttatgatgcacgaggatgctgtgctctgtgttgattttagtagagattctgagatgctggcatctggatcacaggatggaaaaattaaggtttggtgtatacgaactggccagtgcttgcgacgcctcgagcgttcacacgcgaaaggtgttacaagtgttacattttcacgtgatggaactcagatactgagtacctcttttgacactactgcgagaatccatggccttaagtctgggaagatgctaaaagaatttcgcggtcacgactcctacgtgaactatgccatcttttctactgatggcacccgtgttatcacagcttccagtgactgtactgttaaggtatgggatgtgaaaacagcagactgtttgcaatcattcaagcctcctcctcctctgaggggaggagatgcatctgttaactctgtccatttgtttccaaagaatagtgatcacattgttgtctgcaataagacttcttcaatatacatcatgactttacaaggacaggttgtaaagagtttctcatctggtaaacgggaaggaggggattttgttgcagcttcagtttcaccaaaaggagaatggatatattgtgttggtgaagacatgaacatgtattgctttagccaacagtccggtaaacttgagcatctaatgaaggtccatgacaaggatgtgattggcattactcaccaccctcacagaaacttggttgccacctatgccgaagattgtatgatgaagatatggaagccttaattacattcattcatttccagttttattaatctgagtggtattttagaggatgcatttggttcttgtaatattcgtactgtagcatatataaaaccagttggagtgattgatcatcaaactcattaagctacgggagaattgccgcatgctggttggcccgggcaaaaacattttgtttttttttttttgaagatgaaattgagactt

SEQ ID NO: 9332 - DNA, 890 bp, Triticum aestivum
  Clone ID: PAT_TA_9332
ccaagccgccgccgccatccccggccaccctgcctcacccccctccccgcagcccttttgccccctgaccaagccgccgccgccgccatctccggccaccccgcctctcccccctctccctccccggcctcgccgccgccgacccataccggaacaggaggaccgccaccgccgtaaagcctccgtgccagctgcctccccgtcggccacgctgcaaccagagcaagatcccgcccctggtcgcatctcagaatggcgaccctgaggaacctgaagatcaagacgtcgacgtgcaagaggatcgtcaaagagctgcgctcgtacgagaaggaggtggagaaggaggccgccaagaccgccgacatgaaggagaagggcgccgacccctatgatctcaagcagcaggaaaatgttttagctgagtcgaggatgatggtcccagactgccataagcggcttgaagctgcactgacagacttgaaagcaactctggccgagttgaaggagtcaaatgaacaaggcactgagatcggtgaggctgaggctacaatcactgaagttgaagctgtctacacgccaacagaagctgaagattaagctcgcaacttccttttcgctgaaatgtcagtatgcatcaccagacttgctcttgtcgacaagttagtcccattcatatgatgttgacgcgaaagcttgtatgtatcacgactcatgatctgtctcgagatgtgcaactggtaatatcactggacttgaatatggttaggcgtttatggtgtgctggaaatgctgcatgttgttggcgttgttccatttgagtatcggatgatgttgcttgttgctgcttgtttttagttattggggtcattttctttcaaaaaaaaaaaaaa

SEQ ID NO: 9333 - DNA, 1228 bp, Triticum aestivum
  Clone ID: PAT_TA_9333
cgtccgccaacccctagccccgcccgccaccctcctgccccctcccctccccggccaccagccgccgccgccgcctcgccgccgggaaccctagacccctcccccgtccaccccgtccgtccgccgctccgtcaccgccgccacccgcttcagatctcgaggacttccgcccacgatggaggactgggagaatgatgattttcaaccaatcgcacctgttgtgaaagcccaacctcttaaaagtaactgggaagatgaagatgtggatgaagatgatgtcaaagaatcatgggaagaggaggaagagaaacctaaacctgtagaaaagcctgctccaaaacctagtgctaaagctgctgtgaaaaaaggcaaacagccctcaacgagtactgaagtagtggaagatgatgttcttgatgatcctatttcagagaagcttcgccaacaaaggctagtggaagaagctgacttcaaggcaacagcagagctttttgcaaagaaggacggcagtgaaaagtcactagagactttcatcccgaagtctgagagcgactttgcggaatatgctgagcttatcgcaaacaaaattcgcccctatgagaaaagctttcactacatgggtctacttaagaatgtcatgagactttccatgacaccgttgaaaggtgcggatgcgaaagaaatatcctcctcggtcacggcaattgccaatgaaaagatcaaggctgagaaagaagctgcagcaggcaaaaagaaaggaggagcaaaaaagaagcagctccatatagagaaaggagaggaggactttgttgccggaccgggtgcatcttttgatgatcccgacgagttcgacttcatgtgattggctgggaggggaatagcctcttccgtgtaatacctttgaggcaaagcagagattagggtttgcggcggtctgtattcccttcagaggcacctgaacacttggaactgcagtgggaacatgtcttgtctatttgaggttgattttgacactcggagaataagaagaacgcttgcggctccctgaggcgtttttcttgttcaagacctgtttgtctttttttactcttgttctgtgggttgggatctgttcctttttggccaactgtactataacgtgtttctggttatattggagtcatgcaagtaaattttggtggttgcctctgttgaaattctcgagttcttgtgagtgctttcaaaaaaa

SEQ ID NO: 9334 - DNA, 673 bp, Triticum aestivum
  Clone ID: PAT_TA_9334
ccacgcgtccgcggacgcgtgggtgttgattgagacactcatattgctccatttccagctgaaccataaacatctgtcaacgatagcatggacccagagcttccatctgcagggaatatttccaccaatggtgaagtcataaatccatctgcagagacgattcctgtggatgctgaagtcataaatccatcggcagagaatatttccatcagtgatgaagtcgtggagccatctgtagagagtatttccgtccgggagaaagtcataaattcatttggaaatgaaaattctcaaattaagaatgatgctattaagatacctgaggtagcacctactcctgcttcagctcaaaaggatgttattaagaagacttatgcatcgattgttaaggccacaaatgagagtataccgccagcacccattaccaaacccaaacccaaacccaaacctagaccaaatccaacagtaaagagagctgaaaatgtggagaaatcttcgtctgttcctgcaaaaactatgcatgcatcacttactgtgcctccaaatgaccaaaatatttctgatgaccaagggtattcaatctttgtgaagaacttgccttggaatgcaactattgaaatggttgacgctgagttcattaagtttggttcaatcaaacctcgtggtatacaag

SEQ ID NO: 9335 - DNA, 887 bp, Triticum aestivum
  Clone ID: PAT_TA_9335
cgtccgacctacaagtggttttccgcttggtatcactgtggtttaatctcttctcaaggaaacaagttgtggactcaatgattaaaacaacaaaagaggtccaaagctacaagttcataccattggtctaccagattgtttctagacttgggagtacaaaagatgctcggcacgagacaaacttccagaatgcattagcttctctcttgaagaaaatggccattgatcatccatatcatacaatatggtagcttttggctctagcaaatggtgaccgtgtcaaagaccgtccaagaagtagaagttcttttgttgtagatatggacaagaagcttgctgctgagaatctattaaaggagctatcttcttttcatggggctttgattcgtcagatgaaacaaatggttgagatctacattaggttagcggaactggagactaggaaggaggacactaacaaaaaaatctcactacccagggagttccgcagcatttgccagcttgaacttgcaaaggttcctgttgtgactgctactattccagttgatcctaattgtcggtatgaagaaggtacctttccacatttcagtgggctggtggattctattactataatgaatggaattaatgctccaaaagttattcagtgtattggctcggatggtaacagataccgccaacttgcaaaatctggaaatgatgacctgcgacaagagtgctgtatgttgttctctttcattttattgagaagttcgacaatgtattaggcatacagggtttgacactagatcagtacttaactttggcaaaagctatagttgcctgtgaatatcataatacaccgcacttccacccggagcctgagtaaacgctgtcttgtgtaaatt

SEQ ID NO: 9336 - DNA, 611 bp, Triticum aestivum
  Clone ID: PAT_TA_9336
cgcctcctcacactctccaccgctaaaccctagccccaaccccggcgaggccagcgagaagtcgggggagaaaaatcctccgccgctaaaccctagctagctcgaaccccggcgaggccagagagagggcgggatccgcggagatgccttcggcttcgtcggcggtggggaggctgcaggcggcggcgcaggacgccgccaactcctcctcctcctcgcgctccgccttctccaaccagctcctcgtgcccagggaggcaggacggatggtgtctctgtcggcttgcgcgaagttcggcgctgtcagctttgtggttggcgtcgtggttggcttcaccctgaataaaaggctgcgccggtgggctgccaagctgctcaagagaattaaggacgataactagcaaagctagtgcatttaatcttgaaagaaattttgttggcaagtgtgctctagttacatctgtagtaactccaagttgaacctcattgactgcttggatcaactgtgatggatacaacatagtcgtttgtaaactgtatcacaaaattctcttttggggagatctttattactggtgcagattctgcagtacaaaaaaaaaaaaaaaaaa

SEQ ID NO: 9337 - DNA, 691 bp, Triticum aestivum
  unsure (1)..(691): unsure at all n locations
  Clone ID: PAT_TA_9337
tttttttttttttttttggacgtatttgtgttgaaccacggtgtgatcaactcatcatcctgaaaggtcttttcttttatacaaattttgttgcccttggcaacgcacgaacagttagctaggtgcacacccaagagctcactaagaacagagtaatattaagacagactaagaacaagagattgtcgtagtagcttctaaacagtgcaggcgcgtaaaaaggtcccttcgttctcgagtgttagccaacccaagcagctgcatcgaacacggagattgatatacagtgagagatatcaccacttcttggtcaagggaacccagcactcctttacaaggtttctatatctcgttccccttatgtatccgtatctgaactcctcgccaggtgggatttcaatgttcggctcatccctgggtgcatccgtaatccaatcatcaggatagctccaagatggatcgtcaggatcacgccaacatggcatcggcacaggccacctgtttaaccggactgtgctatccccatccattttccagaaagaggaaccactgtccttagcaacctcaccagcatcactcttttccttaaaatacgccaggatgttgccaatctcattccatagcaggaatggggtgcctattttctctgaatagaagttcatgccgataacctctncacgcatattaaaaa

SEQ ID NO: 9338 - DNA, 1686 bp, Triticum aestivum
  unsure (1)..(1686): unsure at all n locations
  Clone ID: PAT_TA_9338
ggnctgcaggnaattcggcccgcccgtcgcccgccgcgcctcccctcctcctccccctcgtcgagccgccggaggccgagcccgatcgcggatcgggtccccgggtgcccctccagtccagaccagccgcgctcccgggttgacccctcgcaggaaccagaggcagatagataggaagaagtaaaatagaaggaggtcattatgcgtcggtggttttgttgcagccagtttcatgcttcatatcgtgaacatgaacatgaatttccttccagcccggatgagaaagaaggaaatggttttgattccaaaagtgatccaacaaaagcacctcctcccattgaaatacctgaattgtcacttgatgaactgaaagaaaagaccgacaactttgggtcaaaagctttgatcggtgaaggatcgtacgggagagtgtattatgctattctagacagcggaaaacatcttgctgttaaaaagcttgatacctcagcagaccctgagcctgataacgaatttctgacacagctctcgattgtgtcgagattaaagcatgaaaattttgtggaaatgcttggctactgtgtggagggaaatcaacgtctggtggcctatgaatttgctacgatgggttctctacatgatattttgcatggaagaaaaggtgtccctggtgcacagcctggcccagcacttgactggatgcagcgagtcaaaattgctatagatgctgctaaagggctagcatatcttcatgagaaggttcaaccttcgatagtccatcgggacatacggtctagcaatgtacttctatttgaggactacagagcgaaagttgcagattttaatctttcaaaccagtctcctgatatggctgctcgattgcattccacccgtgtccttggaaccttcggctatcatgctcctgagtatgccatgactggccagctaactcagaaaagtgatgtatatagctttggagttgttcttttagagcttctaacaggaaggaaaccagtagatcatacaatgcctagaggccagcagagtctggttacatgggcgacacctcgtttgactgaggatacagtgaaacaatgtatcgacccaaggttgaagggcgagtgtcccccgaaaggcgttgccaagcttgcagcggtggcagccctctgcgtgcagtacgagtcggagttcagacccagcatgagcatcgtcgtcaaggcgctctcgccccttcttcagcagaaacctcaagctccaccagccgctgctcctaacacaacgacttcagaagcctgacctacccagttcaacaaggatgtatgtaaaaaaaaaagtgctaagacgcatgtcctggcgtgtgcgttgttttgcttttaccgagagtaccgtgtcgctttgctgagttcaagaacggggctgtggttctgccgagtgatgtgctcttgctgcattcgttggcgatcaccttaataagctgtgttctgggtcgtatatatgctgtaacatgggaacttgggaaggttgtagttggtccgtggcttgatgtttctgggtttgccattgtgattttgagctgacgcccattgatttgtataatctcctgaactcgaagttggtgtgagaaatgaggaaattattgtctattgtccatttttgttacctgcttgcctgatcaaaaaaaaaaaa

SEQ ID NO: 9339 - DNA, 687 bp, Triticum aestivum
  Clone ID: PAT_TA_9339
cgtccttttttttgttttttttcttttttgtttttctttttgcctggcccagacgcggacatgttattgttaatctggtccttttttttagtatttatacaaaaatgaaaaacaaatagtcagacacagacacagacacaggtacagatgtggctgctacaatgacagcacccaatgtatcctccctcgctccctccctcaccagatcatcatcagcaacccatccaaccatttcagacacaaagtactacatacatggcgcacgccggcaccagcgacacttcctccccgacgagctatcttatcttgtagcaaccgcaaacgctagcgcaagttcatggacacagaacatggtggtttgtttgggtaacagggaatggcgacgacaggcacaacagagacgttcttcatcggtatctcaggttcatgtccagctcaggcccgtacatgccgccacctggcaccggcccggccaccgcttggtctatctgctttcagctcgcagtcaccgcaccccgcctcaagcgcccgcaggtggctccgctctgccctctcccccccggacccgcaaccccccgccgcatccgcccgctgtctccgcagctcgcctcgcggcgggccttctgctggttatcttcctcgctcgccccgcggctttagccggccgcctgctgcaccggctgggag

SEQ ID NO: 9340 - DNA, 382 bp, Triticum aestivum
  unsure (1)..(382): unsure at all n locations
  Clone ID: PAT_TA_9340
cgtccgccgccctttttttttttttttttttttttttttttttttgattctagacataactcgtagtaagaataagaancaagaacagaagatccaacatttccatacacctctgttcgtgtaaaacagcagaatttatatccttctttctgaagcccaactcatatagtagctactatgcattgcaacctaaacatcttcatatatatagtttgtttggccaagccagggaaatttccaaagagatgaagcggatgctttggaacataaggaaagcagagcagatctctcttcacttgagctcgtcgtcgtcgtcgatgtcgctgtcgctgaccaggtcgtcaatggcgtccgtgtgcgtcatgcgcgcggaggcctgctc

SEQ ID NO: 9341 - DNA, 688 bp, Triticum aestivum
  Clone ID: PAT_TA_9341
ggtagatcaggtgactcacaattacactgttacattggcaaaatcgaagcaggtacctgaggaccgtctccggcgcgtcttctctgtcctcgtggccggcccttcgggtacttcacgggcgcctgccgcgatcccggtgccctgcgctcgcaccggcgggcgccttcgtgtcctgtgtggggggctcgtgttggtcggcgggatagcaaaacccaatagacctgatatcatcacgggaatcggtatatgggagcttgacaagacacagtggcaagaggtgagtcggatgcctcacaaattcttccaaggatttggtgagttggatgatgttttttgtagcggcggtgccgacgaccttgtctacatccaaagctatggtgcaactgctttgcttggatttgacatgaagcagaggcaatggaagtggtcggcaaaatgccctgtgagcaaaaagtttcctctccagctgttcactggcttttgctttgagcctcggctggatattaccacttaatacttgtaccaggtctgtaccgttaaattgcttggcatcaaacaaaaccagtgaccctcgtcttttgtggaagatggatcatacactctgcctctcttaatttattttcccgtgattgatgcaattgctcttgtgatagagattaatattttgtaatccagtgttgctgagtcc

SEQ ID NO: 9342 - DNA, 1048 bp, Triticum aestivum
  Clone ID: PAT_TA_9342
cgcgtccgattagtgcttgatcgcaatctgcctctctacttgatccaagcgatacatccccatgcgggcgagcgctgctgaaatttttgaccgcccacttacaacgtgcctaccttatgaaatgttcaaaaacatgactcaacaaagcgtggcagttgcccatttaataatgtgaccccgacaccactcttaggatttgattgaggctttgaacacgtacatgcccgaccagaatgacgaccgacctttagctacgttcaaagaaaggctccaatatttacagagaacctaaaatacgagggcctcttgtggtcgatctggagtacatggatgggggctctttgctgttacgaaaattcaggaggggcaaatggtgattgaatatcgtggggaccaagtcagacgtagtgttgctgatttgagggaagcacgatatcacaaggaaaataaagactgctacctgttcaaaataagcgaagatgtcgtgattgatgctacggagagaggaaacatcgcccgtataattaaccactcgtgcatgcctaactgctacgcgaggatcgtgagcgttggcgacaacaagagccagataattctgattgccaggagagatgtttcagctggagaagaactgacgtatgactacaaatttgacccggacgagtcggaggatcgcaaggttccctgcctgtgtaaagctcctaacctgccgtggatacatgaacctgaagtgctcacaaggactaaccaaccccaattacagtggcgaagcgccacattcccagattcatccagattctttcatcatcttgtgcatggccgtcagcatgcaacctgtctgttatttttttagtcacaggattttgctagatagccgaggtagggcttcccaggctagataaaagaaaaacagaactggcaggcacagccagagccagccaggcattgtaaattcttcattgctgtaataaattgatgctttcttctctatgagaaaaagaaaagaagataaaagaaaaggaatccaaaaggaaagaaaatgtccagt

SEQ ID NO: 9343 - DNA, 1150 bp, Triticum aestivum
  unsure (1)..(1150): unsure at all n locations
  Clone ID: PAT_TA_9343
gggcaccacgcgtccgcaccgtcgcgcgtgccacccgaagctcccgtccagcccgtggtgcagccccaccagcagcagcctgaggtgacgccccatcgtcagctcatcccacgaccgatgccgcatctgccgattcggtcacgccgctgcgcctccaccgccggcggcgccacgccaccaccggaagctcttgcccagcccatggtgcatcccgacgtgtcgccctggcgacggccgacctgcttaccaatttgcgccgttgcttctccaactgccgttagtggcccccaaagcttccttccaccgcgtggtgcttccatccacagccaaggagccgcacaaccccctgcatcccgaggtgccacccagccgtccctcttccacctcgggtgatggatctcctattcccccttgtcatgccctcctttgcatctaaccgttgcatcctgtagtgtcttcaattgaatctatgtacagagggaaaactccacaagaggcttctgaagcttggtcaacgccttcatgaggaccaacctataactcgtatgtgtcgctggataaggccatgtctttcgtgggtggtgcttggctgatttgtacatggatactattaaagaatggtacaaacatatatggaatatgaaaggttgatccaagccagcttcaggagctcaaggcatacaggaagaccgaggaggaggggatgaacacacttttaaaccactacctccatttctgtgcagtttctctcaagatgcaagctgaaatgctggtgatcgagaagaacagtcctgcgaatggcatcatcaagctcatcgagcaacatcacatcacaaaccatgtcatgggaacatcttccttctcaccgtgtggccagaccaaatacagcttcgtaacaaggtttcatcgataaacatgcacatcaaaatttcccgcggacttctatatatatttaggcactaagatgtggtaaactcatgggggcacactatcatcttatatagggtcctcgggggtaaacccatgtattgaacagggatncatgtncaccaataggttttcnaagggtttttttncacaggngcantccggcaacaagtagaggcnggngttaaaggggcccccanntttgaccaaggtntcggnggtt

SEQ ID NO: 9344 - DNA, 525 bp, Triticum aestivum
  Clone ID: PAT_TA_9344
tcttctctcccctgctttgccactttctgtccatccctccccagctgtacccccccgttaccttccatctgaccccgccttctttctacctctcttctgcacctgccatcgccccagtgagctgcaaaaatgttgcatggccatcgtggcacccgagcacgaaactcagaaccccatgctgccggcgtcggccgccctgtccgtgcacccgggcctcctggcctgccggtcgtcgcccccgcccctgcgccggcccccggcccgcctgggctccccctccacggtccgccccctcggccgggccccggcccgctcgttcccggcctcctcggcccgcacccgcccctgccgcccccccctcgcgtgccccccctccgcgcggcccctgccgtgcgtcccgcggcccccccgcgcgcgccgccgccgcgcggccccggccgtggtacacgcgggtgcccgacaccagcgacgacagctggctgccggagtccgtcccgcgaacacgtccgacgaggcgcacgcgat

SEQ ID NO: 9345 - DNA, 737 bp, Triticum aestivum
  unsure (1)..(737): unsure at all n locations
  Clone ID: PAT_TA_9345
acgataagaagcgaaacgtcggtggatacaaatgggctgtgcagagcaaacagtggagatacaagaagcatctgagaaacaaatnctccgctctagcaagacttaccctctaacntcactncattttaccgcctcttaacaagcaattaaggatacatctcatgagactctacactgctaaaaaaacgaggctctacataaatgattaatcaagcccatgctagcgattttccgaaacgcatagacagctaaagcgaaccaaaccaaacttctgggccaacgtagcttagcggtaccacatgctgctcagttgccaaatatagatcaaaaaacggaaatgtccatgcccggttcatgctaacacaagcttttctttaccaaacgtttgctccacttcattcttcatcggaatcttctgtatgtagatccattccatcaagggggggaaatgtgtagtcaggtttgaaacgcttccgaacgaggggcatcttatcagcatcacgtatgtcatctggatatagccactttgtcttgggtaccagccaactgttttgctcgttgctgtctatcacagcattgatagttgcagggaactcatgaccattactatttggccttaggacacataccgtaaaaggcatttcttcaccatgtcgcaaaatacactctggcttgtccaaaatcagctcatggaactcttgtgcattgaacagctcaagcttatcaatcttggtaat

SEQ ID NO: 9346 - DNA, 739 bp, Triticum aestivum
  unsure (1)..(739): unsure at all n locations
  Clone ID: PAT_TA_9346
tttcagtactgggaactggatgacatnctgacccaagtcaagaactactattatacatgctttcagagtactaaaggtagtcgagagattgttcagggtccaaaatgcagaaatgatcttctcttcttttcctttccgggagaaagctaacctaacatctactgctaaattctacagtgttaggcacataactgtgagtagttaaaactagtccctttgtcaacagtagaacatcaccctcttcaccttctctttcacagcgggcaaaggcttcacggaggtaccattcgtgccactggaactcttcgacgtgtggttctccgacagctccggctccatgtagaaccgcgcccggaacgcagccagatgcgcgtaatatgcaggtgggacgacggaaacagagcgcgtgcagcgtgcgtaagtgtagcaaaggttgtttgtcaacgtctgcatttcgtctgctgagaagttgttctcatcccagaggacatggtagtgagctggcctacttgttccctggattccagcgtgactacagaggtagaaatcaaactccgttgggtggcatatcttcgaatcaacaacagttccaggcaaaatatttccacttttgtccatactacttctgtctttgtgattgtttgcaaacagtcttgtatggtgacgcttttgaaccaccacaaacgttacaggaggttggtaatttggttctagggacgcacaagccttacggatagcc

SEQ ID NO: 9347 - DNA, 836 bp, Triticum aestivum
  Clone ID: PAT_TA_9347
ttttttttttttttttttgtccgtcgtttgctttttgcaaaaatgctcaggccttgaaacttgtcatgacaacagtacacagaggctacaacagggaacaggctacaggagatcatcgaccgatgatggataactacaaatagacagacattcatcatgagaatgaaattacatttctcaaacagatgttctcgggacagacagaggcgggatttctacaggcaagtgaatcatcatcaaaaaaaaaggaagagctatcactgtacaaatttcaaaagcaggttcggccttcgctctccatcagaaacccggatcatctttaaatgatgccctgggcagtagaagagtcatttccaatttcacaagaaccctttccaaacacctcttctatcacattgtttgtcgaaagaaattcgtctttctcccatacgctactgaaaccaatatcccatgttttcgggtcgcaatggccaccaaagtatccatgatctgcaacgctaccaaagccaacatcccggtagtggtctccagcaatatcagtgggtgtgccatccatggtacaaacatgcggagcctcaaatgatgtgcatgagtcgtcttgagcatctgtgtaaaagatggttgcctcctggttattgtccacaagggacaccatgacattcccctccacgcagcaattttcttgcctgtgaccacaacagtcaaactcatcctcctcaccagactcttcatgcatatttccctggaggggaacttgattgcatgcaccatcatcttgatcagtaagagactcgagcagcaaatcctcaccagccctttctgtcacagcaaattca

SEQ ID NO: 9348 - DNA, 941 bp, Triticum aestivum
  Clone ID: PAT_TA_9348
cgtccggtccagcccccgcacctcagccccggagcaatcgccgcatccaccgccccgcagccggatctccgcaccaatggcatccacctcccgccccaccctgccctttgccttggccctcctctatgacccaactgcagccggcgccatcgccgctggcgttgagctgcccatatccaggtccaccctgccgatccccttcgccgtcgcagaggcagcgggagtgcctccacccaccgcagacccctcctcctcttcctccaccccagccaaactgcttggcacatcgatcgatctgccggcgttcctctacccgtccaccaagagcatcgagccccggaacttcaagcaggctcaggcctttgtgcgcttccagacgtacaggccggagctcggcccgctgccggagccctcgcccgacgaccgccaaggtggatatcggctgggccttctctcccggtaccatggtccttggttggatcagcaacatttccaagaagatgcgagatctggagactgttgatctccccatgctggcggcacatccgaatgacaagactgcagctgataggtgtctccgtcgtctgaatgtcatcaaagacaacatgaagaaggctaagagggctgtccaagggcgagtgactgtaccaactgaccagctcaacgagatctcccgtgctgtcaagaggctgcatcagaagaaagagcataacctgcagtaccttgaggacagactgcccgccctggtccgcgccctgctggctgtccgctcggccgtcgcgcccggtaccttggtccctggctcgatacattgaggttatcctgtttagtataaatgtgataggccccactaattattctatcccctttgtaacttatgttacccacaagttgttaggtgtctccgtcgcctggttggcttctatgacgacatgaagaag

SEQ ID NO: 9349 - DNA, 563 bp, Triticum aestivum
  Clone ID: PAT_TA_9349
gtgtcctgtcagcgtcactttgggtttgggtgcgagattgacgaggaaacatccaacaagctgtaaggcctcccgggtgttctttttgtgcttcctgattcctatgttgatgctgagaacaaggactatggtgccgagttgtttgtgaacggagagatcgtccaacgatcaccggaaaggcagagaagggtggagccggtgcctcagagagctcaagatagaccgcgttacagcgaccggactcgctatgtgaagaggagggagaaccaggcctaccaacggtgacatgcccccgtcggtgccgcgcaagcgccccactgctatcgctcttgccctagatatagcaactgctccacgcccgaaatgcccatcgtcgtctttgctgcattgtagccacgccatatctgggcgtttattttcttcattcacgaactgtaggttaagaactgcatgtactactataagtgagttgttttggtaacggtatcttggtttgcggcggaaagagtaaaagaagttgtaagagagcatttaaacttgatgaactctccttgctctgtttc

SEQ ID NO: 9350 - DNA, 1038 bp, Triticum aestivum
  Clone ID: PAT_TA_9350
gcaccaccgggaacccactgcagccgctagggttttacgcagatggccgccgccgcagcagccgccggagcccggaggctcctcgcccgccgcgcgtcctcctcccccgtcaccatctccgccctcctccgccgcgggggcgcggcggcggcggcggcgccccacgagccgctgctgcgcccggcggccctcgcggccgtcgcctcccgcctcggcttcctccgcgggatggcgcgccggcccggcggcgacgggtactctccggcgcgctccggcggaggaggaggcggaggggaccgcgcgcccaccgagatggcgccgctgttccccgggtgcgactacgagcactggctcatcgtcatggacaagcccggcggcgagggcgccaccaagcaccagatgatcgactgctacatccagaccctcgccaaggtcctcggaagcgaggaggaagccaagaggaagatttacaacgtctcctgtgagcgatacttcggtttcgggtgtgagattgatgaggaaacatccaacaaactggaaggcattcctggtgttctgttcgtgcttcctgattcttatgttgatcccgagcacaaggactatggagctgagctttttgtgaatggagagattgttcagaggtctccggagaggcagagaagggtggagcctgtgccgcagagagcatcagataggcctaggtacaatgacagaacccgctaccaacgcaggagggagaaccagcaacggtgatgagccaaggtgctcaattgaagatcaaaaaataacaatccctggtggcttccgccgggtaaactgaaaggataaatatcatctacggaaactgcatgttcactgtatgccaacacaagtgttttcttttcttcatgttggtgattgcgcatcttggatgtatcaaactagttattagagagagcttggaagtatttggaattgcatcgttgtcgttaactctacagtcatgtgcccttgtaaatctgatttgctgaataaactgctagtttgttcaacttgaac

SEQ ID NO: 9351 - DNA, 596 bp, Triticum aestivum
  unsure (1)..(596): unsure at all n locations
  Clone ID: PAT_TA_9351
gaccccgcgtccgccgtccgcgcccactccctacccatctcgccggcgcgcaggcggcgccgtcccaacatgggatgacgtccgccgtaaaatagggcccccacgaccaaacaaagccccgactagccaccaacatcgaaccccatgaaggcgtctatcaagttccgcgacgacgaccggccgctgatgcgggccaaggtgccgatcggcgtgctcgggctgccgttccagtccggcctctccgccggtggcgatccccgggagctccgcttcgatctctccaccgctttcgcctccgggccagctctccgcttatcgtatcgccccaacgaccctggtctccccttcgccatctccatccgcgccggtgtcggagccctcggctcccctgtccggggccccttctccctcgccgccgagttaaactcctccctgccanatccgggtctcctgccttcttcctcctcctcaagccccgccttcggggatttctaactttccaaaagctcccggtcaatcaaggtttctccgccccgttangggtcggggaaggtctcccnacggngaaagggggggngaccgcaaggacaaatttt

SEQ ID NO: 9352 - DNA, 1201 bp, Triticum aestivum
  Clone ID: PAT_TA_9352
ggccgccggcatcctccgagggcgggggtccctgggccccccccacccccggcgccggcatacccggagcgccgcagctcctccccccccccctgggccccccccgccgttcctgcgccccgacgcgggtcacaagctgcgggtgtactggaacgtgtaccaccactcggtgggctacaccatcatcatcctgcgcatccgcaacatctgcacgggcatgagcatccgggacgtggcgccgccgtggaggaccggctacattctagccattctggccctgggcagcgtcgccgggccgctgcaggggatcacccgcgctgtcctcctccatggcagggtgcaggtcgttgcgctgttcctgagccccaagaaggatcacaagctgcgcgtgtactggaacgtgtaccaccactcggtgggctacaccatcatcatcctgcgcatggtcaacatcttcaagggcatgagcatcctggacgtggcgcagaagtggaagacggggtacatcatcgccatcgccatcctgggcggcgtctccgtggcgctggaggtgatcacctgggccatcgtgctcaagaggaggaagacggaggacaaggcctacaacggcggcgcctccaacaacaacggccatctgcccatgtgatgtgatgtgattctttctcggtggccagaatctatgggttgtgtttgagctgcgtgtgtgtgagcatggattggcagatgctatgtaggttagggtcgggccttagtggccttcgtctctgtgtttctttttgtatgatgatgatgattgatagatgtgtgtgtatagtactgctgcacattatattaattattatagtggaatgagcgccgggtggcgccgggtgatcacctggggcatcgtgctgaagaggaggaagacggaggacaaggcctacaacggcagcgccaacaacaacaacggccatctgccgatgtgacgcgatgcgattctttctcggtgacgagaaatctatgggttgtgttgagttgagctgcgtgtgtgtgagcatggattggcagatatttaggttagggtcgggccttagtggtcttcggtctctctgtttctttttgtatgatgatgatgattgatagatgtgtgtatagtactgctgcacattatattaattattatactggaatgagagaggggaggcgctggccgaaaaaaaaa

SEQ ID NO: 9353 - DNA, 594 bp, Triticum aestivum
  Clone ID: PAT_TA_9353
ggctgaaaatgtatctaaaaagcagcaagcaaagtacagtagcccacagtcaggctccaggtttattagaattacaactcacaagtccaaataaatatactaacttacatctggactgattcaacaacttctacgcatcagaaaaatgaaactgaacatcactcgactggtccgtcgcgaggcctcttcacaaacggcaacaccgggttgaaaccgctcgctctctcgcgcccgccctctccccctctccctcacgcagggattttgcgaggtttcttcggaaggtcacccctacgggggcacgttgtgctcttgtgccccttctccctacaaattgtgcaaaatcttgatctcgcgtcttttacctcatatccaggcttgtccctcgccgttgtcggcctacccttatgtttcttcctatcgggcaccaataatgtggataatgggcccgtcgatgatgcagctcccacagacacagagccaaggccacattcagtggagatgatcatctcagaacacacatcttcttgttgcgagccgtttgccatagtggcatggttggattggctgaatccccaacttgagtttggtcga

SEQ ID NO: 9354 - DNA, 713 bp, Triticum aestivum
  Clone ID: PAT_TA_9354
cccccccccccagtctccccccttccccgcgtccatatcccatgcccagcgcacatccccaccaatccccttctggcgcatccccccacccaggttcagcccaagtagtcaagcaaccacccagttctccaatccccagtctatttcatcttctcagtttttcggtgatccagccaatttagaaaaagagggccaaatctccctccaaaattctctgggtcctctgccatttcaagtgctgatctgtttggccaacaagcgaacaattctaatgcggatctgagtgcttcggatttgatcaacagaatctccttccaggccactcaggacttgacctctctcaagagcatggctgggcagactgggaagaagctgacatctatggcgtccaacatcatatctgatcttgatcggatcctctgagctgaatttacatatcacaggtcttcgatggtccgcctctcctgattgttactgcatgacaacagatttgtggtggtggctctgtatatgagtccataggaatcttaaaacttaaactcggtagagaaagaatgaggattttatcacaaatgctttctggctaaagtcgtaatagcatttggagtttcgtgggaaccagatgggcgttgtgctaccaaagaaatgcctttgctttgtaatgaccatttcataccatatatggttatgagtacaggtgtgtccttgaccta

SEQ ID NO: 9355 - DNA, 1159 bp, Triticum aestivum
  Clone ID: PAT_TA_9355
cgtccgcccacgcgtccgcccacgcgtccgcggacgcgtgggcgcgcccgatcgggttggtggctcgccgcgatggcgaccgacgccggcgccgccgacaggagctccgtcttccgcaagctccgcgccaaatccgacaataagatgtgcttcgactgcaacgccaagaaccccacctgggcctccgttacctacggcgtcttcctctgcatcgactgctccgccgtccaccgcagcctcggcgtccacgtctccttcgtcaggtcaacaaatttggattcatggaccccagaacagttgaaaatgatggtttatgggggaaacaaccgtgcacaagctttctttaagcagcatggttggactgatggtggaaagatcgaggcaaagtacacttcaagagctgctgacttatacagacagttgctcctcaaagaggtttctaaaagttcgacagaagatggcaataatagtgggctgccctccccagtcgcagcttctcagacttcaagccaagcagctgcatttcctgatttcaaactggtagaggtgccgaaagaagttgtgaatggagcctgagtctgaaactattcgttcacctaaagctcctacccattcattcaagaagccaatcggtggaaagaagcctggaagtaagactggtggacttggtgcgcgcaagcttacgacaaagccaagtgaaagcctctatgagcagaaacctgaagagccagctcctgccctgccatcggtggctgaaagcactacagctaggagcaaatctcatacttcccgatttgaatatgtggaaaatgtaccttctgctgggagcagctctgcggaaaaccaggcatttgggcatgttgcgcccccaaagtcttcaaactttttcggtgaatatgggatggacagtggatatcacaagaaatctacttctggtgcatccaaaatgcaggttgaggaaagtagtgaagcaagacagaagttctcaaatgcaaagtctatttcatcttctcagtttttcggtgatcaagccaatttagaaaaagagggccaaatctccctccaaaaattctctgggtcctctgccatttcaagtgctgatctgtttggccaacaagcgaacaattctaatgcggatctgagtgcttcggatttgatc

SEQ ID NO: 9356 - DNA, 957 bp, Triticum aestivum
  Clone ID: PAT_TA_9356
aagaagccccttggtgcaaagaagcttggcgccaagactggaggccttggtgtaaaaaagctcactacaaagtcaaatgaaagcctgtatgatcagaaacctgaagagccaaaacccgctttaccaacaatgacaactactacttcagctgcaaaaagtggcccatcctcgcattcacgttttcagtatgtggaaaatgagacatcaactgagtcaaaaactggaggaggcaacaagactggccatgtagcagcaccaaaaacctcagacttctttcacgagtatggaatggataatggcttccaaaggaaaaccagcacagctgcctcaaagactcagatagaggaaactgatgaagcaaggaagaaattttcgaacgcgaaagcaatttcatcatcacagtattttgggaacacagacagagagcaaaaggaggctcagttatctcttcaaaagttttcgggttcatcatccatttcaagcgctgatctgtttggccgtgatacaaatgattctgatctggacgcaagtgctgcagatctcatcaacagaatatctttccaggcttcccaggatttatcatctctgaagaacatggccggagaaaccggaaaaaagctgacatcttttgcctcgaatttcatcaccgacctcgacagaattctgtgaggtgttgatttgcggaaattgtgggcatttctctgcacgcggaagtactgctccggatcgcagggcatctctgagtggctcaagcatttcttgcacagctatgtagagaatattaggggggttgttactactatcatgaatgtcttatcattcacattgatcgcaatcttgttacaatgggaatattgttattattcatttcatgacaatagacaaaacatatgattttgtacttgttccagcttgatgtgccgtgataaagattttattgtggtgctactgttttct

SEQ ID NO: 9357 - DNA, 1772 bp, Triticum aestivum
  Clone ID: PAT_TA_9357
ggcaatgcaggcttcgcctcctctgtctggctcgctgcgcccatgcccatccctcctcctgccgtctcctcctctctcttacttcctcctcccatccccatctctcctcctcttccccctcaattcggaggcagcgagggctcgcgcccgatcggcttggtggctcgcccgcgatggcgacccgacgcctggcgccgccgacaggagctccgtcttccccaagctccgcgccaaatccgacaataagatgtgcttcgactgcaacgccaagaaccccacctgggcctccgtcacctacggcgtcttcctctgcatcgaactgctccgccgtccaccgcagcctcggcgtccacgtctctcttcgtcaggtcaacaaatttggattcatggacccccagaacagtttgaaaatgatggtttatgtggggaaacaaccgtgcactaaactttctttaagcagcatggttgaactgatgatgggaagattgtaagcaacagtacacttcagaaaggatgctgaattatacagcacaggatgcttccacgaaggaggtttctaaaagttccacagaagaatggcaataatagtgggccgccctccccagtcgcagcttctcagctcttctagccaagcctctgcatctcctgcttacaaactggcagaggtgccgaaagctagttgataatcagaaggaatgagcctcgggtctgacaactccttcggtcacctaaagccccaacccattgattcaagaacacaagtcgctagaaagatgcctggaagtaagacctgctggggtgggcaagcgcgcgctaaagaatgagttgaaggctggtatgcccagaaagaaaaaaaaccactacgggcttgaactgcaaggacgtatgctaaaacaactacaataagtagcacatctcctaattcccgatttcaataagttgtaaaatgagccaacaactgctcaaaaacatagtgtatgtcatcagcttgggcatgttgcggcatcaaaaaacttaagaattggaggaggaaactggactggataagtacttccaaagaaaaccaattacagctgccgcaaagattgagttgaaggaaactgctaaagaaaagaagacatgtccgacggaaagactaatttaaatgtcactgtattcggctaacaaagacatttagcaaaagagggctgattcacatcctaaaaagttgctgacacctatggcttccaaaatgatgacctgttttgtctgcaagcgatctaggttaattcagacttgacgactgctgatgtgcttcacacgatctgcatatcatgccattctggacgcgagttctccagattgcatggctgggcagattataacagacctcacaggatttgtaatctctcacatatctggactggacaagacggtattatggctgacatctttcggctcgaatttcgtaacaggccttgcgggcattcggggtgctgcgtattggcggatagcgtgggcaaatctatgcacgctggactcctgtatgaggatctccatagggatctgttactttctaacacgtatattgcacatttatgtttacacgcaaaggcgttttgttactactattattaatgtttgatctttcgtaagcattaaacgcatttttttttcaaaggaaaatagtgttattattcatttcatgatcaatagacaaaacatattattttgtaataagtacaaattaatgtgccgtgataaaagattttattgtggtgcttccgctttca

SEQ ID NO: 9358 - DNA, 641 bp, Triticum aestivum
  Clone ID: PAT_TA_9358
gaaatttattactcgttctatttctggcaagatgataacctgtaaccatgctttttcatcagttaataacactatagaggatcacttccagaaaaactgcacagaacttgagcaatggaccaagggggatgacaaaccttaacattttccatcctatggtactcacccaggacaggtaaggtagattctctagttttgttttgtgttctctgatagcaactccatgtgtagtttcccagcacagcttgaagcataaacatcagcaaggcctggaagcctctccttgtaaggatgcacgaacctgccaagaaacttcttctcggacagtgaggcggcattgtaatcaaatcggagatccagcaatcccttcgtgttgagtagcttaagcaagcagtacctaggaaacaaacggcgctcaaggctatacttgagcagcaccggtctttgagcaatgtaagatatctccagcccagcaacctttgtgaggaaatgcacattttttctgcagcctctcctcggatatggtcaggatacccggcatcgtcttcacagctagcagcacatcaccctgcgaccaaccaagcgtctccaggactccgattttgtcggtgagcttctccggactctgcacagtgaacgcc

SEQ ID NO: 9359 - DNA, 755 bp, Triticum aestivum
  unsure (1)..(755): unsure at all n locations
  Clone ID: PAT_TA_9359
cncagtngccagatgtggcctttctttngtttaggcacccnagccccaatcagcatcagtaaaccccnntacttttaagtgnccttgattagaaaatagaatcccctcttccccgnacacccttttaagatatctttagtattcttgtgcacaacatctaaatgacttnatctcggggtcatgcataaatttgctccccaagctaacagcataggcaatgtttggcctagtgtgtgataaataaattaaccgnccaactaacctttgatattgatgtttgtccacaggatcaccagaatctgctcgaatacgatggttctgctcaattggagttgtcgttggtctacaatttagcatgccagtttcagcgagtaaatcaagtacatattttctttgcgataagtaaatgccttgtgatccatatgcaacctcaattcccaggaaataatgaagaaaacccagatccttaacttcaaattcctcgtccaacatcttctttaggaatgctatcccatcatcatcattgcctgggatcacattatcatcaacatacacaattagggtgacaatcttgccactctggtacttaaagaaaagggtgggatctgcattgctttggcgataaccaatagagcctatctcctttctaagtcgtccaaaccattgctctatgtgaccggttcaaaccatatttagaccttttagcctacacactttaccccttggttcttgtgtaccaaaccccaggggaatct

SEQ ID NO: 9360 - DNA, 524 bp, Triticum aestivum
  unsure (1)..(524): unsure at all n locations
  Clone ID: PAT_TA_9360
cgtccgcccacgcgcccgcaagagtcagatttgccttgtcacacccccgcgtcgcctcgctctggcgacacggggggcacaaaccctagcgccgccaccgttctccccttcccccacccgtctcgctgccgccagagggtgcccgccggcgaagtctggccggccccgaggaaggcggcggcggggcacttcctgttgttggtgcggcgcgtcgagaggagccgctggaggacgcgcagaggagatccacgagctctggatctgcggtccgtgcgccagatccgcgcgatgcgcgtccatgacgacgcggtggaggtgcctggccgcgcgcccgtccagcacttggtgagcacgcgcacttaagttgcacgtgggagccgttgggcgcggtcaccgcagcgtggaagcccaggggcggcgcgaacgcgcgtgtcgccgtcgtggggtgcgctgggggaccgggctccctcggctggcnggctctggtggnacggccggtctgacggctcgccggccggtcngcn

SEQ ID NO: 9361 - DNA, 704 bp, Triticum aestivum
  Clone ID: PAT_TA_9361
atgctggctgtcttattctggctgggtatgttcggtctcattcctctctctcttgggtggtgagagtgcttgctatgtgggtggggtacagtactggtcgccttgccgcggcgcgacaaattgatgggtgggtttatttatttttgtgcgcgccctcctgcttgcgtcagtcttcctcctgcctggcttccctcacgccttgcgaaggcctttagctcaagagtgcaattgcaaaagcccgttgtcaaccgttgttcctcctggcatctacacgggctttcagttctccagtcctcggtactatcaacggaactaataaaagtgcttaggcaaacttgccctgaatctagcactccagttggccaactcctcctgctcgttgtgcctcaggtcgtaactaaaatagcccctcccctgccaaaagcaaggttgttatgatgatcttatgtgatgaacacatgttacgggttcatccacttctttatgcacacaaatctgatcacggacacagcggagagcactgaaaagaacaacgttgcctgtccgatggtcttcacttatttactatatgccgtgatgccttcccttgtaagaaaaataatgagatacagactgcacttactgatctcttccaacgatttgctgacatcactgcccccagactgaaccaagtgtatcttgccttatgcttggaatgatgcaaa

SEQ ID NO: 9362 - DNA, 458 bp, Triticum aestivum
  Clone ID: PAT_TA_9362
cgtccgaaaaacaccacatccacctctcgcctcaaccacctggctggagaagaagaagaataagaagaagagaaggagatcacgtcatgggcaagggcaaggaacctgcaaaggatgcccctaacaagacgaaggcagcgtcaaccagtacgcagttgacaaaaccgccgtcgttcaagaagaacaaggtgcagtccaggaataacccgatgctgactcagaagaacaggaagcccccgcctaagagtaagcgtccaaaagggtgagagtagctgcccgtccacctgatctcggacatcgtccgactatgacgaagttgagcagtgtgtttttgttaagtacactcatttatgccgcaatatggtactccctctataaagaaatataagagcgtttagatcactacgttagtgatctaaatgctcttatatttgtttacggacagagtaattcataaa

SEQ ID NO: 9363 - DNA, 441 bp, Triticum aestivum
  unsure (1)..(441): unsure at all n locations
  Clone ID: PAT_TA_9363
ggngnatgaanaaggtgagnagaagaaggagaaggagaagaaggagaggaaggagagggagaggaaggagaaggagaaggagatggagaggaaagaggaggagaagaaacagaagaagaataaccggattctgactcacaagaagataagtaaattgtagccaaaaaaaaacaaagtgatgaagcctccaaaatggtgagaacagctgcccgtccacatatctctgatgtcgtccgaccatggcgaagttaagtgtgtttgtgtcaagtacgctagtttatgttgcaatatgttaatttgtaaactcggttcattcgagtccgcatgtaggccagaagcgtgctagtccacgttgcagccaagtaaaagtgtttttcccttgtgttgtccagccatgggcaggttgttgttgggcaactgaataaaaggaaatagttacat

SEQ ID NO: 9364 - DNA, 304 bp, Triticum aestivum
  unsure (1)..(304): unsure at all n locations
  Clone ID: PAT_TA_9364
tctntacccatatacataactngnntcaaatacatatcctaacttcacgcagaacacttcatatctcatagaaaatccttcaaatctgaactgaacaggagcctctcacaccgaaggccacagaaggctgcntcctaatcagctntataacttataagccggtgatctatgtatgagcagagcaattcagggcctgtgngaactttagaatccacaaattcacaacaatctcgatttctcataattgaggtagatttcctgcactaagcaggaacgaggctggactctgagggcgtagacgact

SEQ ID NO: 9365 - DNA, 801 bp, Triticum aestivum
  Clone ID: PAT_TA_9365
gtgtcctcgggacaccgtctccctgtcgctccccacgcgtccggcgactcctcacccccagccgccgccatcgcaaactacgccggccgattccggcgactctcggcggcgctcagcacacatccgtgctcgcttcgctacgctccgtcctctcctccgtccagattcgtcgctcccctcccctcctccgtggccaggctagggtttcggcctccccatctccggccaccggagcccctccctcccccttctccagccggcggacgcccctcccctcccctcccgtcatcaggagaggagatgagaggagaggagaggagagggagatccagcagggcaggccatggcgccggccagaaccgcgccgggactggcctggaccaagctcgtgtcgtcaggacacctaccccatggagctgctctctggggctcctccaggtaggcaggcaggtgcactcattatccatcactagcagcgccatggaccagctgaagatctgatcaacacagctcgctatttatcggggagctcttcgtgttcgtggctggctgccgtgccctgggcgtcccttcgtagcacgcgggctgccacccctggtccgcccactctcccagccacgtccggccagcgatttcgctcaccacactgtgaacgcgggggtggcaataccctccctcggctacaacttgcactagatttggcctctggatggatgctatggttcctgtgatgttgctctgtttggttctctcaagctggatattgaaggacactaaatgctgcggtcatgggccacattc

SEQ ID NO: 9366 - DNA, 1186 bp, Triticum aestivum
  Clone ID: PAT_TA_9366
gcacgaggaactagtctcgagttttttttttttttttttttttttttttttatcattggcactgcagtggcccccataacgccttttaatcccttagggctctataacattttcttacagaatcataggtccccaagttagtaagctcatatacttgtacatccacccgtgtttgaacagtctgtcttgaatttaatgtatggttgcgacacaaccagcaacataagttgcagagaaaaagggtcacacaggtggcatgccaacgtacatctagagcataatatttacatcagtaatgcacaccacaggtttaagggattgagctgaatacacgacgagcagagatgatggagctcagaccaagtgcaatgaaagctaagaacgccattgagcctgaggcattgataagtttggcgaactgatccacgccaaatctagacacccacacatcattgcgagaaagcgctgctgaagacgctgacagcagcaggtaagccaatacctgatccatggcgagattgaagtagttgccccagggacctccaattatgcgcctccccgtgacaaggtagcgcacttctgcaactaattggaaacccgagtatgtaaaagccatcacgctcgcagcaagcgtgtacctgtattcgttgtagcggcggaaggagtcaccagcccagcccggcgtagtgccagccgacatgacggagagcgagatcaagcagaacacggcagctgaaaccttaaaccctagctcagccctcttcagctccgtgagccgtactctatctgggagccctctaaggagccatctcttggaacccactccgactttgcttccgcctccgcccccgccgccgccggcgactgactcggtgactaccgcaggtgctaccttgtcggcggccggcttggcctccgttgccgcggggtcctcggccgagaggagcttcgctatggtcagggccgactccttctgcggagatccggtcggggattcagccatgaccgcgtccttctgcggcgtcggcggcatcactgcttcgttttgggttagcgcaagggctagcgccatgttctccgattcgccgggcacttcatctgcctcctgcaccggtttagcttccggagacgccggtgctggtggagatggtgctgctggagcgggagcgcgagcgggaggagaagc

SEQ ID NO: 9367 - DNA, 842 bp, Triticum aestivum
  Clone ID: PAT_TA_9367
acgcgtgcggtggctctgaatccacttaactattgactgagaccacgatggaaaccagagagatagttacatctgaaaccacgcagtgtgctgcatcagacgaggtccagagcaccatctcggcatccgatgctgttggtaccttggatgacaaggtagatagtgacggtgaagacatcatcgatcatcacgtggatgagtccaggatcaccgaagtggagctgtggcaacaacttgaaaacgagctgtaccggaaaagggaaggggagaacaacatagtggaagagatgactgaaagtaacattgccgaggaagttggcggcagagctcaagatgtcctcagtgaacccaacgagaaggaggtccacagattctacccacctgggaaaatcatgcacgtaataacatccacaagagaagcagccatagacgacgatacgagaccagcgaacatgaggatgaagagcccgaccttcaccaagttgatgctgccggggagtcggagacaagcatagggatcttcttgacgccaagatctctgtatggcaagctgaggctgtcgaagatgatgatcaacgatcattacatgccgatgtacagaagaaacatcgagcagttggttgcggagcttgagaaagacctggctctgtaggtggtagccctgacagcaatacaatacagcttgctggtccaaaccagatactcacagttagcttcaactgttgtaaaagctgatgacatacgtagggtgttagttccataaagtgtacctaacatgactggaactatatcacagccccttgtcacaacttttctcagaaatatctgctacgcctcttttc

SEQ ID NO: 9368 - DNA, 990 bp, Triticum aestivum
  unsure (1)..(990): unsure at all n locations
  Clone ID: PAT_TA_9368
tcctagnaaaataattgcacttgtgaaagggcgtggaacctgtcaaatccacaacatagaacagattcctagctaaagattggttttcagcatcgccacttcagtaccaactacagaaacaaagaaaacatcgactctacccggggtcaaatcacatgcagctccagttcgactgccttagtttccgaaaatttggcgcaagaaatgagcccctactacggtccagagttgagacaacaaataggccgtacaaaaagtagcctatccatctatcaactaagtagctcgatcttctttcgatctgtttctcttttgaataggcttccatgtgttgacatactcgaggaatgacgtagaagggctgtcctttggatgagcatgtacacgagaagaacgccgcaatacagcctcttcaactaacaactgatgtgtcacctccttcaatctcttctccacagcattacttatcttgttgtagaacttgtcaagctgttgtttgagtgctctctcccttatgcctttaatgtttaaagacccaatgagcgcatcaagctcttccttggtgctatagtacccccactctttggaatctgcactttcaacaaaaagtcttccttcacgcctaaaaaaccaatacctgttatagtatctgtcttttccaagaggactagttcgtactgattggtccagtagnttctttctccagatgcctccccagatgcaatttcacatctcccattttgctggcgggagcatttttcctctccttcgcttcttttgccacaagctggctattaacattctcgttgccgtccagatgcaatttcgcatctcccattttgctggtgggagcgtttttcctctccttcccttcttttgccacaagctggctattaacattctcgttgccatcctgtacagcatttgtctgattcatttccttttctgttgccacttccanatcaacttctgctcttccttactctctcc

SEQ ID NO: 9369 - DNA, 749 bp, Triticum aestivum
  unsure (1)..(749): unsure at all n locations
  Clone ID: PAT_TA_9369
taatatactnctnctnccgtccnaaataagtgtcactgatttagtacaaaattgtcccaaaataagtgtcactgatttagtacaaaattgtacattatatgccagtacatactattagtatgtaacaaaatgttctacagcgtttcaatacacgccacacacaagtgtgctacccttcatgctccaccacctgcacaacgctcagcgtcagctgatgcgtgtcataatgtatcggcctttctctaaatcatatataatctttgtcttgggcttcctccatctcaaccccaaaaatactccgcaagcaagaaacgctcccagcacggcgagcacctggtctatgcttaggtgcccgtgttgccgcagcccctgatgcccctagaatcctatgttttgtatttgcaatgaaagctcctagagcccactcaatatgagtgtcgccgacctgatttgaatactcgatcctcttgtcatccaatggtacaccaaggttgtcgtgcagtagagctacaatgtatgccgacgagaagcaataccgtgagaaatcttcatctgaatgattgagatacgtttgtctcagcgtggacaagtccttgttgcaaagttgctctccagcaaccacaaaatcagagagcgatgaagaccgatctagtccaaagaacttggatgtaaaatagaaattttcagttgctaggaaatgcccaagcagctcagggacgaaattagatcctaggtgaccctcgtgccga

SEQ ID NO: 9370 - DNA, 556 bp, Triticum aestivum
  Clone ID: PAT_TA_9370
gttattaaccataacagaagaacactaccattctgttaagttcttacagtgggggtaatcaaaatacagccccgctgaatttgaattgccagtgtaccatcacaatattcacatggtaagacagaactccaagagaatttttatgaacaccaccaggatcccatttgagaacaaacaggtttaaactatggaaacatctttaacttgaggctttttagagcactcagtttaggagtgcgctatttttcctttctcttactcatcaacatcccaacttaggtcttcatcgtcttccacagagttcaaccgttttcggatatcctccactttgctactagggcttgaccgtggactccccgctttcttctcatcttgatcaccaacatcctcaatctcctcccagctaagatcttcctcctgcactgatggtcgagacaccagtgataaatcactctccttacatgagtcgccagcttcagtcttctcttcctgcccagtgccattgcttgactttggtgtcgatgcctcaccgctggattcaccattatcgtccttt

SEQ ID NO: 9371 - DNA, 1596 bp, Triticum aestivum
  Clone ID: PAT_TA_9371
ttttttttttttttttttttttgttccacaaaacgcaaaaagcttatatacatctgaatttcacaaggagcatcctgttccgatctacatcaacacacacgcacactgaggagctgcacatctgcagcttatatatacacggcaaatgacaccatatatacacatgccagtagcagggtcgaggtccagaatcaaagtgggacaaaatgaacgatgtgataccaaataatatctacaaatgttgtcgtagattggttaataagaatgaatgtgtcttctacgacccgcagcgcagctggtcttgttcagcattgcccttgctttgcaatgagtagaattagccttgaaacctccggaaggacaaacccgttcagtgctgcttcaaaattccgctgctcctctttttgttctttttccattttctcatttttttgggttttgatgtcttccttcatcgataatgatactgagcaataatatatacagcatagctaacggagattccagatatcagttctggagggaagaaagccactgctctacaaaattctttccatcggaggggccgccatcggcgagagggccagcgccaaggaaccgtccctggggcatcataggctgctcggcgcggccgcggcgatagcagggcacgaggacggcgaaggaggtctcctggtcaccgtccgtctgcatctccggcgcctgcggctccagccagccgatggaccagtcggagtcgtcggactcggacccggaaaggcacccgccgccgtcggacggcacgatgaccatgtcgtactccctgtcgattctgggctccccgcgactgcgccgctggttcttgaccctcctcggccgcgtgcggcggccggcggcggcactggagaaggcgatagcgtccgcctcacggaacccggaggggaactccgggaaggaggcgcccgtcaaggcgatgccggggagctcgtggttgccaactcgcgcggcgttacccggccagagccagtgtgtgaatcggccgagccccatggccatggcccccatgaaaaatgccttgctccttgcgaagctccgggatcgctccgatcagatcaaaaatttcggcaaaatcaaacgaaaaccggtgttccctggatctgctcgagaaccgagacccggcaagactccaaacgcaacgagaagcgaaacccccggctctccaggctctcgcgtctcgccgatcagtcaatcgctccccgtgcccggatccagattgagattaataaagaagtctgcgacccgccctccgccccaattgggaagctttcttgttctagtccactgattcgcgacgacgggaagcgacaggccccattaaaggtaacccgtccaaaaaaatttcccaatccaggcgctaaaccaacaggatcaacactggggggcgatgatccaaaatcttagcacaggaaaacaaatcacccaaaattgaaaggaaatccttgcctgctcgaaaaccgaggcccggcaagaccccaaacgcagcgagaagcgaaacccccggctctccaggctctcgtcgatcagtcgatcgctccccgtgcccggatccagattgtg

SEQ ID NO: 9372 - DNA, 710 bp, Triticum aestivum
  Clone ID: PAT_TA_9372
tcgctgtgagctgtctcgtcggcggcaacgattgcagcaaataaagaagaaaagaaatagcacatccaatcacacccagctgggctacacctgaagcaacctcctactcgtacaaggccggcctgaagcacaggcacgccgtggctagcagcctagcaagtatcaaaggccgaattgctcgtgggtagcaatggcctacaactacagggccagaaatggccaacgataaaggaggcctttaccattgtgctagctgctggcctgctgggtgtggtgtggtgtggtgtcaagcatgagaagcaggcaggcacatgtgatgacgcggaggcaccatcgctcctttcctcggtggctccattttctcttgtccccttgccagattgtgcagatgagcagatccatatggtgacagccagcgcacgcatggtccctgctcaagccgcagcagcagcggcagcatattcttctgaaaatgcgacgggggtaaaagaaattgaggattgtctgaattttctgcactcacgagtctctgtctgaacttcactcgggcctccctgctgaagggcctgaggctccagatactcagtagtgggatatcatggtactagaaagcatggcaggtgaaacagccactcagagatctgatctggccattctttgtaacatgtgatgtctttttggccttcctgcaaagatgctcatcttggctt

SEQ ID NO: 9373 - DNA, 685 bp, Triticum aestivum
  Clone ID: PAT_TA_9373
gttttttttcctttttgttccagaggcatcttccgttcatttcaatttaggtctttctgcaccatgttcacatcacatcctcttaccattggatacattttccctctgcaaaaccctaacacggctgcattcgctatactgaacatttacaaatgctcagcacaatgcctttctagtgtatcagggaggtgctcccatggcacatagcctcacagcagcaattgaagtcgtctcttggtctcggcactgcaaactgcttcgcctctactgaagatcgttcaacagaatgtaacttcggggaaccatacgagaacaacctaatcccagtccaggccgtgtgagcgtccatgaagtattcagtgacagaggtgcaaggtggcatgcaaatcattagagaattagtgcttgcagcgactaaatgaatcttggaggatactgatatccaaatcacggcctatgaaaactatcttgttcatgcgagattgtgtctccgaccattctcgagccggcacaacctcatagacttccctcactgcctgtaaggtatgaagttggttcgaatcatggatattcaaaatccctttgcaacgatatatatccatgttggacttcttctcccaaagaagatcttcaagccatgattccaccttagtcaagtaaactggatcctgttcataaatgcaca

SEQ ID NO: 9374 - DNA, 831 bp, Triticum aestivum
  Clone ID: PAT_TA_9374
gccggccgggctgcgatcctcctccttcgctcttcttcctcctcctcctcctgacaactaaactagcatcacaacaagtagaaatcaagaaaggcggccaagaaccccaaggtcttcttcgacatctcctcttcgacatccaaggcggggcgggcaagcatggagctctacgccggcaaggtgcccaggacggcggccaacttccggcagctctgcacgggcgagtctggcctgggcagcagcggcaagccgctccagtacaagggctcggccttccaccgcatcatcccgggcttcatgtgccagggcggcgacttcacccgcggcaacggcaccggcggcgagtcggtctacggcgccaagttcgccgacgagaacttcctcctccgccacacgggccccggcgtgctctccatggcccacgccgggcccggcagccaacggctccccagttcttcatctgcaccgcctcagccgccctggctcgacggcaagcacgtcgtgttcgggcaggtcggggcagggtacggcgtggtggcgcggagtggagaagatgggtcgggtcgtcccgccgcttcaccgccccgccgagcccgtcgtcatcgaggactcggccccgccgaccacagctgatctcatgattcattcagcttgtttttttttattttgctaccactgttgaagctgagacgagctatatgaattgatcggaggcactactagtttgtttgtttaggtgtgtgcgtcgtgcgggtgcttgtaattgactgaatgattgaatgaataaatttacagattcagtttcatcaatctcaaaaaaaatgagagatc

SEQ ID NO: 9375 - DNA, 251 bp, Triticum aestivum
  unsure (1)..(251): unsure at all n locations
  Clone ID: PAT_TA_9375
natcacgcatgacggacattcagtctctagtcgattcaatggacaaggagttgccgtgatcaactcgtcactcatgcggaacaacaacgaacggcctttgcttgctgtcaaatgtttttgtttcattgtgtctaggtgtcgtagatgattgtacttaggtgctcaccctcttctataaactatgtgcttccccactgtatattatcttgtgtagtaacatttgcaagggccgggttttcgtttccttaaaa

SEQ ID NO: 9376 - DNA, 884 bp, Triticum aestivum
  unsure (1)..(884): unsure at all n locations
  Clone ID: PAT_TA_9376
atatgtaataaaccactatatttacatgaaacgtttatttacataggatgactcgacatttccaccatctgttttacggctcattgcagagcatgcgatcctgtactttcgagctcgttccgaacataggtgtcattgttcttcaggaagccagagtaccatcgagcagagagcttcgcttgtcgtggcagcgcctcatcgttaaaatcgacacggtacaggccgtaccgtgacttggcccctgcaaagaactcgaagacgtctaggaaggaccagacaaagtagccttttacgtttgctccattcctgaagggcaaaactacgtcaggataaaaatgtctgaatcctggacattttgcggaaaggcagtgctgttgacttgaactacattcttggtgacttttgtttaatggctgaccttactgccttcagtgtgctacccatgtagctcttcaagtattcgatcctttcggtgtcatcgagagtgtcattagatgcaacaccattctcttgcacatagataggaaggttcccataggctttcgtaaggtactgcagcacatattgcaatccttccgggtcactttgagaagatgctgggacattcttgctacttcctgggattgttttagaagctctttggtaaagagacatgtctgctgaatagtcacgagtgcctttgtctaaaggacggtcattaacatacatggaatagtagtggtttattcctatgaaatcaacagctcccttgacaacttgagactgggactttgtgaacgatggaagtcgagacccaacatttttcctcatcacatctgggtaatctccagacaccaagggctctagtatccatccgaacacgaagtctaagtanttttagctgc

SEQ ID NO: 9377 - DNA, 817 bp, Triticum aestivum
  Clone ID: PAT_TA_9377
gacccacgcgtccgaccgtgctttcctccagagtctgcatcattactgcagagatgtggtgcttgtttaagaagtcaaagtattcttcaacaaagctaaaaaatttgggttatctcccacaattagaatatgttcagaagttttggaaactatgtgaacagcagctgaatatatcagatgacacagaagatgaagacgcaaacgaagaatatattgaagacacaaacagggatgctgtcatgattgcagctgcaaagctactgcttgctgatacagtttcaaaggattaccttggccctgagattgtttcacactatgtatctcacggtgcaagtacgacagagatcatcaagcatctcattaccgcactaaagaaaaatgcaaacagtgatatagctgctctattctttgaggcattgagacgggtgtacgaacggtatatggcctatttgcgcgaaggagagaaccaaaacctgatagccaaatcttactcggagtgtcaagatcttgctaatcggcttgcaggctactatgttggcgctgttcgtattaaaaacaagtctgagatcttaaagattatccagtgcggtgttcaatttgcctttgtggacctcccaaagcaattgtctttcctcgaggctgctcttgtgccatttgtttctaaacttccttcgtcagatataccagacattttgacagatgtacagaagagggcacaagatatcgatatgaatgaagatcccagtgcttggcgcccgtacttaacctttgtagaacacttacgtgagaaacatgcaaggaatgaggttttccatgg

SEQ ID NO: 9378 - DNA, 2960 bp, Triticum aestivum
  Clone ID: PAT_TA_9378
tgtgtgtattttctttattgattgatgctattgagtatttttcggtaaactgggcaaaaagcgctcactctattcattaaagcaaaacataattctccggttaattagcgggaaaaccgtacaaaacctgttacaacacacctaaacagccaacataatacatggcgatgcattgggcactgactatatttattatagaaacatttgatttaaataggttgacttgtaaattaccaccattctgtcttacgacattaattgcaaagcatgaactccagttctctacgatctttttacggcaaattagatggcattgtttcttcaagggtgccgagagtactgtcgatcagagccattctctttctcgaggcaacacttccatcgagaaaatagattgggttcgcgtcgtagcgtttcttggctcctgcaaacaccttaaagaccgttaggaaggtcgtgccaaagaaaccttttaaagtcgtttaagaaagtccagactaagaagcgttacacttttgctccattacttactggattctgtgtgctacacctgtagtgttataagtattcgaaccattctctttcacatagagagtcatgttatgaaagaccattctcttgcacataagtacgaagtttcccataggctttcgtaaggtactgcaacacatattgcaatccttccgggtcactttgagaagatgatgggacattcttgctacttcctgggattgttttagaagctctttggtaaagagacatgtctgctgaatagtcgcgagtgcctttgtctaaaggacgatcattaacatacatggaatagtagtggtttattcctatgaaatcaacagttcccttgacaacttgagattgagattttgtaaaggatggaagtcgagacccaacatttttcttcatcacatctgggtaatctccagacaccaggggctctagtatccatccgaacacgaagtctaagtatcttttagctgcttctacatccacatcagagttcgtcataggataactccaagaagagtaaacatttatgccaacacctcccttttgggcagcttgatatttttctcggtaaagtctggtagctgatgcatgagccagtatcatgttatgagctgctatgtatggttccacagttgagtttcccactggtacaatttgttattccaaatgggttggagcaacgtccgggtgcaaatagtgcattgtcgtaagatcctagtgcgctgacattaggttcatctatcgttgtccagtatgaaaccctgtctccgaactccctaaagcacacgtccgcaaatgctgtgaaatcttccacaattttagggcttaaccatccgccatactcatcgtccaaaacttgcgggaaatcgagatgggaaagcataacatggacttgaatcccatgttgcactagctcatttataaggttgttgtagtactccaagccttttgggttgacagctcccctcccatttggtataagccttgaccaggagatagagaatctgtaagcctctaggttagtgtcaaccatgagcttgacatcatccttgtacttgtggtacccatcggcagcgacatcgcctgtgcttttatccgacattttccctgcttgagtgaaggtgtcccagacgcttgggctcctgccatcctcagccacggcaccctcatactggtatgcggaggtggcggctccgaagacgaactccggcgggaagtcgctccgcgtgaagccaagagcaggaggagcagcagcggagagaaacagcagggagaagagggccatggcagccattgctgctgcagccagctcgattcgatcccagaactccgctgaaagctcctacggcttcaggaagcaatagctgatgacggggtatgcactaagtcagtcctgtggatcacgcatgacggacattcagtctctagtcgtttcaatggactaggtgttgccgtgatcgtctcatcattccagcggcgcatccacgaacgatctgtgcttgctgttgaatgtttttgtttcttcgtggctgttttcaggtctttcaataaacaaattatattgttttcctctattcacttcccctaggcctagaggctccatccttgagatgtggtctcagtattcaggtacacgacgacggcggccggtggcgctcccattcatggccggcgaggagaagctgcagcttccgtcgcgccccgaggtaacatggagtctgctcatttgtaacggcatagagataggaacgagcaattcagcttaactttgagaaagtggcggacaaaagagaactggactattgttgctgagcgctagctctggccgcatgatcatctatgtatatagttttcaacaataaatgtatcctgattggtatagcacaattggaaatcctactttcttctgatctcttaatttcaagatgaactggagaggggaatttgtactaagtttggaatctgtcacagtaagtgtgtatttgcggtattgatgtacagttattaagaaagatacattttccagctattgtgctactgagaaagaagaatggttgagaataccagacgctgtagctgtatacctttgtgactgaatttactgcccgcagtgtggcacccatgcatcacttcccatattcgatcctttcggtgtcattgagagtgtcattagatgcaacaccattcgcttgcacatagataggaacattcccttgggctttcggtaggtactgcagcccgcgtcgcctgccttcccggtctctctgaattttatctagctctgtagaacggaaaattggagatcgttgcaaccagactagatcgacttgccattctcttgcacatagataggaacattcccataggctttcgataggtaatgcagcacacattgcaatccttccgggtcactttgagaagatgctcgtgccgaattc

SEQ ID NO: 9379 - DNA, 639 bp, Triticum aestivum
  unsure (1)..(639): unsure at all n locations
  Clone ID: PAT_TA_9379
ggctggcggctgcgaggagggtcgcggtggcgcttatctgcggcgcgctggcggcagtgtggtgccatcgggcgcttgccgcgggggccgctgcggcgggagcaggcgcgggggcgtccacggcggtggaggcggccgatgtggtcggctgggtggcgctgcgactgcgagggagctggcccacggtgctgcaggttctgcagctgctcaaggagcagggccttattctcgccctattactcggcctctccgccttcttctccatggccgagacctccatcaccacgctctggccctggaaggtccgtgagctggccgataaggaacccgagaacggcgtcttcaaaatgctccgaaatgatgtcactcgcttcctcacaaccatactcatcggcacaactgtggttaacattggcgcaacggcaattgtcactgaggcggccacagcaatgttcggtgaagcaggtgtcagtgcagcaacaggcgtcatgactgtcgccgttctacttcttacagaaatcacacctaagaatgttgcagtccacaatgccacagaagttgccaggtttgtggtcagaccaatcgcttggctttcaatcatcctgtaccccgttnggcgtattggtacaattatatcca

SEQ ID NO: 9380 - DNA, 682 bp, Triticum aestivum
  Clone ID: PAT_TA_9380
acacaacttacacctgaagtctttatacctcccggactttattcctttacggtttttcgacttatttaagcaaacgactaaagagacattgtcaatcttttgtttgtttctttgacagccaactaaagagaaattgtcaccaccatttttctttctggaaacctatgttatcaatcaatctttcttcggggtgcttctgaagaaaggattcaataccacaaatctgcaaaccaatgcttcatctgtgaaaggatccaaaaatcctacccctccccccttctaaaggttagccttgggatccggatctggagcagcagctaagaccgacctctgacgaggatccatgttcttgtcatcttcaatgggatagatcactatcttcctcaccatacggcaaaactccatccagggatcatctccgactttcatggtgtcaccttcgttgtcggtgaatgccactttaaagttctgtttgatgtcctttatctcgaacatctgttccagttcactggtcagcccctcatacccatccagacttgctagatccacagctctacccacagcatttccatgcatttgaaccttaacacggttccttccaatattactctgttggctttggatttctcgggggcttctcgttcgcaactttttgttacttttgaaaatgctgacagctgac

SEQ ID NO: 9381 - DNA, 581 bp, Triticum aestivum
  Clone ID: PAT_TA_9381
cctcctcgactccctctccgggaggctggcgaggaatgtgctccaaaccggtccggtgttccctaacggcaagaagaggcggctcgactttggcgcggtggcgtacgtgacacaggagaacgttctgctgggcacgctgaccgtccgggagacggtgacctactcggcgcagctgcggctgccgtcgagcatgtcaaaggctgaggtgcgccgggtggtcgacgacacgctggacgagatgggcctccgggagtgcgctgagcggcccatcggcacgtggcacctccggggcatcagcggcggcgagaagaagcgtctgtgtatcgcgctggagatcctcacccggccgcgcctcctcttcctcgacgagcccaccagcggtctcgacagcgcctctgccttctccgtcatcgagacgctccgcacacttgccattgatggcggacgcaccattgtctcgtcggtgcaccagcccatcagcgaggtattcgcgctcttcgacgatctctgcctcctctccagtggcgagagtgtctacttcggggatgccaagcttgcaccacagttctttgcagaaaccg

SEQ ID NO: 9382 - DNA, 646 bp, Triticum aestivum
  Clone ID: PAT_TA_9382
ggcacgaggccaaacacaagggaattgtcgccgttatatgtcactcactgtgtgcatgcttgtgtagtaggagtagtatacgcaggggtgcccggcagactagtggtcggtagtgcggccaccactccggcccagacagagcgtgtgtccaagagcgcctttcccccccggctcacaccggagtggtgaatccatccaactggtcaatccatccacggtgcgtgcctcaattctctcccttgcaggggagagcagagctccgtttcctcctgggcgcggcggagacgagctccggcggtttggggttggcgttgcgcgcatgcagcagatggccaccaccgtcacgctgctgctcggggcagcctcgtcccccggccccgccgccggtgatggcgccgcgcgggacggcttccagtgctcccgcctgctacccaagaagaaacagcagaggccgcgctgggtgctctgctcgctcaagtacggctgcctcggcgtcggcgagccgggggaggcgggcggccggagcgcggcgtccccggtgtactccagcctcaccgtcagccccggaggcgacgccgccgtcgccgtcgtctcgtcggagcagaaagtgtacgacgtggtggtgaagcaggcggcattgctcaag

SEQ ID NO: 9383 - DNA, 751 bp, Triticum aestivum
  Clone ID: PAT_TA_9383
cgtccgctttttttttttttttttagaagcaaacattttctttttctctatcagcacaagcatattaccgtgagcaacattatacaagtctgatccaagaacattatttaagccgactgatctaaagaacgacagtagcattcctattgagcttcatttctattgccctctttcctctcccggaggaatctcgtctcaaggtaagaactagcacaagcggtgctatggcacaccttgttctacaatgggtacgttaatcaggcaaatacctcctacatacagacacagcgtagaccacggcacacggcatttcaagcaggcatgatcactcctgatctatgaatagacgcttgcgtttggagcttctgtcctcctcgggtgtctctgcaacaaccatctgctcctgaagaaccaaacctcggttccggcaaagtttccttatcggtgttcgttgcgcacatggctccatctgttctcgctcttcagcagagaggctgtgcgccgtcctgtgcggcatcagttcttgcccttcagggacgacttctttcataagcttccaatctctgtaatcatatctgaaaacaaaatggctgtaggacacttctcctgacgctatggcactagcagcaggcgcatttcgtggatagactatatggtgcccattgtcatcaatgtttattgccaccctgccatctttaactaggaaagacagtgcaaaaacattctcaaccgtttgggcaaatgattgtct

SEQ ID NO: 9384 - DNA, 453 bp, Triticum aestivum
  Clone ID: PAT_TA_9384
ggggcgacccacgcgtccgcggacgcgtgggccaaatcctagggtttctcgatccacccctccctcacacccccccgccgccgccgccgccgccgccgtccgccgcactcccgggggtttctcgatccaccccggcccccttcacgccccgccgccgccgccggcccccgcccgcccgcgaagatgttggagctgaggctggtgcaggggagcctgctgaagaaggtgctggaggcaatcaaggagctggtgacggacgccaacttcgactgctccgggactggcttctcgctgcaggccatggactcctcccacgtcgcgctcgtcgccctgctcctccgctccgagggcttcgagcactaccgctgcgaccgcaacctcttcatgggcatgaacctcggtaacatggccaagatgctccgctgcgcgggcaacgacgacatcatcaccatc

SEQ ID NO: 9385 - DNA, 1288 bp, Triticum aestivum
  Clone ID: PAT_TA_9385
cgtccgcaaatcctagggtttctcgatccactcctcccctcacgccgccgccgtccccccgcccccacgcctccccccgggtttctcgatccaccctcgcgccccgccgccgccgccggcccccgcccgcccgcgaagatgttggagctgaggctggtgcaggggagcctgctgaagaaggtgctggaggcgatcaaggagctggtgacggacgccaacttcgactgctccgggacgggcttctcgctgcaggccatggactcctcccacgtcgcgctcgtcgccctgctcctccgctccgagggcttcgagcactaccgctgcgaccgcaacctctccatgggcatgaacctcggcaacatggccaagatgctccgctgcgccggcaacgacgacatcatcaccatcaaggccgacgacggctccgacaccgtcaccttcatgttcgagtcacccaatcaggataagattgccgacttcgagatgaagctcatggacatcgacaccgcgcgctgcggctcacccgcctcgacagcgagcacctcgggatcccagactctgagtaccaggccatcgttcgcatgccctcctcggagttctccaggatctgcaaggatcttagcagcatcggcgacactgttattatctctgtcaccaagggagggtgtcaagttctccagctggctggaagatattggtaaccgcaaacattgatttgccatggtagaactgcaacgtgcccgtgcctcttgccttcgccctgaggtgcatggcttcctgccccaaggcctgccctctgcccgaccgagtctccatcagcctctcatctgaactgccggtggttgttgagtacaagattggcgatgatgggctacattaggttttatctggtcacccaagattgaagaggacgaggaaatgaaggcatgattgtgtttcaaggatatgctgatcttgcctacaataggtgttatctggacacccaagattgaagaagacaaggaagtgaaggcatggttgtgtttcaaggatattcttacgttgcctacattcccctagttgttagtcgttaaaccgacctctatttgcttaacaattgttttgtaagcaaaaatggtgttatgcttgtttacgattgttagttacctgtaacggtgtcatgcgtttcatggctttttcattgctgaatgctgtgtcttttcatccaaagaattccattgatgaatgttggtcttttagctacttgtatccgcctgttggtccatgttacaccagtgctgttattggt

SEQ ID NO: 9386 - DNA, 248 bp, Triticum aestivum
  unsure (1)..(248): unsure at all n locations
  Clone ID: PAT_TA_9386
gttcgggctgtctacacatgctctctcttgctgccaaacgagcaatcagagataaccccttttgggaggaggataaccccactcgatctgcatctttacgatgcgcagaacccgattaccgagcaattagagacggacctgactcgatagcactatatttctcaaaaaaaaaaaaaactntggacaagngactgactgattacncctgcncnanttttccntttanaaatgaaagntttcntttttgc

SEQ ID NO: 9387 - DNA, 641 bp, Triticum aestivum
  unsure (1)..(641): unsure at all n locations
  Clone ID: PAT_TA_9387
tttgaatttaaccaaattcatgcaaaacatggtaacatctcgtacgacatatacgtgatgtttatacattttgcatacgggagaaggaagcagcgacgcttgtcatcagcgtacataaacttatctagcacggctgtcgtatcatactcctagttgactacgatgctagaaatcaaaaatcatgtcctcgtctccatcctcctcgtccagcagcgggctgtcttcatccagcttctcgcactcgaacaggtagggcggcggcgcgctgtcctcggccttctccttgccgtcgcccatctctatgatgcgggccatcctgtcgccggatgcaggacctgaccgccccttccggagacgtcttgaccgggagcccagccccgaggagcgcggcgcattcgtctcggaacccccggtcgttgggacgacgagatcaggccggcgatcgactgcgcgaggtcccgggacctactcgaggatctccttcccaggacaactgataaaccccccggcatgatctgctttcaggntatgcaatgcaagcttaagtgccttcctcacaacatatttatctggttcagatctctgccattcttgtactattccatggtaagtgtgaatggcaatatcaacacgagcaaatg

SEQ ID NO: 9388 - DNA, 662 bp, Triticum aestivum
  Clone ID: PAT_TA_9388
catgaggcccgttccttgtttatttgcatggctaattaggccgtaaagttgggccttgtgatggtgataatacaggatggttatggatggatcggtgatggcatttcttaatgccatgccagcaacacacgcacactgactgacatactactgtttaatgtagcacgccactagcaaaagctctttcttcttgttgctgttcttcttcgtcgtcgtcgtcgtctacggaaagatctcttttaagccgtcgctccggtgggtggtcttttgctcgctctaggtgaccctgatggttccgaaaaagggcgtcctcggcgatggcgacgaaccggcggcagcaccggcctgctggtcggtcttccgggcggccgtggacgagatcttgagctccaggtcaggcgcctgccgaggaggattcgcatttgccaccaggcccagggaaggagggagcttcggtgcacggctcgctgacggtgcgccgatcatcgacgacggcggcgagcagctcggcatcagagtcaggcacggcggtagcgccgcgtccggcctcggccggctggcgcccagggaaagagcagggaacgttaaccccatcgcgtccacggagctggtggcatcgggtttcagcctgtgacgacgctcggtggctcccctgtcgccat

SEQ ID NO: 9389 - DNA, 1267 bp, Triticum aestivum
  Clone ID: PAT_TA_9389
atcgtttcttaacacagtgtcgcttgcaagtgagaactgaccccgactgttcggatttgaccggtcaaacccttatttacgagcttgcccgcatgaatatccgagagaatacagagatcgacaaggaaatcagttcatcacagggcaataatgcaaggtcgccatcaccatgcaagaccatgctagcttgcctccaaatgtgtggtacatcaaagtcagaactcacaagtcataaggataaaaaagaggatgatgttaatgtgctactcaaaaggcctccatttggcgctgccgacaccggactcggatcactccatcctctgatggtagacattgaggacatagctgttcaggaggtcgccgaacgtcttggtcgagaatttctgcaccacgcggtcgcgtgcttgcttgcccatccggaccgctagatcgtgatcgcccacaaacttcaccatggctttggaaaattcgatgggggagggatcgcacagaaaacctgtcgcttcgttcaccactgtctccactgggccgccactgttgcatgcgattacaggcttgtatgctgccatggcttcaagaggaacaatgccaaaatgctcgtcctttggagtgtacaacacacaaaggcagttggacagaagctcgtttctttcagatgaagaacaagatgtcacgaatttaacatgttcagaaacaccttcagtcgctgccaatcttttgagctcctcaaggtattcaacgttttctttgagacgcttatcgtacccacctgccactgttaagcttgcttcccgcagagcatcaccaggttgcttagaaacaactgaccggagcaaagcaaatgctgaaatggctagaccaagattcttttttctctcaaaccggttaattgagaggaaattcaacttataatcatgaggttcatgaaactgctcaacggagaccgctggatatagaacaccaggctcgattcctctagcatgaagaccacaaaaagtcctggcaaaagttgcctcggtgaacttactgttgactagaatcaaatctgccataccagtcgtggcttcctcaatcatgtcaattggcttgcgatacaacctccgaagaagtgttgtatgttgtgcaagcaacatatcaggaaaatggcaataaaaaattgtctttgatgatgcctttagtttaagaagtgggatcacaacagaaacctggtctaccaatatgacgtcaaaggagggccaccaaagtagcacgcagagggcaacaaaaa

SEQ ID NO: 9390 - DNA, 575 bp, Triticum aestivum
  Clone ID: PAT_TA_9390
ttttttttttttttttttaactcaaaactcttctgctcttcgcccacaaaaggtacttctattacttcggaacaagcacacttcccaagtttgttgccctccacttttttggtaagaacttgaccaaatgtggtacaatagggtgtaacaaaggaaccctgactatgtaggtaccacctccaaactagcaaattaacagcaaattggataagcctgaatggctgatcatgtgttttgagatagcctgcctattctccttcctattcagccttctgttgaccataccggcactgaactggttccccttcgatgagcttctccagggcatctgatgggaggccgatcatctcgagggtcttctcccaaacaagctgcgatgtttcgaggttgtgtgcttcttcagaggcattcatcggattacagtcgtagttgatgcaagcacaaacaggccagtcttcagacttcaacgtctcgcagtattccggaacttgggggtcagatgctgcaaacaatgtacctcggccgcctcctcgcggatcaaatatgaagtatggaatgagacgatacccagctac

SEQ ID NO: 9391 - DNA, 560 bp, Triticum aestivum
  unsure (1)..(560): unsure at all n locations
  Clone ID: PAT_TA_9391
tttttttttttttttttttttttttttttacggttattcatttttatttatatggagccgctgagcccgagctagctagcggtggatcctgaagtagtggagcacgtcctccctgctggcggcggcggcgctgtaggccttgatgaactcgctgaactcgaactccttgaacttcgcgggtcccgtcgcctcgttcaccatctccggcgctggcccgatgcggcactccatcttgggcatgatgagggtcaccaccgacagcctcaccgcgtcggtgttcgtgacggcgcggtgttccacgctagccaggagcccgttggtgatgatctccatctggtggcccaggttgaccacgaaggcgccggggacggggcgcacgaggagccaccgcccgccgtgcctcgcctgcagcccggcgacgtcgccctgggagagcacggtcaggaggtggcggtcgcagtgcgggaggaggcccagcgtgaggctcgggtccgggcacggcgggtagtagttgacgttcatctgggtgctgccgccgctnaggtcgccggcgaagaatc

SEQ ID NO: 9392 - DNA, 586 bp, Triticum aestivum
  unsure (1)..(586): unsure at all n locations
  Clone ID: PAT_TA_9392
ttaaacattatnggctaatactggatgtggtagtgattnactgaaattctatgtccatgatatctttgnncattgtgaatggacaaacaatggctaaaaccaaatactatcgtcaatgtgcatatgatacagtcggtcattacttaaccaccttcattcattcaattctagtctcttaatttaaattatactagcaaaaataccccttacccaaacaaaattaaacctatataaactgctatttatatcattcaataaaattattatgtgaggaaggagattgaagtgaagttaatttattcttgttttcattatgtgcaatgatacactcatttattcagttaaaaacatacgtttttcacacaccttcaaaattccaacctcaacgttntagaagngacttgcactgactcgagtcaaaaaccagcaaatagtggatatacatgtggagatggacctcatgtatttggagactcatgtgatttgaattgtaacaaaggatattacatttntggacgagggaatgcaacattgcantgatttaacttctagtgatgatacaaaccaacatggaaattgggattat

SEQ ID NO: 9393 - DNA, 678 bp, Triticum aestivum
  Clone ID: PAT_TA_9393
gggtgatgcggggcattgatggtcagttggatgaccccgatagttcaggctggcagcttgtatgggtcgacagggagaatgatgtgcttctccttggagacgacccttgggagtcatttgtcaatagtgtatggtacatcaagatactttcaccagaggatgtgcacaagttgggcaagcaaggaaatgatccacgttacctttcctaagtgcaagatcattgtgctgtttctgggtccagcgaggattcgacagcacatggtagcacccttgctcacggcggcacaacatccccggaacctcccatcgtctcatcttcgtacctgtctcttgtgtgtgctccgtgcacgtctcgagagctccccgtccgttacctatctccgtccggtgcaagccaccgacaccatgaactgatatttctgtaggttcctcttgggaatctgtatcggtttaacttttatcctagatggtttgtacctcgcgcggcgcggcagcccatctgcccgtctgtttacgcgccgcatcaaatgtttcaagactatgcttagttggtactgtgttcggtcgtattctatctatgtattcgagactcccaggcacgctttccttgaagaactgcaataatttgaatgcaggaggattatttcgagtcaaaaaaaaaaaaaacacgagactagt

SEQ ID NO: 9394 - DNA, 671 bp, Triticum aestivum
  Clone ID: PAT_TA_9394
tttttttttttttttttagaatatagatggatatataagatagttaacttaaaatatcttataatatatagattgggaacatgtggaagcacacaagatttacattacaaaccacaccgtcgtatgaaaaaaaatggataccgtgatttaagcaacaatcacaatgttggggtttttttttgggccagtcacgcgttgggttcttgattgtgcagtgctcggagaagtatggtctcgacggtgaggcctgggccaaagctaaagagcagtccccactcaagaccttcccctgccgtgggtagcccacgcttccgagacctctttcgcatctcatccataacaacaatgacacacgagctcagtgtgttgccatgctgcgccatcaccttccttgagacatccatcttctcttttctcagaacaaggctgctctccaccttgtccagtatctccctgccaccagggtgcaccacccaaaacagctcctcgttccagtccttggtgaggagcgaggcacgctcgagtgccttcttcacacgcccctctatgtttctcgagatatggagcgcgacatctcggtgaagggtgtacacaatcccatcctcgtatagcttggacaccaccatctcttccgtgcccggtatgatgtcttgtgatgcagacaccatctc

SEQ ID NO: 9395 - DNA, 1730 bp, Triticum aestivum
  Clone ID: PAT_TA_9395
atctgaagaaaattagcatcacctagccgccgccactgccgccgccgccgccgggaacatggccgcgcggcggtataccgagcacgaagaggcgctcgagatcaagtcccttcgccgcatcatcgccgcctacatcaactatcaagatgcagcagagaaagatgtcaagagatatgaacgttcattcaaaaagctttctcctgcccacaaggaacttctatttcaccttggtcttaagtaccaacgactgagatggtgtatatccatgaatacatcttttatcatgaatatgcttgaggcatttgaacctcctttcgacatgagtcagtgtgtagatggtgattgtcatgattgtgcagagcacatgcacgggcatagtcatgctgataccataaataattccgaattgcttgctcagcattgttgcccagaggaaggtgcaaatactagagaaactgagaacaagaaggatgaggaagtccacatggtgggctgctcccagcctgctgcctgcaacttggggatatcccaaggtgaagataaatcatgtaatgatggtaaagatgcgagtgcagctgctaactgtcaagatacagattgctttgcatcttctactgatgaaaatataactccagggcaccgcagggctccatctttgccactggatgttcctccagttgatgttgacaaagtaagatgtatcataagaaatattgtgagagattgggcccaggagggtcaaattgaacgtgatgagtgctataaaccaattcttgaggaacttaatcgtctttttcctgaccgaagcaggccaccttcatgtttagtccctggtgctgggcttgggagattggctctggagatctcttctctgggttttgtaagccagggaaatgagttctcatattacatgatgatctgttcaagtttcattctaaaccacacccaagaggccaatgaatggaccatttatccttggatacacaacaattgcaattctctttcagacaaagatcaacttcgggctgtttcatttcctgatattcatccctcaagtgctgggataaccgaaggattttcgatgtgtgctggagattttgtagaggtctacaatgaggaaagccaagaatctgcatgggatgctgttgtaacttgcttcttcctcgatacggcacacaatattgttgaatatattgagataatatcaaaaattctcaaagatggtggagtctgggtaaacatgggtccgcttctttatcactttgctgatgcctatggaccagatgatgatatgtctatcgaactaagtttggaagacgtgaaaagggtagcttaccattatggatttgtgatggaggtggagaaaatgatagataccacttacacagcaaatatggtatcgatgatgcagaatcgataccgcgcggcattttggacgatgaggaaggatgcgtctcggtcgaaagctaaaaagcggcagtgaggcgaagatcccccgtttggtgtgaaattcgcgtcaaagttgttagaaatttagaaaagagtgatttgggtcggtcccattggtgatgtttatcctgggacaaacgaggatgatgtgtttggtgccgccattgtcgcaccatgatatactagtgttgatacttggacctcagagcgaaactgctgtgaatcctgtgatataatttgcttggcgtcacttcacctcgagcaaaaaaaaaaaaaaaaaa

SEQ ID NO: 9396 - DNA, 752 bp, Triticum aestivum
  Clone ID: PAT_TA_9396
cacgctacaacaatatagcgagaacaacgcgccacctgccgtgcagtgggcggcgtcgatcgagcgtgtgatccaatgcaggacaagtacgcagggtgctcgtcctcgtcatcgcacggctttaggagctttggagatgtcatccatggtcggcctgttgtcccttctcccccccgcttcagtaaggagatcttcacccattcccatggcctgcccggagggttgaactgcccgttcagcctgctatcccacttaatgacatgatgtctcccactcgccaccacctgcttcagcgcttgcgcgatctgccacgtctcccagccgctccccgccgtccgtggtcgtctgggcagagatcctgctcccaatcacgatctccagaagcacgatgccgtaactgtacacatcgaccttggcgtcgaccggcaggcccatcgcccactccggtgccatgtaccccgccgtccccctcatgtgggagagctgcacgccggtgtcggcgacctcgccattgcctgtggcgtttctcccggacagcttggccagcccaaagtcggcgatctttgcgtcgaggtcgcgcgtgagcaggatattctctggcttcacgtcgcagtggatgacccactcgaggcactcatggtgaaggtaggctaggcccctggccgtgcccagcgcgatcttgaaccgctcgctccacgccagtgacttgccgatgtccttgccgaacaggtgcctgtccaatgactcattct

SEQ ID NO: 9397 - DNA, 440 bp, Triticum aestivum
  Clone ID: PAT_TA_9397
cgtccgcgctctgttctgttttcctcttcttcaatacgaaattttccccaccgccgccgcctaggtcatatcctaccgccgccggccaccacggagcatgccccatccgctgctggacgccccaatcaagagcaacctagagggctattgcgcgtgcgccgaatagtttgctcagagccggcagaagctgttggcatccccatgggagcggagacgaacctctcgtcgccgcagctagatccgaccaagtcgcgggagtcggtgaccctactcaacgacgatcagggttcagtatacgtggctgagtgtgacaaaagcttggagccggcaattggcatggtcgttgataaatgggagaccggcgagatgttctacacacggtgagatgtctacacatgatcaggagaattagatggcgcaacagacatgcaggttatttg

SEQ ID NO: 9398 - DNA, 1267 bp, Triticum aestivum
  Clone ID: PAT_TA_9398
gtttcagaaacagcacagccaactgccgtctcaggagcatgtggctgagtctgcgtccggacaaacgctgcagcagctggacgtctcgtcatcaaacaacttggttgatgttacaccattcaagggattgtccatcactgccacgtcctcgtcctctcagcgtgacaccatttgggtccgataccagtgtgattgggggctcacattttacaccaggatcgatcttcatggatatttccacacatatcctcatgtggatgggccatttcagagcttagagcaagttaacaatgccattgatcgctatcttcatgaccgtcgggatccaataatgtgcgaggagcgacctgagttctatgaagtgggtaaggctagtgttgagaggggtatacgggactctcttttctggcctgatggctcaaagaagatgtacgtgaaatctgagccggttgatgaaagccgttgctggatgctccagctggttcaagctttggtggacaagtataacgaggatcacaatcttttcaaggatcttgcgtttgaagttaaagatgttgtgtgccgcgaagtaatatatgagggcaactgcctctactaccatattaatttcactacaaggaccaaaggagcaaagaccgccgacaatctattcttttctgaagtcaaacgtatgccaggagaagacaaaaaattggtggtcagctgtacctgcatggttgatccttctgataacggtcaatgctacggctgtgaaagtaatatgaagcaccccaatgctgatgcatatgctggtggtcactcgaaggtttgcaacttgaagggagaatgtcttggtcctaatatagcggtcgcagagactatggatgactggaaggctgaggaagcgagggtaagacaaatgttcaagggccttgacgatccaactgttgtggcgcgactcatggaaccacccaagttgaacttcggagcaaccaaggccaccgatgaggaagtagaacgttttatgaattcgatcatgggaccatgcgatcctaacctttgccccacttatggcatcctcgatgctagcgccgtagaaagatttagagtggcgctaatgtaagaccaaggatgctgcccggagttatgttgcactttcttgtggctagatggttcctatcagcaaaccgttcgataccaagctattttgtgtcgcctgtagaagaagctgatcgaatgcttatttggtttgaagattgttatatgtacggcttttattatgtgtgta

SEQ ID NO: 9399 - DNA, 656 bp, Triticum aestivum
  unsure (1)..(656): unsure at all n locations
  Clone ID: PAT_TA_9399
agcttgtgatngacgcctatatttgcttccttgccctcccaggagaaagaaagtacaggttgctacaagccatgaaatccctagctagctaccccagatatctagtagtgtacacaagcatagctgataaatacccataggaataactgtaccatcttctctaggtatgtagtggactagcctaaatattactaggactagctctcatatgcaggcaccaagtgggaaaagttcacacccgaggtcattttccgtgaacggcacttcgtcgctctccacttttatcatggaattgagaagaccatcaaagttgcagctgctagaattgaatccaccctgcagctttggaactcccaaatcgtacatatcggtctgctcaggcacaatggcaccaccatcatagctaaaacctccactgttcagtctttggtcttgtctcattccaccatccattctatgtctagagttgcttgcaaccacaaactgcaagtattttgaatgtttctcggtatcatgaggagggagcagcattgtactaccacaagaactagctccacatttggcattgctggctactataaggctctcagaaggacaaacagtcacagccattctttccgaaaatatccccttttggtccatctcttgttctccag

SEQ ID NO: 9400 - DNA, 1956 bp, Triticum aestivum
  Clone ID: PAT_TA_9400
gccggaggcaattcccccccaactgcaaacaaaatcgcggctcgcaagaacaagaataaaagtccgatctttcctttcctcgtgccgccaccaccccgcatctacttcctcgccaccccaccccaccccgagctgatcggtgttcagctggattatccaggccccggtcgataaaaccgatgcttctccagcctcgctaaccctagcagcagcagcctccgtgcgccttgggcccgccgccatgtcttggctggagatgtggctgccggccgcggccgagggggcggcggcggggctcttcctcgacgccggcgacgcggcggcgcacggcgcgctcctcgcggccatgcccggctgctcggcctccttcggcgtgccgcggcggcggcgtgggagggcgccgccggggtttctctcgatgacgatgtcggtcaaggggggccgggggtccgcgcccgcccccggcggcctgctcccgggcggggtccgcgcgggcggaggggggccggtcgcgggggggcgggcggccgggtgccgcgcgccgggggtgctggtggccgaggcccacgggaagctgacggaggaggaggctcattctggagccggcgccatgaacaccaccaagcatctctggtctggagccgtcgccgccatggtctccagaacagttgttgctcctcttgaaaggctaaagttggagtatatagttcgtggtgagcagaggaatctgtttgagcttatccaagcgattgcaacaacggaagggctgaaaggcttttggaaagggaatttggtcaatatcctccgtactgctccattcaaggcggtgaacttctatgcatatgacagttacagaaagcaacttctcaaatggtctggtaacgaagaaacaaccaatcttgagagatttattgctggtgcttctgctggtgttacagcaacgataatgtgtatacccatggatacgattaggacaaagatggtagctcgtccgctggtggtgaagcattaggtggggttattggtgttgcccgccacatgatccagactgaagggttgttctcactgtacaagggattagtgccttctcttattagcatggcaccctctggcgctgtattctacggggtgtatgacatactgaagatggcttatctgcattcccccgaaggaaagaggaggatatcaatgatgaaacaacaaggtcaagaagcaaatgcattagatcagcttgagttgggcactgttaggaccttactctatggggctatcgctggatgctgtgctgaggcagccacatacccttttgaagtagttaggagacagctacagttgcaagtcaaagcaacaaagatgaatgcactcgcaacatgcctaaaaattgttgataaaggaggagtaccagcactctacgttggcttgatccccagcttgttacaggttctgccatcggcatctatcagctattttgtatacgagctaatgaagatagtcctgaaagtggaatgagtgcaagttgattctttgtgccaatgtagcaagttcaggaggctcagctgacatcaccttggtaaaagttgcaagcaatcgtcgatttatcagtgcatctagcacattttcttttttctggtaggcttacttcacgaaagcttcagaggctgtgagtgtagcttcattttggtcaaagcattattcatttgaagctttgcagtcacagtattaggtcatccgtgcctctttctgtttgctcatctatagcagattgagctgtgcccgagtgaaaacatgtgtgcttccttgcccttaaaatttcagttaacaaggtttcaacttttaatgcttgatgtatggatggatgcatgtctgcaagccagaacgattttgtttgctgcaggctcttgagaactgatatttgcctcctggctccagtcaaaaaaaaaaaaaaaaaaaaaaaaa

SEQ ID NO: 9401 - DNA, 962 bp, Triticum aestivum
  Clone ID: PAT_TA_9401
ttttttttttttttttttttttttttgtcttcaggctgcgcgctatcgctcggccatctccatttccccgtttccacgggtgaacaaacagactgccatttcacaaggaacagagacagcgcaaaatgaagaagatcgaacgaataacttaacgggcaactcaaccgcgctatttacatctctcaatcctcgctcctacgttattttgtacacttggtctaaattatattcaatccccgtcctccgtagagacaggctcccatttcacaagcaacacgagaccgcgcaaaaggaagaagatcgaacgaataacttaacgggcaactcaaccgggctatttacacctctcaatcctcttgctccgccggtgccgcggtcccgtcggttccgagcaggcacgcgtcggccccctgctcctgcccctcgggatcttctagtgttctgtacagcagcgctgctcttgtacttcttccaagccaagccagccagctgccgggccccgcgcgcggcggctgccggcccccgccctgcccgccgccacccgccgacgccccgcgctccccggctccgggccggctcgtcccgcggctctcaaatttgaatccggacgcaagggcgtcttcttcgaagttcagcaaccatgactgcggctcccgctgctcatccctcctcctcctccccttctcctgcgaccccccctccccggcccgcccgtcccctcccccggtctgccctccctcccggtccctcgcgctgcccctccctccgccctcgttctgggatccggacgcaagtgcgtcttccaggaagttcagaaaccatgactgtgattcccttttcagatcgatccacgacctgcggatctccttgaaaccatcctctctggcccattccagctttccactggtatacgcatcgtcggggttcttcgctgcaccacttccagcagctttgttctgaga

SEQ ID NO: 9402 - DNA, 1043 bp, Triticum aestivum
  Clone ID: PAT_TA_9402
cgtccttccgggggtgtacacataacgtagatatcggctccgtcagcggatgctcccatgttgacggttggagtaaatgagaagaattacaaccctagcatggatgttgtctctaatgctagttgtaccaccaactctcttgctcctattgccatgcaaacgactttggtggtgaccattcttcaaggcctaatgacgccaatgcttgccacgacagccactcaaatttcatgaagctcgtctcctggtacgacctcgagtggaggaatagcaactgtgtcaaacatctgatcgagcactaggttcctgccgcctaacgatgatgcccccttctggctttaaatggaaagctcactggcatggccttccaggttcctacacctaacggatgggttgttgatctgacctgccgactagagaaacaggctgcctatgaagatgtgaaagcagctatcaaggaagcatcagaaggttcgcttaaaggtattctaggctacacagatgaggatgttgtttcaaacgatttcgtttggtgaccacaaggtcgagcatatttgatgccaatgctggtatgggactaagttcatctttcatgaagctcgtctcctgggtacgacaacgagtgggggtacagcaaccgtgtcctcgatctgatcgggcacatgtctcttgttgcctaacgatgatgccacgatacgatttagcacagaaggtctcctcgcgtagtgtaggaagtgaaggctgcaattttgatggccattttcgtatcctggaataataataattctgtacgatgaaaacaatcaaatcaatcggcgtcgacttgaagctgcagaacgctcatgctggtctgtaaaaccccataattgaactgttgtgggtggacaataaacccaatctccgactcgtcaagtcatagtgctgttactttggccctgtggtggcatccgtgttttgtttccaccttcatagaggataggaaatgatgatgatgatgatgactgttgtttgcagtctaaagttttgcaacaatgttgtgtggg

SEQ ID NO: 9403 - DNA, 874 bp, Triticum aestivum
  unsure (1)..(874): unsure at all n locations
  Clone ID: PAT_TA_9403
tnttgatttattgtatgtttgtaaaaangttatccatccggaggaccatacatgccctcaanatttntgcatgtaaaanaacttggaaaatgttcttctgtcttgatttgtgacaatcctgtccgaaatggacagaggcttttatatattgttataaagattacagacatgatgtgatggcagcactcctgcgcttgcggtaacaatcaccgagggggcggtgcgacggaacagtgatcgctttgccaaaccgttccgaggtgacacgagcccattgacgaatctcgctctctggcatgcccatattcagcacaggagcgcattctagtgtcacctgtggttctatggccacatgctcaagtgcaggactcttctcaaggatgcaacacaagagctcaacctgagcccggtaacacctgaacccgctcatgtagactgtcttcaggtgatcaaggcgatgaatacaggagacttcctccctgtcccctcgccttgccagcatttggctcccaacttgtgatacatcatctgcttctgcagcgtctcttcctgggccgccaatgccatattgcgcgccagctgtactcgtcctctgtcgccatccggtaccctggcggccttcttttttgcccaagtcagtggcctcagatgcctgcacatgcgtgcggggctcctggcccccctggctccctgtggcctccgcccggggggcgcggccttcctgtgggcgtgcatgttgtgctccctggcggcccggtgcctggccttcgcggcgtgtgcgcccccaagttcgttgtgttccgttccaacctggactctgccatatcgaaggcatttggatgtctcttgagggaaaatgcacgggggaacaaat

SEQ ID NO: 9404 - DNA, 951 bp, Triticum aestivum
  Clone ID: PAT_TA_9404
tcgtgctccactcccagcctcggcgccccccttccgtcgcctcgccgcgccccccccccagcgacgacgctcacgtcccctcctcccgctccctcccgcggcgacggagctgacctcccgtgccccctctacctccccctccccttctcccgtccccccctcaccccaccaccccccccacccggccccccttcccctccccacccccgcatccgctgcggctgccccgggtaccccttcccacccccgatctttccttggcaagctcgcatctccacctggtccgcaacaggagacgccgcgctgggtgttgtagctacggaggtcatcgattgggcgaaggacgcccagtggcagtgggaagtgacccgaggcgaggtggagtcagcaaggcggcagagtggcgagattcgggatcgatggatccgactcccgacgctgcgagcccgtgttgcccagatcttgacgacggcgagccgaggttgcctacgggcggcgggcggcgctcccgtggcgaggatggcggggcctggtcggatccgggcggatctggccgggatggatctatttctggcggatttggcttggaggcggccggatctggcgagattgagggccgatggcgccatggtcctcctggagatccctgctcaccgagaaagagagacagaggtgagaggagatcaagatgaaggaggagatgggcgaggcggcggagcggccggagctccggcggcggggcacggtggaggtgtggggtcgccggcgaggtggcttgcgggtgcgaggggagctcgggtaggaggaagctgcgggaggcggagcggtccagttcgggctggatttctagggttatttatgtaaaagtgaaagtttttttagaatccactaaagaaaggactacgggttcaatttttgaaaaaaaaaaaaaaaaaaggcccctagggtccc

SEQ ID NO: 9405 - DNA, 292 bp, Triticum aestivum
  Clone ID: PAT_TA_9405
ttgcgcatgaacatattcggggggaaaaatagcagcggaagtacacctcgcgtgtgccccgatcatgtccattatttaacgagtttattaaacaaactccctgattattacatttgctgcatgcacgtgtgaggcgtgacacgagcacgaagtggcttcttcatcgctttgaagaatccgtcgagctccgtgaggtcgacgccacaatttccctcggtccactcgaactcgcgcaccagcgctgccagcaagcacttgacattgagcatccccagagccatgcctgggcagt

SEQ ID NO: 9406 - DNA, 327 bp, Triticum aestivum
  unsure (1)..(327): unsure at all n locations
  Clone ID: PAT_TA_9406
acaacatctatcttgcatgtctcaagcatgagaacatgctattaaacacaccatcgcagttgtatatacagaaacttgctctggtctggtcaacatgtcgggagagaatagccataccagagtgagactgtactatcaaacacacctataatctacatgttgtatgtgtttcatcattgctatacgggaggcgaaagcagcacctccacttgatctttacattctcttgaaggaccgaactggtcgttcatctcctatcactcgtgtnctnttcctggacgcacttgttgganggtgtgccgtntgtgttgcagccgtatcacccca

SEQ ID NO: 9407 - DNA, 710 bp, Triticum aestivum
  unsure (1)..(710): unsure at all n locations
  Clone ID: PAT_TA_9407
ttaatttcggtctattagcagcattttgagcacctacagtacgctcctaaaagttttttaactacagaaaccaccctacctaaaaagattacagaaacaaatatttacaaccaaaaacaaaagcaaaaaaacacaacaaaaaataaattacaaagttcctaaatcccctccgtacagattgacagcggcatcttcccgtgccgaccagtgctcgccagaggtcctccccatcgcagcaacccttgtggccggcacgactccagcgttctcgaggacggcgcttcgccccatcttagctcgcgtgtgatgccccaggaccatggaggcccggcggtgcagacagatcttgtgcatgtcggcgccgtacgaattgccctggcaacctcaaccgcgcacaggggacaaatatggccggcgacatagggctccgtcgtggttcaacgggaagccatcccatgggtggcgcggtccccggtcaggcctcgatgggagccaccccgctggcgatgtagcccccggtcgggactcaacgggaggccatcctgctggcgtgccggccgccgtcgctccggaagtggaggccgtcgcaccttttggcctttggtgacagcatgcgccatggcgcagcttccaggctggtggacggagatgactaggcggcccaccgctgaacaagcaaagaattcgacggcatncttgcgtggtgggga

SEQ ID NO: 9408 - DNA, 686 bp, Triticum aestivum
  Clone ID: PAT_TA_9408
acgcctactactggttgtcttgtcggattcttctcgtctggacacgatgactggcctcccatcgcctctcatatggagtcgggatgccgcaccagcatcagtcaggtggaagcaggcgggtcctgtctttaagtgagtgtgtgccaacgcacaataacttccagcacaattaattcgtgacacagttctaccagtaacttggcacatatgggatgtgaagcaaagatcccagcacaatagattctaactaatgggtctcattgcccagggaactcatgattcccaataacaaaccacaatattaatttctgcagtaacataatacaggttgtaccttcaaatattgattttagtcgcattcttttagattttcctgtcttgaccagcttgtcccagcggattgtgttcacatggtacaattggttgtcttgtcatattcctctcatcattacacgaaaaaaggactcccatagcctcacatatgtagtcgggatgctctcgtggcagttctccatggctgccggccctgctcgccggaccccgaggtaggagacgcgcgggtggacagccgagcgagacatgggcgcgcgctggcggtgcgttcggattcaggagtatgtggtctacgacggctaacgggagctcggggcgttccggcgacaggcgaccgtgcggctgaaattggg

SEQ ID NO: 9409 - DNA, 559 bp, Triticum aestivum
  Clone ID: PAT_TA_9409
cattgttggtggattttatttttgtcaggtcggacgggcgcgcagccgcacctgttaacatccaatttcacaagaaggtgctcttgcaggggactttctggactggcgctatgccgctctaaccttctctcctcctctgttccaactcccctcctcctcgttcccccaatctttccctcgccctctgatctctctctaatcccttgtcacatcttctttcttgtggatcctttctcatcagctgtcctgctttggccctcccggtcacttgtggttctggaggggcgggtttctagcataaaaagagagcttgctcgtccggatgcggacgagcccggggaaaagagtgttaatcaggtcactcagctctcttctcgagcgattgcgccagatcctgggattgagctcaccatgcaagcgctgtccatcagcgaaccggcgattgtttatattcaggctgaacagaggcttgaggagggtcaggatgcagatttcaattttctcatgaagcttgcttctacaagaggcccaatcagagttctttcgggttaggctgggc

SEQ ID NO: 9410 - DNA, 1456 bp, Triticum aestivum
  unsure (1)..(1456): unsure at all n locations
  Clone ID: PAT_TA_9410
cattgttggtggattttatttttgtcaggtcggacgggcgcgcagccgcacctgttaacatccaatatgacaggaaggcagctcttgcaggggactttctgaactgtcgctgtgccggcctaaccgaaggatactcagcttcgttggtggcattgacctctgcgacggaagatatgacactcagtaccactccttgtttaggacacttgacactgtccaccatgatgacttccaccagcctaacttcgcgactgcatccatcaccaaaggtggcccaagagagccatggcatgatattcattcacgattggaaggtccaattgcctgggatgttctttacaattttgagcagagatggagaaagcagggtggcaaagatcttctcgtgcagctcagggatctctctgacataattatccccccttctcccgtcatgttcccagaggacagagatacatggaatgtccagctcttcagatctattgatggtggtgctgcttttggcttccctgatactcctgaggaagctgcaagggctgggcttgtaagtggaaaggatcaaatcattgacaggagcatccaggatgcatacataaatgccatccggcgggcaaaggacttcatctacattgagaaccaatacttccttggaagttcctactgctggaagcccgaaggcatcaagcctgaagaaattggcgctctgcatgtgattcctaaggagctttcgttgaagattgtcagtaagattgaagccggagaacggtttactgtttatgttgtggtgccaatgtggcctgagggcatgccagagagtgcatctgtacaagcaattctggactggcaaaggagaacaatggagatgatgtacactgacatcacacaagctctcgaggcaaagggaattgaagcaaaccccaaggaatacctcactttcttctgcctaggtaaccgtgaggtgaagcaggatggggaatatgaaccccaggagcagccagaacctgatactgattacgtccgcgctcaagaggctaggaggttcatgatctacgttcataccaaaatgatgatagttgatgacgagtacatcatcattggttctgcaaacatcaaccaaaggtcaatggacggcgcccgggactccgagattgccatgggcgcttaccagccataccatctagccaacagggagccggcccggggccagatccacggcttccggatggcgctgtggtacgagcacctgggcatgctggacgacgtgttccagcgcccggagagcgtcgattgcgtgcagaaggtgaacaggatcgccgataagtactgggacatgtactcgagcgacgacctggagcaggacctncccggccacctgctgagctaccccatcggcgtcgccagcgacgggcgtggtgacggagcttgccggcatggagttcttccccgacacccgggc

SEQ ID NO: 9411 - DNA, 2953 bp, Triticum aestivum
  unsure (1)..(2953): unsure at all n locations
  Clone ID: PAT_TA_9411
gggatctccctcccgcccgctccctcgtcctctttcccgtcctcgtcgtcctcttcagcggtggtggcaggtgactgtgactagcaggagcgcggaggaggggtccttcggtgtccgccatggctcagatcttgctccatgggaacctccacgtcaccatcttcgaggcctcctcgctctcccaccccggccgcgccagcggcggcgcccccaagttcatccgcaagtttgtagagggcattgaggaaactgtcggtgttggcaaaggaagctccaagctatatgccaccattgatctcgagaaagctcgtgttgggcaagatagtatgtgtggatgttgggtgccaagccaggcctcctcgctgagtacgatacacatcttcgtcagcagccttgccctgtgcgacggacgatgtggcacgcagacccactcggggcgacgctcattggaagggcgtacctgcctgtcggagagctcctggaaggagaggagatcgacaggtggcttgaaatctgtgatgacaaccgggagcctgtttggtgagagcaagatccatgtgaagcttcagtactttggcgttgacaaggaccgcaactgggcgaggggtgtccggagtgtcaagtttcctggtgttccttacaccttcttttcgcagaggcaaggatgcaatgttagattgtaccaagatgctcatgtcccagacaactttatccccaagataccgcttgcggatggcaagaactatgagcctgccagatgttgggaggatatctttgatgccataagcaatgctcagcatttgatttacatcactggttggtctgtgcacactgagatcaccttgtgtagggacaccagctcgccccaaacctggaatagatgtccctcacggcgagttgatcaagctactgctgagagactgcgtccgggtcgtcatgctagtgtgggatgatagaacttcagttggcttgctgaagagagatggcttgatggccacccatgatgaggagactgcaaattacttccaaggcacggatgtgcactgtgttctgtgccctcgtaaccctgatgattcaggcagcattgttcagtatctgcagatctcaaccatgttcactcaccatcagaagatagtatgtgttgacgatgcattgcctagccagggctccgagcaaaggaggacactcagctgcgttggtggcattgacctctgcgacggaagatatgacactcagcaccgctccttgtgtcacgacacttgactctgtccaccgtgctgacgtccaccagcctaactttgcgacgttcataccaaacatggtgatagctgatgacgcgtacatcggcattggttctgcaaacatcaaccaaaggtcaatggacggcgcccgggactccgagattgccatgggcgcttaccagccaaaccatctagccgacaggcagcgatctccggggccagatcaacggcctttctgacggcgcgtgtcgtacgagcacctgggcatgctggacgacgtgttcccaacgcccggagagcgtcgattgctgtgcagaaggtgaacaggttcgccgataagtagctggggacatgtactggaaagggtcgacttatgagcaggaccattcaggccacatacagaaataccctccgggcgtccaagaacttcatctacattgagaaggagtacttcggtggtggtttccactcctgacagcccggagcccgcatccttcagcaaccaggccggcagcatgtttccccccaatccctaccacagagataagatcgcatcctgcatttcctgtgtgtggcctcagtttggtggtttcgtttagtgattctgaagttgtgcctcagaaaactagcgggctgtcatagttggggtgcagataataaacgctggagtgggcatggatgagaatcacggtagtgactgaggagaattgattggtactttacacggtttctgctgtctctatcaccgtttaattatacattgtcatggagctagatggggaagatgaaccacaggagcaagcatatccagtatagtgataacgaccgtgctcaagtggttaggaggttcatgatctacgttcataccaaaatgatgatagttgatgacgagtacatcatcattgggtctgcaaacatcaaccaaaggtcaatggacggtgcccgggactccgagattgccatgggcgcttaccagccataccatctagccaacagggagccagcccggggccagatccacggcttccggatggcgctgtggtacgagcacctgggcatgctggacgacgtgttccagcgcccggagagcgtggagtgcgtgcagaaggtgaacaggatcgccgataagtactgggacatatactcgagcgacgacctggagcaggacctccccggccacctgctgagctaccccatcggcgtcgccagcgacggcgtggtgacggagctgccgggcatggagttcttccccgacacccgggcccgcatcctcggcgccaagtcggactaccttccccccatcctcaccacatagataagatcgcatcctgcatttcctgtgtgtggcctcagtttggtggttcctttggtgattcagaacttgtgttccagaaaatagcaggctgttatagttgtgggacagttaataagcgcagtggtgtgcatggttgagaaccacggtagtgactaggaggattgctgatactttacacggtttctgctgtttgtattactgtttaattataaattgtcaatgtttagttgtttacgctcgtaactacttggatcttcaatggtggacaataaagttaacgcgtgaattcgacgagaggaccggttcccgcgccccccggcggcgtgtnaactctgacgggaaanctgggtnccaantaaccctgcagaatccccttccanngggtatacaaaggccc

SEQ ID NO: 9412 - DNA, 588 bp, Triticum aestivum
  Clone ID: PAT_TA_9412
tgaagctgtacccgcacctcaccgccgggcagcgggagatgatagagggcgccggcttcgggggcctgctgaggctccagtgccccaccgtccccgccaggctctccacctggctcctccggcggttcgtcaccgactcctccgagctggtcacgtccggccggggcaggatccccgtcaccgtcgacagcgtgcaccgggtgctcggcatccccaagaccggccgcgacgtcgtgtacgggctggacgacgagagcatcgcctccgtgctggacaagcacggcgtcgacaggccgccctccatggcgagcctggagaagtccatcaagctgatgaagtcggcggacgagcacttcctccggaccttcgtaatgctcgtgctctcgtccttcctctgcccgaccagcagcctgaaggtcagcccccggtgcttccccgcgctggtgaacatcgggtccatcagggagctcaactggtgcaaattcgtcgtggagcagctcgagaagtgcgtctcttccctcggcaagaagaacagcgcaaggggttgcctcttctatctcgtgattctgtacctagactcgcttgatg

SEQ ID NO: 9413 - DNA, 1519 bp, Triticum aestivum
  Clone ID: PAT_TA_9413
cccccccccgcgccccccgcgtcgtcgccgcttcgtggctgctcacccccccgcctccggcagcaccctcctccgcgttccacttccaccgaggcggaggatggcctccgacgacagcagctcgagccaccccacggagaagaaggaggaggcctccgccgccgccgccgccggtggagctggcttcgacgatctggaggacccgcggttccagtgctgcgtatgcctggagcttctgtataaaccagttgttattgcatgtggtcatatgtcatgtttctggtgcgtccataaggctatgcattacgcccgggaatcccattgtgcaatatgcaggcaaccgtatactcatttcccaagtatctgccaactcctccatcacttgcttttaaagcttgaacccgtggaatacaaaaagagggaaatggaagtactagagcaagagaggagtgtggataccttttctccacaaatcatcgagttcttaaactccaagaacaataatggtgaaaatggaaaagattggggcaacaagcttgaagatggcaaaactggacctccaggagaagtctcagttgatgacagtactatgaacgaacattcaatgaaaataaagttagatgatgtgtcttgtcctatctgcaaggagctgctgtatcaacctactgttcttaactgtggtcatgtgtattgcatatcttgtttgccttccgtgggtgatgaagcattgaaatgtcaagtctgtggaggtcttcatcctggagattttcctaatgtttgtttagatcttgaccactttctggaagaatattttccagcagaatatgaatcaagacgcaagaaacttcagcttgagaatagccaatgcaatcctgaaggatcatcttcaagtacttcatgcaagaagggaacttttgtacagaagactctagacttatcaaatgttcacattggagttggatgtgactcatgcggggtctatccgatacgaggcaagcgatacaaatgcaaggattgcacagaggcaattggattcgacctttgcggggaatgctacgacaacacttcaaagctcccaggccgctttaatcagcagcacacacctgaccacaggatggaactcgataattcatcactgtttgacgcgttcctgagattccaagggatacccgcggagggtctgcagcagctggtacaacaaatggagctcattggtgctggtggcatggtgcagatagtggctgatgatgaagagatggaggacaatcatgaggatgcttagttgctgtaggaaccaagcaagcatttctagcaaagctggtttggggagcgagccttgaaatattgtggacttgtggtgatcggattaaatgaatgtagtgtttgtccttgattccttttgggtccgaaggtcaattagtcttgtttatgctttcgtacatttatttattactgtattatattagtcttccatctatataataataaaaagaaattatataaaaaaaaaaaaaaaaaa

SEQ ID NO: 9414 - DNA, 1166 bp, Triticum aestivum
  unsure (1)..(1166): unsure at all n locations
  Clone ID: PAT_TA_9414
ccatatcatgnaaaccatagactttgacgtgcatgttggacattattcctattttgaccagcatgcgaaagatgaacatttttcaccgttgttcgaacaaattgctaagttggatgaagcactttacaacattcagtttgagcagcactggctagaggcccaaaccgaccggcaagcaatattgaacgagaatatgagcaggagggccatccacaaggcacttttcgagtcggccgcgctcatcgcagccagcgtcattcaagtctacctgttgcgccgactcttcgagcgcaagctggggacatctagggtctaatgccccgtcagaaagcgctgccttgttgccccctcaaaactgtaacactgaactgtgcgccatcacttgtttgtggattcttgttttacatatgtataatcctttgtgactccataaaaaaaaaaaaaaaggcggccgcctttttttttttttttttgtgctagtagtatataaacatatagataaatagtacatatacatccattgtcagaaatttcaatacgtaacaacatggtactcaactaaaaaaccattgtactagtgcacatccacgggccggtaggcccttcaccggagcctcttgtggctgtagacataggtacttgcgcaacggaggtagagcgcgagctgggcggcgctgaagccggcgagcaaccagtagaagtagtcgaggtgagcacggttaaggttgtccgcgaaccagctgtagccaccaccgctgctggtgatgcggtcgattagggagacaagagtgccgctgatgaagttgcccatgccgatcacgctatagtagaagaattcctgcatcccgacttccgcaaacacacctgcgaccccaatcaaaacatattgtggcaccagccacgcccagcacatcggcaccgtcgcctccgggtcgtccactatgccgtgctcccgtgccgtctcaaggcgacgtgcttccaccaatgccgccaccgacatcgaagccagggtcagcgccatgcccgtgcccacacgttgcagcagcgtcagccccgactgggtgcccgtggtgcgctgcagcgccgacaccagcacacggtcatatatggggacaaacaataggattgatgcaggccccaatgtttgcagcgccgccggcggtagc

SEQ ID NO: 9415 - DNA, 1047 bp, Triticum aestivum
  unsure (1)..(1047): unsure at all n locations
  Clone ID: PAT_TA_9415
gccctgctcttcgtgacatcttgagtatcgactacttcttcctccgttcgtgacatcttgagtatcgactgcttcttcctccgccgagaagggaaggggagcgccacttggaatcaccggagccggacgccagcagcgatttctccgacggccgcctgcaggcggtaactgagaagctcggtacaatctgctattgctcctctgctgatagaagatggaggggctgagttggacaagggcttgtgtcttggtcctctgcatcatgccgttcttgcaccaggctgcggctatccgctttgtgattgatagggaggagtgtttctcgcataacgtggaatacgagggggatactgttcatgtatcctttgtggtgatcaaggctgacactccgtggcattatagcgaggatggggtggatcttgtggttaaagattctaatggagctcaagtccgtgattcccgtgacaaaactagtgacaaatttgagttcatagttcagaagagaggtgtccatcgcttctgcttcaccaataaatccccatatcacgaaaccatagactttgatgtgcatgttggacattattcatattttgaccagcatgcgaaagatgaacatttttcaccgttgttcgaacaaattgctaagttggatgaagcactttacaacattcagtttgagcagcactggctagaggcccaaaccgaccggcaagcaatattgaacgagaatatgagcaggagggccatccacaaggcacttttcgagtcgggccgcgctcatcgcagccagcgtcattcaagtctacctgttgcgccgactcttcggagcgcaagctgggggacatctagggtctaatgctccagtcagaaggcgctgccttgttgcccccttggaaactgtaacactgaactgtgcgccatcacttgtttgtggattcttgttttacatatgtataaccccttgtgactccatatatgagttcttcgaaaatgacacttcacagttccatgtgctgactgatatccatattcgctatttcgcacaan

SEQ ID NO: 9416 - DNA, 437 bp, Triticum aestivum
  Clone ID: PAT_TA_9416
ccttattccctgtcgagcaggcgtccgcgtccatctacaatcatcccagacggtactccccagtgggtacctgacatattcttcgatatattaccccacttgcggccaatcctgaaaagggatagtgtcaggtctttcctccgcttcttaaatcagaatggaagggacatgacactgggttacatcatcaaaccagaagctttaaacgagctagtcatcgctaatgcactgcgatgtgccaaagttgtcttggtgggcaagaatgctgagctgcatgggttccgggccgatcccaactgcatgactcaatttgggttcttccccctgcacctagctgctgaaatgttctctgtcgatatgattgagttgctcttgcaccatggcacgtcggccaatttgcacacatccggtgctttaatcattgacaacctactccc

SEQ ID NO: 9417 - DNA, 841 bp, Triticum aestivum
  Clone ID: PAT_TA_9417
ttttttttttgtatacaagccagcagtacattgagaaaactaatagcaaccaatacaaataaaaggtgaaattccaaaatattgtagtataaactgaaggacattaattccattccacttttctggagtaaaacgactctgaaagcagttaggaacaaagaaacagaatggataatcaaagcaggcaaattgaccagctagtcatacatcacaagtatataacttttccttacaaaagaaagaaatggggaagaaagttcgtcattagcaaaattcaggggacgccacagaaacttggtggtacactggtacttgaatctgacggaagtgataaccgtattccggcataagtgggtacaattacaatgagagcttcatgttgccacagaagaagaatcaaacaccatggcaaagtgttcctgtcttcttgagtgtcactgcctaagttggcaagaatggaagcattcaggcaatatttctaaatctaacacatgtagaagacgagcgttcaacataagcgacactggaacgacaatagcacatggatattgcaagagagcctacttggaccttgttgttgttgttgttgttggtggtggtggtcatgtctgccgcgctctttcggatggatgatcttcagcatgccatgcaagtggttttcttcacttggcaaaaacatatgggaacaatcatcatatcatgtatacgataagatttttccatgccttcaacaacattgatgtctatcagtcaatcatgcttctatttatgatctcattgagtaacactatcaccgagctcaagtgggctaatctcttgtttttcatgataaacaaatcat

SEQ ID NO: 9418 - DNA, 1450 bp, Triticum aestivum
  Clone ID: PAT_TA_9418
agtcaacaaccacaacaacagctagcttaataatttgtcaaacaagagtacatcttcctcgtgtgatctacacacgagcaatcatcgtaacaaggcaagaattacaccagacttttttcgatggtcgacacagcccggccgaatcagtgggtcgagaagaatggctacgtacacgtggagcacagaaacaaagacgatcacaagatccgggagtttgaggaggtcgcttcggcgtcggccctactgcgactgatccagctatactggctgaaggcggaactgtcgtcctggttgccctgcaccatctgctggaacatcctgatgtccgccgtgtttgccacgttgaagagctcgctctgccctggctggacgccgttggttaggtcgatatccgctaagctatcgaggacccgcaccacctggctcattctgggcctctttgatgacgagtgtcgaatgcaggcggctgcagattcaatcatacggaacatttcgacctcattgaagttcctttcaagcctggggtcgactaacccttccagctttcccgtctcaagagctcgactaagcaatggtctagcccactcaacaaggctctcatcgcccaatggtctggatgaatcaacaggctttcgaccagtcataagctctaagagtacaacaccaaaagagaacacatcagatttctcagtcagtttgccactcgatgcatactctggagccatgtatccaaatgtccccataacccgggtagttacatgtgttacagcatccaaagccaatcttgcaagaccaaaatcagccaccagtgcgtcaaagttattatccaacaaaatgtttgaggattttatgtctcggtggattatccttggatggcaatcttcgtgtaggtatgctattccacgagcagcgccggcggcgattttaaccctagccgaccactctaaaacaggccttccctgtccgtgaaggtgataatgcagggtgtcattggacacgaaatcgtagacgagcagcctctggctattggcaatgcagtaccccacgagagacaccaaatgccggtgatgcacgcggctaatgatctccacctcagcctggaactcgcgttcgccttgcccgctgccgtccctcagctgcttgacagccacgtctttcccttcgggcagccggcccttgtacacagacccgaaccctccctcgccgagcaaattgcgcggcgagaaaccgtcggtgatctggtacatttcctggtaagtgaagaagcgcgagttgccgacgctcatgtcggacacgcacgctttcagcctcgggctgccggcgctgtagttggtgtggacggaggggtcggccgacgacgacattgccgcgttcgccgagccgccgcccgaaggaactgacggtggtagctctgaagagtaaggcggcgaccggaagccggcgcggtagt

SEQ ID NO: 9419 - DNA, 2587 bp, Triticum aestivum
  Clone ID: PAT_TA_9419
gcctccgcgcgcacacaacataatctccaccgtggcgctcacgccctcagtagccgtctgctccggggggcgctagccggggcccatcgccgtcggcaagccttattgcgcaggctcaacgaggtcatgaaacccctcggggcctttgctacatccgctgccccacggcctgagcgtgacttcaccgttcaggtgttgttctacaaccttgtgaacgaccacttccccagctacttcgccacggaccgtgtcccgccgcctgttgtcgccgacctcaagcgggcgactgcaggtgcgagggcctgctcccctggcccgacgcaaaggatccaaggcctccggcttcccgcctaccccaggctcggcccagcggtgacccccgacgccttccacgaaggcgcgcacgctgggacgaggagatggcagctaccgaccggcgctacatggtccaaccttccatctccatcagggatgatggagaacgtcctggttcctactctcaagacctgctccctgagagcctatgacccaaagcaggtgatcattgcgggcggagaccaggaggccgtggtgatttctcctgatggtagcctgctgacatccattgacctccccgcgcctccgacccacgcgctgatcctcgaggatttctccggcgacggtctgaccgacgtcatcctggtgacgtccgggggagtgtacgggtttgtgcagacgaggcagcccggggccctcttcttcagcacgctcgtcggctttttgattgtcgtgatcggggtgatctttgtctctctgcacctcaactcgtcgaacggtgccaaaccgaggtcgaccggccaaagatgactgactcctacgatctcagccggattctgttgggaggatcttgcgagcatccccagcacagcagacatgaggagctgttacagtgtttgaactagacatttttaatactgtagtaagctggagatgtttaacttgtgtaaactttgcacagcttttgtatgtattttaagtgatgaagttttgtttgttgtatgatacgacgaggtagctcctacatgacatgactatagttctattacttaaggtcgcataaaaggaaagaattaaagcaaacccaaggaaaaaacgttgttaataacgtgcacaagcctgttgaacacaatccactcggaaaggatgatactaatagaatatccaaagtgatcgggaaagctgcagatctggctggctcagctaaaggcaaaaagtctctgcacacagtttatattcctacaatcactaattatactcaagtttggtgggttcccaatgttgttgttgcgcatgaaaaggaagggatagaggctattcatctagcttctggacgtacgctttgcaagcttcatttgacagaaggaggccttcatgcagatattaatggagatggagttctagatcatgttcaggttgtcggtggaaatggtgctgagcaaactgttgttagcgggtccatggaggtgatgaaaccctgttgggcagttgccacatccggtgtaccggtgcgggagcaactttttaatgtttctatctgccattacaaccatctcaacctgttccatcatggtgacttttcaagaagttttgggaggtcatttgatccatctggcttagaggtggcaaccccagttctgctccagagagatgatggtcataaacacaggaagaggaagtcatggtgatatcatctttctgacaagcaggggggaggtgacctcgtacaccccaggcctacttggtcacgatgcgatgtggagatggcagctatcgacaggcgcaacatggtccaaccttccatctccatcagggatgatggagaacgttgtggttcctactctcaagaccttctctctgcgagcgtacgaccaaaagcaggtgatcattgcgggtggggaccaggaggccgtggtgatttctcctgatggtagcctactgacatccattgacctccccgcgcctccgacccacgcggtgatcctcgaggatttctccggcgacggtctgacggacatcatcctggtgacgtccgggggagtgtacgggttcgtgcagactaggcagcccggggccctcttcttcagcacgctcgtcggcttcttgattgtcgtgatcggggtgatctttgtctctctgcacctcaactcgtcgaacggcggtaagccgaggtcttcaaccagccacaggtgacgggtctacgatgacaatcggcgtgttctgtcgggaggatcttgtgagcatccccagcacagcagtgaggggctgttacagtgtttgaactagactttttactatagttaggtggagatgtttaacttgtgtaaactttgcacaacttttgtatgtatttttagtggtgaagttttgtttgttgtatgatacgacgaagctcctacatgacatgagtatagctctgccactaagggtcatcatctcatataatcttggttatgctagttttaaaaaagcagtacccatcttctgtcttgagatatgtaaggaactaattattcccgctattaccattgtttaaaaaaaaaaaaaaaaa

SEQ ID NO: 9420 - DNA, 1101 bp, Triticum aestivum
  unsure (1)..(1101): unsure at all n locations
  Clone ID: PAT_TA_9420
tttcatgtacgtccgcccacctggatacaatccagagagtgcaaaggctgctgaaattcaagatgagaagaagaagctggatcaaggcgatgccgccgaagatgctgtagctgcaaatacctcttcaatgcctgacgcgtccgcagagaagaaaaagagtaggccgaaagatgtgtttggccgttcattgccaacagagcaagaatttgaagttctgaaaaatgctccaagattggacacaggtgctcctgctagacctaaaccatttggagtcgaagttcgtaatgttagatgtttaagatgtggaaacttcggccatcagagtggtgaccgggaatgtcccatgaaggatattatcatgccgaatgaggagagccgattgaaaagggacgatccacttacagcaataaaggcacagactgattcgagtgagcctttgaagtgggagcttaagcaaaagcctggcatgagccctcctcgaggtggatataaccctgatgatcctaatcagcagattgtagcagaagagatatttgatgaatatggaggatttctcggcgatattgacattccggctctccttaccaacttctccacgagtaaatcaaagaaacgctccaagagtaaaagcaggcgcaggcagtctgagcctgctgctcatgtagaatctggaagacatcgtagcagtcatcattcattctcagattcggaacctgagaaaagcaacagggcgtcaggaagcaagagaaagaaaaaatattgttctgacccatcctcgtattctgattctgaggaggaagctgggaaaggaaaagccaagcagaagtcaaagcacaggcacaggaagaaacacctgctagagtcctcttctgattcagaggttggaagttgacacaagaaggcatccaaagagggagcacaggaagaaaaagaagaaagaggagatggaaattgcncccagtttcctcctccagagataaaggatataccataagcaagaggccttttgaggcgatcggaggggagaagcacccctacagtganctcaagtnatttctggaaagtgagcagcagcatccaacacgatggcaggacaagcat

SEQ ID NO: 9421 - DNA, 788 bp, Triticum aestivum
  unsure (1)..(788): unsure at all n locations
  Clone ID: PAT_TA_9421
cttttacattacaacaaacatgnagtctgttttctcaacttagcattgaaatccattcatgcccaacaataaaacatccaacatatatgcttcacatttgtatattacaaacctaataacagatcatttccacaaatcagatatgtgcaacacactgggtacacatgaaaagatcattctaagttagcatctttactttgtagcctttctaggtcaatacaatataatttcaaaactgaacttatatggtcttcaagccgagtgaagaaaatggttgcacaaggtgagtagatcactagccttgaagcacgcgttgccaaccctccgtttctggttgtgtcaaggaaaaacatgtgcaaagagcctgatgaacttctggcagcaaaaacatcaggctgggcgatgcacggccgaaatgcgagcgagtaaattgttgatggatatgctcccactgaaacctatgtaacttagttgcttgtgccacggtatatactctaatcatagtccccctctccgtgcttggtcccggccatgggcatttaccttttcttttttatgccttgaaaaggcagaaagagatccaaaataatcaatgagtagttggtttttatagtgatatctctcaagaaagatccagcacttggaaaactgtaaaaatccgtagatgcaatgatgtttactcagctgcaacatccatatatgttctacatagttgacactgcacgaaccgagagaaggatttttcatggcgggcaagtatattagttgcacaaggttccggatcggct

SEQ ID NO: 9422 - DNA, 460 bp, Triticum aestivum
  Clone ID: PAT_TA_9422
cgtccggctcggcgagggaggcgcacgcactctccgctcgctaccactcctcccttcttcctcgcctccgtccgtcttatcgtcccctccccaaatcccgactcccaaaacaaatccatccccccttccccgccggccgctcgcatcgccggcgacatcgccatcttcctccgcaagctgacaccaggcggcgcgccctctcctgttcttcggctggcactggactagcacggagtggggatcgatcgcccgccggccggcctctccgtcccctcgcccacagatgaaggaagcctttgatctgcccgccttggtggcggcagcaacgccagaagcagaaaacactgcatccctcttcaccaagaaaaacatctggagcggcgcggctgctgagggagaccacgattcctcgccttggccatgggactgtctgggggacggcgtgtaagctgattttctt

SEQ ID NO: 9423 - DNA, 791 bp, Triticum aestivum
  Clone ID: PAT_TA_9423
ccaattttccatttcccttatttttatcctcgttctcctcctcccgttgggtataagtctcataatcccgcgtgggaagcttccagaagggcttcttccgtacgttcctttctttggtgaggtggccctctaccgcatctggaagctactacggggttccccgggccagatccggccgggaggggcagaggaggccccggcgtgatgtcggccgagcatggcgccgcggcggcggacggggctggggcggagcctcctcccccggcgccgatgccggggctggtggcctcggcggacgcggcggggcagaggtccctgccgacgccgttcctgaccaagacgtaccagctcgtggaggacccggcggtggacgacgtgatctcgtggggcgaggacgggtcgacgttcgtggtgtggcggccggcggagttcgcccgggacctgctccccaagtacttcaagcacaacaacttctctagcttcgtgcggcagctcaacacctacggatttaggaagatcgtgccggaccggtgggagttcgccaacgactgcttccggcgaggcgagaagcgcctgctctgcgacatacaccgccggaaggtggtccagtcggcgggtcttgcggctgctgctgccgccgccgcggctggggcggtcacggttgccactgcggcgatccctatggcgctgccggttacgcgctccggctcgccggagccgcagctctccttcgaggagcaggttctgtcgttcaactcgggatccgtggaggagctgccgctggccgaacc

SEQ ID NO: 9424 - DNA, 1334 bp, Triticum aestivum
  unsure (1)..(1334): unsure at all n locations
  Clone ID: PAT_TA_9424
cccagcgtccgcccacgcgtccgtattgcggacagtgaggagggacttgactagatatgaggagctggataaggagtcccaagctcagatgaatgaggagctctctgggtggaagctggttgttggagatgttttcagagagccaacctcatcaaagctgttctgtgttatgattggtgacggaggacaaattctgggtatggcgattgtcaccattttctttgccacctttggattcatgtctcctgcgtctagaggaatgctgttaacagggatgatattcctttatatgctacttggaattttggccggatatgctgctgtcaggctctggaggactgtaaaaggaacttctgagggatggaggtctgtctcctggtcaactgcctgtttcttccctggcattgtcttcattgtcctcactgtattgaacttcatgctgtggtcaagaaatagtactggagcccttcccatttcacttttcttcactcttctctccttgtggttctgtatctcggtgccacttacccttctaggtggtttccttggaacaagggctgagccaattgaattccccgttcgaaccaatcaaataccaagagaaatcccttcaaaaaattactcatggctcctcatatttggtgctggaactctacctttcggaacactcttcattgagctcttcttcattctctcaagcatctggctcggaaggttctattatgtgtttgggttcctccttgttgtgctccttctgctggttgtggtatgcgctgaggtatctgttgttcttacgtacatgcacctctgtgctgaggactggaggtggtggtggaaagctttctttgcctctggagcagtggcattttatgtgttcctctactctatcaactacttggtgtttgatctgagaagcttgagtgggccagtttctgctacgctctatattggatacgctttcattgtctctcttgccatcatgctagctactgggactgttgggttcctgacatcattctcttttgttcactaccttttctcgaatgtcaagattgattgaaggcaaatctccaaggagtcaaggactgtacacagtgctttgatctggcatcggaaggccatctacacggttgtgccattcttaatgtagcatattactgagagtcttgatactgttgtactacgatacatctggtatgttctagtagatgtgatttttaagcttgtaatattttctcttctctttgctgcaacattcgttgatgcaaatgctctcttaagaccgtgatttgcgcccggcgactctctgccctctacctgnatngnatgtctgt

SEQ ID NO: 9425 - DNA, 2294 bp, Triticum aestivum
  Clone ID: PAT_TA_9425
aatgactggttctaattatgaactcgttgatggtgatactgttcttggctggcattgtttttgtctattattgcggacagtgaggagggacttgactagatatgaggagctggataaggagtcccaagctcagatgaatgaggagctctctgggtggaagctggttgttggagatgttttcagagagccaacctcatcaaagctgttttgtgttatgattggcgacggggttcaaattctgggtatggcgattgtcaccattttctttgccacctttggattcatgtctcctgcgtctagaggaatgctgctgacagggatgatattcctttatatgctacttggaattttggccggatatgctgctgttaggctctggaggactgtaaaaggaacttctgagggatggaggtctgtctactggtcaactgcctgtttcttccctggcattgtcttcattggcctcactgtattgaacttcatgctgtggtcaagaaatagtactggagcccttcccatttcacttttcttcagggtcgctcccgcaactgtgccgctcacgccgacgagcatctcctcccaccgtcgcctcaatctccggtgccaggtgttaggcagaggttgctgggaactggcaatcatggccaagggctggatattctctgctttgctcgtgctgtttcttgtgatggctcctgcttgtgaggcgttctacttggcagatagttccatgcactcgtaccggcaaggcgaggagataggagcaaaggtgaagtcgctcacatgcctcgagacagaactgcctttcagctgctgcagcctcccacactgccgtcctaagggtgggataaagaagagtgctggaaatctgggggagatccttatgggtgagcagattgataattccccttaccgtttccctgtcaatgtcaatgaatcgctctacctgtgtaccacgagcccacttgatgaggatgatgtgaacttcctcaagcagcgaagccaggacctctaccaggtgaacatgattcttgacaatcttcctgtgagggggtttaccgagcagaatggaatgaccactcaatggacaggctccggcgtggcgaaaaccccatgctctacgacatatgtctccatcattaatcacctgaaatttaaagtcttggtcgatgagtatgccgcaggtaaagtgacggtcgttggaactggggaaggaatggaagtgatctcagaatctgacactgacactgatgccaagtctgggtatgagatagtgggatttgaggtggccccctgctcggggtccccggagccgctccccctggccgcgccgtccggctctggctccggcctggccggcgccgccccgggcgcctcgtccggcgaggagaacgaccggctgcggcgggataacgcgcggttgacccgcgagctggggcagatgaaaaagctgtgcaacaacatcgtgagcctcatgtccaagttcgcctcgagccagcagccggacgggggccccgggtcgctgtcgtccgtggtgaactgctcgggcgagtcggcgctggcccctccgccgccgctccccgcggggatactggacctgatgccatcgtgctcagcgctggccacggccgccggcctcgccgtcgacggcgggccggatacggacgcgaggctgttcggcgtctccatcgggctcaagcgagcgcgagacgaggaagaagacggcgacggcgaggagcttcctaacggcgacggcgcgggcgtgaagccggaggaggcagcggagcggcgggccgacggcggcagcgaggatcggcagtcgtggccgatataccggcccaagcccgtgtaccgggcctgcaacgggcaggacggggccgggggccttccgggtcagaccaggacagatccaactcgaggtgagtggacgatgttgtagaagcttcgagcacctactaattattaatcaccaccaaataataatactgtaagcatcactagagtcgtgataggatcttgcattactttgctagctggtggggagctcggctgccccctctacccctgtaattgtgatgttcctgtttcatttgatctataatatgtgttgtgtaatttgtcgtggtagagcggactgtagaaatgaaaaggtgcattcccggtaggttgatcggccatttcatatgctgtatgtaaatagctccttctgcttgtgcgggagacagtagtagtagaagaggaagagtaactacgatttgcttgtggtattattattattttttgataactttcat

SEQ ID NO: 9426 - DNA, 744 bp, Triticum aestivum
  unsure (1)..(744): unsure at all n locations
  Clone ID: PAT_TA_9426
cgggcgcgtgcggcccccacgcgtccggcgcagctagggttttgctccgccgcaacgcacgatccagattcctacacttccctagccctacccaaccctgcacctcccggcggcggcggcggcggcggcgagcagcagtcagcggcaagatgaggcctattctcatgaaggggcacgagcgcccgctcacgttcctgaagtacaaccgggacggcgacctgctgttctcatgcgccaaggaccacacccccaccgtgtggtacgccgacaacggcgaccgcctcggcacctaccgcggccacaacggcgcggtatggtcctgcgatgtctcccgccactccacgcgtctcatcacggggagcgccgaccagaccgccaagctctgggacgtcaagacggggagggagctcttcaccttcaggttcgacgcccccgcgcgctccgtcgacttcgccatcggcgaccacctggccgtcatcaccaccgacagcttatggggaacatgcccaccgcgcaggtcaagcgcatcgccgaggacttgcaagaccagacggaggagtcggcgctcgtgatctccggcatcacggnggaggattaacagggccgtgtggggacccggcaaccggaccatcatcacggctggcgaggatgccaccatccgcatctgggactctgagactggaaagctgctggaaggagtcagacaaggaggctgggcatcagaaggcaattagctcactatca

SEQ ID NO: 9427 - DNA, 1443 bp, Triticum aestivum
  Clone ID: PAT_TA_9427
ttcggcccgaggttttcgactggtggggaggtgcgctatcgcagcgcacgaccttacgatcctgaatcttcccacatcccaacccccccccgacccttcggcggccgggggcgtgcgcaagatcgggggtagccgcgtcaaggggcagtaagggcccatcagagttcctgaagcataatcgggtacgcgagctggtgttctcttgtgcagtagagctcagccccaccgtctgggacgccgacatcggcggccgactccgcacctcccgcggacacaagggcgcggtatggtcctgcgatgtctcccgccactccacgcgtctcatcgcggggaccgccgaccagaccgcccagctctgggacgtcaagagggggaaggagctcttcaccttcagattcgccgcccccgcgcgctccgtggacttagccatcggcgaccacctggcgggtcatcaccaccgacagtttcatggggaatatcgcccaccgcgcaggtcaagcgcatcgccgaggacctgcaagaccagacggaggagtcaagcgcttgtgatctccggcatcacgggggaggattaacagggcctgtgtgggggcccgggcaaccggaccatcatcaccgccggcgtgaggatggccaccatccgcatctgggactctgagacccggaaagctgctgaaggagtcagacaaggaggttggacatcagaaggcaattagctcactgtcaaaatccttagattggtctcatttcctcacaggttccttggataaatctgccaagctatgggatgcaagaacactgaccctgataaagacatatgtcacagagcgaccggttaatgctgttgacatatctcctactcttgatcatgtggttattggaggtggccaagatgctatgaatgttactatgacagatcgccgtgcgggtaaatttgaggccaaatttttccacaagattttagaagaagagattggtggtgttaaaggacattttggacctatcaatgcattagcatttaatcctgatgggaggagcttttcgagtggtggtgaggatggatatgtgaggctacaccattttgatcctgagtatttcaacatcaagatgtaagcctgtgaatttctcaaggctgcagttgagagacctccctagtaccctggagagaacatagtttttttgcggctcaatttgtgagagaacttgacttagctggatggtctactatgtgatagcactcattttcctacaatcagcaaaggatttgcttaaataggtggcattgtgttgccatggttctttatttttgttcatcctaatcatttatccagaacatcttatactagtaaacaaggggtacaattagcaaggaaaatgattaaagtgtttagttacctgcatcgtttttttgtccgtttatttgaaacattttgcttacccgcc

SEQ ID NO: 9428 - DNA, 545 bp, Triticum aestivum
  Clone ID: PAT_TA_9428
cgaggggagagagagagagagagagtttgagaggcggagcagaggaggcaattccttctgttcatgtcgattccgagatattccaccgctcgatcttgatttctcttccctttctctttgatccctggctgccgcccggttgttcttgtctctcgccctccccggtatgattttgcttgtgttgtggttgtgtcatgaaaatctaggctgagtttcttgtttggatccgtggcaggtgcatgttgtggccatgttgtagtccgtcattttgcttcccttctacttgcctgagatgggtgatttgttctgttagtcatcgggtgttctaggtcatctggtcgtttgggtcgttttcacccctgctgatttgtttcctctgctgtagatgtagaggtaggcgaagccgtagttctatgaatggattccccttccgattttatttctgctggccttcatgtctattccgcctgcatttttattggtagatgtagttgtagatggcttacactgtagtgtaccatagttttacactataatttatatgg

SEQ ID NO: 9429 - DNA, 1663 bp, Triticum aestivum
  unsure (1)..(1663): unsure at all n locations
  Clone ID: PAT_TA_9429
cgcacgcgcaatctggcagctagccagagccagagccacgatgcacgcgcctccgccgccgtgttgataggttgctgccgccttgtgcgccggcaccgccacctgctgatcccgctcccttgtcacgcacctctgccgctctcccgacgcagcccgcgtcgcgccgtcccgcggcctgctcctgcaatccggcctcgcacctgccccggcggccctgtccccgcggcagccgccgcgctgcaggcttgttccccttcttcagattattctcgtcagaaccatgctgctggagatttttggatctggaatgagactaacacggaataatgaccgggttctaagattgctctttggtgaccgatctgcttatgcatcctttgtcctggcaagcaacattgcagtaaaaggagtgaataaatggggcaggccaaattggctctgcgtcctcccttgtgtcagtaactatttctgcacctccatctatgccaccagaggcaanacaattgccaccaccaaggggatggacacatcagggatgaaggggcgaacgaagcaagtccttgttggccatgcctcttatcctgtatctgaagccgacatctataagaaaaccacccatcgggatggttctatatacaagataaactatggtattctaaagctatggcatcttactcaacgtcgtccggcacaactagagccgatgatgttctcgaatcccacgaattgtttcccggatagggatagatgcatggtacattctgcaactgctatgttgcagattttctcgctgaaattggaaaaagctagtaccaacatcggcttggtacaactatatggatatatagcagcgcgtgatcgttatgattcattgcttaattatgtcttcagtcgtagcagagatgatcccatcattgttgaacagggttctcttattgagatgactggccctaagagaggcatcacaatggtagcccctgctctagttgagtttgacatgaggatcaagaaaggaaagcaagaagatgatctacaactaattgatggtgcaatggagtaccatgatctagtcacacctgagtatccattcacgcatcggattaatggagattgtggtgcggttgacatcactttagccctcgttcgttgggcatttgaggccacaatagatgttgtcatatcaaaagtgcagtgtggatttgatttatctctcagttcgtgtgttgtccttaggaatggattacatgagattcaactctttcgtggcagtgttgttgagtcatgtggcttaagaagatatgtgattgctgtaaaagaggatactttgatgcatttgaagttcaaggtaggtcagaatagttgtaaaaatgatcttgatcatcattgttttttcaaagcaaaaaaacatgggtacgactatcagcaaataatgcttgagcttgcctctatctcagtgaaggtgacttggtcgaacttgcaaaggtaaatcactcgtttcatattccaactttggttgtgttactagttgaatgtacgtgtgttgccatagaaaacaaataaatggctccacaaaaatgtgtatactctgattattgtatcatatttgtttacagagggagtatttattattcaactctattagagttgtgcgagttcagatttg

SEQ ID NO: 9430 - DNA, 1819 bp, Triticum aestivum
  Clone ID: PAT_TA_9430
tttttttttttttttttttttttttgcaatgtttcttggttgaacaataggttcctttgggaaccatgaaaattttactattccccttccggttaggcctacatacatcaaataccttaagtgaccaaatgttctaccctcatcctgtctttcttattcttacttggcataaaaccatcttagcagtacaataaagcttgatgcgaaaggaacctcggttccatgagtggcagcacaacacaagattacattgaagatgaaactccaacgtgcagactacaccactaccttcatgctctcacgccaagcgtcggtgggttcgtgccctcggcaaagcttccagggttgatagttatactcttggtgatactcttggttgcatttatcagtctcgtagatgccaaccagcctatcagcttggttctgacatgttgtttcatgagactagtaacaatgaactgggcttccttggtacgatctttcacataatgtccctcaatggataaattcttaaaaaccactgccgcatctatctcgtccataacatacaatggagttggtttataatggtgaagagcaaacactagagccagcgagctaagcgtcttctcgccaccagataggttggcaatgttcttccagcttttcttgggaggccttacgctgaaaacaacaccttctgaaaatggatccaacgaatcaacaagttccagctccgcatctcctccaagtgtaatcatctggtacatctctttcagtttcagagagatcaagttgaaccctgccatgaactcatctaaccttctcttcctcagcccatcatatagcttcttaagatcatcacgctcctgagtggtagcatttagctcatcaacacgttcgccatataaacgagcctttgtgcgatactctgctattgaatccagatttggactcgagtctttaatctgcgcttccagcaatgccaccatctccatggcttttttcaggtcacacatttcattgagatgctcatcacttagtgtttctttaagtttctcaggatcaatcgcatccttctggagttgatccatgtgtttggcaagatttgtctgaatgtcagctagccttttcttatatgccttcaccttcatttcccactccttggcaagcttttttgtatcttgcagtttgtactctgcatcaacctcagtggctcttagttcatccaccactttctttgttttattgtagtcttcctttgtcttgtcaagctcctctttatgggtgtcaatcatctcctgggtcttcttataatcttcttgaaccagaaaagccttcttctcaatctctttgaaaacggacattaacttctccttttgagcaaccagattttccatttcttttttggcctcctcaacacccttggctaactttttcatcaacttttcacatgtagttattttaactttgtggcgattgatgtctgagctagttttgtcaagttcagattggattttttctacttttgccttctgatccttgagcacctgcccccctgcattttcaattttctgctgaagttctgaagcctgatctttgagcttgctagaactcttctcaagcttctttagtgcaacttgttcagtagaaataaggtcatccagctctttcattctgctgatctcgtcatctttgggatttgctgcagcctccagtgaatctagtcgcttctcattgtaagtgtattgggcattcatactctcaacctcctttttcgcttttgccagttccatctcaagtcgagatttagcatcttccagggaccctcgtgccgaat

SEQ ID NO: 9431 - DNA, 747 bp, Triticum aestivum
  unsure (1)..(747): unsure at all n locations
  Clone ID: PAT_TA_9431
cctgtagtgcctgtgtctttatcttttacagcgccaagacctgcgggacgctgcggccgctatctataaaagtagggtaccattcggatgtcacgttggtctccatctgcgtactctctggagaaagaccaaccatccaggggaaacgggcgtatcaaaatgcaaatacagaattcctattttactatcatttgagtaaactctgaacacacatccgttacactgaaggctgaattgccatttcctgcgcagtctgttgatctcctgatggtcgcccaggcgtggccccaggcatcttggaatcagcttcaagtgacatcagagtcgaggatgcgatttcttcctttgcaagtgttgcaaccgtcgaacatggtctatgaaacagcaaatgggctacaattcgatcgactggattggtgtctgtttctgcttccttcaccagagatctttttctcctgttggatgcgtcattttctgaaacttcatcttcatctcttttagtcttgttactgctagttctgtcaccagcaatttgtctctgtgaggaactctgagccaatcgaagcagactgtctcgaatgcagagtcgagtcctggcatccagcttcccttcggcttcggctagctcactgggtgttctttcctccagaaccggagcagttccacttccagaagtcggttgcttctcttttcgtctacccggagtcggctctggtgcttctgcgccgacgacccctgcactcccnn

SEQ ID NO: 9432 - DNA, 609 bp, Triticum aestivum
  Clone ID: PAT_TA_9432
gggcggcaaattcaacactacgtttctcttatccccaactcaaagaccttccaggctagcaataatccgaacacgacacagggaaaaacaaagctcatcactgattgcacgtcagactaaccaaactatctccaacttccaaactgaaaagggcctagactgcttatttacacaccaaaaagaacacgggaggaatcaatcaacaacggtctactgcacaccgaacgccctatgacgacttgaggaccgcaccttctgttatcttccaccctcctggtccagtgaaggtcatctcgtaccgggtggtgtacttagtgtcgtacaaatcgttgttcctggggttggctgcatcggtaagctggcctgcctcctcgatcgtcgcctccacagtcgcccgtcgtccgtccagggagacggtgatgctgtcaatcgccacgtcggacagtgtgtagtcccagaaccagcctttgcgctcgatctccgctgctcggtccctccataccttcagcggacgcgtggcaagaacctcttgcaatgattccacagaatgatctgatcccaaggccttggttttgatactctgccacttgcgaacaatatcttctgcca

SEQ ID NO: 9433 - DNA, 2008 bp, Triticum aestivum
  Clone ID: PAT_TA_9433
ccacgcgtccgccctcgcgtccgccctcgcgcccccaaacatatgactgttgttgttatgctgaagtccatggagttcctcgttgatctaatgcgttttccaggacaactaattccattctcatccaaagctataatcacatcccatatatctgctgctggagagagtgactctgctgactatgattcttgtgattctcctcttgaaccgaatagtcctttgtgctctcaacggcaagagcaagatgaaaacaataggtcatttaaagttacgtccctaagagacatcatgcgccgaacttcaacgtccgttcatggtttacaagttcatcacatagtgaaccaaatgttgcaaatgccttatgtggacgccgtgggaggaaagctaatgaacattaaagaactgccagttcaagtccagaccatccattgtccagagcacatggacgctcaaacttgggtgatagacagtacggagatggtgtagctgtatcaaggtacctcagtcagatggtgcatcaacgtcaagtgcgcggagaggacgtccaaaaagtatgagtacatcccctgaaattggtgatgactttgcgagggcagttaaagaaatgagtgaaagcatgaggaaaaatcccattcaagggcacataatgatggtagtccaggacattcaaatgattcacagagaaaagaggaatcagtaggtgacctcaacgatgatgaggtgtcagtaagagaaccaaatgttcaggagggttcaagaaggcacattattactcagaaggcattgtcattaccttcatcaccgcatcggttaggtaaccatggttctaatcttagagagccagctgacttccttacagcagaagatctgatgtccacttggaataaagcattgcaatcttcaccatttctgaacaagccattattgccttttgaagaatggcatattgggttctcagagattgctgttggcactcgtgttggaataggtttttttggggaagttttccgtggtatctggaatggaacagatgtagctataaaagtatttctggagcaagatttaacaatggagaatatggaagatttctgcaatgagatctctatacttagccgtctccgacatcccaatgtcatattgttccttggtgcatgtatgaagcctcctcacttatccctagtcactgaatatatggaaatgggttccttgtactatttgattcacacaagtggccagaaaagtaagatcagttggcgaaggaggctaaaaatgctccgtgatatctgtaggggtcttatgtgtatgcaccgtttgaagatagttcatcgtgatctaaagagtgcgaattgccttgttaacaagcactggacagtcaagttatgtgattttgggctctctcggttattgtcgaattctgcaatgagtgacaactcatctgcaggcactccagagtggatggctcctgagcttattcgtaacgaaccatttacagaaaagtgtgatatctttagcctcggagttatcatgtgggagctttgcactctgagtaggccctgggcaggaaagccgccagttcaggttgtttactctgttgcgaacgaaggggcaagattggaaataccagatggacctctgggtagcttgatagcagattgctggacagaaccggagaagcgaccaagctgccaggagatcctgacccgtttgcttgattgcgagtacaccttatgttgagctattttagcgctagtatgtatagcggctagaggcaacacattggtttggtttatacatcatttcttttcccccttttcaccattttgacatctttgagatgtaaattatcgaacttaagtataataataagaacttctcatagcatcctgaatattacaccattgtcctggattaagcaatttccattatagtcgtgtatttctttgttcatgtcatggaaatgcttatgggatgtaccatttgtctaatataagtttgacatagctattat

SEQ ID NO: 9434 - DNA, 1127 bp, Triticum aestivum
  unsure (1)..(1127): unsure at all n locations
  Clone ID: PAT_TA_9434
ccactgtggaaggcatcgtcggctttcgtatacgcagctgcgaaagggatgtctgaagcntaagttggtaacccaggtttcccagtacgcgtgtaacgcggcagtgagcgcgcgnatcgctcacttagggcgaattggtaccggcccccctttttttttaggnagccttggaaacatgttactcaatgaagagtgactacatcaaaaaggatctaaaagagatgaagatctaagtaacaatgccatccgtttgcctctgtccattcattacaacaaaaaaggattacagttttagtatgagattatttaatcttaacttgacaaccacacacgcacacactcctaaacaaaatatgttgccggagcgcatctgcacggaccactcagctagttttaataaacgtcgacaaccaaaatgcccctgcctaatactctaacctgttttttttctccaaaaaaatgggggaaaattaccaagatgcatgtgagtaatagaccctggatagatggatcatgccaccaggagcagcacgagcaagcacgccgaggcagcggtgatgacggaacgcggcgtcacaagcggcgcggagttgggcaggtaggggtaggagtcgggcggcggcatnttgctcccggccccgttgaagtanatcttgcgcggnaacgcccatccctggctgaaggtgaaggttctgtcgtccttgcgcatgagcacctccgactgcacgttgccgaaggggccggcctccatgagcaggtcgttgtagagcttgaggccgtagaacatgccggtgtcgttgatgttcccgtaggggaggaggggtttgtactggaagctgaagacctcggtgacgttgttgaggttggggtgctgggcgacgagcgtccactgcgtgtagttcatgcggtagttgaagttggtgacggcgatcttggcgcgccagtagtccttgtagttgagcttgacgtgccagtgcacccggatggggcacatgtggttggtgcactgcagcagctgcgccccgtccttcttgggcgtgttcacccccggggtcagcgcccgcttggagtcgcccatgatgcacccgtcgctgtggctcttgccgccgcggccgcccatcctcttg

SEQ ID NO: 9435 - DNA, 591 bp, Triticum aestivum
  Clone ID: PAT_TA_9435
gaggggtcatcgcatggcaaaaccaggatggcgtgaacatggtgcccgacacagagagaagtgggatgctcagcctaaacagaagctacaacacagcgctaaactacccagaccaacaaaagcaacccaaactaagacaatgccctagcactctgaatctagtaccagacacggcataagcaagcaagacaacgccttcatgaaggggaacgccgccgtcatccgatccaaggaactggatctggggtttccccgcgcttgaagaggggctcggagaataagccgtggcagcgcctccaggaagggtacggcacccgcagatgtcgccgctgccagtatcaagcggggatttcgccctggccaatgtccgaacaatcccaaagccgtcgggactagatccgaagataggaacatgtcgtaaagctggagccgccatcgtcggaatgggagcttagccaccggaagcacaggcattggaccccgcaggggtgggctgaggcaaggggtggcggtcacggttagagaggcggcagcatgatgaagaggaaccaacacacgggatgcgacggcaaccggcatgtcgacgagcca

SEQ ID NO: 9436 - DNA, 802 bp, Triticum aestivum
  Clone ID: PAT_TA_9436
tttttttttgaccatgaaggaagtttccaggttttcactgaaaaccagttttaagtggatacttcgcctatgggccgactgtacaaagcttattacagcacgaacgaaccataacatttacgccgtaaacgtgttccacttgagacgtgtgcgcgcgcgccgccgaggtacagattggcaacaacaatggctgtgtcgcaattgcgtgcggagcaacacctacgagctgtcttgcttcggtttctggctgagctccgagtaatgccctcccatcagctgcagtatctcggtccagagacaggaaggatctgttgacaccgcgtcgctgatcagctctgtgctacaggaagcaacagcccagtatcccgcccggatctcgctcaggagctgctcgtaatcccaggctgcatgccccacgaagaatctcaggtcctcggtattgatagcaccactcttcatcagaacaccagccttctccagctccgttcgaaagccaaagcagatgcctggtatcacctcctcaaaccccttcagacgtgagctgtctttagtacctcccccgcggccacgctagccgacggggccccccacgaagggggcgcggccgccgagagggggtctttcggctcgcgctcagggggccgtccctttcttgatcttcgtgtaaagtggacggtttaggatgaccccaaatgggccatcaaaggtacctctcgacccaagtctgagcaggagaataacagttctttcgaagacgctgtcgtcatccagcacctcagtagctaccaacacacaccctgcc

SEQ ID NO: 9437 - DNA, 854 bp, Triticum aestivum
  unsure (1)..(854): unsure at all n locations
  Clone ID: PAT_TA_9437
cgtccaatccagcgcgcggcaccctgcccccaaccgagtcggctgcaacaacttgagatccaatccagcgagagagagaaatccccaatccaattcaccgaaccctaaccctaaccaagcaggcggcaagagagatgttggtccagaagatgccgatggccgccggctacgagggctttcccctcatcccatcgttccaggcggacaaggagcaggcggaggcggtgttggccgtcagggccatcaaggccaaggcggaggaggcgtcgttgatcctcaaggcggggtgcggctccaagaggaaggcggaggaggacggcggcgaggtcaccgtcaaggccaaggccaaggccgcggaggaggaggcggcagctttcaccaccgtcaaggccaaggcagaggaggactcggacgaagacgctgaatgggacgatgatgagttcatggccagaatcacggcagaccacgccgcccatgtcgagaagatgaaggctctgtatcccaccatcaagtacggggactacgaccctaaggtctactgccacagccccgacccggagtcggatgcttggaatctccaaaagaaatgccttggtcttgctgagattgctgccggattactgtaatttgacgactgggatgggaatatgggatggaggagggttaccaatgctatctatctatctatatgctagtagtcgatcaatcgatccggaggacatctaaattaatgttagccaagcaccacctatatgtgatgtgcgtgcgtgtgtgatatcagtgggcagtgtcaatgccaatgtatctactaatattatnctagtgctattatattataatgncttcaccagact

SEQ ID NO: 9438 - DNA, 796 bp, Triticum aestivum
  Clone ID: PAT_TA_9438
cgtccgcccacgcgtcccgtccgttcccatccccaaccctagccgccaggagctgaggaacaaggaggcagtccgggatgcggcgatcggcgatggcgctccgctccacggcggaccggtgcttcggccaccactcaccgttgacgaacgttatccaatcaacattcagtgcaaacattggttcaagattgggaagtcttgcaagagctttcagtgcaaaaccacttggaaatgaggttattgggattgatttgggaacaacaaattcatgtgtttctgttatggagggaaagaatgcaaaagtgatagagaattcagaaggcactaggacgacaccatcagttgttgcctttagtcagaagggcgagcggcttgttggaactccagccaaacgtcaagcaattaccaatccacagaacaccttctttggtacaaagcgtatgatagggcgtcgctttgatgacccacagacgcagaaagagatgaaaatggttccatacaaaattgtgaaggctccaaatggtgacgcttgggttgaaacaacagacggcaagcagtactcaccgagccagattggtgcatttgtgttgaccaagatgaaggagaccgctgaatcttaccttggcaagtctatttcgaaggctgtgatcacagttccagcttacttcaacgatgcccagcggcaggcaaccaaggatgctggtcgaattgctggacttgatgtccaaaggatcatcaatgaaccaactgctgctgctctgtcttatggaacaaacaacaaggaggggttgatagc

SEQ ID NO: 9439 - DNA, 1278 bp, Triticum aestivum
  unsure (1)..(1278): unsure at all n locations
  Clone ID: PAT_TA_9439
gttttctgtacttttttttttcccaacttataaagccataaactttattgcaagtagactatgcaaatgcccggctttccggggcagcgtcgcaccccactgcggctccgctcctcggcggtacctctccttggcccatctctcttctttgaacaaaggtatcaaagcaaatttcatttgaaaaacagtttgtaagtgaatttcatcaaaaggcatgtttaagcaactcagcgttcggaactcttgggacttggaaagtcactcacacctcaaggcgacggggagcaggcctgaggtcccggactcaccccggccgcgccgcggcagctgcccgccggacgccgtcgacacagacggggatctcctggaacagcgacgccggcacgtcctcccgtgatgaagccggcgcggaactcgatcaccccgcgctccaggtgcgcggtcatgctggtgatggagacccagatgaagagcttcttggccatgacgccggagaggttggtgatggcgccgtgggagatggtgccgctgaggttcttgtcgaagtagacgtagtggtcgccgaaccaggcgtagcagctgctggcgagctcgatctggtagtcgccggtggcgttttcgaaggtgtaggacttgaccgagtccgggaggaggcccttggggaggccgtactccaggaggacgtcgttcgccacgccgtgcagcatggcgccgctgccgtcggcgcatgcagcctgtgcgatcggcgcggctgtcgcggccacggcgaggacgaggaggatggtcattggagacatggccgtcgtcgttcgggtttgggagtctgtcttggagtttttgaggtgaaagcaacaaacggtgatactttcctgggtggagaagactttgataatactctattggagtacctagtcagtgaatacaaaagatctgataatattgatctgtcaaaagacagactagctctgcaaaggttgcgtgaagcagctgagaaggcaaaaattgaactctcatcaactgcgcagactgagatcaaccttccttttatcacggctgatgctgctggagcaaaacatttgaatataacattgacaagatcaaagttcgaaagtttggtgaatggccattgcaaggactagagaccatgcaagaatgttgaaggatgctggtataacacaaagagttgatgaggtctctgttggtggatacaaggtccagagtgaggaagtggtcagaaatctcgcaaggccaacaaagatcaccagataantgtcatgt

SEQ ID NO: 9440 - DNA, 1718 bp, Triticum aestivum
  unsure (1)..(1718): unsure at all n locations
  Clone ID: PAT_TA_9440
ctctttgaaacacttctcttggcaatgtctggtcagcaccctgtctctctcaccacagagtatgatggtgccatacaatcagctgtccacaaggttcttcctcaaaccaggcaccgattctgcaggtggcacatcttgaatgaagcccagtgcaagctatcagatttcttaaatgcattcccgtccctttatgatgatcttgtcaactgcatcaacatgtctgacacaattgatgagtttgaagcaaattgggaggcattgatttccaaggttgggtctgggcataacgagtggcttgattcaatgtacaattgccggcagcagtgggtcccggtatacttgagggatacattctttggagacgagccatcaaggcaggagtgtatgagcaggagncttcgttttttgagtgtcccatcactgctaaaactgattcacagtcgttcattcagcactatgaaaaagctctcgacagttgttatgagagggaggtgaaggaagagttcgaaacgaagtattcgcttccagatatcaagacaccatctcctattgagaagcaaggagcagacttgtacacaaggacactgtttttgaggttccaacaggaattgattggtgcctctgtttctactctggaagtggcagagcaggatggtaaggcttgcacatataaagtgaccacatctcaaggaagtgagaagcctcgtatggttcaattcaattcttctgagtgttctgcaaaatgtacctgtcagatgttcgaatgtcttggtattgtctgtaggcatattcttactgtctttggtgcacaaggtgtatctgcgcttccttctcagtacgtcatgaaaagatggaccaaaaatgccacagatagaagctcggacaagaaacctgatgaagttattagagttaaagagctcaaggaggagcaaagaagtactgtcgaggatggcgagcaatctcagacatggcgctacaacagtttgtgtcgtgaagcacttaggtatgctgaagaaggagcatcatctgcagaggtttatattgtggcgatgcaggctcttcaagaggctgctaacaaagtcaatatggccaagagagggattggacaagtagcagcaccattggcagtgatgccaattacagcgcagctgccagaatgttctggaaaaatccaggatagttttggtcagcaaaagaagagaaaaaggaattcaaacaactcaaagagagaactccacaccgaatcagtttatgcatatgcagcaacctaagtaattacctctttgttggcccaattacatcangtggttcacaaagggcctatcactattgctgcattcctgttcctccctgtgcacaacatgnggcaaacatccgggtgcacataactccaacccgatggnaacatggcacncttcctgtactgtttacaantttcaangttcctccaaacccgaatgcatcnacacagancttcttcanggaatgtttntgcaancangngaatacnttccangggtnttcaccaattaacgaagncatgacntcccaagctaatgggaacaaggaacacgtaatctacggctcacacactgtgacgtccaatgggtccgcctgcccccaggcaaaananantcacgcnggagaatcaaacncgngatataataangaagcncattntttccagtaacctngcangctcaanccaggaaaaggga

SEQ ID NO: 9441 - DNA, 1708 bp, Triticum aestivum
  Clone ID: PAT_TA_9441
tccacccccgcgtcccggaaggacgtcacagcctccgacgcgccccaggcgggggatatgttacgcagcctgggtgcccctccgatccgctgccccagcgcttctaggatccgtcgtcgttctggcccaccatgctctgggcggccttgtccttgggttgtgccgaccgcaggctgtgcggggctgcctgctggtttgactgtcgtgcttcagtgttgaccctagcaggggtgttgggtgaacccgtggtggccgtggctggcggggcgaccaccccagcccccgaattatctcccagttgagctggcgaacctgatatcacttcaacgttaccggaatgcactgtcttctcagcaaagagcgatactagttgaaaagtcacgacagaaacctcaggatcgcataagagttattactgatgcagtaaaaagtagccaatataatgatgatccatttttttcttctggtggcattgaaattgagaataaactcatgcctgttgatggccgtgttctgtccgctccaacgtcgctgggggggcagtgtggggcatgctgtccatcctgcgcgtccggaatattttaaatccaagcaagtgtttctggagaagccttatctgccatgtcttgatgtgggaaagccgaaacgcccgaattatctcccaattgagctggcgaacatgatatcacttcaacgttatacgaaggcactgtcttctcagcaaagaacgacattagttgaaaaatcacgacagaaacctcaggatcgcatgagagttgttactgatgcagtaaaaagtaacagatatgatgatgacccaatcttttcttcttgtggcattaaaattgatagtcaactgacgcgtgttgagggtcgtgttctgtctgcaccaatgttggttgtgggaaatagtcaagattgtgttccattcaagggcaggtggaattataataacaagaaactatttgagcctgttaggattgagcgttgggcaattgtgaacttctctgctcgttgtgacatgagccggatctcaagagatctcgtcccccgcggccgagcccacggctgccccacgctcggcccttacagcctggtggatgaagataaccaagctaggagatgtgctcccattgtaagagttgaaaggatgttcgaaaaagttaaagcaaaccttcctggtcctccggaatttctgctatgtgttttaccagagaggaagaattgtgatatttatggcccatggaagaagaaaaatcttcatgagatgggtattgtcactcaatgcattgttcctagtgctaagatgaatgatcaatacttcaccaatgttcttctaaagatcaatgctaagcttggtggaatgaactctaagctggcactggagcatagccgtaagattccagttatcaataagatacccacaataattttgggaatggatgtttcacatggttctccaggtcgatcagatataccatcaattgctgctgttgttggatctagatgttggccactaatatcacgctacagggcatctgtacggacccagtctccaaaggttgagatgattgattctctttttaagcctctggataatggaaaggatgatggtataataagggaacttctactagacttctacacaaccagtcaacaaagaaagccagagcagataatcatcttcagggatggtgtgagtgagtct

SEQ ID NO: 9442 - DNA, 771 bp, Triticum aestivum
  Clone ID: PAT_TA_9442
gtttctgtcgtctgtcatcgctgctagcgattttgcataaaagtacatttcgctcggggccttctacccgcggtccgggtttgtgggccctattccccattgacggggctttttggcttaatggtccccgctgttctgttgattcgacctccctcttcggggcggacaacctccgtcttttgtaatcaataggatcaatttatatacaccaactgcttgaggcatctacaagcagaggaatggaactgaagaaacaactacaagcacacaatcggtagcggctgcttgaggcatcaacaaccagaggaagaagggaacagaacgaagaagcacaatccaatcagcaggaggacggacggccccttgagaaatagaaaatgtgtctatgatttgggctactagattcactgatgacagaaccacaagatcacttgcatccccacacgcacagcgtctccagccaccaaaacatcactcaccacgtcgcatgagtaactccggagagccacaacaggtagtcggcttcgagctcctcaagttgtagcgcctggcccttggagccagctcgtgcgggctagcagcagcgagcccctgccttgcaaaaaacccgcagcttgcgcgcgcaggcgagcacgacagcgcctcctccggcagcatcggagcgcgcccggacgacggaagcttctcgtagcaagacaccctgccgtgcatcgtctcccgcctcacccgtcccctcgcccttgaagaagaggaaagtgagcctcgtgccga

SEQ ID NO: 9443 - DNA, 602 bp, Triticum aestivum
  unsure (1)..(602): unsure at all n locations
  Clone ID: PAT_TA_9443
cgtccgaaagaacggaaccctgaaccggccgcctgtggcgttatccccttcccatcccctggctctcaattcccgatcccctttcttgctgctaccaaattcatcaattgtacccagatatgtgatgaactgatattcgatcgagcagagggagttgaggatcgtatcangatgggcggcggcgcggcggaccatggccaggccagcgcccaccctcgcccggaaccggccgtccccgagcaccggcgcaagaagcgccgtgctcgtctgcttccacggcgccacggcgtccaaggagatccccgacgagctcgtggcggagatccccgacgaagctcgtggcggagatcttcctccggcggcccaacctaaccgatctggtccgcgnctccctcgcctgcgtctcctttcngaaggctcaaccgcccgaccgctaattcctncgggnggcctccgnaaggttcaangcccaaccgtcctcnggtttcttaancgggtaacgagaattncttccccgtgatnccgcctttctccctttcgngttcggaaacaaaggccttcgcccctccnccgccggaatttntctttnnccttcctggccc

SEQ ID NO: 9444 - DNA, 977 bp, Triticum aestivum
  Clone ID: PAT_TA_9444
ataagaactagagactgggtcaacataggaagacgcgagactaaagcaaatagactgcgaggttatcaggataccggagaaatggtcaatgctttagtccttgtaaatggcactggtttttctggtgcgagtaaagcctgatagtggtgtactccagcaatgtgaagctgggacttccctatcaggcgtgaccttgtagccaaatccatgaggagtcggaggtagttgcagcaactaaccataaagcgacggcggagatccagttcatctgtacatccaaggctgccttctgaccgaaccgtgtcgcggcaaaaaaatccgctttgattcaatgctctgatcatctatgctttcctgctgtagatttttggagcttgctctgttaatccgtgttattttgtgtatcacattttaggtctgaccagcacaaggtggcaacagcagtagtggcgaaggcatgaagaggcccacatctgaaaatccgttctgctgactgatcaagggagatggtcttagcatccactgtgacaatgttgtccagaacatggacgactctggaaactgaaaagtaacagattttgcttccaggcacacaaaggccaccgattggatcagtgcgaagaaacccgttcggaccgctgccgcaagcctcgcctcagcaacggatcaacctctacacctacatccacttcgacaggtcgtcagtcaaagcagatccattttaccctccttcatgcggatgaatctgatcaagtttatttcaaattcgcctctgcctgcctgcttctagcagggttgcatttctccaattttcagagcttcgaatcactacctacgaattgcgtatgtgattcatcatcgttcaattaccccgtaccctatgtgaattatattctgaagtacaggttgacaacaacctactagctgtacatacttttctagctggtacacaataaaaagaaagggcttgagtaaaa

SEQ ID NO: 9445 - DNA, 555 bp, Triticum aestivum
  Clone ID: PAT_TA_9445
aaaggagtagaattgaactttgtcgatacacacagtaatctagtgagctgcctaacgtttggagactgtgctgaccctcttgtaaacttaatcttggctgaattggattcttaggcattggcgtcttggtgagttaaagttgcagtttctgacgagtaacattgattagtgaactcttgtgtgtgtgcgggtgaagctttgagctaagcaggtcttcagtgtaccgactatcaagtcattgatgtaccgactaccaagtcatactgtaatcagtttcagtatatgtatgaatgaaaaattgttggcctgaatttgtgcaaagcatttgagtaactttctgtgtaaaaaaaaaaaaaaaaaaaaaaaaaaaaaaaaaaaaaaaaaaaaaaaaaaaaaaaaaagaaaaacaaactgaaaaaaaaaaaataaaaaaaatacaaaaaaaggggggagctctgcctgaccagaacccaaggtttactactggcgagccctgatcttttgaactttttttttggggccccctaaaatcaattcacttggcccgggttttta

SEQ ID NO: 9446 - DNA, 1113 bp, Triticum aestivum
  Clone ID: PAT_TA_9446
cgtccgagcttcttggtggtagtcttacatcagaggagaagagtcggcagtgagaaaagcagagggagcagaggaatctagttgcaagctacaagttgccaactatgtaatctagttgcaaatttgtaggagtactgctgctgcgcctgtgaaggcggtctctcgtcacgtcgcttccaaggcttgctctttcgtcggctctacaccactgcctgtcactgctgctgcgcccggtgtgaagaagatgactccagcagtttccactcttcccgcaagaagggggatcgggggagctcagctgcaagattccgaagcaaaaccggtcgcttcgagtgtcactgttgcgtcagcaccaaggaagcaaccaattcctttgcttgggtccgggggtattacgcccttgctagtcttttacttgcttcctaaaccattcacacatgagtttcatttaatctttgcatctctaggttctgcacttaatcaccaagatttctagtgttctttgaatcccgttcagtcattagtaattttacaagagtgtcagcagagtctccatctagtctaggcagcaaaaaccttgttaagatgtgtacggcatagttacactacatccatacctggtcctaagttaagggtttaagtaaataaagggcattttcaataaatcaaagtaaagcagatgagcccaaaaaggaaactcatgtactgcaattccggcacgagacagagcgtaaaacgcactcgccgcaaaatccaaaacgcccgtttgctacccggcttgtagcaggaaaaaaggagtagaattgaacttgtcgatacacacagtaatcttgtgagctgcctagcgtttggagactatgctgactctcctgtaaaattaatcttggctgaattggattcttaggcattggcgtcttggtgagttaaagttgcagtttccgaagagtaacattggttagtgaactcttgtgtgtatgtgtgggtgaagctttgagctaagcaagtccttgatgtaccgactatcaagtcatactgtaatcgattttggatatgaataagaaaattgttggcctgaaaaaaaaaaaggggtggcctgaaaaaaaaaaaaaaaaa

SEQ ID NO: 9447 - DNA, 713 bp, Triticum aestivum
  unsure (1)..(713): unsure at all n locations
  Clone ID: PAT_TA_9447
aaaacagtacacgacaattgataaaagatccggtaaggtgctacaggaagttagatgattttttacaagtcatgagcaacacgattcaataagattcactgattcagtaagtagatctaagcaatagaaaattacaaaaagatccactcagcaatgcatgggctcatcagtgcaacttttgaagaatttgatcaatctggagcgcattgcgaatcagcccacaagttcattgccgcagccttcaactcaaatcttgccagcattggaacatccaaactaatctcagctgtgcctcggtaatgggagaaaacaggcatgactctgcagtcaaccatccattgcctctttgtatctcttgtaaggctgctcgatatactccggtgttctgcactgcaagaatatgaggacaagggccaaggcatggggcaaagaacatcccgcaccccttccctagcatatgtcccagtcccccgggattatccatttcctggccttgtatagcctgggctggtagtggaggcagcgccggggtggctcgcccctcgctctcgcgccactccgtcgcccctcgggccgtcggccggccccacggaccctccccggcctgccgcgcccccccccagcccctgggccctgcaacagaaatgatcgtccatcgccaatgccctgcaccattgggtgctactggttncatctgccctagctgagctncc

SEQ ID NO: 9448 - DNA, 2029 bp, Triticum aestivum
  Clone ID: PAT_TA_9448
cgtccgcacgtccccggcgtggcggtagcctcgcgtcgcagtagggttttacctttgctttccctttccccaagctgcagaggccgcggcgaccgaggcgggaggggaggggagccatggagatcggggggcagcacccggcgagcagctgctccaaggagcaccagaagatctaccgcgactggttcgccctcgccgactcagatggcgacggccgcatcaccggccccgacgccatcaagttcttcgccatgtccagcctcccccgcgccgacctcaagcaggtctgggccatcgccgactccaagcggctggggtacctcggcttcggcgaattcatcaccgccatgcagctcgtctctctggcgcaagcggggaacgagatatcccaggacagccttcagcgcgaagatctaatcagcttcaatcccccagtgatggagggtttggatgctcaacttgccaaatccaagcatctggcaaagagggtcgatcaggatatggatggatttcctcaggcacagggaccttctactaaccattggttcaactcgaagtcatccaagaagatacccctgactgctgttacttctgtcattgatggtttaaaaagactatacatcgaaaaattgaagcctttggaagttacatacaaattcaatgattttgtgtcccctttactgacaaacagtgattgtgatgctaagccactggttatgctcttaggtgaatattctacagggaaaactactttcatcaagcatctgctaaaaacaagctacccaggtgcccatattggaccggagccgacaaccgacagatttgttgttgtcatgtcaggacctgatgaaaggactatccctgggaatactttagctgttcaagcagatatgccttttagtggtctcacaacatttgggacttcgtttttgtccaagttcgaatgctctcagatgccacatccactactagagcatatcacgtttgtcgacacacctggtgttctttctggtgaaaagcaacggacacaacgtagttatgaattcacaggtgttacatcatggtttgctgccaagtgtgaccttatcctgcttctgtgtgatcctcataagcttgatatcagcgatgagtttaaacgtgtcatcggatctttacgtggacatgatgaccaaatacgtgtagttctaaacccggccggccgcccgggcacgcaacagcttatgagagtgtatggtgcacttatgtggtctcttggtaaagtattgaatacccctgaggtgtctcgcgtttatattggatcgttcaatgataaaccagtaaaggaatcagctgttggcccgatcggaaaggaactatttgagaaagagcaggatgatctcctttctgatctaaaagatataccaaagaaagcttgtgaccgcaggatcaatgaattcgtcaaacgtgctagagctgccaagatacatgcttatataattgggcatctaaagaatcagatgcctacgatgatggggaaagctaaagcccagcagaaacttatagacaatttggagggcgagtttgcaaaggtgcaaagggaacatcatctccccgcgggggatttcccttacgtggagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatcggaagacggctttggttcgcagttcgacatgtcaggcatggatggcggtggctgcccatagggttttggctgccagtgtagtagggtgttcattgctactgctacattatacccattgttgtataactgtattatgcataataagagccagaagcaattgctcaggtgttcgctggagaacgcccttgttgtaatggcatggagagagttcggaataagggagggagcaaagagcctgtaagtgatcgcggcctcgaccc

SEQ ID NO: 9449 - DNA, 890 bp, Triticum aestivum
  Clone ID: PAT_TA_9449
ctcgttccccggtttcttaattattgatccgcctgtgctcccacttagcgactccccacactcgagctacctggtagcatcgcaaaactcggagcactgaaccgttacatcccatgaatttttcagaggttcgtggtttcgcaatctgtataactgaatttggcagccatcgctggcaaacctttacagacatctattactttttttttgtttaggaggatgaaacctaaatttcaccgtcccagagctcctcgtaggtcttgtaaacgctctgtggatttatcatcatgttgcctctcagaagcctagcctgcttaatctctgagaactttgcaagcatgtcagctggaattgtccaatcataaacatcaaggttttgctttatcctttctggatttgtactctttggtagtacaccgtgccccatctgaatgttccagagcagagctccttgtcctggtgtcttgcggagtttctcagctattgagatgattattggctcttcaaggacattaccattcatccaagtagtaccaggtgaacctagtggtgagtaagcactaagatgaacgccagttgactgacaaaagttgtggagcttagtttgctgccaacaaggatgacattccacctgattaacagcaggaggtacgcgagctacatcaagcaagtcacccaacttctttgatgaaaagttactcacaccaatcgcgagagctttgccagcatcatgtaacttttccctgtaacaaaattctcaggactgtggtttgttcccttcttgactctaactggccaatggataagataaagatccaagtactcaagctgcaaatcattcagactttcatttagtgcctcaggcacatcttcaggagcatgatgatcat

SEQ ID NO: 9450 - DNA, 831 bp, Triticum aestivum
  Clone ID: PAT_TA_9450
cgtccgcccacgcgtccggtgggattcatcctgcctaacctggaggtgaagttcgtggaccccgacacggggcggtctctggcaaagaacacgccgggggagttgtgcgtccggagccagtgcgtgatgcagggctactacaggaagaaagaggagacggagcgcaccatcgacgccaagggctggctgcacaccggggacatcggctacatcgacgacgacggcgacgtcttcatcgtccgccggatcgtccggctcatcaagtacaagggttttcaggttgctcctgcggagctggaggccatactcctgtcccatccttcggtcgaagatgcagccgtcttcggactgccggacgaggaggctggtgagatcccggtatcgtgcgtggtgcggcggagtggcgcggcggagagcgaggcagacatcatggcgtacgtggcgtcgcgcgtggcctcgtacaagaagctccggatgctgcacctcgtggacgccatccccaagtcggtttccggcaagatcctgcggaggcaactcagggacgagttcatcaacatgatcaaaccagcagctgcttaataaggatttgccgcttctttctagcccacatgcatgcacaacaactactcctatatatctttgttatttcagaattgggagtgtccacttatatctcaacacttgattatatacagatatgctagttgacactttggcaatcgattgatttcttttgatcaattgccgcctgcaatctcctctcaaataataacaaccatttgaatatcaaaaacaggaagagtcacatggtttattcttttgaatgcatgc

SEQ ID NO: 9451 - DNA, 1934 bp, Triticum aestivum
  Clone ID: PAT_TA_9451
cgtccgcggacgcgtgggcctcaaaacccctcatctctacaaattcaagcaaagcggccggcaggcgtccgcccacgcgtgcgccaggcctctcacaaccaccagcgcagcatgggtgacgcggccatcgccgtcatggaggaggagggggagcaggagcacatctttcggagcaggttcccgccagtggccgtgccggatggcgtcaccgtgccggacttcgtgctggcgggcgcagaggcctacgccgacaaggtcgcccttgtggaggccgctcccggcggccggtcctacacctacggcgaggtggcccgtgacgtcgcgcggttcgccagggctctgcgatccgtgggcatccggaagggccacgtcgtggtggtcgcgctcccgaacctcgccgtgtaccccgtgggtgtccctcggtgtgatggccgccggggcgatcttctccggcgtgaacccccgctccctcgccgccgagatcaggaaacaggtggaggactccgaggccaggcttgtggtcgccaacgaggtcgcttacgacaaggtgaaggacgtgggcgtgccggtcatcggtatcggcgaacaggggctcatggccggcgcgataagctgggacgagctcctcgccgcggcggaccgcaccggcccgccggtggttccgctggaaccggtgcagcagtccgacctgtgcgcgctgccgtactcgtccggcacaaccggggtgtctaaaggcgtgatgctgagccaccgcaacctggtgtccaacctctgctcgtcgatgttcgccgtcgggacggagctgctggggcaggtggtgacgctgggcctcatgccgttcttccacatctacggcatcaccggcatctgctgcgcgactctgcggcacaagggcacggtggtggtgatggaccggttcgacctgcggacgttcctgggcgcgctggttgcgcaccgggtgatgttcgcgcccgtggtgccgccggtgatgctggccatggtgaagaaccccatcgccgacgagttcgacctctccgggctggccctcaagtccgtgatgaccgcggcggcgccgctagcgccggacctcctggcggccttccagaggaagttccccggcgtgcaggtggaggaggcgtacgggctgaccgagcacagctgcatcacgctgacgcacgccggcgacgacccggagaaggggcacatcgccaagaggaactcggtgggattcatcctgcccaacctggaggtgaagttcgtggaccccgacaccgggcggtccctggcaaagaacacgccaggggagctgtgcgtccggagccagtgcgtgatgcagggctactacaggaagaaagaggagacggagcgcaccatcgacgccaagggctggctgcacaccggggacatcggctacatcgacgacgacggcgacgtcttcatcgtcgaccggatcaaggagctcatcaagtacaagggttttcaggttgctcctgcggagctggaggccatactcctgtcccatccttcggtcgaagatgcagccgtcttcggactgccggacgaggaggctggtgagatcccggtatcggtgcgtggtgcggcggagtggcgcggcggagagcgaggcggacatcatggcgtacgtggcgtcgcgcgtggcctcgtacaagaagctacggatgctgcacctcgcagggacgagttcatcaacatgatcaaaccagatcctgcggaatcaggatttgccgcttctttctagcccacatgcatgcacaacaactactcctggatatctttgttatttcagaattgggagtgtccacttatatctcaacacttgattatatacagatatgctagttgacactttggcaatcgattatttcttttgatcaattgccgcctgcaatctcctctcaaaaataacaaccatt

SEQ ID NO: 9452 - DNA, 916 bp, Triticum aestivum
  unsure (1)..(916): unsure at all n locations
  Clone ID: PAT_TA_9452
tgacatgccctctatttctctatttttcctattcctgcattttacaaatattgtgaatcaaagaggcctgatatcctgttatcgcaaaagaagaaagtatcgacgacataactgcaagatcgcatgcagctttccctatcttttactctggaagctcaactggatgcagttacaagtgctgggctttcatagctgccattggccagttttgtgtatcttggcggcaataaggaatccacatgggcgaagtagtcttgctccctggatggctccatcaatactggtgcgtcaaggacagagtcaggaatggcgtcaagagtttcctccaagaactgcacaagtgtcttgcagtggcgcaacgtagaatcagccttacgtttccacaaactattaccaggctctgagtggaacaaatgtaacaatggcttaacaagttgcctcacgtttggcctgctgatgccatactgtccaattatagaatcaccataaacttggtagctctcaaggatctggcgacgcgaagagcaacgtgttggcatgccataaatttcactatccacgtgccccagcatattccatggattattgtanagcagcacgaccaaccataacttgatgggcgccttgtcttatggatgcactaacttgttcaatagtcgttaagcctccatttagtgtancagtgtacctctgggaagtcccgcaacaaagcataatagtactcatattttaaaggaggaaccttccgattctctgcaggactgaggccactgangcaacgccttccgagcatggataataaaatgcctacttggtgacttacaaacanctttatctacanatgtacaaattcttcgtacggagcacgatcgtcaactccaattctgcattttcactgacagggacatcacaattg

SEQ ID NO: 9453 - DNA, 1034 bp, Triticum aestivum
  Clone ID: PAT_TA_9453
ttttttttttgcaatttctgtaagattccatcatctcttttcaatcagtattcacccgttccgttacaaggggcttgcttatacatgaatgaatgaattacaaacaatcacacactacaccacccaatccaaactctagtctgtatgctgatctttctcatgcacgccccccaaaaactgaatcaatgagaccctgtcgacgactaagctcccaacaattcaacaggcccttccgggctggctgatatccggctgcgcaggtgagggccagcgaggttttgccagctccaagatgtgacggttctttcttttctaggacatgaaaccagatgaactcctgcgtacatcggccttggccacagggacatacacaacatcgactagcgagctgcgggttcgcccgtagaaaatgtaaatgaaaacacctatcaccgcccaggggccgactctcagccatgcatctccgccaaggtttatcaacagatatgtatttatgaggatgcatacaacaggtagaaacggaacaaaggggcacatgaatcctccagaatgaccaaaagagtgcctgccatcatcgcgggctcgccgccggggtacgacaagaccaggtataaggagcacaccaccaacaatgcaaccaatgcaaagcggtaggaaaggtagccatgtggcagaagctgaagccgtgaggaccagaactcctagacaaacagatcctatgctgaaagcagctatctttcgacgcttcatctcatccatcttgcctttgtgttgcttctcgagaagagggtccttcattgcttctgtcgcaatcaaatcctttatttgagatgtgtcacagatgtcatccccaagtggatccctacccttttcctcatcatattcttggttcaaacccattgattctcgccgagatgatgatagagggacctcctctggaggaacatatctgagtatcaagatcgatactgccactatggtgaacgcgaggagtgtgcctacactgaccattcctgacctgcccgggcggccgc

SEQ ID NO: 9454 - DNA, 594 bp, Triticum aestivum
  Clone ID: PAT_TA_9454
cgcagcacgccgcgctcaacttcgggcagtacccgctgggcggctacgtcccgaaccggccgccgctgatgcggcggctgctgccggacccggagcgcgacgcggcggagtacgccatgttcctggcggacccgcaccggttcttcctcaacgcgatgcccggggtgctggaggcgaccaagttcatggcggtggtggacacgctgtcgacgcactcccccgacgaggagtacctgggcgagagcctggacgagggcgcggcgccgtggacgggcgacgaggaggccctcgcggcgcacggcatgttcgcggccgacgtgcgccgcgccgaggagaccatcgagaggcgcaacgccgaccacggcaggcggaaccggtgcggcgccggggtgctgccgtacgagctgctggcccccagctcgccgccgggggtcacctgccgcggcgtgcccaacagcatctccatatgatacgcacgccattgtatacccgcgattcgttctggattttgtttaggggattccccttatttagggccagcttgtcgatatactcctactagttttgatctggatgttagtctcgtggcctccc

SEQ ID NO: 9455 - DNA, 867 bp, Triticum aestivum
  unsure (1)..(867): unsure at all n locations
  Clone ID: PAT_TA_9455
ttttttttcaaattaaagctaacatatcttttgcggctttaaccacaatacgtgtcactcttcttaatactcccaaagcaaaactatcactaagtcacntgataccatctcttcttgtttgtgccatcccaccacaattcataatggcctcaggtggcaattgtggcatatctgcagataatacagaacaattctagaaaccgagaacatatatataaacctatgagagatcaccaagaaaattaaacaccgaaactttacagtggtattgacagaacaaggcatcacatattatttactccattctcctaagaataatacaaaagggacttcaaactatgtaactccatgaataacctatgcttgaagccacatgaacatattgccgtcggttgccggtcttccgcatctacgcacagcacaatcggcgaagacgaagacaccactgactgctcgtccttctcttcggcgccacactctgaggcacgacaagtgttttcatcattccagttcccattgaactgatgcttgattctggtgaaaacctatacgaaagaacacatatttatgtatatttcatcaagtatatgccagaaatatcaacaagcgaaacctgtgtggtttgacctaaagttccgtcatcccatcaattgtggttgtttatggagtgcttctcatccttgctctagaaacatatttgtatatgtgaatttgctagtctcaatcatatgtgtaaagaaaagggtaaacatgaactggctatatgtgtttattccagcataccgtcccatgacacgctttgcatacagacctttccttatgagctgaagtaaaatgagctagtatccagtatttagcaagatatta

SEQ ID NO: 9456 - DNA, 583 bp, Triticum aestivum
  Clone ID: PAT_TA_9456
gagcacaactgaaacataagagagcgccagatcataggaaaacatcaaccggctgatttcagaccctatgagaaaaatacacctatgctatacctaatttaggcaataactgattagaagccttcactgaattgcacctaggctacatattcatgtgctttaacaacttcttggaagttgtttagagcgtactgaaatagtaaaaaggataagtgaatcaagcacaagagagattcacaacacctaaattgtccccctgcctaatttccaactcaatgggcataattacaacaagctagactttacactctagagcttccaatagatatttaaggcaagtggaaaatggtttagccaaaatggtacagtaagaaacttgatctatggttcctcgctttgcactactagtagctcttgctggtggaattccttgggtgcttgtatttcttcgtgcccctgttggcactgagggtttaggaatagcaggatcccttggtttaggccgcaagcctgatgcttttcggactgtcaacttctgaactcgagataccgtctttgtcaaccgctctttcgcagcgctaga

SEQ ID NO: 9457 - DNA, 490 bp, Triticum aestivum
  Clone ID: PAT_TA_9457
gcgtccggggtggtcaagcccaatgtcaccttcctgcacgagttcgggctagctgcttgtgataggggcgggctctggatacctacgccatcgctgctcagcatcagcccggaacgcatccggacagcagtggcgtgcgtctaagtcttcttggtgtaccccgcggatctccgatgttcaagcatgcgttacaagctgttgcattcctcaacaaggacaaaatcaccgccaaagtggagcacttgaagaaaactttcagctggtcggatgctgaggtgggcattgctgtttctaagggtccagcagtgttgtccaggactaaagaatcgctgcagcgcaggtccgagttccttatctccgagttgggattggaaccagcatacattgcttatcgtccagcattgctcacttatagtctagagggccggctcaggccccggtactacattgtaaagtttcttaaggaaaatggattgctcaagtgtgaccc

SEQ ID NO: 9458 - DNA, 1681 bp, Triticum aestivum
  unsure (1)..(1681): unsure at all n locations
  Clone ID: PAT_TA_9458
cgtccgcggacgcgtggggccgaacatcccctttatggcatttgtcttttacgcccaaattcacagacgggaaactactgtctgcatcctcgaaaccgaaggttgccatcattcgcgaagaagggagcaacagtgatagggaaatgtctgctgcattccatgctgctggttttgaaccgtgggacatcacaatgtcggatctcttgaaccagaaggctgatctaatggaattccgtgggatcgcatttgttggtggatttagctatgcagatgttcttgactcagcgaaaggctgggctgcatctatcaggttcaaccagcccctcatacagcagttccaggagttctacaatagggcaggctctaccttgggcatttggtctgctcatggtgaagggagagccttgttcccagataaaaatgttttatctggtgttgttaactctaatctggctcctctgagatattgtgatgacactaacaatgctaccgaagactatccttttaaccctaatggttctcctcttggtatcgcggccctttgttcccctaatggaaggcaccttgctatgatgccacacccagagcgttccttcatgatgtggcaatacccatggtaccccaaggaatggcaggttgagaagggtggtccgagtccttggttgcgcatgttccagaatgcacgagaatggtgttcatagagcagaaaaatggtggtcgctggtgctacaccgtatcctgcccgcagggacctggatggacatttgctcttcgggagttgagcctggataacccaataatctctgttcagttgctagagcttctcccagcatgatttgtggcaatactagggctatcatcatgatttgcaataatcatagggttatttttgaacgtgctataataagtggttgtcagcggttatgctcctaccatggttgaacacttaatatctatattttgtatacccgatttccgcccctttaagtgttctgcttagctaaagcttgtgttgtgcaatcctctattctgtagacagtaccgaaagaacctctctgaagggttattctgaattcgggggttatttccatttatggaagacgccttgctctgatgccacacccggagcgttcctttatgatgtggcagtacccatggtatcccaaggagtggcaggttgagaagggtggtcccagtccttggttgcgcatgttccagaatgcaagagaatggtgttcatagagaagggaccaaattggtggctcgtatgtctgcttagagcttgggcattctgctgtagaactgaacatgatgtggccatggatcaactcaataccatgtctgaaattatcgcgttggaagaactcaagcgactgacagcagctctcagttcttgaatatttctgctacttattctcaatggacagtgcctgtataggtgctgcgtgcgagcatagttatgtctcgctagctgaattgagctatatgcttcttctgcaaccattcacctatatccaatggatactatgctctagctgtccggcaacataaaatatacctgtcactttctttctgccaacatatattttcaattttagcataaaanaaaaaaaaactcccaaggggggggcccggtaccaattcccctatatgancctattacgcgcctcacggcgttcnt

SEQ ID NO: 9459 - DNA, 1069 bp, Triticum aestivum
  Clone ID: PAT_TA_9459
ccacgcgtccgcagatcgccgccgcgtccgccatggcggccggctccgcggctcccctcctcgcggccgtcgcctgcaccgtcctcgtgctcctcgcccccgccgtctccggagatgcagctacgctggaatctgttccagatcttgtgaaggcaatgtatgtaaacattgaaagcttcccttgtgtcagccggcgcgtgcgttctggtgaaatcggctgctctaatcctgggcacggcctggttattgcaccgattgtaagattcaaaaacagcgatgaccagttggctcaaccgtctgcggttcttcttcccttggatcagatgccagctttctttctgagggtatccaatgagccagaactttaccataaggttgccggtgtactggttgaatcaaatggtgacaagttactagagttgtcaccggatagaaaatttccacaagaggattttgcaccatactcaaatgtcagccatgattggaatcctgctgggtcaggtattatgtggaacagatatgattttcccgtgtttctactttcagaggagagcacgcagactctgcgaaagattgcggacaagaatgagaagtctaacaatggatatcaagcaaatgtagcggaatttgaccttgttatgcagacaactaaagctgaaacaaatggttcatagtcctgcctcaaagagcagtcgtgcttgcccttaggaggacagagtgtatgggcttcgttaccaccaatgagcaatgcatcagcagagcatcagaaaccaataataatggttgttgcatcccaggattctgcatcgttctttagggaccgtagtctgggtgctgcttctcccatatcaggattgattgctttgctcactgctgttgatgctctttctcaccttcatgatctaggcaaactcaagaaacagcttgtatttgctgcttttgatggtgaagcatggggttatcttggtagcagaaaattcttacaagaactggatgaaggtgatgattctgtgaatggcattaacagctcaatgattgagcaggtactggagattgggtcggttggcaa

SEQ ID NO: 9460 - DNA, 1444 bp, Triticum aestivum
  Clone ID: PAT_TA_9460
gggccgaacaaatctccttccccttcctcttcctcctcccctctctcctctcctcccgttccatcgccggcgccgcaccctcgaattccgcgatgccgaagggcgccaaaaagcgtgcgaagctcaagaagaagcagcaggggggccagcctgccgggtccaacggcggcgccaccaccaccaccaacgacaacggaagcaataactcgagccacggcgacgccgccagcgatggaaaccacctaccaatcaaacttaacattcctcccgtggatgcgagcgaggattcgatggagagctccgaggagatggtgacgccgagggcggaggcggccgaggaggaggagaagaagggcgccacgtcggaggtgccggtggagcgcgccgtcgaggtcgctgatgagggcgccacgggggaggccggggccggaggtcagaggttgacgctttaccgtttgaagctgctgaccgggagcaagagggtaaaggtggatgtggatgcggaggcgcatgccgtggtgcaggtgccggagctgcaggtgcaggatatcgtggtgtccgaagcacctcaggtgctggaaccagagatggagagcgaggaggaggtgatccgggacaaggccgcatcctgcgcatcgccccaacccgaaggccgaggaggtggtggtcagggatgcggacaccgctgctgtggtgcaggaaccggaggcaaagggtgaggtgtcacggtctcgtgggccgccagctgctgcgcagactgcggtggtgcgccgcggaccggcagtggcggcggctgcggcagggcatcgggcaaaatggtggaattgcggggggttggaggatctcttggtggttcaggggagataggaggggaggtacatagaattggaaaggaacataggaaagtgaagaaaggcggaaagatgcaaagttcttgcaaatgctggtgggtatctgtaacttaggctccgttgagtgctcagacagatgatggagttgaaggatttggaatgacatcgagctgatgtttctctccacccgtgttttccgtctcttgctgtgcaaagttacattgtattggttgtggttaaaatcctgggtgctgtattctgagtattaccccttgtctagcatgttataggttctgctgtccttgtagcatatgagttaaaaagttggtcaacagtgaaaattttggtctttatcttctatacttatctgtcgggaggtatcgtctgttacgtcccttttaatggccctgttacaatttgagatgctgtttatcgtggtcttaagtagttcctcacagcatatcagaatgttgaatacaaaagcaaaaataaagatcttgatatgggttaaaaaaaaaaaaaaaaattcttcgagactagttctctctctctctctcacccgcccggccgcccgctcgcataattggcccaaa

SEQ ID NO: 9461 - DNA, 687 bp, Triticum aestivum
  Clone ID: PAT_TA_9461
aattttaagatacctaaaaaaggttaattttaagcatcagagcacacagttcgtgctcttgaagtctttgagagagattcttacattcatgctcaactgcatactagttagaagaaactaattagtgctagtacatcataacacgagtcttccgtttcctttatacattctttattttccgtgcatttttctagcattactaatcatggaacagtacaacgagtgcacgtcaagcaccatctgctagcatcacttgttgaagtacgtgtaggccgggttcagtcgcgcagcaactcgaacaggtcctctagggtactatcagcagcctgtccatcttccaagccagcccattctctcacaacagcctccactgttacaaaattagctgcgtacccctgctgcacgtcaccatcttgttgcactcccacgacacgaccatttgcaataactggtcctcctgagcatccactcattgatttgcaatcatgcctcatcctttccttccagtccatttcttttgtttccctgatttttggtccgacgagtgcttccaggacatgctccgggttcatatgggaataggattgttagtctcactgccaacttatcgggagtgtagtatgcctctaacacggcatctgttccaatcgttaaagttgtctcactggaaaatatcaaagccggata

SEQ ID NO: 9462 - DNA, 243 bp, Triticum aestivum
  Clone ID: PAT_TA_9462
gcgcagcagcgaagcgccatctcgtccgcccacgcgtccggcgccttttagaaccttccaccccaactgccggggctgcgcagatggggaccatggagaacgtgatcgtgctcgtgaaccgcatccagcgcgcctgcaccgtgctcggcgaccacggcggggacggcgccgccgcctccctccccgccctgtgggaggcgctgccttccgcggccgtcgtcggagggcatgagatcggggaag

SEQ ID NO: 9463 - DNA, 1206 bp, Triticum aestivum
  Clone ID: PAT_TA_9463
ttttttttttttcagatataaatagtccgattttgatgcaccagacgagattcgcaaacacataaaaacgctacaagtaaaactgaagaaaaatcatcctcagattcatgtaaacctctttctgagaatcgattcaatcatgttcttgaaaaaagaatcgattaaatcaacggggcctttcattcatggctcaatcaacggggcccttcattcactaaataaaaaggaggattcggcagccacaaatgccgaaccacctgcaaagaacagccacagcctgtagacttccatggcgaaacagcaccttcttcaaggggcagcgtgcatcaatcgccaaatgttggaagcatgcactggatgacgggtaaaattgagcatcagagaacctgaataatgtgcagttgtcttactaaagtaacattaacatatgcataactcagataacagacattgcacagctaagacaacttggcagttgacaccaaagattcaacggcatggcatcggctgcaaggctccaggatatttaacttgaccgtagaggggactttccccagaacgtatcttctgatggccaagagcgctttctgtgcctccaccaggctatccccatcacctgcccgggcggccgctcgaaattttgtgacagcgcaactaggatgacatgtggtgtccagcgtaaggcagtcgagtgatgttgtattctcgaggatatgacatgttagctcaaccaagctctttgccgagcaaaagccagtgatcgtcacactcttgagcttggcatggcgctgctgcgggatctgcctcagatcatgtgagggctctccaagaatcgaagcatgcccccatgcgatgctgggatatagctaatacaaaattctccaagcaaggagaagcatcgacaaaagaaaccagagaaagataatcataagctccggaaagagccattcccactaatgaaatctgcaagagcttgaggtggagaaacttgctagatagcatcggtgtgttcaccatctcattcggtgatgatatggtaagtgtttcaacatttggcgcaatagacaaaagattgtgccgagcataacagacaatgttggtctggcggaagcatatcatgcgtagggttttcacttgcagtgagcccccaagtgagatttgacctatgaaaccttcgaagtaaaaagtggtgagatttggagcatt

SEQ ID NO: 9464 - DNA, 734 bp, Triticum aestivum
  unsure (1)..(734): unsure at all n locations
  Clone ID: PAT_TA_9464
ctgggtgaaaacntccccgaagctatttgtagtatataggaaatgtgatgtttgctaaacatgtatggcagcacgaacacacaaagtaacatgatctaactcgatcagttgacatggttaagtttaccataacaaacactctacatcaggcggcatacacaaaatataaccatcaccacaccagccccgctagtgaaattttggtactatcagtgctaagaattaaaatgcaataatagcctcgcactagaaactccacaagtttgacactgaatgcccatgttgattgggacatcaaactgacgattgcacctgctccatgtaatatatcacagacccaagcaaactttgctgatccatgagggtggtaatggtagactcgatgccaaggaatgtgttgtgtatatgacctgaagacaactccattgatgcccccactaatatgcccaatgcatggctcatcaagttctcgaacaataatagtgcttctcttgcagactttagacgagccactgtttgtgcatgtgtttccccaactgcgggattggcacgggatgtagcaacatagtgttccagcagtccattgaccgaaaccaaagaatttgtaaggtccaggtacatatgattgaagcaaccgacagtgtcgatcctgtggttatgtgcaggattggcgcggatcgcttccttttggcgagatactgaagcaacgacgtgtccagtagccggacgcgtgg

SEQ ID NO: 9465 - DNA, 308 bp, Triticum aestivum
  Clone ID: PAT_TA_9465
tgtttttttttgttttttttacactcaagtcggtttcttgttttatttacttactgataaatcagtgacacgtacagatttattttcagaaatcagaaggtagcaaggcatgtacagagctggtgatggatagacatgaatctttggctggagaagttgagcctggtaatatatatacatggagatggagtgatggctactggttatggtctgaagtgagtcctcccttgatcttgatcatggagatggcccggcaaggtactgcagccactcttgaggcaggccgtgcctcctcctgatcctcgtgc

SEQ ID NO: 9466 - DNA, 1240 bp, Triticum aestivum
  unsure (1)..(1240): unsure at all n locations
  Clone ID: PAT_TA_9466
ggagcaagtgcaggggagggtctgggcaatgccttcttatcccatatacgtgctgttgatggaatctttcatgtcttgagagcatttgaagacacggaaatcactcatattgatgatacagttgatcctgttcgtgatttggaaactattagtcaagaactgaggctcaaggatatagagtttgtgcaggctaaaattgatgaccttgagaagtcaatgaagaggagcaatgacaagcaacttaagatagaccatgaattatgtcagagggtcatgacacatctccaagacaggaaagacgtacgtataggagaatggaaagctgctgaaattgagatcttgaatgcctttcagctgcttactgctaagccagttgtttatttggtgaacatgagtgaaaaggactacctgaggaaaaagaacaagtttctaccaaagatacatgcttgggtgaaagaacatggtggtgaaactattattcctttcagctgtgccttcgaacagaaactagtggatatgccagaagatgaagctgctaaatattgcaccgaaaaccaaacgacaagtttgatccccaaaatcatcaagactggttttgcagcaattcatctcatatacttcttcactgctggtcacggcgaggtgaagtgctggcagatcagacgtcaaagtaaagctccgcaagctgctggtgcaattcacactgattttgaaagaggcttcatatgtgctgaggtaatgaagtttgaagatctaaaagagctgggcagtgaatctgctgtgaaggctgctgggaagtacaggcaggaagggaagacgtatgtggtgcaggatggagacatcatcttcttcaagttcaatgtttctggaggcggaaagaagtgataaattcatcacagggtcgtgtatttttgcatttttgagttcacttgcaagtagccaggtactatcagtacggattgcagactgcggggaggctatatataaattttcattcgctctgcttttgaaagtactcctcgatgttatgaagtcatgtgtgccaactgccaactgtacacctgaacgatgtttgaggcctctattagaaaactggaagttgtaactttgtgactggacaagtttgtcgtaattaggatgcaaagttctttgttatgcaattctaccgttttttgttgcaaaaaaaaaaaaanaactaaaataaaaaataaaaaaaaaccaaaatatccaacacaaaaat

SEQ ID NO: 9467 - DNA, 1701 bp, Triticum aestivum
  unsure (1)..(1701): unsure at all n locations
  Clone ID: PAT_TA_9467
acgccccccccgtgcacaaaaaccctagccgtccagcccacatctctctccctctctctcccacacacgctagcccatccccagcactcctccccagcacaccacctcgccgcagcggaagccgagcccgatgccgcccaaggcatcgaagaaggacgccgagccggcggagcgccccatcctcggccgcttctcctcccacctcaagatcggaatcgttgggttacccaatgttggcaaatcaactttcttcaacatagtaacaaagttgtccatcccggctgagaacttcccattctgtaccattgaaccaaatgaggcacgggtacatgttccggacgaacgatttgactatctttgccaacttttcaagccaaagagtgaggtggctgcatatctggaaaatcaacgacatagccgggcttgttagaggagcaagtgcaggggagggtctgggcaatgccttcttatcccatatacgtgctgttgatggaatctttcatgtcttgagagcatttgaagacacggaaatcactcatattgatgatacagttgatcctgttcgtgatttggaaactattagtcaagaactgaggctcaaggatatagagtttgtgcaggctaaaattgatgaccttgagaagtcaatgaagaggagcaatgacaagcaacttaagatagaccatgaattatgtcagagggtcatgacacatctccaagacgggaaagacgtacgtttaggagaatggaaagctgctgaaattgagatcttgaatgtcctttcagctgcttactgctattcctgttgtttatttagtgaaaatgactgaaaaagaaaaaagagcaagtaactaacaaagatacatgcttgagagaaggaggggggaaggtgaaactttgtttcacttctgctgtttccacgaacggcttcgaacagaaactagtggatatgccagaagatgaagctgctaaatattgcgccgaaaaccagacagcaagtttgatccccaaaatcatcaagactggttttgcagcaattcatctcatcatacttcttcacagcctggtcacgacgaggtgaaagtgctggcagatcagacgtcaatcgaaagctcctcaagctgctggtgcaattgacactgattttgaaagaggatttcatttgtgctgaggtaatgaagtttgaagatctaaaagagctgggcagtgaatctgctgtcaaggctgctgggaagtacaggcaggaagggaagacgtacgtggtgcaggatggagacatcatcttcttcaagttcaatgtttctggaggcggaaagaagtgatgaattcatcacagggtcgtgtattttagcatttttgggttcacttgcaagtagccaggtactatcagtactgattgcagactgtgcggggaggctataagcaccaactggaagggatgaaaaatataatttttcattcgtgagctagaactgctctgctctatcggaaaactggaagttgtaacgtgtgactggacaactttgtcgtaattaggatgcaaagttatttgttatgcaattctaccgttgttgcatgtgtagctccataattcttactaatattttacatagaaaattactttgattactttattggatgaaaaaatccntgatactttaaaaaaaaaaaaaaaactnnaggcttttaacggccnggccn

SEQ ID NO: 9468 - DNA, 631 bp, Triticum aestivum
  unsure (1)..(631): unsure at all n locations
  Clone ID: PAT_TA_9468
gcccgccccccttcagctcctcctcgtcgtcgtcctcctcggaccaggagctcatgagagcgctcgaaccttttatcaggagcgcttcctcgcccacctcctccacctccgcctccacctcgccattctcattctacgccacctccacctccaccaggacctccacaagtgcccgtcgtgggagatcgactgggactccatcctctcgtgatcgccagagcaaacggaagctccatgaacgaattaatcattaagcagtgtaattaatcctgcagcggccgaggctcgatggaatattagacatcggccgccgccgctgcggttagggtttaaggagttcgccatcgtcgtcgtcgtagtagcagtcgttaagaagggtttaagcttaagtttgcttacttagctgcgtacgtactttattgtattattagtgatctcctggttgcttcgccggttgttttttctccgagcaaggccagtcgagagtgtaatgtatgcatgtaactcttcgttaccacgtactgaatttgaattttataaataaaaaatactcataaagatgttaaagtcnnanggaaaccgggttacacttanncctgaaaacccttccaggggnnaanaaagccacgtt

SEQ ID NO: 9469 - DNA, 816 bp, Triticum aestivum
  Clone ID: PAT_TA_9469
ccacgcgtccgaaccccaccacgcgtcgggccgctcggcctcgctcgatctgccccgcccctcgcgccgccttcctccgccccatctcctcgccttcctccgccccactccggcatcgagctccgccgcgccgccgtccgcgcgtacgagcggacctaaaatccaatcaccccgtcccttgccccctcctcccattattctcctcctcccaaaaccctaaccctagcacagacaccagccgccatggcgctcaccacccgcggcggcggcggcgccgaccaagcgcagcctccgccggctcccgacgcgagcctcggcttcctcacgaagcgcgacacggaggtcaagctcccccgcgcgacgcgggtgaagaacaagacgcccgcgggggtccagattaccgccgagcagatcctccgggaggcccgggagcggcaggagcccgagatccgcccgcccaagcagaagatcaccgacgtccacgagctcgcggactaccggctccgcgagcgcaagaggttcgaggacctcattcgccgcgtccgctggagcgtatcggcgtgggtcaagtatgccaagtgggaggagggccagatggacttcgcccgggctcgctccgtctacgagcgcgccctggacgtcgcccaccgcgaccacaccctgtggttcaagtatgccgagttcgagatgcgcaaccggtatgtcaaccatgccaggaacgtctgggaccgtgccgtctcgctcctccccgcatcgaccagctgtggtacaactatatccacatggaggagctgcttggtgctgtcgccaatgctc

SEQ ID NO: 9470 - DNA, 783 bp, Triticum aestivum
  unsure (1)..(783): unsure at all n locations
  Clone ID: PAT_TA_9470
caagggatttntgaaggngttaagttgtaacncaggtttcccagtcaggacttttaaacgacgccattgagccgctaanagatcnnatagggcaattggtaccgggccccccctttttttaatgggaagattctattattattcagtagcatactngttatacagaggccgtactcttggagaaaatccttgcaacatatatagcattagcaacacctcctaggtcctcgcagctaacagattaggttggaagagagcaaaactattaattcctagcgcaccaaggacccatatatatatactatactagccacccagctgccgccttcctagctttcttgtcatcgatgaagtgttgcatgagataggaaacgaacccccaggcggcgatgagcatggatatgatctttatcccatccatggtgtcgtggaaaatgagcacggcgaagaggggcacgatgggcagcgacacggtgctgatgacgttggagaagagggaggagacctcgaagacgagccccaccaccccgacggaggtgatctgccaggacacggccgtccacaccagcgtcatgaagtaggagaactggccggagcggaaggtgtccatctcctccgtcatcatcctccactcgccactggtgaagaggccgaccatggaggcgatggtggcgacgagcgctgtgtatatctgcatgttgagcacggccgtgtaggtgtgcttcttgatcacgttctcgaanggtgagctgcatgagggagaggatgagcgagtaggtgccc

SEQ ID NO: 9471 - DNA, 780 bp, Triticum aestivum
  Clone ID: PAT_TA_9471
cgtccgttgacgcgtgggcggacgcgtgggcggacgcgtgggtctcaccacgcgagacggtggcgagcccgggcgggtgcggcaaggagtcgtgccccttctgcgagatgtcgaggcagcacgcggccgggtgcgcgcggcggctgcccaagcggatcatcctggtgcggcacggcgagagccaggggaacctcgacatgtcggcctactccaccaccccggactaccgcatcccgctgacgccgcgcggggtcgagcaggcgcgcgccgccggccggggcatcctcgacgtcgtctcctcggggggccccgacgccaactggaaggtctacttctacgtctccccctacgagcgcacccgggccaccctgcgcgggatcggcgccgccttcccgcgcgaccgcgtcatcggggcccgcgaggagtgccgcgtccgcgagcaggacttcggcaacttccaggtcgaggagcggatgcgcgccatcaaggagacccgcgagcgcttcggccgcttcttcttccgcttccccgagggcgagtccgccgccgacgtcttcgaccgcgtcgccagtttcctggagtcgctgtggagggacatcgacaacgggaggctggatcccagcaccacctgcgagaccaacctggtgatcgtctcgcacgggctcacctcgcgcgttttcatgatgaagtggttcaagtggaccgtggagcaggtcgagcgccttaacaacttttagaaactggagttcagtgggatgcatctcgggccccgggggtgag

SEQ ID NO: 9472 - DNA, 586 bp, Triticum aestivum
  unsure (1)..(586): unsure at all n locations
  Clone ID: PAT_TA_9472
naanaagntcctctgtgtgtttgacttccaanggggaatacttagngaattactatgcttgtacaacggcgctccacccagcttgtcctccggtgcgagggggagggtgatcaggccggattcaggccagaagatgacactcctactacactgacttcatcttgagcaaacaggtccaaccttgcgcatgtgctcattgctattctgcgtgacaaattttccgaagtttcggctcccatgctaattaatggccacatctggtctctcaagtctcaatgtcatttccagtgaatctggacctcatataatcaactgcatgttccctccagtctgatagagatgcgaacggcaacaaaccagccaagcatggaaggaccaaagagagcacagcgtagaatatgtaccggcgaacccaatatggcaaaccgagagccttgggtctgtgcgtcacagaaataggaccataaagaccacggtatagaagagatggataggtgtttccaagtaaatggatggcgcaaaggatttcccagaatacaagccaaacatttccatccccgcctagggtgtcaacgcagaaccttcc

SEQ ID NO: 9473 - DNA, 653 bp, Triticum aestivum
  Clone ID: PAT_TA_9473
cgtccggagacggagccctcgcccctcacctgaactgcccgcacagcgagatcaagcgcccctgccgaactcgctcatcgctggctctccctgcgccccccccccccaaccccccctgcctcgccgcctcccacataggcctctcccagatcgagtagggcagtgcactgactttgcgaaggttcctggaaacacttgcttcaaatggctcagcaagcggatggcatttatgatgtgccggacgggcccgtccgcggacgcgtgggcttgaagctgagcagcgaaaattccttttcagaaatgcaccgctcctacgcaagccagatggagcgcctacggaaacatctcaaaaagaagtttaagaccctcgtgaagggcaagaggaagtttcatctcaccccagatgggttagctgttttcacggttgcatttactgatggtgaaaggactgtcagggcgatcattgaaggaaggcatatgtgggtgagaggattcgaaactacagatggacaggtgtatgagttcaaggagaagaaccagggacatgaaacaaagaagtatatcaaagggtcaattttactttcccatggaggagggtttcccacgctactacgtgaaggccctccacttgaaaactttgaagtgggctatac

SEQ ID NO: 9474 - DNA, 630 bp, Triticum aestivum
  Clone ID: PAT_TA_9474
tttttttttttttttttacacaacagatatgtttattcacgtgctaattaaattttagaaagcataacacaacttggtagatgtacaacctacgagtactacatatcttgggcatggacgcatggtggccaacatcaatctcactccatacacatcttctttagaccctacctacgtcgtgacgtcgatgccaccatcaatctcgacctcagtagcgacaggcaccgtcgtttctccctcctccgtgccatcgtgcccgatcgagagcccctggtggcgcagccgcagcagcacgccgtcgagtatgcctgccacccccgtcgccgcgacgagctggggaaagtgcccaacggactcgacaatctccacggccacgtctgtgcctgccttcgtcatcctccgctccatgtactcggccacgaccggcggtgcggcgaagtcatggcgcaccccgacgatggtgcactgtgctggcacggcgtcgagggccgggcgctggtcgccgaggaagatcatcctggccaccccgagagccacggccgggtccatggccaggaagctacgctccaggggctccacagttgcggccgccatgtcgtcggcagcgccaccggcggcgttggggacgaa

SEQ ID NO: 9475 - DNA, 737 bp, Triticum aestivum
  unsure (1)..(737): unsure at all n locations
  Clone ID: PAT_TA_9475
cgtccggctaaaaccaaagcacgccgagctttagaacacaaaaacgagcttgtgattgttcttggagctgtgtggctggattgagttgatggtcgcaatacacacctctgatagttgtataagtaatcataatcatgattctgatcatcatgctgcatcacctaaactaatctgggggttgataaactgcaaacgattctttggtggaacaattaatttgtataacaactttgtggcccgttctgttgcactgtgtaagaataggaacttacagttctatcctcgaacactggttgagaggaagttcttctatgagttttggtagcctaatatccttcttctcgctggatatgtgtgaaagggtcctgcagtgaaattgagaggagataattctatgagttctctctataaacgtagacttttaccattggttattgaatcattagctattgacatgtatgttttactctaattgtatgcctttacttagcagttttacgatttccatcacttgtgatgatctgctagttaaaattctatttgaacattattgattccatattataatatttactcttgttctatctgctgcgaccttgatcttttaacttattctgaggatacattttccttttagtcagttcacaataagattttgctgtttactgcattgcagagaggaggcaggcggaggctaaccgcataagggagaagtacctgcccgggcggccgctnna

SEQ ID NO: 9476 - DNA, 1150 bp, Triticum aestivum
  Clone ID: PAT_TA_9476
aacagtaacaaaatgctttgaacaaaaacaaaatcttgcagcgttccaaatgggcgcagggctgcacacagtagtgcatttattactgttcagacagactggggatgcaaatgtggaacctaaagggtcccctccgatccttttgggttcaatcaaatgaactaacttttcagaattcaagttagttcatttagttgaactataagtagggtcgaaggataccctggaggttccaaatctgcatccctcagaaagacgaagatgaatgagaaagcaaagataacaaggctagctgccatattatggcttcgaattagatgttttcttgctcggattcatgaagttgatgcactccacgtcctgtcccacactcccacaaggcgtccctttgtgccgcacgtccactacgcctcctttttccgggtcgaatcggcaccggtagaagcgtccattaatgccgaggatgagaaggtgtttgcctgattgctgaacgcgaccaagtacttggtccttcagggacgcggatctgagtcgacgaccattctgaactgaaatagcccggcaagaatcctccagcgaacgacagcgacgacctcttgttggctgtagctactgctggagacgacggcgccggggctgcttggagaccgccgggaccgttgctgtcctccggtgtcaggcttggcaaatcgacattgacgctgaacacgtgcacggtcgccttgtcgctgctgaccgccaaccattttaaatccggagagaaggcgatgcagtggatgtctgctccgtctcggcctctcctcagaacttagcgaagcatgctttatctctcgggggtggccgccatgtatggttaggtcatcctgaagatctttccttcgtccctgggtttgggaagtgacaagcgggcgaggaggttgcggccaggaagatagccgaccatctccatgccggttaaattcacaacaggaagtcttcttcttttaaacatggacaaatctgcttggaacaactaacaatgaattctacggattaaagtcaacccgagctggtgtttcacaatctctctcgcctgtctccactggtaatttcttgctaatctattcaagaatatgtgtttgcttcgtggtttttctctgcggacgcgtgg

SEQ ID NO: 9477 - DNA, 1118 bp, Triticum aestivum
  Clone ID: PAT_TA_9477
ttcccgtgccggccgctggtgtccccgccgctgccgcgggcccgggtcgacccagcggccgcggcccccgccgtcgtcgccgacgtcgctgcgcgtggtgcggtgcatggccaaggagcggcgggtgcggatggtggcgaagcagatccagcgggagctggcggacatgctgacccgcgaccccgtgatgcagcgcgccgtcctccccgaggccgccctcggcgccgaccgctaccctcctccctcaccaccatcgccgacgtcgagctctccaacgacctgcaggtgtgcaaggtgtatgtgtccgtgttcggggacgagagggggaagaaggtggccatggccgggctcaaagacaagaccaagtacgtcaggagccagattggcaagcggatgaagctgcgcctcacgcccgagatacggttcatcgaagacgagtccatggagcgcggaagcaggattcttacgatactggacaaactaaaggaggaaagggagcagagagaaggaaatgctgaagacgaagatggggaagtttcagatatagcagaagaagaagatggtgactgggagggagatgaaccagatgaggaggacataatttatgtaaaatagcccactacttcttctgaaagctcagtcaccattcgttcaacttcagagctcatcagttctcctagggtttccgtgtccacctcatcgacaaagtgctccatgggatctcaacgcttgaagcctgaggacatctgaagcgaattcatcgggcataagatcgtaccatgttcaccagatcagtatctgacctgaccctcaataggagacagtttcgctgatgtccatcctgttctgtatgctaaccatccctgttatgtccacctgttgtgtctgttcatgtcgctgattgaacatggaggcacgcgcctttcattctgtatttggtttgggagctgtcttgtacatctcccttcaaaatgttttgtagcacaaagccgggtaggtaacattgactgttcattaacttctgtcctgtaattcagcaacttcaagcttcccgtgaaattgaacgggcaaattttgtgccctattcttctaaattaaaaaaaaaaaaaaagggcggg

SEQ ID NO: 9478 - DNA, 813 bp, Triticum aestivum
  Clone ID: PAT_TA_9478
ggtttggatccacagagcaattgaaggtcattgaagaagatattacaaaatttcacgttcactcccattttctccctatcctggaggagaaatcccgtggcacgaaaaaatatgccaaggttgtgtcaaacttaccattcaatgtcagcactgaagttgtcaaacaaattctcccaatgggagatgttttctctgtcatggtgctcatgcttcaggatgaagcagcactacgccttgcaaatgcttcaatacaaacaccagagtaccgacctatcaatgtgtttgttaatttctactctgaacctgaatacaagttcaaagtagagagggccaactttttccctcaaccaacggttgatggtggtgttataaggtttaaaataaaggacgtccgggagtatccgcttgttagttctaacaaaagtttcttttcaatggtgaactccgcgttcaatgggaagcgcaagatgcttcggaaatcacttcaacacctatattcttctgctgacattgaggctgctctgaccaatatcggtcttccgcctacggctagaccgtctgaactggggatggatgatttcgtgagggtgcacaatcacctgggaaaagtatgaccacccctgcgtttcaaaatgcgtatggaatcatcttattggtttgctcgctggactaagcatgccgctgaagtgatttggttcacagctagagcgcactgcagcttgcatattatgcttgctgacagtgaccgcctagtattctccagcagtcccacagccttcaccgcaacataatcggtggcacatcttcagccca

SEQ ID NO: 9479 - DNA, 637 bp, Triticum aestivum
  Clone ID: PAT_TA_9479
cctgagagcctgcatgcatgttaatgattattgccaccatactgtattgataagatgaaataaagcttattcggtttgaattctgatttctacttttctacttatcatgcattgcatactactaccactacatacatacacacaccagagagcttttccacatgcaagatgacgagcataccatccatgtgtaagtaggttacgcgccatctccaatcctcatccaacttcacccatttttcttcaagaaggttggaattcaccttctcctcttccatccagaaaatttttatcaaccatcgcagcccgctgaaatcctcaacaagatcctctgcatcacaaattgcttctgatgtccaagcgatcacactttcctgccacatcccccagctatgaagtcaaagtcaaccttggctgaaatcataattcacgcaccactaacctgtgcagtttctcattgccatattatacggttgatggactatatatgtgcagacatcataagccttcaatcccattgattgtgctccattatacagcttcgcattgccattgagagagtcttcaagtaagcactgatttctacaaggcctggttgtgctggctgtcacctgacgcctgagaagtgtgacaggcg

SEQ ID NO: 9480 - DNA, 786 bp, Triticum aestivum
  Clone ID: PAT_TA_9480
gtatagtttgactatgctcgttcatctggatagggcaaaactttctgcagcggcaacttgacaagtgcaaatcatcaaagcaaattcaggagcaccattggagtgttgaaagttttgaatgtttgctactatatcctataattctgtcataataacatagtacatccataggaaggaggggaaaccattttattctgctacctcaaattacaaaaaaattattggcaaagggggcggcggaaaactttgtacagtttgacaacatgctcgttcatctgaatatagggcaaaactctgctaccaagcgcctaataagagcaaagtaagcaataccatcttccaacacattgcactgcttgcaggtctcagggagcgcagcaacctcatcagctgaccgaagtgcagattgactgctgagagtagagaccgtttatggggttcacgaagtgctgcttgcttttcctacgctttgagactactgtaaacccctctgtatccttctcgctcttgggcacctcggcggccttcggttgtttgtcgaactctttcggacttacggcggtcttggttacgttgctgctctgttcactactagcttcatctgacccgcttggttttctgtccggttgaggccgagtcgagcctaagctgtcatggaccgacttgacaatgaagctgagcagaatctgccttgcaagttctgctttgtatgaatctctcgtcgcctctttcgctcgttccttccctttacctggagttgtcttctccacttgacctgccttgtct

SEQ ID NO: 9481 - DNA, 420 bp, Triticum aestivum
  Clone ID: PAT_TA_9481
cgtccgctctagcctctccattccgtgtggcgaccgagcgaaccctagccgagattagactaccatccccaatctaccggaggaggacgaggacgacgccgacgagatgctgagggttgcggggaggaggctctcgtcttccctctcctggcgccccgcggcgaccgtcggagccaggggcccgctcgccggcgccggcggccctgggagagacgacgacgacggttcggcctaccagcggcggttcgccatcgagtcccccttcttcaccgccgcgagaggcttttcttcggctgaaacacttgttccacggaaccaagatgctgggttggctgaactcccagccactggtgctgcactgaagaaccccaactcaaaaatcctttatgaccagtacaaccatgaaagatattcttctgg

SEQ ID NO: 9482 - DNA, 800 bp, Triticum aestivum
  unsure (1)..(800): unsure at all n locations
  Clone ID: PAT_TA_9482
ccccacccttcctagcctctccattccgtgtggcgaccgagcgaaccctagccgagattagactaccatccattaccgtgtggcgaccgagcgaaccctagccgagattagactaccatccccaatctaccggaggaggacgaggacgacgccgacgagatgctgagggttgcggggaggaggctctcgtcttcgctctcctggcgccccgtggcgaccgtcggagccaggggcccgctcgctggcgccggcggccctgggagagacgacgacgacggttcggcctaccagcggcggttcgccatcgagtcccccttcttcaccgccgcgagaggcttttcttcagctgaaacacttgttccacggaaccaagatgctgggttggctgaactcccagccactgttgctgcactgaagaaccccaactcaaaaatcctttatgaccagtacaaccatgaaagatatcctcctggagatcccagcaagcgtgcctttgcctactttgttctgagtggtgggagattcgtatatgcatcactgctgcgtctccttgtcttgaagtttgtcttgagcatgtcagcaaagtaaaggatggtgcttgcacttggcttccccttgagggttcgtttccattccaagcaagcgtaaccccggttaggcgcaagtgaacttggtcagagatgggccgttggaaaaaggccccagttctttcaattcagcatccttgcgcaccanacaaacctagcgttnaagancaaatggcggtttatgggtctgcccacttggtgatccctccaacc

SEQ ID NO: 9483 - DNA, 795 bp, Triticum aestivum
  unsure (1)..(795): unsure at all n locations
  Clone ID: PAT_TA_9483
aaaaaaatcagatgacattgttccaaanttnccttgaggccaagtgaatgtntgaaacatttatgacatttcnaagtttgtaccacnccaatatgtcatatatatgataagacactntggttaacagttctacgtatccttttgtcggaaaatagaccacgttgaaaggaaggccatcaacctttgacaattgatgctaccgtacattttctcctttgattaaacgcacacactaacttgttgtggaagtcttagtaaccaggagttggtgttgttactccctcaaaaaaaaagttggtacagtatattacagctggacaagtcaaaccacgccaaggcctcttacatttcaagcgacccgtcggcatgtttgtcgggtgtgggcgttggctccggtgccggtttgacgaagcgcttccagtaccaatggcgtgcccagaccgcgcccatggcctctatgggcacgcccttggtctctggaaggaaggcgatgatgaatgccgtcatgacgacgacccaagcggcgttgtaggcgaaggagccatacttgaagctgcaaagcatggcgaggaaggactgcgtctgcacgaaggtgagcgtgagcgagatggactcgctcatgctctgccccgcggacctcacctcgagcgggaagatctcgctggggatgatccacttgagcggcccccaggagatgccgaacccagccacgaagaggcacaccaacgccaccacggccaccgcgtagggcctcggcatcgccttcccgccgttggtgcccagctccgcgccgaa

SEQ ID NO: 9484 - DNA, 670 bp, Triticum aestivum
  unsure (1)..(670): unsure at all n locations
  Clone ID: PAT_TA_9484
gccatgaccgttggtgatatccctcctcattacaaacttncacacatttgatgatggtacaaatttgcgagtcattacaatttacaaacttcacaattttcatgtctagaccacctctttgcattaccttgagcaatcacagaaataagcacaagcctcttatattaaaaaggcgcagcaagatgcatgtcatggacggtgcagcaggcatgcgaggtggatccgtgcgggtagtgccggatgcaccttgaacggcggacgtgcgtggggcagaaaatttaaccatggaagtgttattcaatttcaccatgttctgcatgttcattgcatcaacaggttcacctttcccttggcgtccagtcaaagccttttcaactcctaaacacagaggcatgcttagtaattctgttaaccctttaagcaacatcacgctgcatgaaatgatggatgacacatgtcatgcccacggggtgagatgaagtggtcagcgcttgcagatttcagcagcattcacagcctcagctgcaccccctggcagtgaaaggcaccttgcggctcgcgtatattgacatgtcaattggcatttagccaaacaaaactgtgccaaatccagctggctcatcccggccagatctaaaaatatataaaaagaatcagtattgaaaggaga

SEQ ID NO: 9485 - DNA, 464 bp, Triticum aestivum
  Clone ID: PAT_TA_9485
ttaccgtttcttaattcccttggggagggacgcgtccgcggacgcgtggtcccgatgatcgtgtaccggaagacgaaggacgaggtgatggacatgggcgtggtgctgtacaacatgctcctgtcaatgtgcgccgacatcggctacgtcgacgaggccgaggagatcttcagagacatgaagtcgtccatggacaccaagtgcaagcctgatagctggacctactcatcaatggtgacattatattcctgcactggcaatgtccctggtgcagaggccatactgaaggagatggcagaggcaggtttcaagcccaacatcttcatcctcacctcgctcatccggtgctacggtaaagcgggatgcaccgacgacgttgtcaggtcattcggcatgctagaggacctcaaaatcacgcccgacgaccggttctgcggctgccttcttaccgtggcagcggatac

SEQ ID NO: 9486 - DNA, 1776 bp, Triticum aestivum
  Clone ID: PAT_TA_9486
ggtgaccaagaatttgatcttccagtgaatcaaaggacagatatatgtactataatgtacactagtggaactactggtgaccccaaaggtgtactgatctccaatgcgagcattatctgtctcattgcaggtgtgcccacggaccggcttcttaactctgtaaacgagcggctggaggaaacagacgtttatatgtcttatcttcctcttgctcatatctttgaccgagttgtggaagagctgtttatgttccatggtgcatctattggattttggcgtggggatgttaagttactggttgaggatattggtacactgaaaccaactatcttatgtgctgtgccacgtgttcttgatcggatattttctgggcttcaagctaaaatctcagctggtggtttcataaagagcacgatgttcaatcttgcttacaaattcaagcagtttagaatgatgaggggagctaagcacaatgaagctgctgcaatatgtgacaaagtagttttcagtaaggtgaaagaaggtcttggaggaaatgtccgtgtaattttatccggagctgccccacttgccactcatgtggaagaatacctgcgagtggtgacatgcgcacatgttttacaaggatatggtctcacggaaacttgtgctggatcatttgtctcgctaccaaatcagatgtccatgatagggactgttggtcctccagttccaaatattgatgcccgcctagaatctgtccctgacatgaattatgatgcacttgcaagcacacctcgtggagaaatctgcatcaagggagaaacattattctcagggtactacaggcgtgaagaccttacagaggaggttttggttgatggatggttccatacaggggacattggcgagtggcaacctgatggaagtatgaagatcattgatcggaagaagaatatcttcaagctttcacaaggagaatatgtagcagttgaaaatttggagaacatttacggtgttgtttctgctatagactcgatatgggtatatggaaatagtttcgagtcattccttgttgccgtagtcaatcctaacaaggaagcccttgagagctgggctgaggcaaatggaatcagtggtgattttgaggcactgtgtgagaatccaaaagcaaaagaatatattttaggggaactttcaaaaacaggaaaagagaagaagctcaaaggttttgaattcataagagctgtgcaccttgacccagtgccgtttgacatggagcgtgacctgatcactccaacatataaaaggaagcggccgcagttgctcaagtaccgcgacggcgcccacggcatttggttccatagggcctgtgcacctcgtcccggtcccgtttgacggggtgcccgaccccctcgctcctgcctgtagtaccaagcgcccgcgggcgcccctgtactaccggggcgctgcccccagcttggaccgatgtgcggatggagcgcgccttcagcacgtgttctctgtttcccgtctcccaaggggccgacggaggggcgcgcctcatgggtgctccccgtctcctgttgttggggctctggcccctgcctggttcgcctgcgtcctgtaatggtctttcagagtttgctctgtttttaatatgtggcaaatgggcaatgtggggccccgcataatggcagacaccgtttccagttgttcgagctctgaaactgccatttttaccaacgaccgattagcagccgagaaacatgctccgattcaatcttaaaaaaaaaa

SEQ ID NO: 9487 - DNA, 1293 bp, Triticum aestivum
  Clone ID: PAT_TA_9487
cgtccgccaccactcccatcgctctcccgaatcccccccatccgagccaaacccccctgctccattaaattcatagaccaccatagtcccagggctcacgcacacgctcggcagccatgggcacgtcgggctccaaggggctggacggcgtcggggggctcggcgcggcggcgctcgccggcggcagcgggggcggaatgggcggggacgagggcgacggcgacggcgccgtgacggggtcgtggcacggcggcgcgcagctctacgtgtcgctcaagatggagaacgcgcggatcatcggcgacctcgtgccgcacgtctacggctccgagcccatcatcggctcatgggagcccgcccgcgccctcgcgatggagagggagctggcgtccatgtgggagctcagcttcgtcgtgccgccggaccatgaaacactcgacttcaaattcttgctcaagcccaaggatgcggagaccccttgcatcattgaggaagggccaacgcggcttctcaccgggggcatgctcgagggtgatgtgaggcttgcaaacttcaggcttaacggagatgatgagttgcttgagttcagggttttcaacaaggccgacatcgtgtctccgcttgatcttgccgcgagctggagggtatacaaagaaaatttccagccttccaaggtccggggaattcctgatatcagtataaatgaagcacccactcatgcgaccgaggatggatctggttctagtttggagcttgacttagagcattatgttgttccaacgccaactgcaccaccaactgaatatgcagcaaaccttgctgcaaccccagcatccttagatcagcctgaaacaccgtggacaaatgatatgcttcttagtgatggcattcagagtccaagaagtgctgctgcagattttaaagatgatagttaccataataaggatactgaggcttcaatagcagattcttctaattctaagaagttacaaagtttctggaatggtagagtcaaaatcagttggtaccttaatacaactgcaaaagaaggacatgccacaagggctatacgttgacaggggtgttgtctctcctaagcttggaaaatcatttagtgcatgttccctggcatctggccttaattttggatcaacaaaggccatgccagaagcagccggagctgttgcagctgcagctgtagctgataggttgcacggatcaaaggaggaccggaaactggctattgttctggttggcctaccagctcgtgggaaaaccttcaccgcagttaag

SEQ ID NO: 9488 - DNA, 637 bp, Triticum aestivum
  unsure (1)..(637): unsure at all n locations
  Clone ID: PAT_TA_9488
nggttgattngngtantggtncccanaccncggttatcncgtanggggtccttcccttnggttcgaatnttggaggcatcgtncggctcttgtatacgccagttgcaagggatttctgcaaggcgtttantgggtacccccggttctccagtcggtatctaaacgacgccctcgccccccggtaccagactagtgtaggcgattgcgtaccggccccccattgattttggtgcttcgtcctgtccgtacacataagattgacgttatattacaagtacaactgaaccaattacagattgcaagcacgtatcaaatcttgaatattaaatgtcatacactgcctaacttcacagaaattttcagagaaagcgagagagagagagaacagcagcaggtggaacgtagtagcagcagtatggggttcagagtacgccgtgggagaagaagtagcaggggcgttgagaggaagcagcagcaggcgttgagggagaagagaaagagcagcaaggagagaagagggttcagcaggggcagcagcaaagatgtgggagagagagagatcgcagcaggtgaagggagaggaaaagggggagtagtagcagagtttggggaagaagaagcagcaggttgaggcgct

SEQ ID NO: 9489 - DNA, 753 bp, Triticum aestivum
  unsure (1)..(753): unsure at all n locations
  Clone ID: PAT_TA_9489
tggctccgggcgtgcttgtccccacggaggtcactgcacccttgtcttgcgactcggcggccgagcggatgggccgcgcgcccagcctccgcacggcctcgttgccggcatgctgctcgatcatccgcttcagcgcctagccccctccaactatgcacctcatccatgctgcgcccgccgccgcggcttgcagccccgccgtcgacggcatcctcgtcccgcacctccactgctccgccgggcgcgctcgtcgtggcgccctgcgtcgttgtcggcgcctctgggcgtgctcctcctcgccgtgctcactgcgcccgtgtcttgcgacacagcggggctgtggatgagtagcgctcacggccccccttggtcctccgtgtccgctgcccgcctggttgccccctgctgcgccgcgccggcgggctcggctggcgcccctcgcggcgccgtcacgcccgtccaccttccccccggcggcgccggccccgcccgccgtgagttgcccctgcgtcctctacccttccggacggggtccggcgccgccgccgctgggagcgcgtgcctcgcgcccgggcggggcccggggtggatctgtgctccttggcgtcggggtggggccgcgctttcagtataaatctgaagcatacaacatgattcttttcgcgtcttgctttgaataaatattgttcaggtgcctccttgttgatgcgtatacactgcacatctggttgcttcttgttgntgcatgaggag

SEQ ID NO: 9490 - DNA, 1307 bp, Triticum aestivum
  Clone ID: PAT_TA_9490
cgtgtaaacagatcagcaaaatatgtcagacttaccataccagctgtggcctatgaggagcttcagctcacaccatcagcatcgacatagcaagagagtgtcaattctcagccagccgtggtttaaataagcccaaagatttagtacaagtcggaactcaaaaacatagtaaccattaacagaatgcatcaaattcagtactcacattggtcgtcaaaccaaacttagtgggatgatctgttccatctccatttaccgtaacaggtgatgcggcactcaaacaatgattacatttatcaaattctaactcatctcgctgaagaaaatgctaagagacaaattcctagttcacataaggaaaaggctgaccatggaaaaggttgagatttatgtatgatggacagcgcaacctcacccatgcagtgactgcaaaactgcaatggtgattaggtgaatatataaacctgtaacattgagtttttcatgttcaagtgataaaatcaacgagccaacaatctttctcacaactgtagcaaccgatatatgatgcacttaaaccatgatgaaacattgcggagtttcttcagaattcaggtgctagcagagcgagttgcaggagtacacatccagggagtatccggaatgcggtaataaggaatgaaacattgctgcccatttagatggttagtgaagattcaaaacatgtgaacctacagcaggatccttcataccgcaacatcagttggcagtttcccttggcaagcagctgcgtaggcttcagcaaggcctggaagaacatgcctatgagcatctatatgcctgcgctgaaacgtcttctcactaggcgtgatcatcgtgtagaagctctgatctttctgaatcaatcctttctcctggagcgccttcatcacataatgccgaggaaccagtcggcacttcaggctgtacatcacgattgagggcctggcaaggatgtacctggtgtcaacaccgaccaccttggtcaggaactccttagcacggcgaagcttctccccagagatcctcagcaccgttgggttgatcctcaccacgttggtcacctcagcctcagaccacccaagaatctcctcgaagagcttgagcttggctgccatcgtctcggccccaaggcccgtcgtcgtggtcactgcctgcctgaacataagcgaaccgcgaggcacgccgagcttatctgcacgctccaggatggacatcacggtcttggggctgctggtgagcaatctcgagtttggcacgcacatcttggcaatatcgtcggcacttac

SEQ ID NO: 9491 - DNA, 646 bp, Triticum aestivum
  unsure (1)..(646): unsure at all n locations
  Clone ID: PAT_TA_9491
attttattggcctgcatacaaagtagaatntattcgatctgccgttatcttttccatcaatatcgaattgcagcgtttgactaggcccattttgccagcatcgacatcaggccggcccctatcaacataaaaatgtagataccaagctgaagcttccatcttccctgcaccttcgggttggtaagttcctcagctaggaggtcgaccagtgccatgtacacgaggatcccagccgcgacggagttgagaaggccctccatgatcagcgcgttcgggctgttctcgttgtacaccgacgatatagcggcgccgatgccaatgctgaccggggtagtgaagcaaaagaagaggatcatagtaatgagggaggtcgccttgaactttgcctgaactatgcagccaccaaggccgatgccttcgaacatctggtggaaacttagtgcgatgacaagtggcttgatggtgtccggatccggacaagcgccgagggagatgccaatgatcacagagtggaccacaatgccaagttcaagtacctgtgagataacacgttgccggatcgtgtattttgtcgtcatggctgccgccgactgccacgacaagcgctgccgatccatgagcatgcccgttcgatgcatgggtgtng

SEQ ID NO: 9492 - DNA, 423 bp, Triticum aestivum
  Clone ID: PAT_TA_9492
cccacgcgtcccggcagcttctcctctgtttcttctctgcggcagtgtgcttgtcaagatctccctcggctcttgagatctggttaagcggacaagatggtgaagatctgctgcatcggagctggctatgtcggcggcccaacaatggctgtcattgccgtcaagtgcccagcaattgaggttgttgttgttgacatctccaagcctcgcattgacgcttggaacagcgacaaactcccgatctacgagcctggccttgacgaggttgtcaaggcgtgcaggggcaggaacctcttcttcagcaccgacgtcgagaagcacgttgctgaggccgacatcatctttgtctcagtgaacacctctcaccaagacctgtggtctgggaagccggcaggctgccgacctcacctactgggagagcgc

SEQ ID NO: 9493 - DNA, 706 bp, Triticum aestivum
  unsure (1)..(706): unsure at all n locations
  Clone ID: PAT_TA_9493
acgggcgacacccgggagacgccggcgatcgacgtgtgcaagggcctggtgggcgacaaggcccaggtgagcatctacgacccgcaggtgacggaggagcagatccagcgggacctggccatgaacaagttcgactgggaccacccgatgcacctgcagccgaccagccccacgncggtgaagcaggtgagcgtggtgtgggacgcgtacgaggccgccaagggcgcccacggcgtgtgcatcctcaccgagtgggacgagttcaagaagctcgactaccagaagatcttcgacaacatgcagaagccggccttcgtgttcgacggccgcaacgtggtcgacgccgagaagctcagggagatcggcttcatcgtctactccatcggcaagccgctcgacgggtggctcaaggacatgcccgccgtggcctaattcctctccctccctcgtcggccggtccgccgggccggagctgcaggggaaggaagcaaggaaggaagagcaagaagtggtttgaccgtgattcattctttatagtttgcattttgcaggagaagcatccacattttctctctcggccataagaatttagtaaaccttcatgtcttgttaagttcccgatacatgtttgcgtctgtagatcttacttataatcaagtcaaatcctcgggcccctgtgctgcctgaggaggttttcctttgttaa

SEQ ID NO: 9494 - DNA, 1052 bp, Triticum aestivum
  Clone ID: PAT_TA_9494
gcagcttcttctctgcatccaccaagaagtcccctccgttgctttcctccagcagtgcgcgcccctcctctccagatcttctccgagttcctgagatctggttgtaagcaaccaagatggtgaagatctgctgcatcggagctggctacgtcggcggcccaaccatggccgtcattgccatcaagtgcccggcgatcgaggtggtggtcgtcgacatctccaagccccgcattgacgcctggaacagcgacaccctcccgatctacgagcccggcctcgatgacgttgtcaaggcctgcaggggaaagaacctcttcttcagcactgatgttgagaagcatgtcgccgaggccgacatcatcttcgtctcagtgaacacccccaccacaagacccgcggcctgggagccggcaaggccgccgacctcacctactgggagagcgccgcccggatgatcgccgacgtgtccaagtcggacaagatcgtcgtcgagaagtccaccgtgcctgtcaagaccgccgaggccatcgagaagatcctgacccacaacagcaagggcatcaactaccagatcctgtccaacccggagttcctcgccgagggcacggcgatcgaggacctgttcaagcccgacagggtgctcatcggcggccgggagacccccgggggccagaaggccgtccaggccctcaaggaggtgtacgcccactgggtgcccgaggcgaacatcatcaccaccaacctgtggtcggccgagctctccaagctggccgccaacgcgttcctggcgcagaggatctcgtccgtgaacgccatgtcggcgctgtgcgaggccaccggcgccaacgtgtcggaggtgtcgtacgccatcggcaaggactcgcggatcgggcccaagttcctgaacgccagcgtggggttcggcgggtcgtgcttccagaaggacatcctgaacctggtgtacatctgcgagtgcaacggcctgccgggaggtggccaactactggaagcaggtgatcaagatcaacgactaccagaagagccggttcgtg

SEQ ID NO: 9495 - DNA, 1003 bp, Triticum aestivum
  Clone ID: PAT_TA_9495
tgcagacgtgccgccccagccaaactccccacctgacaatgtcttccgcccggcacctttattggctgatgatcttcacatgaaactaagctacctggaaaacaagtcgcgttcgcaagactgttcttccctgctgaagccaaggttgccatgcaaattgcacaagcagacgtcacaccagaagttggtggtttttctgcagcaagtacttctggtaaactgagggaagtcgatctgaatgagacgccagtaacaaaaaacaaaaggctgcgttcaagggtggatgcactagcgaaaacagtggaactgggccgtcggtacttcccaaactgctcgcaggtgctcgacaaattcttggaagtgggcctgcctgatggccttgatgcgttccagcagcaaagcggcacccctgatgagcaacaggtgaagaagatgggcttctgcgaggtgaaggaggacgtgcgcaaagcatacagcaaggacacggccgataaaagcatgttttcagccctgtcgtcaaactcctcatcctcggcgatgaagtgaaggtactgtaacaggctgttttctggagatgtcaggactaaagagggatcgctggtcatgcgcatgtatagtgctcaccatcgtgtaaaactgaatatgaacatgaaaggaggccccaaaatagtagaagatgatatatactttgctggactagggagtttgttggagaaggctgtgccatcccatcccagattcccaatatcaatttcccatgctggttgtgaagacagagcagcggatcatccagctccgacgctatgcatgcgtgcagcctgctgtatttgtttcgcatagctgcaatacttatctgtttaataatactagggagtagtaggttattgaggctgtagcggaagttggaacctgcctgaatgtaagtgaaaggggacagttgcccattgtcgaattgttttgttatcaatacatagttgattttcgtaaaaaaaaaaaaaaaaaa

SEQ ID NO: 9496 - DNA, 2004 bp, Triticum aestivum
  Clone ID: PAT_TA_9496
cggcggcccggcccccggcggcagcttcttctctgcatccaccaagaaagtcccctccgtggttttcctccagcagtgggggcccctcctctccaggatcttctccgagtttctgagatctcggtgtaagcagccaagatggtgaagatatgctgcacaggagctgtctacggccgcggcccaaccatggctgtcatttccataaagcgcccggcgattgaggaggtggttgtggacatctccaagccccccgtcgacgcctggaacagcgacaccctcccgatccacgtccccggcctcggtcgttgggatgtccaaggcaggccgggggaagaaactctccttccgtgatgatgtggagaagcatgtcgccggtgggccgacatcacctacgtcccgggggaccgcacccaccacccgcccccgggcccgcggcctgggggaacggctgccggaccgcaccccaccggcagcgagcgtccccgatgaccgcaggttggacaaggtcaccgacgatgacaagaccgtagtcgacaagtccagccagccaacccagaacacctatgccaacaacaagacgctcatcaacaaccggatcatcttcaacaaccagtcccccccggagaggctctccgaggccgacgccatcgaggacctgttcagggtcaacagcggtgtcatcggcagccgcgggggccagacggccgagcaggcccaccagggcctcgcacgccaagtgtgtgaccgacacggacccccatcaccaccaacctctagtccaaccgagctctcgacggaggccgccaaggggttcccggcccagggggttctcggcggggaacgccacgtcggcgctcggcgaggcggcgcgctgccaacgtgccggaggtgtcgtacgccatcggtcaaacactcgaggcaaggggccgaagttccggaccgccagcctggggttcggcgggtcgttggttccatcatgcacatacctgaaccctggtgtcacatctgcgagtggaacggcctagccggagcgtggccaactactggaagcaggtgatgaagatcaacgactaccagaagagccggttcgtgacccgggtggtgtggtccctgttcaacacggtgccgtgcaagaagatcgcggtgctcgggttggcgtccacgacgagaaacacgcgggacacgcccgggagacgccggcgcgacgtgtgcaaaagggcctggtgggcgacaaggcccaggtgagcatccacgacccacccggtgacggaggagaagatgcagcgccaagctggccacgagcaagttcggcacgaaccacccgatgcacctgccgccgacccgcccgacggcgggtgcagcaggggagcgtggtgtggggcgcgctacgaggccggcaagggcgcccacggggtgtgcatcctcaccgagtgcgacgagatcaagaaggctcgactaacagaagatcccacgacaaacatgcagacgtccagcctcccggtgtttgtacgggcgcgacgccaggcggacgacgccgaagctctcgggaagatccgccttcatctgtccacctccagtctggcaagccgaccggtcggccggggcaaaaggacatgccggcccgttgccctaacttccacctcgtcgggccggccgggtccggaagaagaggcaaaaagtggttagaccggaggtgcattctttatattttcgctgtttgcaggagaatcatccacattttccatgtctggccataagaatttagtaattcttcatggtctttttaaattttccgatacactgtttgcgccacccctgtatggtagcttctgaagtttattccattccatgggccccaatgcctgcctgagcaggtttttcccgtagtatcccatgaacgaactttgtagccctgttttgctgaaatcattacagaatccaatgtgttttttcataaaaaaaaaaaaaaaaaaaaaaaaaaaacaaaatcgacccctaacaccc

SEQ ID NO: 9497 - DNA, 640 bp, Triticum aestivum
  Clone ID: PAT_TA_9497
ttttttttttttttttttttaggttcacaaacatacataaatatatattcacacaggttcacaagcatagtttgaccatccagaacacacaagtcaaagggccactatttgctagtctgaactaattcaaacaatggtccagaacacataaatcacatacatgagcacaaagtttctactccaaaacacttgaagcaccaaatggtccagaacacacataagattcaagaaatgattgaagttggttggtccaaaatactgcaaacagccatatgtgttccatgacactccaagtcctcctcacatccaatgctaggtgtggctaagtacctgcaactcctggcacattagttgtcttcttggcatctttgatatgtaattattactagtacgaatgccgtgctacaatcttcaacttcagtatcaaatatactgtcatcagagacgcccgagtagttccgctgcactgagagcgctctgctgatgttgcacagcacggcctgctcgtgctactgctcttgcatgctcgggctgtcgggcgtccggaaagaagaaaaattgtagagctgcgacagcagcagcttcaggtgctgatgtgctcttgaggaatccttccatgttggtaaattccctcgtgccg

SEQ ID NO: 9498 - DNA, 873 bp, Triticum aestivum
  Clone ID: PAT_TA_9498
gagaagaaccagcatactagatctttcctctagttaagatacactggtaagctacgggcctctgacttagataaccatacagagagcagcatattgagctgcttacagtcctcccaaacatattttctcttcattgaccagagcagggagcaaacaaaaatgatgagcatcagctgataacttctctttcctgtacaaacctaacccaaagctaaactaaaacaagaggggggacaaggagtaagaagagcccctatgaaacagaataccttctgttcctaagaggggggagaggagagggcttcacttccgtgggcttcgccgtcgatggcgggctctgtgagctgccggacgtctctgaacccttgccgttctctccatgccccttgctgctccacagcttgtcgaatatcctcctcgaccgcgactgcagcaggaggcctccgagttggtccttgaagctgttcctgccaacaacttgatctttgaagctgtttctgccaacaacttgatccttgaagctgcttctgcctcccctgagctcgacgtgccggtcctcgccctctcctcttgcgcttaggcttgtcacttgcttatccagcttgtttgggtgcctcggtatccgcctttcgcagtgctcgctttgttcctgcacaggctttgcacaagcatgctctccgccgtcagttggggctggtacactgcttgttcccgccccctgctcccgggcgtcgggggcctgctcctccaccccgagcggcccgcggtccttctgtgtggcagcctcgcttgcgtctggcggttccttcttatacgcatcaaccgcgtagtacaacccgtcatgaacaggtctagctgcttctggcaccgccg

SEQ ID NO: 9499 - DNA, 569 bp, Triticum aestivum
  Clone ID: PAT_TA_9499
gctttgggattaaaaatctgagctttgggatgatgataatttgatgttctcaagattatgagatgctctaattggccgcgatgaacagcggcaatttcctaccctcagacacccagcacgttttatatcaacaccctacctttgttaggagagctactatccacagcgagaaatagtaataattacacagagatagacgagcccctggtgatcgtccggtccaggtaaaacggacaaaataaaagagggatctccttctcatccatctgcccgtctacctatctgatctcggcgtcggcggtgagctccccctgctcgccggccggcggctgctggtgcccctgctctgtgaccttgttgggggcttcggggtcgccgaatttgtccttgaaggcgtcctgccgcttcaaccacatcatgtgcccctgcagcgccgccgcccacgcgatgaggaaggaggctgcccagaaccgcttctccttcaccagcttcgacagatccaccgccgccatggtcgcccctctcgccgctgctactccccctccggcctcccacctccagcctcgtgc

SEQ ID NO: 9500 - DNA, 1801 bp, Triticum aestivum
  unsure (1)..(1801): unsure at all n locations
  Clone ID: PAT_TA_9500
cattggtcctcctcccttggcgcggcttttctggagtcctgccgcctctccaccccccgtggcgcagccttcagatgggcccccgttccgatgccccgctccgtcctcggctccctacttctgccacgtctcctggggttccaccgggtctcgtcccttggacctgctgctggacgggctttcccattgcgcgatggcatgggatctccgctgctcacgcggatcgcccgcgcgtcccatgcgccttgttgccgcggcccagggcctcgtacctgctgcccatgccgttggccgtttcgtcgtccggcccgtccctgtccggggcgcctccgtctccgaccagacgcctccgccctgtcctcagagactccgcctgcttctcgtcacagttctgcataagggcttccacccggaagttgataccaagagaacccagcacctgggattgagtcattggcccatggacggaaatatcatctgaagcgtccttggcagagtgcttgattgcagcaaaatcaacataggcactgagatcagcagacccaggggtcgtctaatatgtgaacgaatttcgtgtttgctggattgcctgaagactatcagacactattccatttttgccatagtcaatgatcagagcacctccaccatctgagctaattcggtctgcgatctgttcgctaatctccattgctttcgggcagacttcaatctgctcaaccttctcgagctcctcaggactagcccattcacaacgtttggagaggaaaatcaaagaggctgtaggctgcggagacagaacaaagcgaaacgatgagtctcctgcgagatccaccatcttttcacaccagccgcgtgaccctttctgaaattgatggattggtaaagcatcaaagaattcatgagcaacaattatggtggggaatcctgaaggaacctgttcgagggaggcgtgccaataaacaggggctccacaaagcttgctaactgtccttttttcatcaccaacagattcatcttcacatttcagagtattgtactgcaccttttgcaatgtagggctacattctaccaagttaatgttgagcgccttagtgaaattaccaaactttgctgagccacgaagtaaatctgccaagagagttcctcgtcctgggccaagctcaatcaaattcaccttctctggttgccccatttgctcccacagacacatcgcccacacaccaatcagctctccaaacatctggctgacctctggtgaggtgatgaaatccccagactccccaaacacatcgcgattcatgtagtacccagactgtgggtttgtaagcacctcctccatgtactcagctatgctgatcggcccactccggaactttatgatgctcttaaggtgcttgacaaggttagagtccgacgacggctcgtgagagtgctctggggggctgtatagaccggcgcggtccacagaaatgctgagcctggcgccggaatcgcttgatgatccctgctcgtgcccatcctccgcctcatcgtcgtgggcnccgacggaggacggtagcggcggggacgtcggcgtggacgagaagcgcgcgaggaaggaggaggaggaggatatgtaaggagggagggtccgacgcgtggatgggccggctcccccactgcagccggtgaggcgaggggccaggcggcggagcagagcgncggctgggctccgaagcatctcgncggcgagacagagggagtagctgaagtgctggtgggttgggccggagagggggtaggacgacgacgggtttcc

SEQ ID NO: 9501 - DNA, 1044 bp, Triticum aestivum
  Clone ID: PAT_TA_9501
cgtccgcggacgcgcgggtctcggcgggcgtttactctccggcgacgccaacctcccgtctccggcgaccggctgccgccccgccctccctctcaaccggctcggcggtgctctatagcctgcaatgtctaagaagaggggcctttccttggaggagaagcgggagcaaatgcttcaaatattttacgagagtcaagacttctatctgcttaaagagcttgagaagatgggtcctaaaaaaggagtgatcagccagtctgttaaggatgttgtgcaaagcctggtggatgatgatcttgtcttgagagacaaaataggaacttctgtgtacttttggagtcttcccagttgtgccggaaatcagctgaggactacctacaataagctggagtctgatctttcaaactctaaaaaacgttacatggagcttcttgagcagagagacgacttgaaaagaggcagggaagacactgatgagagagaagacgctttggaggagctgaaggctgtagagctacgccataagaagttaaaggaagaactagctgcctatgctgatagtgatccatctgcactagaggcgatgaaggatgctactgaggttgcccattcggcagctaacagatggacagacaacatcttcactttgcaacaatggtgttcaactacattcccgcaagcaaaagaacagcttgaacacatgtacagggaggtgggcataactgaagactttgagtatctgcagtaatgctcaacagcctgcatatgccctattgcaatcatcgtatgcaatctccctcagcacgtggtgttggatctaaagtagttcaccaaaaattggtgagaatcacccgtaccgtcggctatttaacttttgagcagatgatgccattatcgcacatgctctgttatgtaaaagtcagatgccttgcctataattgtcgtcaggagaaaatgttgtacgataaaacggtgctacaagatgaatttggcacatgcatttaagagattagcaatcaaaaaaaaaaaaaaaaaaggccccta

SEQ ID NO: 9502 - DNA, 720 bp, Triticum aestivum
  Clone ID: PAT_TA_9502
ctgaagcaaagaaagtacaggagttctggtgccagattgttcacacaacatatccttgccacttctacaggtgtggagagtttgggttcggaagttagtgggtgggagcggaggaaggaaaggggagaaagatgtgctttcctcgttgcaatgcacgggcaattaactatattgctaataagtgaagcgacaaccaagtttccaagtttatgtcagactacaagagaagggggtttagtattttcttgatggcacatgttggaaggtctgcaggaggtgcctttgaggacttgctcgtccgttcggtaccatcgtctttccaagagcccacatttctgcatgtatatatttgttgtacagcctatgctggtttgcctgcaataataattatcaaaagggaatatgcagcagccgaattctctcgacgttcatttttgtcatgtgcttaagcaaaccgtgcgtgccatattcctcaaaaggtgaagaggacaggaagacacatgtgctaaagcaaaaaaataaatagaaaagcagtatattaggaatctaccccttagcttaatttacaagttgtgtgagtgctcatatattggtattattctcaggatagcaagaaacctatttttttattctgctagaattgagtaaccagctttaaaatttgtaactataaccaaattacgtatgtgttcctattaaaaaaagagagcaatgcatgtc

SEQ ID NO: 9503 - DNA, 963 bp, Triticum aestivum
  Clone ID: PAT_TA_9503
gttatcagtgttcggccttcaatgatttcggtgcggcgggccgcggccggcgcccttaaggcctcccccctccgggcggtgcccccttctttccacgcgtgcatagtcccgcgcaccgccacttgcggagctccttctgctggtgggcctgcgcgaatccgtgccaatgactacatctatgctcgcactgttgccagcgtgccgcattcgtccagtccgctgctgccccgcgagcgcctcatcgcccccgtgcgcaggctatcaagcaagctcggagaggtggcatctcagctgaagaggagcgcagtctggggtggcgcgcgcgggcggcgatctcgacccgatgccacaccaacaagacaggtgtttttagggttagttctggctgaaaccctgctggcagtaatatgcagagagggtttgcccgacttaaagttctacgacagcaagcggttttttcttgatgaaaatgatagctaccacttgatgagatttagcaatacaagcatttcctctaattttatttgtaggtctgcaggaggtgcctttgagaacttgatcagctacttgagcttcattgtcagcgaagtctccactgggttgcccagatctgtcctgaattgcttcattgatgacaatttggagaaggctccgctgacacttacaaaggatgttttcctttgttggaaagacgaggatacgctggagatagacatggggtggtaagaaaatgatgagttactgatgatattatgcttgctggtctaaacctacatgtattatgtcagtttgttgttaagagtatcttgaaaatataaagccactggatggccaggcattctatactatcgtctttccaagagcccacatttctgcatgtatatatttgttgtacagcctatgctgatttgcctacaataattatcagaaggtaatatgcagcagcccgcggccgcgaattcg

SEQ ID NO: 9504 - DNA, 630 bp, Triticum aestivum
  unsure (1)..(630): unsure at all n locations
  Clone ID: PAT_TA_9504
gagagaggagaggaggccgaagagggatgcctggacctggagatggacttgaccaccggggcgccaccaacgcctcctccccctcccctccgcctaaatggcgcgtccgcctccaaatctcgcctcctccccttcattattcctccaccctcgccccctccccatcccccaccccgttcccgctcaaaaccctaaccctagcggcgcccctcgccatggccgccgactaccgcacacccgacaggctcctccccgccgccgccgccgaggggccagcccaggacccgcccaaaccggccctcgccgtcgcggggccggccgccgccgcgacccacgacggcctgcgcttctggcagtacatgctcgccggctccgtcgccggcgtcgtcgagcacacggccatgttcccggtcgacaccctcaagacgcacatgcaggccgcctcgccgccctgccgcccgaccctctcgctgggggccgcgctgcgggccgccgtcaccggggagggcggcgcgctcgcgctctaccgcggtctccccgccatggcnctcggtgccggccccgcccacgccgtctacttctccgtctacgagttcgccaagtcgngcctctcggaccggttcggcccct

SEQ ID NO: 9505 - DNA, 1054 bp, Triticum aestivum
  Clone ID: PAT_TA_9505
taaaattgtatagacacaggagtgtaaatcttagtaattccaactcctcaatcaaataaaaaagaaaaagcaaaaacaaaacttttctttcacttctttttcctggctctttcttcctccaacccaaaacttgagcatagggcctacatattaaggcaattagggaatagcaacttcattacactacaacgtactgcggaaacaaaactacctagtcctaagcagcaccaacacatacgataggtagatagtaccagccaatagatttggctttgatactaccaaaaccacctaattctccccacagttctccgtaactattctgaaaagctagcacaacttctgctagttttagaagtagttgagcttgctcttcaatgtcatctttgctcttcaaagcagccaagtcttcttccaaactatcaggaaaataaccaacaatcataacagaatggcctctaaacttgcccttgcgatgcagatgcggtagtgccctttcttcctgaaactcatatacaccaactccattcatggatttccagttatctgatattgggaagctcgctgcaagagctttcccctgatccagtagcagcatgacttcgtgaatatctttgcgacggaattttctataagcatgaatcttgaaacgttcttcagactttttctcactagccatgtcgacaccacgaacacccacttccttcaaaacttccatgcaattctccaggcttcctcctgaaccatttgcgcctaacactttcccagtgtgagaggtgtacaccttaaaatccgacaacgagagacaataattaaactcttctggaggactcttggcattatagttgactttgtaatgtgtctccgtagtgaccatcgaggcttcgaacacacaagtccttcttgcgccctgtttacggacaggagctagaaacctcttacgcaagccaatccaaggtactgctgcatcttgattaggtgcatttccaccttcattgatttcagcttcaagttccttggctgcatttgttaaagaagcagaaagaacctgtga

SEQ ID NO: 9506 - DNA, 949 bp, Triticum aestivum
  unsure (1)..(949): unsure at all n locations
  Clone ID: PAT_TA_9506
cgcttggtgttgtgccacaggatacggtacttttcacgtccgcccacgcgcctaaccacgcgtccgggcggttatcagcaactgatgaagaggtttatgatgctgctcgacgtgcttctatccatgatacaattatgaactttcctgacaagtatgacacagtcgtgggagagcgtggattgaagttaagtggtggtgagaaacaacgagtgtcaattgctcgtgtattcttgaaggagccttccattctattatgtgatgaagctacaagcgcactcgatagcactactgaagcatcgattttgaattctctgatgtccttgtccgtcgatcgaacctcaatttttattgctcatcgactcacaactgcaatgctatgcgacgagatcatcgtcttggagaatggaacattagtggaacaaggaccacatgatcttcttctgtcgaagcgcggggcgttatgccgaactttggtcccagcagaatacaactgaagccagttgatgcttctgcttttggtacataagtttgatacacccaatacgttttccctttgcatgggaaaacaatacacagccatacttcaacggaagcaggtttttatttgtctgccttgtaaatggagttcttgagatttcaggtacaggggaaacagaaatttacagttgagggggaaattctccatttcatagagccgagaggcgaaattttcctgtacagatatctaacaatactggcgtatgtccatatgtcgatgtaataattcttttactacatggaataagtaaataatttctgctgttttttgtcgctggctggctggctgcttaatgtagtattcacatattcagttatttccagttaantaaaaaaaaaaaaaaaaaaaaaaaaaaaaaaaaaaaaaactcgagggggggcccggtacccaattcgccctatagtgagtcgt

SEQ ID NO: 9507 - DNA, 2909 bp, Triticum aestivum
  unsure (1)..(2909): unsure at all n locations
  Clone ID: PAT_TA_9507
cggcacctggcccctccccccgccggcgccgccggccccgcgcctccccctcccgccgcccgcgccccccgctgcccgacgcgccggcggcacccctccccagaccccgcccgcaccgccacgggcgcccgccccatcccctgcggcctatgacattcgccccccgctagttgcccggggttggcgcccccgcctcggccgccccctccgcctcgggcgccgcctccgtcccgcacccctgcctcgtcctcgccggcggcaaggaaggagggttcctggagctggaggagatcgacggggccgacttcgggatcttcgggagcttcgtggaagacgtgggagcaagtgagaagaaagcgtggaatgaccagaagaagaagaagaagataaagaaacgcaagcgaggggatgccaagcgcttggatggcgatgtgggcggcgatggtgatggtgatggcgattgtgcaggcgattcggtagctgagagcgaggaggggggtgagaagggtgagaagaagagaaagaggaagaagaggaacaagaggaagggcagggggagggctaatgagtcagactgcatggtggacgttgctctggacgaggtggcaggtgtgcttgtgggcttggttgtctcggggctaggcttcgtagaggtgcggctgctgcgtcagcaggccccttctgcgccgcgagtcctttcgtggctgccccccctcgccgaggctttgctcaggcttggggtctgtggaccatctccgttgcaggaggcgtgcctgccgccaggggctccccgtggcgcggttgttgttggagcagctgagacaggttctggcaagacacttgcttttggtctccctattttgcagcgccttcttgaagaacgagagaagaccacaagattacatgtagaagatgaaaaagcggcggagggaagttctacaggaggcccactcagagcacttattttgacacccaccagagaacttgccaaacaggtctgtgatcatctaaaagaagcagctcagttcttaggaattcatgttgttcctattgttggtggtttatccatggaaaagcaagaacgacttttgaaaaagaaacctgaaattgttgttggaactccaggaagattatgggagctaatgtcatcaggcaatcagcacttagttgagcttcattcattgtcattcttcgtgttggacgaggctgatagaatgatagagcgtggtcattttaaagaagtgcaatctataattgagatgcttccattatccaatagttctgatgagcaaactgtaaaagccacgtcaagctgtgaaactgtagcaaatttgcaaataaagaagaggcaaacctttgtcttctcggcaacgcttgcgctttcagctaattttcgtaagaagttgaagcgtgggctttctacttcaaagacagcgacggctgatgatcttagttctattgaagcactttcaaagcaggctggtatgaaacctaatgcagaaatagttgatttgacaaatgcttcgatcttgcctgagaaacttgaagaatcattcatcgagtgtagtgatgatgataaggatgccaacctttattatatattgagtgttcatgggcaaggccgcacgatagtattttgcacatcgatttccgcactgcgccacatttcttccttattacgcactcttggaataaatgtcttgacaaatcatgctcaaatgcaacaaagggctcgcatgaaggctgtggatcgtttccgtgaaggtgagaactccgttttggtcgcgactgatggttttgcaaggggcatggactttgataatgttcgaactgttatccattatcaactgccacactcaagtgatgtttatatccacaggagtggaaggacagcgcgtaaatcattgactggctgcagtattgcattaatctcccctgccgacaaagccaagttttactctctttgcaagtcattttcaaaggagaacctgcagcagtttcctgttgatcaaggcctacatgcctgcaataatgaataggctctcccttgctccggcagattgacaagatatcaagtaaaagttcaaaggaaaatgctaacaaatcctggcttcagaaggaatgctgaatccatgggtttgatattggaggctagtgacagcgaggaagaacgtgtacggggccacaagcaacgaaaggcgacttcggcacagctccagaaacttcagcaggatttgaatgaactcttgcaacatcccttgcagcctaagacattctcacgccgctatttggctggggctggtatttcaccattgcttcaaaagcaactagaagagttgtccaaaaggaatgtaaacagtaatagcagtaatgacaataataaaggatcgcggtttgttattattggccaggatcgtgtggaaccattgcaagctcttcaagattctgggcaagagatttgtgtgaacatggacaagcaaaaggagaagagaagacttgctgagaactggaggcgaaagaaacacgaagagaagaaaagcacacgggaacaaaagagaaaggacaggagaagtgctaaagagagggactgaataataaatgaaatactgaaagaggagccatgtgctgttttgagattgtttgtnctcgggggcttgggatgggtaaatgtgccgggctgcttcatcatcaggccacttcagttccacgattcctttcgagaatgcatgccttcgctgatgattttgtcacgacagatgattgaagaatatgtcagttggaggaaacgagatcagaggccatgtattnccgtgttttgcagttgaaggtaagttagaactgagccctagcagagaatgaacgccgtacaattgactcctctnctgtaacatgtgtacgttatcacagtt

SEQ ID NO: 9508 - DNA, 655 bp, Triticum aestivum
  unsure (1)..(655): unsure at all n locations
  Clone ID: PAT_TA_9508
nccccacatacattgctaataattccctttcccatgaaaaaggtatacatgagcaaagcaatagcatatacattcctaccttataatcttgactatgtttttggagcttgacatcatgacatggtacagacaaagcatgatctatatatgttttattggagaaaatggcagcaccacttttacctactgctgctgcctcctccttgttcttcttgtggttgtggactccgaaggtctggacctcctactttgggctgcctgtcccactataacagccagggtgctagaagtcgatgcctgctccatggatgacgactgctgagtaactgcgggtgcagcattaacggaattagaagacggcaatcggacctgattgccactctcaggggccgcgttgcttgcacgcagcattattggggagggtgaaacaagactgtgtctttgctgtccccgtgccctagcccgcgcccgggctgcgggaagtacagtcacctcaaccccgcctgcaggtggagctgcctggcctctcactatatcctggttttctatcaaccgtctcaccatgcttgcaatgcctcttgggtctggcatttgcagttgctgcctcaagctctcactcctgtttgcgcgtggtctgggaggaacatcattgctg

SEQ ID NO: 9509 - DNA, 722 bp, Triticum aestivum
  unsure (1)..(722): unsure at all n locations
  Clone ID: PAT_TA_9509
aacctttttattntttggtgtggaccgatgagatgatttaggcagagttacatttgcaagtgcccaccaaattaactacattgacataattgcttgtacaaattactctggaatctgcgttccaggttttgagggatgcaatctaataaccctggtaaagatcatacttgctagcatgcattacttttccattctttctgaagaatcaagaacttattgatcaacttatacatccttgagaactgaactcttgtagcaagactgaaaaatcctaagctatttttttttccatatccagctgcttttgtaggtacacttagtcgccaatgggtggataggttgtgtttgggagcctctgtccaagcacaaatgagcgaaataggccgagagctcggtctggctgtgcaaatggcaccatgtgagatgcgccccgcactgttgcaaaggtcagaagattaccgtactctgttgtccagcctccaacctggcctttgcggaaccaagtactgtacggaactgtgacaggcaaccccatgtcatgagctagctctcgcacaagggttcgggagcccaagaggggcaccacagagtcttgatcgccgctgaatatccaaagtggtatcttatgttccactattctccgaagtaaaggcaagatgttgatgttaccatccttatcggtgtaattcagcacatcactgcacatgccccagccataaggt

SEQ ID NO: 9510 - DNA, 750 bp, Triticum aestivum
  Clone ID: PAT_TA_9510
gttttttttttttttttttcatcaggaaattcacttaagattaacaggcagcgatgaacttcacctacccagcactctcaggttcaaaatgattcttaagtccacaagatacacggcgacctccctaggctattacaagaataacttgcatgcagggcacgctcaactcatttctcatgttcacattgctttcatcacatccaatgtgtcctctggctcatcatatccagtgaatacacttgcaaccatacagctcagcctcagacctcaccatgcaccttctgttattcttcccatttttcttgactgggatacgcgaagaacctgggcaatcccaaaagcacctccctccttgccagtttcccttgcgatcctgatatacccatcctcaccaataatctgccccgcgtgaatttttgacaagccaaaaaagctcaccaatctcggttatcccataacctacaacagtaacgtagtgcccaatatatgaacccctgaacttaattgtcgacagtccaccaagggtattcttcctgccacccacacccccacctgcgttctccgcactcgccttttcggcccctagggcaaccacctctggctcgggggcttcccccgccctcagttttttttcggtaccaccataggtaaaagcaaagccgtcaatagatactggcaggtgcaattactcttttgtggacagtgttcacttcagctgtgtatgggtagacatcattcaaaacttgccct

SEQ ID NO: 9511 - DNA, 731 bp, Triticum aestivum
  Clone ID: PAT_TA_9511
cgtgcgtctctttcaggacaatcgggtatcattctcctctgcaaggagaagctagatgtgttgcttatcatttgttgagtagcaagttgatggattatcaagagaatgtagctttcatttgaaaaatagagatgtatgattcatcagcgaaaaaaaaaaaaaaaaaaaaaaaaaagggggtacatgctcactgcttggcgggccgaaatgtccggtcaccggcaagaagatccaggggatacctcatctaaggcctactgagtacaaaagatccagattatccaggaacaggagaacagtgaaccgtccttatggtggtgttctatctggtcaggctgttagggagaggatcatccgtgctttccttgtcgaagagcaaaagattgtgaagaaggttttgaagatccagaagaccaaggagaagcagccatcaaagtgaaatggccgaggcctttttttggaggacagatggtgatgagtgttcagtcaagcctgcgcagtatgctaagcccgtggttactgaattaagctagagatttccgtccattttcttgttccgagggtggatctgggtctcgttacccgtatgctattactttgtgtttgacggtttgacctgagtacttggttatattacagttttggataccctttgcagtattgttcgtggatttctactgcaagctgcagtattttctggcaatatttgaagattcttgatgcagcgttgt

SEQ ID NO: 9512 - DNA, 957 bp, Triticum aestivum
  unsure (1)..(957): unsure at all n locations
  Clone ID: PAT_TA_9512
ttcggcacgcgggttttagccgccgccgccgccgccccagccccccgcagagagaagcgagcgacagcgaggtcgacgccatggtgcagcgcctgacgtaccggaagcggcacagctacgccaccaagtccaaccagaccagggtcgtcaaaaccccaggagggaggcttgtgtaccagtacaccaagaaaagggcgagcgggcccaaatgtccggtcacaggcaagaagatccaggggatacctcatctaaggcctactgagtacaaaagatccagattatccaggaacaggagaacagtgaaccgtccttatggtggtgttctatctggtcaggctgttagggagaggatcatccgtgctttccttgtcgaagagcaaaagattgtgaagaaggttttgaagatccagaagaccaaggagaagcagccatcaaagtgaaatggcccgaggcttttttttggaggacagatggtgatgagtgttcagtcaagcctgcgccgtatgctaagcctgtggttactgaattaagctagagattttccgtccattttcttgttccagaagggtggatctggatctcattacccgtatgctattactttgtgtttgacggtttgacctgagtacttggttatattacagttttggttaccctttaaagtatagtatgttgtggtctcatttgaagattcttgatgcagcgttaatgctcaagaaatatgaagaaaaaaaatcccgacctggtaatcctggccttcccccctancnccttgttgacaaccccttctgcntnnttnanntannagnnnnnnnnngggnggncccntnccnatnnncccntnngtncnntttnanttnnntgggnnnnntttnaaatnnnnnnntgggnaaaacccttnnnnnncccnntnaatnnctttncnnnatnnnnntttttnnnnnnggcnaannnnnt

SEQ ID NO: 9513 - DNA, 1942 bp, Triticum aestivum
  Clone ID: PAT_TA_9513
cgtccgcccacgcgttcgaccacgcgttcgcggactcgtgggccgaggcctaaatacagcaagcggccgacgcatcgccagtgaaccccacaccaccaccgtctcttcatcagttctcacttctaaccgcgcgtttctgttatgcccccgctccacgccaggcaaaccgaatcccccaccacacgacgccgcccaccctcccctcccctcctctggaatcgggcgggggaagaagtagtattcaggcctggccggtggcggcatggaccgcatcgtcggccgcaagttcaagctcggccggaagatcggctccggctccttcggggtcatctacctcgccacggatatggacacctacgagatcgtcgcggtgaagattgaaagtagcaactcgaagcatccccagctgttttatgaggcaaagatctacaacgccctgcaaggaggaagtggcattgcgaatgttaaatggtgtggtgtggatggggaggaaaatgttcttatcattgatctgttgggcccgagcttagaggatttgtttgtctactgcggcagaaaattcaccttgaagactgtcctaatgcttgcagaccaaatgcttacgaggatagaatttatgcattccaaaggatacttgcatagagacataaaacctgacaattttctaatgggtctcggccggaaggcaaatcaggtctatgtaattgattttgggcttgcaaaaagataccgtgattctactacgaatcgacatattccttacagggaacataagaacttaactggcactgcacgttatgcaagtagcaacactcaccttggaattgagcaaagtcgacgggatgatttggaatctcttggctatgttcgcctatattttctccgaggaagtcttccctggcagggactaaaagctgcaacgaaaaagcagaagtatgagaagatatgtgagaaaaagattccgacacctatcgaggtgttatgcaaatcctgtccggtagaatttgcatcttacttccactactgcatgtcgttgacatttgatcagcggcctgattatggattcgtgaagcgcctttttcgagactcattcgacgcaacaggttatgattttgattatgtctttgactggactgttttgaaatataaacaaggccaaaagacccagcatgttcctggggcaactattactcgagcaatcccaacacatcttgacaaacgagcgggtgtaaatggggatgtccatccaaatgaagcccatgaacagatggagtcaagccatatgaccgggtcagctgcacagttacagaggcaaaatatggctgccagtgccagaaatgaaaacccgaagaatgatgggaattcaagacatatagtgcgtattgacgcttttcatcaaaatcagggttttgacagcaatactggctctcctagcgcttgttttccgacacttccgcacaatgccccagcaaggtgataggtcacctctcttgtggagctagaaatgtggaaatgctcaactagactccatttcttttagagtggtcagattcaagaatcacaaaatcaattcaaacatcttgatgcctaatgcatgttacaaagatggctacagatccgattgattatgcaaggtttgatcactgctgcgttggatgctccagcagtttctgtcactcttacttcagacattttgttgtcacagttgcggaggacatgtaagtagttcatatgtcagataaatggcatggacattatgcaatagtgatgatgttgggtgtacatagttcatatggttagataaatggcatggaccttgagccatagtgatgttgtcgggtcattcagcatctggtaactatcccatagacatgtggtgataaggttattcatgaaatttgcatcctgatctgatatttttagcaaaaaaaaaaaaaaaaaa

SEQ ID NO: 9514 - DNA, 717 bp, Triticum aestivum
  unsure (1)..(717): unsure at all n locations
  Clone ID: PAT_TA_9514
ttttttttttttttttttcctcggcaaattgacgggctaactttgtactgttgtgaaccatggtcctcaaaataatactcacaccacagatgtatctcgcttgcaaggaaaccgcccgtaacagccatcacaatgatgggcaacatgcccccacccaatctcctataaattatgtagcaatatatacatttaccaatgggaacagttagcaacaccaggaggtcagtaattagagcactaaaatttctacactacctacacgagattgacaaatctctgctctatcctagtttacaaaactagctttgccttctaaatactgaaggtggtaatgctcctcactcccatttcctatcaagttttgaaatgctcctcaatagttgttgagagcagacagtctgtgcctgagctacatactttacccgatttgctctcacccatgcaggctcctcagggacaaagtgcgagaagccaaacttgactaagaggagagcatgctccattataaggattgccgcgagtcctggctcaatccgccatttaccctcctcgtcgtatagacaaacaagaagcaagcagttggtgcagattgccattacgatcaggaccgggagtctgctcctccacgctccgctcgcggctgcggctccgcgtgccggcctctccagcatcgcctactactgctgtccagcccctccagatacatggaagncagca

SEQ ID NO: 9515 - DNA, 684 bp, Triticum aestivum
  Clone ID: PAT_TA_9515
ccgctcgcttccttctcctccccccgcacccgccgcatcttctctcgcgccatggagtcctcctccaccaccgccgccgccgcgctgcacgcaggtggcgtggcggagcgggagtacgaggaggtgctgggccgcctctcgtcgctcatcacgcagaaggtgcgcgcggacaccggcaaccgcggcaaccagtgggacctcatgggccgctacctccagattctggagctggaggagcccatcgcgcggatgaaggtcatccatgtcgccggcaccaaaggaaagggtcgtccgtgcacattcacggagtcaatcctgcgatcctgtggcttccgtaccgggctattcacctcaccgcatttgatggatgtccgggagcggttccggctagatggggtggatatttctgaagagaagtttttgaagtacttctggtgctgctggaataaactgaaggagaagactgatgatgatattcccatgccagcgtatttcaggttcatggccttgctcgcattcaagatcttttctgctgagcaggtagatgtagctcttctcgaggttggtcttggagggaagttcgatgcaactaatgtgggtaaatctcctgtagtctggggaatatcctctcttgggtttgatcatattggaattcttgggaatacgcttggtgaaattgctggg

SEQ ID NO: 9516 - DNA, 710 bp, Triticum aestivum
  Clone ID: PAT_TA_9516
tttttttttttttttttttttttttttttttcaaactgctaatatttcggatttcttctcgattcattcacatggtaaaaaatcgggaaaccactctctttctctctctgtacttacgtgaagccttacaaaaccacctaacaaacacttcaccgtttgctcatgtaagcagaactcaagtcagtgctaaatttcagccccggacaagaaacctcccaggttaaatctgacaaacatcctattaattccccttcatcatggaacggtgattcagttcagattgcactgcatagctccaagattactaggaagacttcaagtaccaggaaacagccgtagcttcagaagcaacgtatggaagaaggctaaccgtcaactgatagaatgtggtcttcagtttcctccttaagacattccacgggtaacctaaaacttaagcaaaacatagccttgttaggtgcaacatcacgaaccctatggaatattggttctgctatcttggcattcagtttgttttgtgcttcacataatatcaattcttcagattcactcgaacggatgaaacaataacagtggatccaaggtaatgaccctttccagtatctcttttgaacaagaccatcaaaacaatcgagaaactgcagtgcggaagcagggagattcattattacatggtcaatgtgctcccaaggcctggcaggtagtggccc

SEQ ID NO: 9517 - DNA, 1530 bp, Triticum aestivum
  Clone ID: PAT_TA_9517
gtggcgcgacgcgtgccactcgtccgtccacccgctgtcgagtatccgggcgaaggaagcaagtgcaagtcactctttcccttcccaaatccacccacccgcgtctcctcccgttgccgcacgagcaagagaatgggcagcgtcgacgcctccgagacgacggtcaccgggtgggccgccagggacgccaccggccacctctccccctacacatacactctcaggaaaacaggccctgaagatgtggtgttgaaggttaagtactgcggcatctgccacactgacatccaccaggtcaagaacgacctcggtgcttccaagtaccccatggtcccagggcatgaggtggttggcgaggtggtggaggtcgggccggaggtgagcaagttccgcgccggcgacgtggtcggagtgggcgtgatcgtggggtgctgccgcgactgccggccgtgcaaggccaacgtcgagcagtactgcaacaagaagatctggtcgtacaacgacgtctacaccgacggcaagccgacgcagggcggcttcgcctccgccatggtcgtcgatcagaagttcgtggtgaagatcccggccgggctggcgccggagcaggcggcgccgctgctgtgcgcgggcgtgacggtgtacagcccgctgaagcacttcgggctcatgacccccggcctccgcggcggcatcctgggcctgggcggcgtgggccacatgggcgtgaaggtggccaagtccatgggccaccacgtgacggtgatcagctcgtccaacaagaagcgggccgaggccatggacgacctgggcgccgacgcgtacctcgtcagctccgacgccgaccagatggccgccgccgccgactcgctggactacatcatcgacacggtgcccgcgaagcacccgctggagccctacctggcgctgctcaagatggacggcaagctggtgctgatgggcgtgatcgcggagccgctcagcttcgtgtcccccatggtgatgctggggaggaagaccatcacggggagcttcatcgggagcatggacgagacggaggaggtgctccagttctgcgtcgacaaagggctcacctcgcagatcgaggtcgtcaagatggactacgtcaaccaggcgttcgagaggctcgagcgcaacgacgtccgctaccgcttcgtcttcgatgtcggttggagcaacatcgaggacgccgcctgatcgatgacggccgggaaaaagagagagctagaccgagcggcgagtgcaatgacagtatcatgtgtgcccgtgccatttgcctgtacttgatgcagtacatgttcgtgacctgtttccgttttctatcagagttgcgcgcgttcgtttcggtggagatgcatgttttgctgttaatccggccttaaggactatgatatatgtatggagttatctctactcttaatgtctgagttggttgaatagtacggtttattttaaaaaaaaaaaattcctccgctctcctcggccgcgaccacgttaatcactagtgaattc

SEQ ID NO: 9518 - DNA, 753 bp, Triticum aestivum
  Clone ID: PAT_TA_9518
tataatgaagtgcttgttagcatgattatcattaacaaggctaaaaaatgtgccattgcattttcatgcaaatgcatcaccaggtacagcaggttcagtttggagtggcaggtcggtacaacatattgcataccaaaatgtaggagaaagggtgggcaggaacttataattagcccacggtgacaaaccggccatctttcttcctcctggcgacatggacggtcatcgttgtcatcttccttgcgcctttgatcagctcaaagacgcagacgtcgccctcgcgcagcccattgtccggcgacaaaccggccatctttcttcctcctggcaacatggacggtcatcgttgtcatcttccttgcgcctttgatcagctcaaagacgcagacgtcgccctcgcgcagcccattgtccctcacaaacttgacccaacgttggcagttgaagcatctggtcctgctggaatagtagcacctgacatgccacttgtcttctctgctcagcctaagcagcaggacctcacgcggcttgctctgaagatgatcagctgcaaatttactggggatggtcagaaagttgttcttgcgttggagatgggtcatcagcagaaccaccacgaatgcgggattccccggtcggatggaagcacgctccatgatttcctgtttttcatcctcatttagctgacttgcagtcctcgaagagtagtaaccgggctcagtgcatgtgtcatcatcactcttctgttcctca

SEQ ID NO: 9519 - DNA, 1686 bp, Triticum aestivum
  unsure (1)..(1686): unsure at all n locations
  Clone ID: PAT_TA_9519
agtcgcccccacccccgccctcgcctacttcgccccctctaccccagcccccgccgcagagaaacgcaaccccaagagaagcgcaactccccgcgaccgccgccaccaccccgccgtcgccccccagcccgcccgcaggtagccggatccaagccggacccgaggggacaggaagaggcggccaagatgccgacggtgacctgccacgcctgcaacgcggcgttcgaggaggaggaggagcagctccaccactagcgcgcagagtgacagcgccaccacctaaagcgcaagggggcgggagttctggaagttaccgaaggcgttctttattgcaagccaaactttttaccacaggggggcgactctctctaaccgttgctcctccgatgacttccacgcctgtagttgttaagtggaaaactggtgtacacgatcgtagaaccccatgtccaacacaagaacacgcagtcgcatctcttgataggttttcaggggcccaatgggtttagtagtgcagccgacaaaccacttgcttaccgagaaccttcgtagagcccccgctgcaatggaagaagatgaagttgaggatgaggaggagtaggaagagtaggtttgaattagacccaagttagcgggagtctaccttaaacattcaagatgataaggactctaaatcaaatgatgatatggctgatattgtaaatttggatccctcggactgcttcatgtgtgatctcaagcatgacaacatagaggactgcatgatccatatgcacaaaaagcatggtttcttcatacctgacagtgaatacttgaaagatcccaatggccttcttatatatgttggactgaaggtgaagcgcgattttatgtgcctctactgcaatgacagatgccagcctttccaaagtcttgaggctgtcaggaagcatatggatgcaaaaggtcactgcaaattgcgttatggagatggtggnnggaggatgaagatgctgaccttgaggatttctacgattacagcagcagctatgttgatgtggagggtaagcagctggttgctgctggtgacatggacaacagcattgaactgggaggtggtggatccgagctcgtgatcacaagcaagagcgagaaggggagacgcgtgacgactcttggttcccgagagttcattcgctactaccgccagaagccacggccttccgttgcagcagaccgtgctcttgcactttccctggcttccagctacaagagcatgggtttggtgacggtccagtccaaggagcagatggtgaggctgaaggtgctccgagcgatgaacaagagcggggtggagacgatgaggaccaagatcgggatgaagagcaacgtgatccgcaacctgcccaagaacgtcccgtactagtcgcgacgcccgctcttcctgtaggagcagcaatcagtccgtggagctccagcactacttactgccctcgcagccattggtgtgtttcgtcgacgatatctattctagaataacggtgcgtcctttgtcgaaatttttgtgcggctgctggtatcgacagtcctatttacaccgttcagcccagttgaacctatgactagtctcgcggcgatgggtgtatgcagcgtatgacttacttgtcgagaaaatgatatatggccttgttggattcaaaaaaaaaa

SEQ ID NO: 9520 - DNA, 686 bp, Triticum aestivum
  Clone ID: PAT_TA_9520
tctgtaatagtttggggctggcttgtctgtatgggggctggaatgtcctgaatgaggagtacaaaccgccacgctacaaaaatgtacaaggtgtcaagctgcaactggggcagaatcttcttaacaaccaaggatgtcacaaaaaagatggccccgatgcaagcacctgtacatgtaggtaatacatacatgctacaaaagaagaaggatacgatctaccaccgtggatttgatcaaaattctcaccaatactagttctctccctgttcgacaaataatggaacacaatagctactactgcgacgaacacaactttgagtagtagctttgacctcggcagagatgcaggagacgtggattctgattctgacggatcaaccttctgcccccttagcttagctatcaataggggaatgagacctcgtctcttatctgctttcttcaatcccctctcttcctcgccaattcttcgtctcaaagcattaagtagtgagccaaaataaagagctaagacagtgcaagtgaaggtgataacaccgcggccccggccacgctcaggagttgtcaatggaacaagcaacacttctgtgtacgacttcacaacaccatcttccttgaagttctctagcaaaggcgatacaaacaatggatcagcttcagggtaacttcggctagagttgaactca

SEQ ID NO: 9521 - DNA, 596 bp, Triticum aestivum
  Clone ID: PAT_TA_9521
aacggctcctcctcggtcttcccctcggcacctccacaggtgtcttcccttgtggctggggccttgtcatcagcctggttcgcccggcgttcgcgcgctccattctgcgtgcatgcccctgtggcggggggctggccggcctcctcctgctgcaggctccccccgcgccgccccgtgtacctttgccacctcatctgttcaatataatactcctcccatactgaacattgaagaccgcaatatcaatgagatctctgtcggggtcaaacacttaaaggtacttttgttgtcgttgctaatttatgaatatcaatatcaacaatggacctagttgggcagatgcaggagtaactgtactatgaaccttgtttgaaataattgtgcaattaatttcccacgaagataattgaacgtttcttgtgttgaggaaagaatagtccacatggaccaagcacagctgcaatgggttgtcagtcgcacacatgctgataagcttccgttgtgtcctaatctaagcagcaggctaatcacctgatgatctgaaaagatgacatgaatgttcagagcttgcatgtgcaattctaccagtgtcttca

SEQ ID NO: 9522 - DNA, 605 bp, Triticum aestivum
  unsure (1)..(605): unsure at all n locations
  Clone ID: PAT_TA_9522
cgtggaaaaggtcgtcaccgtgagcagcggaaacagcggcgacgccgcatttagccgtcaggccggcgacacagtgccgggatacttcaacaaaaccgtcagaacatcgggcagcatcactacttcaatccagcctggttgaagttcactgtcacttcatcttgcagtacaaacacatccccaatcagaggcagctctttgtccggtttagctggacattatggttgatgaagcagcagtacatcaggtgtccccgttgttggctccgctctccgaggaggaagctcggcgctagttctttgatttcactgaccattttttagcattatgaggagcgagttaatgtcggcaaaatgtttagtgaataggtggagcacagattggagttgtgcttgtgctgctagatgtacagacggtcgccttctactctcctcaatttcaggagttgtgctgctggatgtgctcacggtgaccttgaaatatcctctcgccggcctctctgctagatgcggcgccaccgctgtcgtacgctaacagccagccttagtatcttagaagcttcagnttgctttgatgatgatgataacctgccagcagnttcttnn

SEQ ID NO: 9523 - DNA, 638 bp, Triticum aestivum
  Clone ID: PAT_TA_9523
cgtccgcccacctgtccgggagaagcgccgctcgactcttggcaaccgctgacaagcggcgccggcgacggcgaggatctccgggagaaggacgccatattttcctttgatccgctgggccccattctgggacctgttgctctgttcttcaagcattctttttcctgtgactctccgagcgggctccggagcatcccttggcttggctgtgatctccaggtggtggaagcatgaggttgtggtctctccttcttctccttgtttgcttgcctacactgatcctgtcggaagattactccgacgtaaccgtcatcgtacggggctccaagacgatcgctgcgaccagtgatgagttcatttgcgctacccttgattggtggcctccggagaagtgcaactatgatcagtgcccatggggaaaggcttctatcttgaatatggacttgactaatccgttgctagctaaagttatccaggcttttagcccactacgcatcagagtcggaggctccttacaagatcaagtggtatatgaaacaccaaatttaggatctccatgcagaccatttacaaaggcttcaagtggcttgttcggattttctaaaggatgcataaccatggaaaggatgggatgcatg

SEQ ID NO: 9524 - DNA, 2003 bp, Triticum aestivum
  Clone ID: PAT_TA_9524
ctctcctggctgcctctgacaaacggcgccggcgacggcgaggatctccgggcgaaggaagccatattttcctttgatccgctgggccccattctggtcgcagagacctgtcacttcttcgagcattagtttttttcctgtgactctccgagcgggctccggagcatcccttggcttggctgtgatctccaggtggtgaaagcatgaggttgtggtctctccttcttcttcttgtttgcttgcctacgctgatcctgtcggaagattactccgatgtaaccgtcatcgtacggggctccaagacgatcgctgcgaccagtgatgagtttatttgggctacccttgattggtggcctccggagaagtgcaactatgatcagtgcccatggggaaaggcttctatcttgaatatggacttgactaatccgttgctagctaaagctatccaggcttttagacctctacgcatcagagccggcgactccttacaagatcaagtggtatatgaaacaccaagattatgacatccatgcaaaccatttgctacggctttatgcggcttctttgaattttctaagttatgcataaccatggaaagatgggatgcaatgaatgatctgttcctcaatacaggtgcagttattacttttggtcttaatgcacttcgagggcgaaagcagatacgtaaaggtgtttggggaggtgcttggaattcaagcaatgctcaggagtttatggaatatactgtttcaatgaactatcctattgattcatgggaatttggtaatgaactgagtggaagtggaatcggtgcaagcgtgggagctgaacaatgcggaaaagacctggttgaacttcaaaagatcgtcaatcagttatatgaaaactctagcaaaccattggtgctagccccaggaggattctatgacaaacaatggtttgctaagctccttgacgtctctgggccaaatgttgtcagaggaatgactcaccatatttacaatcttggtgctggtaatgatccacatgtggccaatagaatcttggacccgcagcatttaagcagggtttcagacacattcagagatctccagctcacgatacaacgacatggaccatggtcggctccgtgggtcggggaagctggcggagcgtataacagcggcagccgtaccgtttccaatactttcctggatagcttctggtatcttgatcaacttggtcagtcagcaaagtatgacaccaaggtctactgcagacagactttaattggaggcaactatggcctcctcgacaccgatacttacgtgccgaaccctgattactacagtgccttgttgtggcatcgactaatggggaatggagttctttccatagacttcggcggtacttcatacttgcgtgcctatgcgcattgcggaaagcagaagggcggtatcgctctcctcttgatcaacctgagccaaaacatggggtccatggtcaccgtcaggaatgacctcaacgtcggcctagcgcaagggcaggggataacaagggacagctcctttgttcatggcctgaagaggacggtctcctgggtcgggagcaaagcctccgatgggctggagaagagggaagaataccacctgacggctcaagacgggaaccgttttgcgcgcaccatgctgctgaatggagttcctctggagctcactgaagatggtgacatccctccgatgtacccggtgcaagtttctgccagttcaccgatctatgtcgcgccgctgtccattgccttcgtcgtcttcccagattttgaggctgacgcttgctagcgatgaactgtagtttttagataggataccatgcgagtttttcagctacaacaatatagcgcttctcaactatacaaatactgaaaatggtttgtgttgatgtgttctgccccaattgggccacctatgttcaacaaattcacaataaagaaaagctcaaaaactttctcctgtatttatcaaaaa

SEQ ID NO: 9525 - DNA, 1495 bp, Triticum aestivum
  Clone ID: PAT_TA_9525
cgtgcgcggactcgtgggaagcgagcgcgtccgcagagacctagcccgcgtctccccgcgcctctccccgcgaccctcgttcctcctcccgccgccgccgccgccgcccacgatggacgaagtgagaggaaagagcctcgggagaccgtcgcctctcctcaccggccttctcccaggttcccgatctggagcctctcctcaccttctcctagatctggagcgggagggacggacgccggcgaggccagcctccccttcacacacggaggttgttgagattattgatcggtatgatcatgcatgtgtcccacctaacatgactgataataagcttgcgtacatccagaatgaggctatatccagagagtgcacaaggactctcacggttacaaaggatacgaagcagccaatttatgcctactaccaacttgacaacttttatcagaatcataggagttcatgccccggtcaaatctagagctatgcatgcctatgtcatctctcacagatcactgttcttttcattcctccaattgaaaccatggctgccagtattgagggtcaggattctgtactagacgtgatgagataaaatgaggtctgaattttttagccatgctttcttagctcatgaaggcaggagcatatgtgatttttctgtaccaccttcccgcggctctgaggattttgtctgctcgctgcctctccgctatttatttgttgtgtctactgcattgtttgttctgccacccttttcctcagttgctagcggggggccttggcttatcgtattgtttgttgccttcctctcataggttcgttggtattgtaaaccatttttgttgtagtaataactacaatgtcaaataaatttacatttcaccttgcttccactattattcaagtttttccctgcttattggtcgtactagcaagatggtttttgtttttttaccgtgtctaacatagtgtatttctacgatttttctctgttaaaacatatccacttccatgctcttttctctattttagtacacaatagtatggctgcatactaccaattgcagaaattattcatttgccactaaaatatatattttcctattcacaaattaaataacaacaaagatgaagttggtccccggatgcctaatatgttctttcatatcctggtcagtttaccagcgtaacagaattaatacttcttgttggttcaatagtcaataccagtgttgtgagaaaattccttacggtttgttgtattttggtagcttcttcttttgcaagtggcaaattactgttatgtatatgtggaatcctattaaatcttgtgcattggtttcagtcatacttttctaaatggaggtatagttcaagactgtgttgttcatttaaatcattccttctaccttccaggtgtggcgctggcaccccccatatttcgtctacttatacatgtattcaatgtttggcggctcgatccgctcctggatcg

SEQ ID NO: 9526 - DNA, 1803 bp, Triticum aestivum
  unsure (1)..(1803): unsure at all n locations
  Clone ID: PAT_TA_9526
cgacgactacaagnctcaagnangctggcacgggcgtcctcgtccaagnacggacaaggcccggnaaggacagccctcccccaccgcccagccggctgcgggcctcggcccggnctgacaggtctgccaccaagagcgcactcgacgagctgcgagccaagaggatgaggcagcaggatccggaggcgtaccgtagcaggttcaaggatctggttcccaagagtggcagctcgcctaatagacgcagggctggaacccccccgagcgatggtagcaatgatggcggtcacagggggaggatgaacaaccatgttgggattgctgaggataatcgggatgatgactttggcgaatcaccaagtagacttgaccctctcaagtttgatgatgtgaagagcataacccttcggaggtcaaagctggtgaagtggttcatggaacccttttttgaggaccttgtatctggttgctttgtgcggcttgggattggcaagacaaaatcaggcacccccaagtacaggctgtgcatagttagaaacgtggatgctaacgacccagatcggcagtacaaactggagagttacgaaacatgcaagtatctcaatgttgtatgggataatgaagctaatgctgctcggtggcagatgactcaggtctccgactctcctgtccttgaagaagagttcaaggagtggcttcaagaggctgaaaagaatggcgtacgcataccaacccggcaggaagtgctggagaagaaagaagccattatagaggcctacaattttgtgtattcagcagctactgtacagcggatgctgaaagagaaatcagctgtgagacgtcctatgaatgttgctgctgagaaggataggttgagggatcagttggagatggccctggtccggagggatgatgcagaagcagaaaggatccgtgcaaggctgaatcatctgcagaagattgctcagccaatgtcaactaatgagaaggcagcaaagttagaggagatgaacaggaagaaccgtgctgagaatttcaagaatgcatcagaaatgaaagctgttaatacaagtttgaaggctggagaggctggttatgatcctttctcaaggaggtggacaagatcgaggaactattatgcagcaaagccagaaggagaagcagaaaatgctgaagccgccaatggcaacagcgataatgtaatagctgtgacggaagctgtgaagggtggggtgcgagttggtacagcagtcacagcttcagctctagtagcagctgctgaagctgggaagctggttgataccaacgcacctttggatctcgggacagaaacgaatccgctacataattttgaacttcctatatcattggctgttctggagcagtatggtggacccaaaggtcagtttgaggcctacatggcgaggaagcagaagatagaagcaacgatgggttacaaaatccctgacaatgatggaaggaggcatgctctaactctgtctgtgagcgactacaaaaggcgacgtggtcttctttgaaggatatatctctgctcaatgtatctgtcctcttggcaacaagactttctgcccgctgtgacgaattgtccagaccagttgcataaatacatttcatggcacgagacaggcggattgtgcgtttattttcataaatatatagacctgtacgtctgaaagtgttgttgacatttcatggcgttttttggggcaaatacatttcatgtttgtatttgtggattgcatcagttcctttgaatcctatcagttgttgctcttgcttann

SEQ ID NO: 9527 - DNA, 725 bp, Triticum aestivum
  Clone ID: PAT_TA_9527
gcgcgaatccctctgtggttaccctcgtcggacggccgcgggctgcaccgtgtcacactcacagctcacgagtcagagaccgcaaaattaaaccgatgatgatacagcgaattcccacctactatatacagatatatcctgaagctaagagaacagtcgatgaagactcaacagaaaggttttctgtttgaactttcgcagcagacgacatagaacaacactgaggaaggcgatagctattgctgcttttgggcaggctccgcggtccagtaagttttgacggccacaaggatcttctcagggttgaacggcccggattcatgatccatgatctggctcttccatctcatgccattggtgatggcttgtatcttcactaacatctccacggtgtccctgaagatcaccgtcccttcaggccgcagaatccggtccatctccaggaggatgtatgttatgtcacacctgtcatgataaaagctgaacactttgttagcgtggatgaggtcatacgtcctgggatacgtcgagaaagcctcgcaccagtcatggaatgtcccgataaacccccgctcgtagataacaccgagggcatcaggagcagaacctgaaggcaccacattcatcacccagagcggatactccatcagcgcagcagcaaaaccccccatccctgcatccatgtccatcacgttcctgtatcgccccttggccagtggcgggat

SEQ ID NO: 9528 - DNA, 735 bp, Triticum aestivum
  unsure (1)..(735): unsure at all n locations
  Clone ID: PAT_TA_9528
gccccaggttgacaccattctccaacaacagaaatgatccatacagtacatatgtacatatgacacaacagcctcactctcttacatatcctaatcaatccagttctattaccggcccattgcaatatagtatgtacgtattatgcttctaccctacactacatgcacaaataacgaaatctgcacaagatcacaaacgaataatgatggccaatacacactactgtgtatggccgagcaatagcagcatgcagcacccaccgatccatatcatatattcacatctacatcaggctgttgtagttgtagtgctcctcctgcacctggagccctaggtccatcagctccccgccacactgatccccggcgccgtctctcaaacccgccgctgcgccgccgccctgaagttgctggctgaagtcgacgatgctgtcgtagctcagcagcggtggcatgcccgcgaaggggtccacgtcggtgagcgagacgccggccgcgccgtgggtatggtgatgatcacaggacgtgagctggtaagggtggccgcctgcgccgagggaggggaacagcgccgccggaggcgagtggtggtactgatccggatcgtggcaggacccgctcccggcggcggcgctgccgcccacggcagtagcgttgcgagtcatgccgccgatgatcacttgctcgccgtccatggcgtactncgtgtcggccttcttcttgtggaaaactctg

SEQ ID NO: 9529 - DNA, 1079 bp, Triticum aestivum
  Clone ID: PAT_TA_9529
cgtgcggccagtatcccctagtcaaagttttgttccatcttcagtagcgccatttgcaccacctgttggggtgatgcctttgagtaacaatcaagttccgccacctgcattcagccaaccagtcgttcaaccagttgtcttagatccactgcaagcttctccaggtagagaagagggcgaggttccagagtctgagttagaccctgacacaaggagaaggcttctcatattacaacatggccaagacacaagagatcctacaccacctcttccagcagtacctcctgcacaagtttcagttcctccggtgcaatctcatgggaattggttccctatcgaggatggcattggcatgaactcaaataatttgaacatgggttcagcagggttcccttcagaatctgataccatgcattatgataaaaagcaaccaccacagccatcttacttccatggtggcgataataatccagtgtcctctggtagatttagttatcagagccagaggtttccctctcaggtaacacatactgaggaccaccgcatgcttcagaaccatgcacctccaagatacagatcctttcctggtcagagaaacaacttgattgagtctggacaaagctatgcacgaaatgtaggttctgttggcatactagaggagatcgcactgaagtctggatctaaggtggagtacaggtcaacattatgtgataccgcagaactacagttctctattgagatttggatagtgggagaaaaagtgggtgaaggcattggtagctcaaggaaagaagcacagcgtcaagctgcagaaatatctttaagaaatttggccaataaatacctgttgtctgatccaaataagatgactgatgtgaacgaagatggtttcggtagcaatccaaacttttttggatactctgaaaataccaggaacgatatattggcagtcccaagcacttcagaggaatcccgattcacgaaaacaggggagaacaattccaaaataacaggaggctctattgctgctctgaagcaactttgcacagttgagggatataacttagtttttcaagctc

SEQ ID NO: 9530 - DNA, 497 bp, Triticum aestivum
  unsure (1)..(497): unsure at all n locations
  Clone ID: PAT_TA_9530
taaaactttnctttaaattttacattatttgctgcggcaggatacatttgcaaagaaacaaaagggtggccacttgaatcgaccacgggattttatgatgacattagcagcttaagaatgctacagcttcttaggggccacaaaaaactatgggtgtatataatctggtaagttgcccgtcatctgtgttttctatacagctgctgacggtgacccataaaagaatgaagcgcagagagatgttgctcatctgcgtgtatatcctctcccttttttatgggggattatggagaaatccagcaagaaatacaactcanaagacatgagcacttgctcgcatgtttgatatgcttattagttgaccagctgtcctttcacgcatggaggcccatcatcatcaaaaagcattgccgggaattatcggcagcagctangcacacataaccacttcaataaatactggctgctcattcttaccactgaaccactctgaattt

SEQ ID NO: 9531 - DNA, 1187 bp, Triticum aestivum
  Clone ID: PAT_TA_9531
ggtcttcacatcaaaaccaaactggagcagtgtagctgcaaattggactttgctttgaaaattttggttgccctggttgcttcaccagattattgccccaggggtaacatatataaaactgttgtggactagactccttcaaaaggaagaaacctgtatttcaaaaatgaaaatggtggcttcgcaacatatgaactccaaaggtcttatgcctggcttgagcttatcaaccctgccgagacattcggagatattgtgattgattacccgtatgtggaatgtacctcagccgcaattcaggccctgacatcatttaaaaagctctatcctgggcaccgcaggaaagatgtagataactgtatcaacaaagctgctagttacattgagagcatccaaagaaaagatggttcatggtatggctcttgggctgtgtgcttcacctatggcacatggttcggagtgaaggggctactagctgcaggtagaacctcgcataggattacttatgggttgctgaagatggcatgaagatgcagggttataatggcagccagctctgggatacagcttttgcagttcaagctattgcagccactgacctcattgaagagtttgctcccactcttaagctggcacatgattacattaagaactctcaggttgttgatgactgccctggagatctgagttactggtaccgtcacatatctaaaggtgcatggcccttttctacagctgatcatggttggcctatatcagattgcactgcagaaggactaaaggcctcattattgctatcaaagatttctccagaaattgtgggcgaaccagtggaagttaacagactatatgatgctgtcaattgtttgatgtcttggatgaatgaaaatggcggcttcgcaacatatgaactccaaaggtcttatgcctggcttgagcttatcaaccctgccgagaccttcggagatattgtgattgattacccgtatgtgggatgtacatcagccgcaattcaggccctgacatcatttaaaaagctctatcctgggcaccgcaggaaagatgtagataactgtatcaacaaagctgctaattacattgaggaacatccaaagaagtgatgggtcagggtatggccctggggctgtgtgcttcacctatggcacatggttcggcgtgaagggcct

SEQ ID NO: 9532 - DNA, 1412 bp, Triticum aestivum
  Clone ID: PAT_TA_9532
ggcacgcccgataacacccatccacctcctaccctggccttgggccgacgcctcccctcgggccgacgcctcctgctccctctcgctgtcgcgtctcccggcgaccttctccgtcgacgccccggctataggctgccgcccatcatttcccggcgaccagatcgacggcaatcctatcctccttgatctccctctcgggcgtcgggagatctacgcggggaccatgcataagctggggagaggaagccgcgacaaggtgcaacagttcatggccataactggtgcaagcgagaaggtcgcccttcaggcactgaaagctagtgattggcacttagaagggtcttttgattatttctacagccagccacagatttctgtgaccaattctcgacatcttgaagatctttacagcagatacaaagaacgtgatgctgatatgatcatggtggagggcacatctcaactttgcaacgacctgttggtggaccctcatgatgttgtcatgcttgtcatatcatggcacatgaaagctgccacaatgtgtgaatttactcgccaggaattcattgatggtctgcagtcaattggggttgattcaattgagaagctccgtgagaaacttccatcactgcgagctgagataaaggacgataataagttccataagttatacaactttgcgtctgcttgggctaggcagaagtccctgccaccggagacacctatggcaatgattgggttgtggtttgctgtaaggcattggaccttaatcgatcacaggtgtcagtttctccagttccggcagatcaaagctatctatacgatcacatggcagttatcgaagtatgacgtagaagctgtttagccctacctaattgatgaatttgtggaggacctaaccgagaatggatgcgttcagcgtaacaagtgaaccgtttgaggctgcattctggacttggatatcatgatttggtggtacaaacatgattcatgtcggatcaatagagtatttatctttggatgtcggcattgttcccgctacccttcacaaaagcagatgatgtcgtttggtggaatctacttgcgcaggggttgtttcactggctaggattgcaaactatcaatctagtttgtattttgtgctgcccctatctgctacagcatacccaaaacagttattggtttactgctgaatgggcgatgggtctatagttcatgtaggtccaggtatgaggtaatgcgaacttgtgctatcggtattgattgattgttgccagatggggcaccttgctatgaggtaatgcaaactttgtgatagattgcgaaaatttatatgaggtaatgcaaacttgtcacttctttctagggaccgttgctgcttagttggctgcagttaacttgaaaaaaaaaaa

SEQ ID NO: 9533 - DNA, 714 bp, Triticum aestivum
  Clone ID: PAT_TA_9533
acaaagaacaatctttccatttccagatgtgcaccatcagatatcttaatttacaacactgcttccctttcagtacatacactgacaaatcattccatgtatacaacattgagcgtttctgaataccatctacacccccaaaaactgcacagttgatcaataccagccagatcccagaaactacagcagtacaggaactcctcagaccaaagggccagcacttctcgatcaaaaagatgaactggataaaagaaggcgttggcacttgaatcatcttcagcaggccatgatcaccaatgatctctgtgcacatggcgtttgcaagagaatcattgcatggatccatgctactcatgacggtgttctcattctgcggggaggaggtccgcatatgaaaaatcatgagatggtggacctttctgttctgctaaaaggtaaaacggaatgtgagctaccatcttggttcctccttcgctccagttcacaatcccaggaccatttccttgggcagtggatggtcccagtaccggcccgcgcggccccggttcattcatgagccctaagtagtcacaggcgcgctgccagactcgcctgtctgaggtcctggaccgagcgaccttagccaatgacacacgtgctcttggaagcagctcgttatggcaagttgctagcttcgcaatggcagtcaccacaaagcataggagcctagcttgg

SEQ ID NO: 9534 - DNA, 694 bp, Triticum aestivum
  unsure (1)..(694): unsure at all n locations
  Clone ID: PAT_TA_9534
agcttctgcttggtaagtaaaaccaatagaaagctactccctccgacccatnatangtgttgcagttttgaactaaggtttaaaaccttattttgggtcggagggagtactgacaagcgattgttgtaagaggacgacgtacacataacatacacggtgggataaatgtagttcaacaatataacaatattttttcgctccattacttaccaaattttgccaataatggtatattccagtgatgtttcgcttcctccactccttcaggtcaaacatgttcattccaaaagcccaaccacaagcacgtggatcaaagttctcagagatcttaggatgtgagaagttgagataagtgtcgaagcgatggaaactttctttgcaggtttcaacagcaccatttaccatccctttaagatcaacgtcccagaggggtgtcaagtccttctgcacaacaacatcatcatcaagaaacaggatcttgtcaagcttgggatgtatctctggcatgtagaaccttagatggttgagcatagacaaatattttgggttcctgtacttcagattttcagtcccatcagagagtgatgacggatcatgtgctttaaagtaaaattccttgagacgagctgagtcaagttgccgcataaccaaacaataagacgaattgagccacttgaaattgtcaatgntctcc

SEQ ID NO: 9535 - DNA, 660 bp, Triticum aestivum
  unsure (1)..(660): unsure at all n locations
  Clone ID: PAT_TA_9535
taagcttggcaccatggcaggtaccattaaaagctttacaattttctcgacttggctcccgtgttcagccttggtggcaagatattgctgacgtttaacacaacagcaaaaacgaagaattgtactagtacatcataatacacatggtttccataattacactcttctcatacacgaaaaatattaggccaactttcaacaggttgctgtactatctttttcatggcatctgcttatcccctcccaaaggagatcagatcccttattcacagactgacgcttcaatgccaggcctgttctgttattattgtatcttcttgattaacatctgcatatatctccttccgaaggagatgagatccctcactcacagctgcttcttagccagatctttgttctgctcaatgtacgggtaggctctctggtactgcagtatcgcccagacgaggtgcctccacggagaactcaggccagagggggtctggggttcctgcagatgggctaaacgtcctctgccacaggaggaagttgctcagccgggtctcgcccgaagtccggatcacgatgtccgggctccgggcaaccggcggtgtacattggcgatccaagtcggacaccgagatatccgaacatgcgccgccatttccagggnggcgtttg

SEQ ID NO: 9536 - DNA, 512 bp, Triticum aestivum
  Clone ID: PAT_TA_9536
gaatttggtaccatcgcgccagcaaactttgaaggccgagctgcagcggcccggaggctttttgcaactggagcgacaattccgccggtgcacagagggcattagtaaggaagtgaagcttccggattggagagtccaagagttgattgcgcaggaaattaattacaagcgtgcattgccaaagacgtatgcacactacgccaggaagaagctccagattgcagaagtcttaggaatgattcccaaggccgagataccagcgtagatgtgtttgttgctggagtccgcggtgatcgtttggcattagatgcccaagtacacctgggcttatatatgacgtaccctttgagcaaattcttcatatgttacccaacataagatgtgcctcaagatcttatatgatgatgtctaacttatttctattctctgttcacacatagatatgttctaacttattcctgactcggatgtgtgtagacacattttagtgtgtatgttcctcattttggtcc

SEQ ID NO: 9537 - DNA, 1160 bp, Triticum aestivum
  Clone ID: PAT_TA_9537
aggaggttcgcgagctccatgtcaagtatgtaggttaccgcatcaaagcctacctgttgctgaaagggaagcatatcgacgagctagacgaagctacatcggaatgcaagtaccctctcgagcttgcattggagaatacatgtttctctccttacctggaagatggtgtctttggctggtatttcgactctgacctctgtttacttaagtcattgagtgactaccagcggctagtcctccctaactgtgcttggagtgagtatgaaagcttgagtcagtacatcttgttttataacacccatgaagctgatagagactatgtgctgtactgggaaaagatggtcaaggaaattaagtggcttgaaaatcatgtgcttaaagaagatactccggagggggatcaaatgcgctgtaaaggtttgtaccaatcagttaagattgccagtgggttcaccaacattgatttggatctagcatgtcatggtttcgaggagtatgtatggaggactcgcctttatcgtctgtttgtggaaggtcttgaccgtgcctttcttgagatttggaagcgggtcaatgaggatcagacgtctttcagagatgctctgcaggaagtttacaatgacaatccggttccatcgcgccgacatactttgaaggctgagctggagcggcccggcgggtttttgcaactggagcgacaattccgccggtgcacagaaggcattagcaaggaagtaaatctcccagatgagagagtccaagagttgattgcacaggaaattaattacaagcgtgcgttgccaaagacgtatgcacagtacgccaggcagaagctccaggttgcagaggtcttaggaatcattcccagggccgagattccagcgtagctgtgtttgtttgttgctggcttccgtggtgatcttttggcattaattagatgcccatgtacatgtgggcttatatatttggcgtaccctttttgaccaaattgttcattgtgcctcgagatctgccacgatatcatttgatgtggttcgtactatggaattgtgcgatgggatcttctattgaagaaaaaactttatgcggctgatggtgctaaaaaagtaaagatccctagatatagtccaaataacaacaatgtggcaagatttgtctcc

SEQ ID NO: 9538 - DNA, 924 bp, Triticum aestivum
  Clone ID: PAT_TA_9538
gggcgctcgactgatttaggcggacccgtgcgcgctccgagtggattctctatactgggaaaagatggtcaaggaaatgaagtggcttgaaaatcatgtgcttaaagattttctggagtgggaggccaatgcgccgtaaagggtttgtaccaatcaattaagattgccaatgggttcagcaacattcatttgggtctagcatgtcatggtttcgaggagtatgtattgaggactcgcctttatcgtctgtttgtggaaggtcttgaccgtgccttttttgagatttggaagcgggtcaatgagggtcagacgtctttaagtttacatgagaatccggttccattgcgcaacatactttgaggtgagctggagtgccccggcggttttttcagagatgctctgcaggaagtttgcactgagaatttggtaccatcgcgccagaaaactttgaaggccgagctgcagcggcccggaggctttttgcaactggagcgacaattccgccggtgcacagagggcattagtaaggaagtgaagcttccggattggagagtccaagagttgattgcgcaggaaattaattacaagcgtgcattgccaaagacgtatgcacactacgccaggaagaagctccagattgcagaagtcttaggaatgattcccaaggccgagataccagcgtagatgtgtttgttgctggagtccgcggtgatcgtttggcattagatgcccaagtacacctgggcttatatatgacgtaccctttgagcaaattcttaatatgttacccaacataagatgtgccttaagatcttatatgatgatgtctaactttttcctattctctatgtctaatttttcctactctctccgttcacacccccctatgttctaatttttcctgaaaaaaaaaaaaaaaaaaaa

SEQ ID NO: 9539 - DNA, 799 bp, Triticum aestivum
  unsure (1)..(799): unsure at all n locations
  Clone ID: PAT_TA_9539
ttttttttttttgngaaaaggcaaatccttatcttcgagctcttgttcttctttttttcgtatacacagccaacgatatgacgtgtctggttaggaggtggcggcgttcccacttattaatacaattcctgtattaaacaaatacaactcgacagctgcccccccaaaacaaaaccactcccaggcctataattgttcgtttcccacccgccagcacaagcttcaaagaagctgaaatggaacagcagcatagatgaccaaaaaaaagagcgcaatcacgcactgctccgacaacaccttgaaataaaccgacacaaccgtctgggatctcagtttttgccaaaagaacccttacaaaaccgtctgggatgaatgcaagacaatgcaaatgcaaaagaaagaaaaaacagctcaggaggaacatacccccacatagtgaagttggacaccctgagcagtacaaaaatcctgtgacgatgcacgcgagccccttatgcataatggatgaataagcaaccgggccttgtagtgagtgaccgaagcaacggaatgcgatggctgcaccagacccaagggcaagcaagcgagcccagaccaccagcgccgtggcccccccccggggccgcccgtctcgcccccgacaagagatgctccgggattcctgcctttagcaaagttagcaggcggccaacttaaccctcttttccacacatgtgaaaaaggctgggctgacacatgtactgatgcatgagttagtgaggacccttcgactctcctgtgaggatggtggacttctcca

SEQ ID NO: 9540 - DNA, 1087 bp, Triticum aestivum
  Clone ID: PAT_TA_9540
cagcgttctagacaggcttcgtttcctccggcgacggcggaacgagcgagagagtcctcggcgcggccgacaaccggctgcgggatcgcgcgattcagtcgtcgccaagggccgcagaactagcggcaccgcgccgcgccgcgcacaacgccatggcaggtaataacccaccaccaaagccatgggaacgtgttggcactttatctggtccagcgcctttcaaacccccatctggaggcagcactagtgacctcgttcgcccatgtggcagatttggcgggggttatggtatcggtgcgttacagggaaataataacttgtattcaagctatggaggtggttcgggcggttcgtacggaggctctgggatgtatggtgggtcaatgtataataacgggatgggaaatccgtacggtggaatgggcatgagtccttacaatcagggtcctcattcgtttggccctccagcaccacccccaggtttctgggtgtccttcctacgagtgatgcatgggattgtgaatttctctgggcgagttgcattccttatcagccagaatactcaggcattccacatgttcatcacagctcttttgcagctatgtgataagtctggaatgctttatggtgagcttgcgagattcacatttcgattgctggggatcaaaaccaaaccaaataagggcagaattcagggtgcacaagctccatcattggatgggccaggccagcagttcgttgaggcaccaaaagctaacaagaactcatgggagaatgtctggaacggcgatgctaagggaatgtgagctgctatatatgtgtgcagttacagtgacaggttttgttagacgaggacgatgagtttgcttatggctatggggagaaaggaaatctgctgatttctgttctgatgcatctgccatttgaaccagagcgagaaaaccaagtaatccctattgctcgttgtatttaccgtgatatcttttcttccctggtatctgtgtagtgctgttacgaggagtttgctgctgtgagaaatgtgagcttgtaaagtatggctttcctgataatagagtaaatattaccc

SEQ ID NO: 9541 - DNA, 994 bp, Triticum aestivum
  Clone ID: PAT_TA_9541
aaccgaacgcacagggtgagctcagcccggtgtccacgcccgcgatctgttggtctcctcaggtggctctggcgcccccgctcaagttcagaaagggtgttgacgcgatcatgatgtgagctgcagctgtcacgttccgtcgcgcggtcggagatgctggactcttgtagcctgacataccttaggccagtttttatcttcctctgcctttcttctagtcttgttagccttgctgtcatgcctggtttgtaataaaacctgaacctctcgagacaagtagctggtatgtaaggggacttcgctgtttggtttctttctgtggtttgggagcttagtgcatatatttattgtactataaccgataatgttagtatgctgtttgcagtatgtacagtacactgctatcgctacggtatcagtcttaggcgcgagtggtccgtttaacgactgtcggagctgaacctatcggcctatctggggtgttccgtagaaggagcgccttgaattatctgtcttctttggaacagcaactgttgaagtaggaatatacaacttcaaatgcttcaaccagtggttaatctaggtcagaaagatagatttcctattccatcccgaagctcaggcatacactagatggtctttagctatgtacttagttaatccgtggatccttccttgatagatgagtggtaaaagcctgaagatatttgcctctaaagcctaaaggaagaatcatctttaataggtgattctgatgctggagatgagaacgaatcacaagaagaggccctagcatcaatcaacattgatatcacttctcgcatgctaggcctatccaatggcgattcactagtgcagaacaatgcaatcttcatcaccagagtcatttcttccacaaccctctttgagttcagatcgagtctgctgtcaaaaacttgagaattttggtgtcatgctgttcattgtccgcctcaccaaattgcctcgtgccgaa

SEQ ID NO: 9542 - DNA, 537 bp, Triticum aestivum
  unsure (1)..(537): unsure at all n locations
  Clone ID: PAT_TA_9542
cagcgccccggggctcggcctgggttctctgcgcccctggctcttctgcggggactgccgtctcgccgctgctggtctccgccttctcggtcgcgccgccgccgccccctcctgacgcgtccgcatggttaaactcacatggccaaccggaatcagtgatcctcccttgtgtctgcgatgcttaagagaagctgctgttaatcgcttgcgaatgcccctagttatttttcatggccttggcaaagattatacatgtatagctgatccgatgaatcgctgaatatctgcatgccagttttgggcccggagattagagtccatgtaccatcattactagatttgatatgccaagttctgtaactggcccgttaggtcaggtcactgcaaaaatactttggagcgacatcatagataaattcgcaatccgccctacattcagcagttggctgttcctccttgaaatctatacatgtacttggaagagaagaactccaatttggaacatttgcatgcanngtttattatatttttaaaatt

SEQ ID NO: 9543 - DNA, 986 bp, Triticum aestivum
  unsure (1)..(986): unsure at all n locations
  Clone ID: PAT_TA_9543
actctaaactctattctcctcttatttaatggatgaggcaaatattttgcctccatttcggaaaaaaaaactggatgttatccaacacaggcaagagacgcatctaaaccaataancaatatgtataaaaatacaaaaaccacaattacgttatttttcatacatgcgctttacaagttatcctcctgtacggaacaccgcttcacgatttttttttcagcttgcaagcatcagcaacctactccgccactgctccgacctccacagaagaggcctcagcggcagggcgcccaggcaacccatggacaaacggaatcgcaaccgagtactgccggtcgagcagctgggcaggagcccgcgccaacagcttggtcacaccatccaaagtggcgtgtaggtcttcctcaccacgatacaaggtcctgcaggttgtgccaagggcagcacgcattcgctcggtgaggtcggcaacttgctgaagccgcgaagccgcgtcctgaatggcgagtgctagcgtaaaccacctgatggctcgcagttatcagccgcctacatcgcagccgttcacttgatcgcacttcccgtcaacgcacatcttcctctcgcgctccaagcctaccagctcggcggcagcggctgcggtgcaatggccatcggagttatgacgcagcgggcgttgacgcacggtcatcggagtcgctgctggaggtgcgatccggcggtcctcgacgcttgtcggagcttcaatgcagcagccacgacatcgccagagctgcgatgcagtggtcggagtcgacaccacgggagctgccatgcaacggtcatcgacgccatcagagcttcaatgcagcagccacgacgtcgctgagctgcgatgcagcggccgtcggagtcgacgctgccggcaaatgctgcactgtagcaccgggagccgcaggcgatgcttcattgcaacatcgagcgtcgtagctctggagccactggcg

SEQ ID NO: 9544 - DNA, 767 bp, Triticum aestivum
  unsure (1)..(767): unsure at all n locations
  Clone ID: PAT_TA_9544
gcagcgaccagcctcaaacatggtactgacttgtaaaaaatctgaataatggtactgatccgttacaactgcaagtgttatacttccctgcaattaactcaagcaccaagtgaagggtagactccttctggatgttgtagtccgccagagtgcggccatcctcaggctgcttaccagcaaagatgagatgctggtggtctagggggatgccctctttgtcctggatcttcgccttcacgttgtcgatggtgtccaaggactccacctccaacatgatggtcttgcctgtcagggtcttgacgaagatctgcataccaccacgaaggcggagcaccaggtgaagggtggactccttctggatgttgtagtcagcaagagtgcgaccatcctcaagctgcttgccagcaaagatgaggcgctgctggtccggggggatgccctccttgtcctggatctttgccttcacgttgtcgatggtgtccgaggactccacctccagtgtgatggtcttgcccgtcagggtcttgacgaagatctgcataccaccacgaaggcggagcaccaggtgaagggtggactccttctggatgttgtagtcagcaaatgtacagccatcctcgagctgcttgccggcaaagatgaggcgctgctggtccangggagatgtcctccttgtcctagatctgtccccttcacattgtcgatggtgtccgacgactcaacctcaagggtgatggtcttgccggtgagggtcttcacaaagatct

SEQ ID NO: 9545 - DNA, 197 bp, Triticum aestivum
  unsure (1)..(197): unsure at all n locations
  Clone ID: PAT_TA_9545
gtcaacagtttcatgtgttnccatgcctacttaatatattatattgctagcactattcagtggcctaaactcccatgaaatttaagcctgctgagtgaaacaggcctacgncagacggaggcttttcaagtgaataaaacaccacctctatgcaccttcttttccagtctgctgtgcctactttctttctccatcat

SEQ ID NO: 9546 - DNA, 726 bp, Triticum aestivum
  Clone ID: PAT_TA_9546
ttttttttttttaaaaaacggttatttatacatctccatcatgtattgaaggtgctctggcaaacagcattctgtgttaataatcacaccacctaactttctcagttccattccctccatatcaatccccctggacacggttacaaaacgctcaacacaccaaccaacacagctgacttttgcacacaaacatgacaacagagcacgcaaacaagacaatgcggcacacttattcgcaagaccccttttcagcttaaaatgtgactgtaccgaaaccgaaggcgttgccagtcgcgagctcgtaggtcataagcctccccatctgggccctggtacccaggatggtctcgccggtgcttgacggcaagacagacaggcaccgcgccccatccgcccgcgtcttccagacggagctccctgggccgcagcgccatgacggcatcgccggcgaactccgaagagtgatggtggggaagcggtaccttcgcgtccgccgagtagcacaggccgttggcagtggcaccaggcgcctgcagcgccgccttgaggaggtcgtacacctctccgttgaggtacatgccgaccggcatgggtgtgctcaggtaaaccccgccgcggccgtattgctggatgtcgagcgctccccgcgggatcgggagcggctggttgccgaccagtaggctggcgatcggcacgtagtagcggttggggaacaaggggttggag

SEQ ID NO: 9547 - DNA, 701 bp, Triticum aestivum
  Clone ID: PAT_TA_9547
cccacgcgtccgcgtgggcggacgcgtccgctttcatagggtttatctctttcctcctcccctctcgcgcacggcagccggattccctaccgcaggcgagccaccacgccggccggagctcggcgataagatagttctttagcaagcaatcgagaatgtcgtcggtgcagctctctggtgctggtgttgctgcggtggccttcagcaacaacggcctgcgcctctctcagacgtccgcactcagggtgtgctcatccaggcgctcgtctcgtagcctcgttgtcaaggctgccactgtcgtcacccccaagtatacatcactcaagcctcttggagacagagtgcttgtgaaacttagcgcagctgaggagaagaccattggtggaattttgcttccatcctccgcgcagtctaagcctcagggaggtgagattgttgctgttggagggggtagaaccattggggataagaaggtggaggtcagcataccgactggatctcaagttgtatactcaaagtacgctggtactgaggttgaatacaacaactccaagcatcttattatgaaagaggatgacatcataggtattcttgaatctgatgatgtcaaagacatgaagcctctcaatgaccggattctcatcaaggttgcagaggcttcagacaagactgaagctggtcttatcctcaccgagacaacc

SEQ ID NO: 9548 - DNA, 1136 bp, Triticum aestivum
  Clone ID: PAT_TA_9548
cccacgcgtccgcccacgcgtccggctctccgctttcatagggtttatctctttcctcctcccctctcgcgcacggcagccagattccgtaccgcagatagttgttcagcaagcaatcgagaatgtcgtcagtgcagctctctggtgcgggtgttgccgcggtggccttcagcaacaatggcctgcgcctctctcagacgtcggcactaagggtgtgctcttccaggcgctcgtctcgtagcctcgttgtcaaggctgccactgtcgtcaccccgaagtatacatcactcaagcctctgggagacagagtgctcgtgaagcttagcgcagctgaggagaagaccattggtggaattttgcttccatcgtccgcgcagtctaagcctcagggaggtgagattgtggctgttggagggggtagaaccattggggataagaaggtggaggtcagcataccgaccggatctcaagttgtatactcaaagtacgctggtactgaggttgaatacaacaactccaagcatcttattatgaaagaggatgacatcataggtattcttgaatctgatgatgtcaaagacatgaagcctctcaatgaccggattctcatcaaggttgcagaggcttcagacaagactgaagctggtcttatcctcaccgagacaaccaaggagaagccatccattggaacagttgtagctgttggtccgggctctctcgatgaggaaggcaagaggcagccattgtcggtgtcaccaggcagcaccgtgctgtactccaagtacgcaggcggcgagttcaagggtgctgatggcacgaactacattgtgttgagagtgtctgatgtgatggctgagctctcttaagtgtgtggtttattactttgtttcagttttgagttcacgatagaggctagcatgagtggtaacattgctatgtgataaccacttgatgctatttcagatgattatagaattgtatgagcaaacctgttgtccgggttaaaaacatttaccgaatttgtttacaaagggagcttgatgccggtttccccctaaaactgcaatatgtatgtacattagtgcttggctgattgcctattgttgtggccctatctatgtgaaaggttcctagcc

SEQ ID NO: 9549 - DNA, 1337 bp, Triticum aestivum
  unsure (1)..(1337): unsure at all n locations
  Clone ID: PAT_TA_9549
gctctgcgctttcctcaggtctcctcttcccttgggtagggcttttgctctttcctcctcccctctcgcgcacggcagcccgcaatccctaccgaaccgcgagccttgacgctcgtccgtcttcgccgtctcgagagatctggaacgaggaatttctcgtccccgggcgcgccaccacgccggtgggagcgctgctatgagggcgttgattaacaacggatcgcgcatatctccggactagccgtcccggtgctggtgttgcccacgctggccttccacaacactgagtctccgcgcccctctgtcaggcgtcagcagaaataagcgtcgctcaagtctgagggacaccaatcgcgtttgagaccttagtcgctccgggcggcgaaggtcctctcggcggaagtttaccttactctccgccgcggaggacacagagtgcatgtgaagcttggcggagccgaggggaaggacgtataggcaggaagttttgcgtacatcctccgcgaggttcacgcccgtcacccgaggtgtctactcgttggatgttggagggggtggaatgattggggataagaaagtggtaggacagcataaccgactggatctcaagttgtatatgcaaattatgctgggaaatgcaggttgcacacaataactcgaagcatcttaatatgaaagaggatgacatcataggtaatcttgaatctagatgaagtcaaagcacatgaagcctctcttaaatggaccggattcccctcaaagacctgcggttggctgcaggacaggactgaggctgctcttgtccatcacccgaagcagcaacctaatggagaagcaatcccattggagacaacgtcggtagctggttgggtccacgggctcctctttgacggaggaatggctatagtggggcagctcatttgtgtagttgtctacctgaggcgagtcacctgtgcttgtaactccgaaggtagcgcaggcggacgagttcaatgggcaactcgatggcacgtaactacattgtgtttaagagtgtcctagctgtgatggctgagctctcataagtgtgtggtttattactttgtttcagttttgagttcacgatataggctagcatgagtggtaagattgctatgtgataaccacttgatgctgtttcggatgattacggaattgtacgagcaaacctgttgtctgggataaaaacatttactgaatttgtttacaaaaaaaaaaaaaaaaaaaaaaaaaaaaaaaaaaaaaaacctccganaaaaaaaaaaaanaaggggngtccggnnataaaacccaccgggagcttgatgctggtttccccc

SEQ ID NO: 9550 - DNA, 592 bp, Triticum aestivum
  unsure (1)..(592): unsure at all n locations
  Clone ID: PAT_TA_9550
aaaagactagctgcaactaagccatcacagcagccagaaggaaaggatagggaaacccaggaacgcagcctggttccaaaccaacaaaagatcaccatcaccatccagactcccagtgatatacaagaactaggttcaaataaaatcgcacgactcatcagggggctaacaactagttctggttcgcacaagacaaacatggactgactagttgtggcatgcacgcccacgcacgagcacgatgggcaagccatgtttcaaccatctaacaagctcgccgcatctgaatcatgtcctccgtcctctcttcctccgccatcgtctctggatgccggtcccccatctgagaagctgccttgcccgtctgacgtctgcggatcgtccctggcacggcgaatatcctgtaccctggccacccgctccttccgccgagcgatctcccagatctcgtccatgctcagacggtagtcatgcgtggcgaccttctcactcaatgtccgggaactgcttcacaatgaaacacaaggtagtagttatcgagtttttgcgttggtggtcaagccctccangagcgcgagctgttccgtgacgg

SEQ ID NO: 9551 - DNA, 982 bp, Triticum aestivum
  Clone ID: PAT_TA_9551
cgtccgccgccatcctgcctactgtgcggccctgcccgcccgctgctccgcgcgaggctgaccgcggcccgtcgccgttccgctccggaccccggccgccgggcggcccgactccccggccgccgtactgcagtgctgcttaagcgccgggcgctctatagatggagaagtctaaacatgggaagaggaatcaccgtgaggacgggagcacgggcagagggcatggaaagggccgcccttcgggcagttcgatgaagatgaaccccgggggcatgaagaatgagaacgcattgcagccccccaatgcttcaacctcagcgatgaatgttattaggaaaaaggtcgatcctgaaactgctaaatacttcctcgagatatcgaatctctttgataacaaggagatagacttggaggaccgttcgacgatctgcgccaatgctttggaagaaaccaaagggaaagagctcgaacttgtcactgatggtgtaataagccacaccttgcagattcttgtacaaggttgcgagttggagcagttatgcatgttcctccgcagctgtattcagtcttttgctgttattgccatggacaaatttggatcgcatgtggctgaagcagccctcaaggcactggcaacacatcttgaagacgacacctccagggtcattgtggaagagatactgaataggatttgcaaggttattgctgcagatgctacaaatgtgatgtgcagctgctatggatctcatgttctaaggacacttctctgtctttgtaagggcgtaccgttcgattcattgcaagatttccacatgacaaagagatctgctgttctggctgaacgattgagcggtggttcaagtagaccaggcgaccagaatctaacaagctttgagcatggtttcccagatatgttcaaaacttttgtcaggcaaatgctacaaaatgcaaaaaatgacatttcaagtcgacgcggccgcga

SEQ ID NO: 9552 - DNA, 492 bp, Triticum aestivum
  unsure (1)..(492): unsure at all n locations
  Clone ID: PAT_TA_9552
actgttgtgagntctaacgggaatttntttgcttngaaacaccgngtccagtcgtacgacggagggggtcgacgggatgtaatgctaggtggctgacattgcaagtataatttactagtggctcagggtctaattgcaagtgtaatattacttttttcttttgtaactgctgatttcgagtcattttattatgtccaaaaaaaaaaaaaaaaaaaaaaaaaaaaaaaaaaaaaaaaaaaaaaaaaaagaaaaaaaaaaaaaaaaaaaaaaaaaaaaaacgggcggcccaaaggattcaaacttaagtaaccatgaaaggaaagtcaaaacccctccaaaaggtcaaccaaattcaaatcaatggccgtccttttaaaaagtcctgaatgggaaaaacctggggttaaccaaattaaacccctttgaaaaaaaaccccttttgccaaatggggttaaaaccaaaaaggccccaaaaaatttcctttccaaaaa

SEQ ID NO: 9553 - DNA, 675 bp, Triticum aestivum
  Clone ID: PAT_TA_9553
caccaaccgaaaccaaaccaaccaatctaccacccctctccaatggcaaccgcgcccacgtcgcaccagctcgccgccggggcgccctggagctccctcccccgcggcgggttccgggcgctcacggactccgcccccgcctccgtccgcttctccgtcggtcgccgccgcgccgcccgcctagaggtgaaagcagctggaaacatcttcggggactacttccaggttgcaacttatggagagtctcatggaggcggtgttggctgcgttatcagtggttgtccacccagaatcccactcacggaggaagacatgcaaggagaccttgatcgaaggcggccgggtcagagcagaataacaaccccaaggaaggagaccgatacttgtaaaatcctttcagggacatacgaaggaatgaccactgggacaccaattcatgttcttgtcccaaacacggatcaaagagggggtgattacactgaaatggctaaggcgtacagaccttcccatgcggatttaacttatgacctcaaatacggtgttagatctgtgcagggaggtggaaggtcatcggcaagagaaaccattggaagggtagctgcaggagctgttgcaaagaaattcttaagctcaaatgtggggtagagattctagcattttgtttccaagggcatc

SEQ ID NO: 9554 - DNA, 674 bp, Triticum aestivum
  Clone ID: PAT_TA_9554
caagcaaggggttgagatcggtagtggatttgcaggtactgacctaactggaagtgagcataacgatgagttctatatggatgaggctggaaatgtgagaacacgaaccaatcgctcgggcggtgtacagggagggatatcaaatggtgaaactatatacttcaaagtagctttcaagccaacagcaactattgggaagaagcaaaatactgtaacaagggatcatgaggatatcgaacttctgacaaggggtcgccatgacccatgtgttgtccctagggctgttccaatggtggagacgatggccgcattggtcctcatggaccagctgatggcacatgttgctcaatgcgagatgttcccgctgaacctcgccctacaagaaccaatcggctccacgaacagtacacctgcgttggcaccagatctagcataatacctgctttggaacgagaaggccctcttacatattctcctccctctctttcatctcccatatttcagggttttgctaagcagtttgcagttttgtaccaaactgtatactagaatatacattggattagtgtacaccaagagatctgttgatcaccgaaaataaaaagtttgtgacgtgaacagtttgttctggacaaccagtcaatgtgagcaatagaacatttctccacttgttg

SEQ ID NO: 9555 - DNA, 1645 bp, Triticum aestivum
  Clone ID: PAT_TA_9555
gttccgcctcaccaaccgggtcaaggcaaccaatctaccacccctctccaatggcaaccgcgcccacgtcgcaccagctcgccgccggggcgccctggagctccctcccccgcggcgggttccgggcgctcacggactccgcccccgcctctgtccgcttctccgtcggtcgccgccgcgccgcccgcctagaggtgaaagcagctggaaacatcttcggtgactacttccaggttgcaacttatggagagtctcatgccattggaagggtagctgcaggagctgttgcaaagaaaattcttaagctgaaatgtggagtagagattctagcatttgtttccaaagtgcatcaagtggtacttcctgaagacgcagttgattatgaaactcttaccctggatcagatagagagcaacatttgtagatgtcctgatccagaatatgcacagaagatgattgatgcaattgataaagtacgagttaatgggaattcgattggtggggtggtcacatgcattgccagaaatgttcctcgtgggcttggctctcctgtatttgacaaacttgaagctctactggcaaaggctatgctttctcttcctgcaagcaaggggtttgagatcggtagtggatttgcaggtactgacctaactggaagtgagcataacgatgagttctatatggacgaggctggaaatgtaagaacacgaaccaatcgctcgggcggtgtacagggagggatatcaaatggtgaaactatatacttcaaagtagctttcaagccaacagcaactattgggaagaagcaaaatactgtaacaagggatcatgaggatatcgaacttctgacaaggggtcgccatgacccatgtgttgtccctcgggctgttccaatggtggagacgatggctgcattggtcctcatggaccagctgatggcacatgttgctcagtgcgagatgttcccgctgaacctcgccctacaagaaccaatcggctccgcaaacagtacacctgcgttggcaccagatctagcatgatgcccgccttggaacgagaaggccctcttacatattcttctccctctctttcacctgacacttttcaggattttgctagccagtatgcagtattggacaaaaactgtaacatagaatctacagtatattagagtacaccaaaagatttgctaatcaccgaaaataaacctttgcggtgtgcccagggtgttctcgacagccggataaggtgaccaggaccagcttattgcacatgttgatgaaaccgagatgttcccgctgaacctcgccctacaagaaccaatcggctccacgaacagtacacctgcgttggcaccagatctagcataatacctgctttggaacgagaaggccctcttacatattctcctccctctctttcatctcccatatttcagggttttgctaagcagtttgcagttttgtaccaaactgtatactagaatatacattggattagtgtacaccaagagatctgttgatcaccgaaaataaaaagtttgtgacgtgaacagtttgttctggacaaccagtcaatgtgagcaatagaacatttctccacttgttgaaaaaaaaacacgcgtccgcggacgaaaaaaaagaaa

SEQ ID NO: 9556 - DNA, 701 bp, Triticum aestivum
  unsure (1)..(701): unsure at all n locations
  Clone ID: PAT_TA_9556
tttttggtgtttcgcaaaaagaaaatagaatagaattaagnccggtcggtcggacgatatatacatgtacacccacgttcatcaatctttttggtggtgttgtcgaagggaaggccatcgcaatgaacgacgggtggggcttcttcggtctcggcatgcatgcatacagaacgggccgggcagtttggaccgtcgcccgcccacaggattctcctcgggcgcgccgggacaaaactcccggtggcggactggaaaagcgctcatgtgccgccgttgggtgtggcgtcggacagcatgctcatgtcctcctcggggtgcctcccgttcatctgcacccgctgccgccgatcagttggatccccatggttcccgttcaacagcttatggaactcgtccttcagcctcacgtctttctcatcctttggcctcccatctttatctttgttgctcagcggaatcaagggcgacccgtttgtacggtccggcatttctgggagcttggtgtccacgaagaagacaactagattaacggcataccaggcaacaacaacatccacggtgtagtgcttgcgagcggcaatgatgagaagactttgaactatagccatgacccangcaaggagcttaataaacctttttgagccatatttgtgatatgttcgaacgaaaacaagagtgaaaatcatgtgggatgaaaatat

SEQ ID NO: 9557 - DNA, 663 bp, Triticum aestivum
  Clone ID: PAT_TA_9557
ccaacaaaatcaagctaaacaattaagctagcaaaccagtccgacctattacatatcccacatggacagtagcacctacatactgaagcaacacaactgacaacaaaaatccccatatatgaacatcacaacccaaggagccgagctctcgaccatggatgccctggtcgttgtcctcctccacaaagggtgcaataattagcagtagctaattggacttgatccagcacagaagcacatcaagcactgaccaaatgacaatcatgacgccttcagattgaagtaatctgtggcatgtatggacggattggcagagaacttctacagccaacgcttgagaccgatcagcatgcacacacacttcaggttggcggagaacttctacacccaatgcttgagactgatggcatgggcacaccaagtgtgccaccatgatattgcttctgcccagcttcaaagtagttagctttccttctcctaaaaatagaaggatttacctgctacaataaacatatattcctgccataaataaataaagataatgtgtgatagactgacaattgaaactgacgtctttgtgtcgcttagttactatgatcttgatatacatatacatttatattcagagttctcatttcagaaggaatataacatatatgtagc

SEQ ID NO: 9558 - DNA, 676 bp, Triticum aestivum
  unsure (1)..(676): unsure at all n locations
  Clone ID: PAT_TA_9558
ggggtgtgcaggatnatctttcgattccgacccncatacaataaaatagctaatacactttggaaccnaaacgcgcaagtccacatgatacatgcatgccaagaaatcatatttgtacaccagccaactttaacaaggtcataaaagatgataccttggaatttttctgatagtaacatgtctagtgggcacctcatcctcaggccggcaagtaagcaagttttttacctaaaatgagagactttttagctgatcaaaaatatacatcacgcaaagtggaaaagccgggcttgattggtgttcagaatggtgtcatgtttttacactctttatacttcattacacaactctgcacatgatcatgaaagctccacaataattgaagaacaaactttcaatggccatctcacgggctggttttgcaaaaaaaggtcagtctattttttcttttgaaaatgagaggtcagtctctttcttttttgaagaggacaatttttttttacgaacaacaggagtgctgctttcatatactaagaggagaaattctgtgcagaaatgaaaatgacaagaaagtggaaaaggtgtccccaacgcgacatagttcaccacctacccctgtaacctttttctttttcttctgaaaaggacaactcgaaaagcactgatggatttatag

SEQ ID NO: 9559 - DNA, 688 bp, Triticum aestivum
  unsure (1)..(688): unsure at all n locations
  Clone ID: PAT_TA_9559
aaaaacaatataaaatgtaacacctacaattagtaaattaaaagcatctacacatcctcagaattactacaaccaaataggataaattgcctccccgataaaacaaatatcccaatcaaaaactacaaaattaacatcttctctacaagtagtgtatgtatctaagataatctaccatacccagagcaagtaattggttgccaatgtccctctcatctccagttcctgatctgatttacaatttcagattgccttctactgatttgagcatctatgaaatattgagtcatctagagaaagaaccaaggtgatttggattgagagcgcccgttgaatactccttagcaacagaatggacagcaagaacagcagggaaacatttttgtcgctggaggtggctccgccggtgctggtgccggttccgctactggggcttcttcaggtttaggtgcttccattgcagctttcggtgattccattgcggctttcggtgattccattgcggcttttggtgattccattgcggctttcggtgattcgttncttctcatcatgcggctctggctctggtgcatgactcagttgcgccgtgctttgttgggcaagatctggttggttgtccttcgagcaccccctggctttctcatcacctgccaatatcgggaatgcaaagttggtcgcgcttnct

SEQ ID NO: 9560 - DNA, 845 bp, Triticum aestivum
  Clone ID: PAT_TA_9560
atcccacctcccctcccctcccgcagcagcctcgccgagatccaatccggcagcccccctcccccaccggcggcgagcgagccagcgagagggcggagagcggcggggaagcacgcgggaggagccatggggcagcagtcgctcatctacgcgttcgtggcccgcggcaccgtggtgctggccgagtacaccgagttcaccggcaacttcaccaccatcgcctcccagtgcatactgtgtggttgctgttgaatcagtggggcaacagatgccaattgctttcttggttcgggttaaggatgatttcagcaagagatatgctggcgggaaagctgctactgctgcacccaagcagctcaacagagagtttggatcaaaacttaaagagaattgccttcttggttcgggttaaggatgatttctgcaagagatatgctggcgggaaagctgctactgctgcaccaagcagcctcaacagagagtttggatcaaaactcaaagagcacatgcagtactgtgtggaccaccctgaagagataaacaagcttgctaaagtgcaagcacaagtttcagaagtgaaaaacgtgatgatggaaaacattgagaaggttcttgatcgtggtgagaagattgagctgcttgttgacaaaacagagaatctccgcttacaggcccaagatttcaggcagcaaggaacacaggcgaggagaaagatgtggctacaaaacatgaagaccaagctgatcgttctgggcatcatcgtcgcgctcatcctcatcataattcctgccggtgtgccacggattcaactgcggcaagaagtgaggacaactcgaggtcgtgag

SEQ ID NO: 9561 - DNA, 629 bp, Triticum aestivum
  Clone ID: PAT_TA_9561
ccccgttgccccccgttccactccaaagcgaaaccgacctttcccccttcccctccccctcccccctcccctcccgcagcagcctcgccgagatccaatccggctgccccccaactcccccaccggcggcgagcgactcggcgagagggagagagcgagggcggagcgaggacgagcgggcggagccatggggcagcagtcgctgatctacgcgttcgtggcccgcggcacggtggtgcttgccgagtacaccgagttcaccggaaacttcaccaccatcgcctcccagtgcctcgtcaagctcccggccagcaacaacaagttcacctacaactgcgacggccacaccttcaactacctcgtcgaggacggcttcacatactgcgtggttgccgttgaatcagtggggcaacagatgccaattgctttcttggttcgggttaaggatgatttcagcaagagatatgctggcgggaaagctgctactgctgcaccaagcagcctgaacagagagtttggatcaaaactcaaggagcacatgcagtactgtgtggaccaccctgaagagataaacaagctcgctaaagtgcaagcacaagtttcagaagtcaaaaacgtgatgatggaaa

SEQ ID NO: 9562 - DNA, 573 bp, Triticum aestivum
  Clone ID: PAT_TA_9562
ctccaccaacgcgtccgcgacctttcccccttcccatcccacctcccctcccctcccgcagcagcctcgccgagatccaatccggcagcccccctcccccaccggcggcgagcgagccagcgagagggcggagagcggcggggaagcacgcgggaggagccatggggcagcagtcgctcatctacgcgttcgtggcccgcggcaccgtggtgctggccgagtacaccgagttcaccggcaacttcaccaccatcgcctcccagtgcctcgtcaagctcccggccagcaacaacaagttcacctacaactgcgacggccacaccttcaactacctcgtcgaggacggcttcacatactgtgtggttgctgttgaatcagtggggcaacagatgccaattgctttcttggttcgggttaaggatgatttcagcaagagatatgctggcgggaaagctgctactgctgcaccaagcagcctcaacagagagtttggatcaaaactcaaagagcacatgcagtactgtgtggaccaccctgaagagataaacaagcttgctaaagtgcaagcacaag

SEQ ID NO: 9563 - DNA, 1169 bp, Triticum aestivum
  Clone ID: PAT_TA_9563
ccacccacgcgtcgcgcgaaaccgacctttcccccttcctctcccctcccctcccgcagcgcagcagcctcgccgagatccaatccggcagcccccctcccccgccggcggcgagctccagcggagaggcggcgaagcgcgcgggaggagccatgggccagcagtcgctcatctacgcgttcgtggcccgcggcacggtggtgctggccgagtacaccgagttcaccggcaacttcaccaccatcgcctcccagtgcctcgtcaagctccccgccagcaacaacaagttcacctacaactgcgacggccacaccttcaactacctcgtcgaggacggcttcacatactgtgtggttgctgtggaatcagtggggcaacagatgccaattgctttcttggttcgggttaaggacgatttcagcaaaagatatgctggtgggaaagctgctactgctgcaccaagcagcctcaacagagagtttgggtcaaaactcaaagagcacatgcagtactgtgtagaccaccctgaagagataaacaagctcgctaaagtgcaagcacaaatttcaggaagtcaagaacgtgatgatggaaaacattgagatggttcttgatcgcggggagaagattgagctgcttgttgacaagacagagaatctccgctcacaggcccaagatttcaggcagcaaggaacacaggtgaggagaaagatgtggctacaaaacatgaagatcaagctgattgtcctgggcatcatcgtcgcgctcatcctcatcataatcctgtcggtgtgccacggattcaactgcggcaagtgtgagtgaggaccactcgaggtcgtgagacacattcaactgcccttatattcactgctgaattcgagcaaaaacccatatatggtgcttagtgttctttttttgttaagtgtgcgctggcccgggccgtggtgcctgtgggtgggtctgtgttttcgttgtcgtgggtgttgggatgttcggttaccgctgggggatgggtggttgggtcggcgggtcgtgtatttttggacgctatgtatgtatagcttggaatcttgacatctttgttctattgttatatgatgatgaggatgagtagtagatttacttaatcggagtcggaattaagaagatatcactcagcataatga

SEQ ID NO: 9564 - DNA, 783 bp, Triticum aestivum
  Clone ID: PAT_TA_9564
cgtccgcggacgcgtggggcttgagcggcttagcctccccattcccacggcacctttcgtcgagcacctggcaatggcggcttcctccccgtccgccacctctcagatgcgcctaagccccctccgtccttattaaagaccaccgccgccgccgctttccttctatccaactcccgcaaatccctacctaccccgctcgcgttcgctcgcttgcgcccgaactgcccgcatctctcgcgggcacagacccccgttccggtccttgcctctgccgtttcgtggctagtggatgcccctgcccttcccctcccgcgaatccaggtgattcgcatcaccttcgtgtcgtcaggatccagttcgtgcgcaatgtcggcggtggcgccaccgctgtgcacttggatcgtcgccgcctgcttgtctgcaacctgcgtcgctgacgatgaagggaagcagcgcaactacgtgggcggcgggcttttcggcacgcgccggcaccttgctgcgcgccgcggaggcggctcacgctctggagtgcccattgctgtttcctttcatcctgaaagaggaggtgtggaaaacaacagatctgaaaccaaagaacggagggtagttgtcactggcatgggtgtcgtgactccgttaggccatgagcctgatgagttttacaacaacctcctacagggtgtcagtggaataagtgagatagaagcatttgactgttccagctatcccacgagaattgcaggagaaatcaaatccttttcaacagatggttgggttgca

SEQ ID NO: 9565 - DNA, 826 bp, Triticum aestivum
  Clone ID: PAT_TA_9565
gttcggttcgagcaatgccctcatgctgacgagtgacgactccaccaacataagaagaagagcacccatcccagtcacaagtccctcgcatctcctttccaatcctagttccatacttccattgctgcaagaaagcgtctaggtaggcggcgcggtcagcaagatggcgaggggtggcagcgccgtggctgtcctctccttcctcctcggcctcccgctcctctccgtcctcgtcgccggcgaggatccgtaccggttcttcacgtggaacgtcagctacggcgacatctacccgctcggccgtcaagcagcaggggatactgatcaatgggcaagttcccggggccgcaggtagaggccgtcaccaacgacaacctcgtcgtcaatgtcttcaacaagctcaacgagccattcctttctctcctggagcggggtacagcagcggcggaactcgtttgaggacggcgtggccgggacgacgtgcccgatcccgccgggcgccaacttcacctacatcctgccggccagggtccagaccggctccggcttcctcctcccctcccccgcctccccccgggccgccggcggcggcggcgccggccgcggccgcagccgcccctccctcccgcccccccgcccgcctccccccgcccgcttcaccccccccctccccgtctggtacaagaccaaccataccgatttgaggtacatgctcgacagtggcaaggcacttggcttccccgatggcctgctcatcaacggtcgcggctggaacggctacaccttcaccgtccagcccggcatgacgtaccgtttccggatcacc

SEQ ID NO: 9566 - DNA, 1018 bp, Triticum aestivum
  Clone ID: PAT_TA_9566
aacgaaattttctgccgttacgctactctgtttattgggttccaccacattcactctacacgcgggcaacgacatttctatgtgcagcgatacaatcagtcacccaaaaaattctacccccaagtattccgacaggtaccgcccaaaaccgccccacacgttctgtccctcgtccctatccccgccgctgccgaggaccaaccaaggcagcggcaccacgataaacactcagtctcccaaacacacctcaagcaacatctcgtagcccatatagctcctcatcctctgtagagtgtaaagatcccaatctcattctcactaatctatccatgaaaatgaactgacataagttttagcatgccaaggaaaggagatggtagcatttggttttgccagggtagggaggagctcggacagaaaaaggagccggtggagatagcttattagccttgcatgcaaaaataacatgtcgaaggctgggaggagatcgtgcgcggacggtcagcgtgtttgcttgagcgagctgatggccgacagctatgctcgagtgcagacggagcgccgaacttgagtttgataggaagcggcatagctcggacaaatgcctgagcggccctctgcgcctgcctggtcagcgtgcgtcaccgccttcgcctcgtcgcggaagttgtagtaccgttatatgcttggacacagatttttgagatagattattgcttgcttcatggactcatgcaatcagagtatcatagtatcattaacaatgacaagagcttccgaattaagtaaaagattgcttcacccttcttgaatgctttttcagagaacctgacaaacttaagtacctctgcaaactatcctccgaagccattcgtacaccactttttcccgaaccatgatgctgagacaggactaagagtatcactcaactcaagcaagtgccatgtaaagcaaccagtgaatatcatttaagctagctgataataatgacaaattatattggtcgacgcggccgcga

SEQ ID NO: 9567 - DNA, 708 bp, Triticum aestivum
  Clone ID: PAT_TA_9567
atataaatgggtgccttcttcatagaatgcagaccctggtcgcaatcagtcatgatacatatgatagggtacgtactctgattacatagcatcctaattaatccatcacactctacaagttttcttttgcgggtacactctgcaagttataacaaagatagttactggaattgcaagtaaggaaatgcagctgtcttctcttccttgctgaagcctttgtccattcaaaagctcccacatatcctttttcttcacatggcaaccctgtgtcagtgtgtgcagaggaggttcaggatagcggcacacaaatttccttgctggaacctgaacattacatagcaggttcacaaatttactactcgtattgtggcacacaactccaaaacagcagcttcgtaagctcatgatttagatgctgtgtaaattaagcatgacaggtcaattctgaactacatatggcaatctcacttttaggaaaggaggatcatcatacacatatatagctcacttcatctggggcaggggctatgggagaggatttcacttgaaacggaagcaatatatacctgactgatgtgaagcgttgtcccagatgtattcacaagagtctagaagatgtgctcaaccaaccgtcacaaaaacaaataaattattattcgcctaagttggtacaaggaatgtacaggtgccaaaatctcatcacaccag

SEQ ID NO: 9568 - DNA, 653 bp, Triticum aestivum
  unsure (1)..(653): unsure at all n locations
  Clone ID: PAT_TA_9568
attgtgattccttactgcgcatgctggtgatagatacctatgaaatacttactccctaagaccnttgtcggacggagggagtagtgtgttcttggttttgcttgatttaattaccgtttccctttacaaaatcaaattttcttatcaacaaacttgatggtgtagctgctcttctcatgtcaacatggattgaacaaatccacacctgtgtgccacagccacaaaactgagaccaaatacagaacctcactcggtcagtccacgactggtgctgcctctgacagtgaatcttctttgctaaacgtggcattcgatgacattggttccctgtaccactcattctcctcgcgagtgagaaagcgagcctctgacacaaaaacatccttgtagtcgtcatcgtcatacacaaacgcaggtggatctggggaaccaattccaactatagtgcttccacttcctgacataaaaacagcgctgtaatctccccggttggatgcaataaatcgtttcttcaacttctttagtgaacgcaacacctcaaaagctggaggctctagatcatttacacagacatcttgtgatatcccgttttgcgtaatctccttgagcaaagccagnnnatcagctttactagtctggtctaaccggagtcg

SEQ ID NO: 9569 - DNA, 1000 bp, Triticum aestivum
  Clone ID: PAT_TA_9569
gatccccgggctgcaggagagaatatgtacttcagatactagcactgaagctggaggacagctgaagctgctgagcagctactgtgcagagattggtcgacacgatgcttatattcagcttttggatttgtatttggacccgaaaaacgggagagaaccgatgtttacagcagctgtccgacttcttcataatcacgggaaatctttggatcccatacaagtattggagagattatcctcagatatgcctctccagctagcttcagatacaatattgcgaatgctaagagctcgggtgcaccatcatcgccaagggcagatagtgcataatttatcacgcgcgacgaacgttgatgcacggttgacaagactggaggagaggtcaaggcatgtgcagctaaccgatgagagtatctgcgattcatgtcgagctcggcttggcaccaagctattcgtcatgtacccagacgactcggttgtttgctacaggtgctaccgaaaccaaggcgattctgtctccgcacggggccgtaacttcaggaaagatgctatattcaaacaaagctggctcgtcagtagatagcaaagattgaccagcaaaactcgtacagacactctttttgccatgaacaaccgagagaggttatgtgtaccacccttgcagttcaaggtacatgatcctgctacagttccttcgaagtgctctaaagcgtgcaacatcatcagctgctttcgatggcgctgttacttcattcacccggggccgtcaacagtctgccatgtgtatgcgatggccctgggggctggctggcacactgttttcccggaaaatgtcagaggaactcggattccttttcttgttttcccagagcacttgaaaatgggatgcaacttgcaggaatagtttgttagcgttaacaccgtaaatgtgtgattgtaattgctgagctgagagatagaaacgacggacatcgacaatggaacataccaccaaacaaaa

SEQ ID NO: 9570 - DNA, 406 bp, Triticum aestivum
  Clone ID: PAT_TA_9570
tcgagcggccgcccgggcaggtcggcaacgaaatctcgtatgcgcgagaggggctcggcggcccccacgggagcttgtggaccaagggctccgggcgggaatactgatggttggagctttgtcggtgtcttatattattgcagtatagagcctgtatatcggagcttgtcgtttgggttgctatataattaatgtgatgttgttgtggagagtgctactcgtcttaggttttccttgttttgtatccacacaggtgatgccacgcggcaaggtcctgcttctttgaggagtagtgtatataggagaggtgcatttcggaattgaggaaagatatgcttgttgcagctgtgtttcatatatcaggctaatgtaaattttgaagtttattatcagcaaaaaaaaaaaa

SEQ ID NO: 9571 - DNA, 584 bp, Triticum aestivum
  unsure (1)..(584): unsure at all n locations
  Clone ID: PAT_TA_9571
caacgatggnaccttcgcctcgccgccgcctcccgcaaaattggccgccccgactacgtcctcctctgcacatatgggtgcagcgacgcggtggacattaacaagaccacagcgtgcgtctcgctgagcaaaatgggatgcatcaaggtaaccatctcaaaacaagatctgccatcgatctcctacttccatgttacctgtcccgacctcacagagaaccccttcacccaaagtcctgagatcctttggtcgtcggagaacttcatcctcttccgtgtccatctcgtgggacccggcccaccagagttcttcctctatatggtcgaaggcccggagttcaagaggccgatgcttagtctgcttcctgactttggctcgtattgtgttcgcgagatgctagatccataccttgtaggcgtcgttcccgacgatgacggcaagagccattccgtgaccgctttcaaaaggaaggagtcagcggattgcgaactccacatctacaggcttgaaggcagtaccgggacctggagcaaagagcatattttcccagatttcccctcctgggcacgttcaggggtttttcc

SEQ ID NO: 9572 - DNA, 385 bp, Triticum aestivum
  unsure (1)..(385): unsure at all n locations
  Clone ID: PAT_TA_9572
ggtcagcatcgacggagaggaggtggcgggggtgcggcgagttgggtggggattccgcggcaaccgcgcggtcctgctggccgacggggaggtggttgacgtcatgtgggatgtgcacgactggtggttcggccgccgcggcggcggcgccggggcgcagttcatggtgaggtcgagggcggaggaggggagactgtggatggccgaccagccgtcggcagcaccgcccggcggcgtcttcttgcatgtgcagtgctaccggcgttgatggttgacttnccttgcaacaaccatttcatttcatgattttnctatattgagttgctncattctgtncaatgtacttcgtcaatgaaatacatgtagatattgttcaaaaaaaaaa

SEQ ID NO: 9573 - DNA, 966 bp, Triticum aestivum
  unsure (1)..(966): unsure at all n locations
  Clone ID: PAT_TA_9573
accggcccgccagtccgcggcccacgcccccttctcccttctctcaatcccccaaaacccacgcgaatccaccagccccttccttcaacttcctgccccttgtagggtttcgccccccaccaacccctaccccccgggttactgctcgtgctctcagccatggcgaccacgaccttccccacctcgacccccttcttcgtccaccacggcacccggcgcccctccgtcaacctccgaacggccgcggtggtgtacggccgtggtgggcgggcggtggcggccactgcgcgtcgcctgcgagaaggtggtggggatcgacctcgggaccaccaactcagcggtcgcggcgatggagggcggcaagcccaccatcgtcaccaacgccgagggcgcgcgggaccacgccgtcggtcgtggcgtacaccaaggcccggcgaccggctggtgggacccagatcgccaaggcaggcgcggcgggtggtcaaagcccggagaaacaccttacttctcagtccaagacggttcatgcggccgaaaaggtaacgcgaagggccgccggaaagagtccaacgcacggtttcctacccgcccttgtccgggacgataacggcaagcgtccaagctccgacttgcccagcaattggcaagcagttcgccccggaggagatctctgcacagggtcctgagaaagctggttgatgatgcatcaaaagtttttaaatgacaaangnnnccaaaggnnggggancancaagntncctggtttattttnaatggactnccnanaaggaangggttncaaaaanaangcccnggcccnnattngnaaggccctggatngttnntnccnnnannatnaaannanncctnnccnnggggnttnnnngggnanaanggnnttnnaaaaaaaangaacnanngnanncaanttntggtttttgnaccngggnggnagggnnccntttt

SEQ ID NO: 9574 - DNA, 529 bp, Triticum aestivum
  unsure (1)..(529): unsure at all n locations
  Clone ID: PAT_TA_9574
gcgatttcggagaattcggaggcatcaaggcaacagagcgcacagcaaggcacaacaaaaggcgggcaaggnagggcatcaaggcagcaccaagacagcaggctcaccgacactgcagcagagcgggcagaagagacggcgaaccggcgacgacggtgagcccagagcagaaggcatggcagacaagctgctggagatcctagagcggaacagccagctcgtggcggcgcagctggaggcgcagaacctgaactcggagcgcgaccgggaggagaggagagagcaggccaacagcctcgccgtcgtgctcggcaggctcgccgatgctcttggcaggatcgccgataagctctagctacctggactggagctgcatgcctggacagaagaagttgggtgtacagattggtataggaggatgattactctcctggcatttgattcctttttnctnctttgtgatgaacttgttnccggaattcggtnccggaagggtgggggatttatncatgtactgtatgtagggtaa

SEQ ID NO: 9575 - DNA, 341 bp, Triticum aestivum
  unsure (1)..(341): unsure at all n locations
  Clone ID: PAT_TA_9575
gctcgccctcgccgagcagcgcggaagtcgaggtccgggttccgcagacgtggcagcagnaacggcgggcaggaaacaggggatcagctctgggacggcttgcaagacctgatgaagctagacgagagcgagctctggttcccgccctctggaaattcttgggactgaactgaacctgcttgattagatcctagccgttggagtgagtggacaagaccatttcacttttttttcttcctttttacctctgttgcattatttggacaaaacagagtctgtgaattataagtaggattgtacgaagattgaagagtatacatattaacaaggcaaaaaaaaaa

SEQ ID NO: 9576 - DNA, 662 bp, Triticum aestivum
  Clone ID: PAT_TA_9576
attcggcacgagaggagaatggccatgtgcaacgtcaacgatttcttccgggagtacattgtgtcgcggcgaatggaggagaaccatgtgtttgcactggaggggaggtgcagccagaccacgcggcgcactggacggcacctggtcatcgacaaaagctgggacggggacgagagcgtgttcaacaggatcgagttctcgcgactgcggtcggtgacggtgttcggaccctggaagccattcctggcctccgacaagatgagggtgctccgcgtgcttgatctggaaggcactgagggtctgacagacaacgacatcaagaacatcgtcaaacggctgcctcgactaaagttcctctccctgcgaggatgcaagcacatctttcggctgccaaaatccctgggtcgcctgaggcagctccaggaccctgggatgtgaggcacactgccgtagccgggctgccagcgaccgtcgtgaagctacagaagctgcagtatgttcgtgccggcaacacaccagaggagtatgccgtcagcgacagcacggaatctagcacctcagtacccatctgtttctcatgtggccctgttggcaatcacattgtccgcgttgaggtgcctcgcggggtcgagaatctgaccaacctgcacacactgggcgtc

SEQ ID NO: 9577 - DNA, 711 bp, Triticum aestivum
  Clone ID: PAT_TA_9577
cgagagctcaggggaagctaagcctgagttacgcaggtcgaaggtgcatctaagatgcgcacctgggcagtctatttctgccatcaagtttgcaagcttcgggacgccctctgggacttgcggaagtttcgagcaaggggagtgtcattcaaccaagtcacagactgttcttgagaaatgcattgggaagcaaagatgcgccgtcgccatctcccccgacaacttcggtggagacccctgcccgaacgtgatgaagagggtggcggtcgaggctgtgtgttctcctggtacataggcgactccttcaactagactaatttaatgacggcgtggccttgtgcgtgaccgatcgagcacacgggaggtgatgtggagacgagagttcaactgtaaagtactaccgactcgatgtagacgtggctggaggatttagaaggtcatttctagcatattccgattcaaattagggtccgcgctttaccctgcatccccatgaattgttcaaaaagcgaccaactgggaatttgcgcttggtcccccatggagtgtggggagagcagaggcaaaagattgatgcattcttttgcttggtatgttttggctgtgtcatctttcttgaagaagagaagatgctgtatccttccttttgaaaacacttgcttttaattgtgcatgctgtgagcatgaacatgttgttggtcaaaaaaaaaa

SEQ ID NO: 9578 - DNA, 660 bp, Triticum aestivum
  unsure (1)..(660): unsure at all n locations
  Clone ID: PAT_TA_9578
caccccctcctcctcctctgtccgtgctgaatctcgagccctgcatcttttggcgcggtgagccttcccacacatccgcccctgctccaactgcaggtcctcctccagaggacgacggcggtgccaaagggccccacatcccaactggaaggcagatccctagacccagatcccctcccttcgcagccaaggacgaggccctggattccgtcgccgaggagctggcggttgaggttgaggaggagatcgcggtggtgtggagaaggtctaggagtacatggagccgtcggaggaggccaaggtgacgtttgcaaccttccctatgacgtcagcagcgagcgcctcgcgcagctcttcgatcaggctggcgtcgtcgaggttgccgaggtgagcatctcttcctcttagaccatcttgaacgctggatgctatcaaaaggtgctgggatttctttcccagtcgatcggccaggatgcatcaagcgcttgatattttccttcgcaggaggtagaatactaaaggtatttgaagtctgtaattagcgccctacttagcatgaagagttgacagagagcgcatttagatgatttttaattttgatattgtatnctatttttttaatctctaagtgtnctacacaagcgacccgcatctatcagt

SEQ ID NO: 9579 - DNA, 916 bp, Triticum aestivum
  Clone ID: PAT_TA_9579
gcacgaggtggcagctcacaacataatttgcagggatgagcgacggtggcgactccgtctccagcgatgactgcatcgacgactgccttgaggcctgctgctgcgactgcttctgggatcccatctgcttccgcatcctctgcgctctcgtgatcctagccgtcctcgccaccgtggtcaccctgctcgtcatcgccttcgtcccccgccccgtcggagtcagcgtcgaggacgcggccctcacccgcctcgacctcgccgtcaagaacgccacgtccaccgcgctctcctacgacgtctccatcgccgtcgccgtccacaacggaaacttgttcatgcccgccgaacacaccgctggcgaccgcaggggccgtggtccgaccgcggcgcaggaaagtgtaccacgccacggcggcggccgacagcgtgagcgtcgcgctggggagcgcagacgtggccgacttccacagggagagcgctgccgggctgttccagctcgaggtgaagattgtcggcgaggtcatgtaccggccacaccacaagaagcacaggctggacgcgatctgccggctagagttggctctgtcaacggcaacctcgccggcgatgttcaagaaggtcaagtgcgatgttcagaaagagcattgatgctcaggatcgaagctacgcacggtggttcaagttctctgttgcccctctcttgacgtagggcctgttgcacggctgatggtttatgtttttctagctaatgtaattaatgtggctggctgttctaacaacccgtgtgctagttggtaatttgtgttcttagttttgcgtaatttgtgtggctgttctagtagtaccccgtggtgcttggtagccaatgtttctggctgatgtaattggggtcgccgagagctgaacccatctcaag

SEQ ID NO: 9580 - DNA, 1259 bp, Triticum aestivum
  unsure (1)..(1259): unsure at all n locations
  Clone ID: PAT_TA_9580
cgccccaacctccctgtcgaccttctgccgccaccacacctcaccaccgtcgccccaatcccctcccgcgcgctgccgccatggnatttcccctgcaccctcgtactgcacggnagccgcgcacccctcgtcacctcttccccgcgtgcaccaccatccatggccgaggtggatccactacttccttctctcgccggccccggcccaccgctcccccagaaacccgcgaccacttcccaccccactacggcgcccccacctcccaccccgcggccacgccatcacccccgaccacatcccaccccacggcggcgcacccactcccgaccacctcccaggctcccaccccgtggcctctacgtctccccttcctagtggcccctgatccctccaccttcctcccgcggacagcaccccaccgccgccgcacccaacccagcttcctcgtccatccgccggaccagccacctaccagtgttgccctggcgcgcaccacctccgcccatcgctgtcgcaataagcaccgcgccggagacctttggatcttggcagccgcgtcccagcctcccgcgacccccgcagccggatctggctccaccttctcccctcctccatctgcttgccatagaggggagccccggcctcaaagaaaaagggagcttgtcagcaacgggggacgcatcggttgtgtttgcgctggaggtgttgtgcagtttgccggcacattccctggatgcatgcgaggggagtcaaacgggggcaccgatgcaccgtggaagagcagtagtggcgctttgcaattcagaacaatggttttagcatttttgcttttgatttcggtgtattcagtgcagtaggttccttgacgcagtccggtgattcaaccatctcttactcagtatcggtgtcatgcagttcgctactgtgatgcatggtgtttgattttattgttcagacttgctcaccgggttcccgagaggaggatcacgccaagacgtttcagcagcacacccacttgtagttcagtcggcgaagggttgagggccaccaggagactgacggcgagccagccatagcgtccactattagtcggcgaaacaatttatgcatcagtgtggacttgaagttcgtcggcgatccactagcggttggagcaacaagggcatgcagtccgctatttccttttttgtttgtnctttgacatgcnctcgccgaggacacatggcctttnctttgcggtcattcacttgnacggctga

SEQ ID NO: 9581 - DNA, 857 bp, Triticum aestivum
  unsure (1)..(857): unsure at all n locations
  Clone ID: PAT_TA_9581
ngagggcccgcgccgccgcggctggcccctccgctccggcgactacgccgagctctgcgaccgatgctatggttcgttcgagcatgggaccttctgcgagaccttccactcggaggtggccggatggaggaaatgcgaagcgtgcgggaagaggctacattgtgggtgcatcgtctcagtccattccgatncgcttnttcaaccccgcggagttgactgcattcctatgtgctcgcaagtcctatgcggcaatggcaccaagtcagatgtggtcaactcctactgtgcatatgcctcaaaatgttgctgacagaaaagacagttatgtaaagagttggagacctcctacgggccagatttcaagtcagtggcgacagaatcaccacctgtggaacatgtccactatacaaccggacttgcagcaacgtcgagcttatgagtttgataggccaagtggcagtgaaaaattacctccagggcgcacttttattcatgcccaggcaaaagaaatccgatgacatgcatgacagaccaacaacacctgctggcatgggcctgattataagggacagatatcccaatgggctcggacagcagacaagcatggacccgacacactcctcgacgccctaccagagagaaggaccaattccaaatagccttcaggatcctagtcaccatgtaggagaaagcgatcctttgtcttcaaggaaagggataatttcagatggtggttctactgtatctactggctttaagcttgattcacatcatccatccattctaaaggatgatgcggcgtnaaccctgccgacaatgggtggctacactatcactaattatccaccggtacctgg

SEQ ID NO: 9582 - DNA, 588 bp, Triticum aestivum
  Clone ID: PAT_TA_9582
tcctttcctccaaaatttcacatcgcacgcaaccttctctcgtgccgccgccgccgccgccgccgcctcttctctcccccgattctcctcgcgactgctccgagcccctcctcttccctgtgtcggctgctcgacgcgccaccgctgcgggagaaggtgaacacgaggagatgcagggtgggtggcctcgccggaagagggtgacgccgggaaccaccggctggccaaggaccgtgtgggctggcacttccccgcggcgccctccttccccgacttcgccgtcgccactgccccctcccctcctgtcaaggctgagcgtgcacagagtggacgagtcgatcgcggcggaaccagagtcactcgaggccggggtgcgagatgatgtccagcaggcggaggggtggccatgggaggagtagcccacaatgaaatccattttctctttgtgtgtgtgtgtgtgtgttggatttggatcgaggaaggggatggcgtggggatgaggcggtggacagaggaagagggcgatgctggctggctgagcgggcggatctggtagagcggccagaggagcaggccaacataacacca

SEQ ID NO: 9583 - DNA, 983 bp, Triticum aestivum
  Clone ID: PAT_TA_9583
gctataccagcgcagccgccgtcgccgccgagctagggttaaggttcaactgaagaaactgatctccctccctcaaggaccttcactgaacccaatcgcctctctctccctcttctgtaccaccgtggcaggcgagttaggtggtggctcattgtgagtgtgcattggtgactcaatctactgccgctgtcgtctgcatcaactcaaggatcttgtgtggtctgcttcgtcctgtagccgtcgctgtcgactccagctgccatggtgccggcgttctgttcgcggacttccggggtggtggtgcctacgcctgctctcagcacgacggtacacctgactccgtcctcccattcccttgacgtgtgtttgtagcggcagtggcccgtgtgaggactattgtctgacgcagtctctggcctctcctgtcactggcccctgctttttttggcaccagctgtgcttgactgcccgcttgctcagcatcacataacacttgaacctgaatgtcccggtctccatgtgtacatgaattggtatgttgatgcagtctaactatatttctgtactttttactagactccagcagcgatggttccggtgaagatttcgggaacttctgtggtggtggtgacaatgcctactcagaggacgaagatacaccagacaccatccttcgattcccataacgaatgtttgtagcagcagtgatacgtatgaagattattttcatacatattttcaggccacacaagtctcaggctctagttatttttggcaccatgtaaacaagaatgtacacttgtcaaaaaataaaatagtatacaacattttttgtagttcagatgggtggttgttgtatagtttatgtgcatgcttgtgatgctccaatgtaaaatacagcaatgttcttgcatggaagcatcaaaagaaatgtgttcagagatctttgcttcgttacagtgcggaacatcattcgctgcagt

SEQ ID NO: 9584 - DNA, 951 bp, Triticum aestivum
  unsure (1)..(951): unsure at all n locations
  Clone ID: PAT_TA_9584
ctctgcggggccttnctgtctccgtgtggcggncacggngtggcacacgtccaccttcgggtccctctcgtcgaccacgaagcttctcctcgtgctcggcctcctggcgctgtccatcatcttcgccgtggcggccgtgctgaaggcgcggtctctgaagcggtcggcggaggcgcgtgcgtggcggatcacggcgttccancgcttggacttcgctgtggacgacgtgctcgactgcctcaaggacgagaacgtgatcggcaagggcgggtccgggatcgtgtacaagggcgcgatgccgggcggcgcggttgtggcagtgaagcggctgtccgccatcgggcgctccgggtcagctcacgacgactatggcttctccgccgagatacagacgctggggcggatccggcaccgccacatcgtgcggctgctcgggttcgcggccaaccgcgagacgaacctcctggtgtatgagtacatgcccaacggcagcctcggcgaggtgctccacggcaagaagggtggccacctgcagtgggcgacgcggtacaagatcgccgtggaggcggccaagggcctctgctacctgcaccacgactgctcgccgccgatactgcaccgcgacgtcaagtccaacaacatcctcctcgacaccgacttcgaggcgcactcgccgacttcggnctcgccaattcctcaacngcaacgccggtggtccnaatgcatgtccgcatcgccggntcctatggataatcgctcccgagtaccctacctctcaaggtggacanaagacgactgtaaacttcggtgtgtgtgctggactctgacggaccaagccgtggtgattcgnnacggntggcatctgnatggtcggtggcacggnttacaaggagntnataaatnccnacncctccaagtcctcanantaanaattnaattcangctggtcgg

SEQ ID NO: 9585 - DNA, 597 bp, Triticum aestivum
  unsure (1)..(597): unsure at all n locations
  Clone ID: PAT_TA_9585
ttcggcacgaggcacgagtgctagacagcagtaccgtccgggcaaaagccacctgtatgtgcaagattggttgccgctttctccttctctagtgcgtttaggttccagaaagctctggtgtgttttcattagggtttgcgcctgcgcagtttggttggcgttggactctcttttcttgcggtggaatttcgggaaatgctccgggttccaatcagtggcgaaaatctctcgcgggtttaagcagagacaaggagaaattgccctgagaggtaaataaagatggagatgcctgatattgaagctggcacggtagtcaccgattctgatagttcaagaaggccaccagccaatactgcgacatcaatcccaaacagtggaaatttagaaggttcaagccacagggccacaaagaccaccaggttcaaagacgaagacgacggggttgttgagattacccttgacatacaacgcgattcagtgtcaatccaagatgtcaggccagntgacgatagtggctcagcacacagcggngcactggtgtcaccttcctcatcaaggggcggcaagctgncatcgaaactgagacaggngacgaac

SEQ ID NO: 9586 - DNA, 300 bp, Triticum aestivum
  Clone ID: PAT_TA_9586
cgaggatctgttgttaatataggcacaataacatcaatcaatcagcaatccgtaatagccccatctcagatccacagagtcagctgtgttgactgactacacggaactctgaggcctatataacgatgagaaagaattattcatgttattgtgcctatattaattccagtttatctgttgttaaaaaaaaaaagtgcagaagctggagactgagatcatctatctcatgaacgggtgccttctcttcctcgatcttctgtgcaaattcgttttcctctcgcaacctcttgtaagtgatct

SEQ ID NO: 9587 - DNA, 1034 bp, Triticum aestivum
  Clone ID: PAT_TA_9587
gggtggtgccccccgtgccctgctctgtcctgggaggggacgggctttcaagccgcggatcttgagccgcctaccggctaggtcgcatcttgcagattctgatctggtgaggcaggccacgggagaatctgagagatagcttgttgttagctctactctccgcctccccgcgccggcgctgcgtgctgattctgatctggtgaggcaggccacgggagaatctgagagatagcttgttgttagctctactctcctactcatcgtgccaggaatgagagatttgttgtcaggttggatgaccatcttctctgtcgtcgttgaggtggagcagtatgggccgagagtctgcaggttgaggcgagctatgggcttcctcattgctggtgctgtcagcttccacctatgtaatgtgctacggctttaaatcattcctagttcctccatagtggctgattgttcacatgtatttttatttcttgttaccatatattagcaagttatattacttgtatgtgtattaagacaaagcaggacagcttcctgcccctatcgcatccgtcgctccttgttatggtgtttgtgaggctctcagacgccatccatcatgccattattgcatccatcccactttgttatgttgttcagcctcacatggagcaagatggatggattgtgcccgatccgtgtccttgtagtccatgccaaaaaaaaaaaagatttggcttcctgggcgttgctggacgtggccaactgggtgtctttatttgctagtgttagccgattgagtccgtgtgtaaatttgcgtgcacgcgttccaatttgtaataattgtgtgcagtagaatccatatcatgtactctctttatttggtgtactttctttatttggcaggtatttgtggttgtctcggacacataattgaaaaggcatgtttaggaggcgtgtcagccatgcgtggcaaacaaattatttgtacctagcaatagttgtatgtaactttgtaatcctttaaatctcaaaaaaaaaaaaaaaaa

SEQ ID NO: 9588 - DNA, 618 bp, Triticum aestivum
  Clone ID: PAT_TA_9588
aatctccctcccaaccaatccaccaaggaaaccccgatggcccgcacgaagcagacggcgaggaagtccaccggcggcaaggcgccgcggaagcagctggccaccaaggcggcgcgcaagtcggcgccggccaccggcggcgtcaagaagccgcaccgcttccgcccgggcaccgtggcgctccgggagatccgcaagtaccagaagagcacggagctgctcatccgcaagctgcccttccagcgcctcgtgcgggagatcgcgcaggacttcaagaccgacctccgcttccagagctccgccgtctccgcgctgcaggaggccgccgaggcctacctcgtggggctcttcgaggacaccaacctctgcgccatccacgccaagcgcgtcaccatcatgcccaaggacatccagctcgcccgccgcatccggggagagagggcctaagatcgtgtctgtcttatctgcaggtgtagagattagcatgtgttgcgtggtgatgtgatctggtattgtggtaggaagatccctcgttcgtgctatgttaggtgtgttgtgatgttaccatcttgttgtcatcagcaatctgaatgaaagctggctatcagatctctctcc

SEQ ID NO: 9589 - DNA, 1133 bp, Triticum aestivum
  Clone ID: PAT_TA_9589
cggcacgaggggtaagcgggtgagctttgctgattctgcggaggtgtttagcatcgaaggtggtgataatgaagaggatgccagcagcaatgaatcgaaacgtgtgcatggtcgatttaccccagaggaagacgccgccctcatggaagctatgaggggttacgcagagatgaagcaactgggagagaaaggtttagagatgattgggtcttgtcgtaaatatccagagctaaagggttgttgggatgatatagcgaaatcgttaccccatagaccttacttggccatatacaggcgagcacatacattactccataggagcaccggatgtaaatggacagatgaagaaaaagagcagattcggcggtttgtcgagaaaaatggcacggattggaaaacactggcacaggaacttggaaagagtgagatccatgtaaaacatgcttggagaagaataaaacctaagaagaaaaaaggtgctgatgatgaagaggatgtcagtggtggtgaatctgaacttgtacatggacatcggtttaccacagaggaagatgccatcctcatggaagctatgagggattacgcagagctgaaacaactgggagagaaaggcttagagatgattgggtcttgtagtaaatacccagagctcaagggttgttgggatgatatagcgaagtcgttaccccatagacctcacgaggccatataccatcgagcgcgtatattactctataggagtgctgaacgtaaatggacagatgacgaaaaagagcagattcggcggtttgtcgaaagcaatggaacggattggaagacattggctcgggaacttggaaagagtgagatccacgtaaaagatacttggagaagaatgaaacctaagaacttgaagaaaggacgttggactcaggatgaacaccagaacttgtttgatttggtgaaccttgacttgcgtctgaaagcccatcagatcaaaaatcctgatcatcggctgctttgtgatttcccttcctgggtgggcttctgtgttttggtcacgctttcctgatttgaactgtgctcacagctgttcatattcttgaatcacatgattgaatctaatgaggtggcttacttatcatctgtgacag

SEQ ID NO: 9590 - DNA, 653 bp, Triticum aestivum
  unsure (1)..(653): unsure at all n locations
  Clone ID: PAT_TA_9590
gtcaccctggcagggcacgcccaagcttcaacaacacctctgctgtgcctccccctctgcctcctagtactgctatcctctgcccaacgggcaacgggcatgtacctcgacgccggcggaaaccacgagaccttctccggcggcaccgtgcctgagagcttcagcgtacggagccgcaactcctccaacagctccggcgccggcgcggccttctgcaggctcctctccctccagatcctcgacctgtccaacaaccagctcacgggcgagctccccgactgctggtggaatctgcaggcgctgcagttcatggacctctccaacaactccttctcgggccaaatccccgctgccaaggcaagtcacaactgctccctcgagtcgctccatctcgccggcaatgacttcaccggcaccttcccgcgggtcttggaaggttgcgactcgctggccaacctcgacatcgggagtaataagttcttcggtgccatccctccagggatcggcaaccgcgttccggtcgttgagaatccctaacccttgacagggcaatcccgtggggtccgccccctggccttctcncgccccctaaactcatctgctcgtccgcgcatcgactgactcacgggccaaatccggtacattcggaaatt

SEQ ID NO: 9591 - DNA, 682 bp, Triticum aestivum
  Clone ID: PAT_TA_9591
cgttccgagaaaaaggcccgaatggctgcatctcaggtgaatggtcctgtacttgttgaggacacctgtctatgtttcaatgcgctcaaaggtttgccagggccctatataaaatggtttctagagaagattgggcatgaaggtttgaacaatctgctaaaagcttatgaagacaaatcagcttttgctatgtgcatcttttcccttgctcttggaccagaagaggaaccgatcacatttgttggaaaaacagcagggaaaattgtacctgccagaggccctgctgattttggatgggaccctgtattccaaccagatggatttgaacaaacgtatgctgagatgcccaagcctgaaaagaatcaaatatctcatagggggagagctcttgcactggtgaaagaacattttgcttctgccaattatgaagttcagggtgacggattggcttaaacttcgttttcaagcaccaaatgaacaaaatctaatggaatatgtgcaaaagattcatgtctctgttatagttacagaatcttccaagctgtactcatttctcctgcaacttttggtgactgttatgagattgtggatgtattctagatgaattttggtgactgtcatcatgtctctttgcctatgaagcagagtgatggacaaattacttgaatcagtttgccagttg

SEQ ID NO: 9592 - DNA, 944 bp, Triticum aestivum
  unsure (1)..(944): unsure at all n locations
  Clone ID: PAT_TA_9592
caccgcgtcgctcccgtctcacccctggaccctcgcaccacccaacaccagcctttctcccgtttcacgccggaagcagagcaccacccaacaccgcatcatgtcgggcgcggcggcggcggtggcgcgagtgctgccgaaggcagtgaccttcgtgacgggcaacgccaagaagctggaggaagtccgcgcgattctcggctcctccatccccttccagtccctcaaactcgacctgcccgagttgcaaggtgagccagaggacatatctaaagagaaggcccgaatggctgcatctcagatgaatggccctgtacttgttgaggacacctgtctatgtttcaatgcgctcaaaggtttgccagggccctatataaaatggtttctagagaagattgggcatgaaggtttgaacaatctgttaacagcttatgaagacaaatcagcttttgctaagtgcatcttttcgcttgctcttggacgaaaagagtacccgatcacattcgtggtaaaaatggcagggaaaattgtacctaccagaggtcctgctgattttggatgggaccctgtattccaaccagatggatttgaacaaacgtatgctgagatgcccaagtcagaaaagaatgaaatatctcatagggcgagagctcttgcactggtgaaagagcatttcgcttctgccaattatgaagttcagagtggcttgaattcgttttcaagcaccaaatgagcaaaagatttcgtgttagagaatcttccaagctctctctatatgtactcgtttctcctgcaacttttggtgactgttatgatcagattgtgggtgtactgaatttttgtcagatgatgttctagatgaattttttgcatcgggntaaatnttgttgttttttagttttttaattataataaaaataataaaaatggtgtcgatttttaaa

SEQ ID NO: 9593 - DNA, 285 bp, Triticum aestivum
  Clone ID: PAT_TA_9593
ggtttcgttggcagaatcagaagctggcgccattgatttgtcttctccttctccggttgtcgacaggagaaggaatggtaaccatggcaaggatgcaatagacattagtgaagctgacagtagtgtcgtgtgtcctgatgatgatgaacatgagaggaaggcgagagagctcagatcgtttctcaagagcattagagacgaactgtaataatatttgaacacacgatcaatttggtgtatttgatcgaatacatttgtgtaaagtttgcttttttaaaaaaaaaa

SEQ ID NO: 9594 - DNA, 633 bp, Triticum aestivum
  unsure (1)..(633): unsure at all n locations
  Clone ID: PAT_TA_9594
gatcccccgggctgcaggttttgatctaaaaaaggaaaagagcagtcaacaggtttgagtactttataagcagcaaatgccaccagggaatgctccatgttgtaagaaatttgtgaactctgaacctaatcaagtgcttctaacacaagcaacagttacaatgaagaaaaacccatcactggtttgtcactgccaaaggtgggtgcaggagatgatgatgatgcgctgctaatattggacatgccaggggacaggtcttcagagcagctgccgttgacttggaaaagttcaggactaaaatttgatgttcaggagaatcaaattcatcgtaaataaggggctaccattgacttgtcgttcatcgcaaagttcaggagaatctgaatgtatgttcagaactatgaaatccggtgttcaagcacatgttcaacatgtgaaatatgaaacctgaatccgatgttcatgctaagcactggtgtatactcactgagattatgttagttttaagactgctcgttgctgcatttgataaactgaatctaacattgtatcaaatggactggagacttgctcgttgccgcatttaaaaactgaatctaacactgtatcaaaggacnaagatttgctcantgc

SEQ ID NO: 9595 - DNA, 527 bp, Triticum aestivum
  Clone ID: PAT_TA_9595
ggcgtgcggcacatgaagggcccaaggagtaagtgacaggattctgttccggccttctctctaactcaccaaggtcgtccgcactagggtgtttggtcaagatggtgttactgcaggtggacgatgtgctcgagcacctggagagtgttgagaaatgacttgtgcaccttgaggaaggagcggttagaccgtgcatgggaaggaatcaacatgtgtaggtggaaagaggggggattcatattgggccatgtttgcaaggagaccatccaggacaaacaatcaggaagggaagtatagatattgaaaagagagctcggacatggtgtcgagaatggaaaggaggggtagaattattatttttcttctaaatagagtgtggttaaagagacacgacaattattgatagagagaaaaagccgaaaaatgagtttgtcgtttttcggatggaaagcatatcacatcatggaaagcatatttcacaatgcttgacatattattttataaatagaacaattgttttatcattt

SEQ ID NO: 9596 - DNA, 766 bp, Triticum aestivum
  unsure (1)..(766): unsure at all n locations
  Clone ID: PAT_TA_9596
ctcgtgccgaattcggcaccaggttctgcacgagcgcggaagaccagggggctcggcgcaaacaccagtccaccaccacctcggctcattcatataccacaaccccacctccccgcagcctctctcccaactgctgccgcttctacctccccgcaagaacggagcagagcagctcgccatggtcaggaaggagaagaccaccaccggcatgaggctcccgccccagcaccaggggctggaggtcaagatccccagcttcttccgctgcccgatctcgctcgacgtcatgcgctcgccggtcagcctctgcaccggcgtcacctacgaccgcgcctccatacagcggtggctcgactccggcaacaccacctgcccggccaccatgctcccgctcccgtccacggacctcacgcccaacctcaccctccgcagcctcatctcccactggtccgcctccgccgcctcctgctcgcccatcgccggatccgcggcgttcttcgccggcccctcccccgcggggctcgtccgccaggtcgcctcctccggggccgacccctccgccgcgctccgcgagctggcggcctatctctccgacgacgacctcgacgagttcgagaagaacgcgctagtcggcgccggctccgccgcggagaccgtcgcgtccgtgcttagacggaagggtgagcatataagcgtcgcggttgcggaggcgggcgtgcggnttctcggcgcgatcggggcgctggatggnatcgaggacgcgaac

SEQ ID NO: 9597 - DNA, 378 bp, Triticum aestivum
  Clone ID: PAT_TA_9597
aacttaaagacatgtttgcgcggattctcccttcccattgactgcagaagttatagctcaatcttggaggtctgatgattctacattccatcgatatcggaatcttcagagtctccaaataataactggcatcttgctgcccctgtggaatagctgctcctagaactcttgtggtgttgtgtgttgtagggtactagtgggttttcgtcccgtagtttgtctcttaattgacgaggaacagcgggtttcccattagtgtgtcgaactcgtttctttccctttctctcctttctttctttctgtaagacttggtatttctgatattatttgcctggtagtgaactacttatataagtttattaaaaaaaaaaaaaaaaa

SEQ ID NO: 9598 - DNA, 737 bp, Triticum aestivum
  Clone ID: PAT_TA_9598
acgaggcagaggtgcatcggccggccagcggcgtcggcgtccgaagatgacgcactggcggagggcagtgtcaatacaacatcctaccgcccgtcggtcctgttccaggaagacctgcacttctaccctgtgaagaaacatggcagcaacatgctgatggtattcaataccactgccgagtcattccgttggatgtctgctccggctacccctgagtcggccactttgtttgagatggatggcaagctcgtcctctactacatcgatgaggacatcaccatgattgatatttgtgtgctacaggactatgataatgaggtctgggagttcaagtacaagatcaagcttccagtggcagaccttcgtctgtcagctcgatcacgtggttatatatcgccggtcttgtatgagaagggtggtgtgctcatctcaatgcatagccgtcttgttcaagttgacactctgggaagtgtgaggtcagatattatatggagtggctcgaatctgtcgattacgccgtataagctcaaacaaagcctggttcgtcacacattctttccgagtcaacctggtggcgcttcctcagggggacctttcatctgatgactggttggtgagaaggtgcttcttattcttattgacattagtgttacaatgccttggagcttttctggcatgacctcattgttgtttacaaacaattctgatcttccttgtaacaataccctggatctttt

SEQ ID NO: 9599 - DNA, 473 bp, Triticum aestivum
  Clone ID: PAT_TA_9599
gatgcgaccatcagttaatgctggttccaaatccgcctcttagaggtagttcttcagctaattttttttgttcagccgaggggagagccgctggacagagatcccactgaatgtagaaggaattgacgtagttcaggctaatcaaacgtgaggttagtagcatgcaatctacttactatctagctattacgattggtaattagtgtaggctcatcaagtgtgattccatttatcttatgcaacatgcaggctactactagctagctattcttattagggattacatgtaagttaacaccttgtgcctgcaagtgagcctaactgattgtttgttagctacatatatactgtatgacttatgtgcacagtccggatgttatgtatgggaaataaaatgaaatgtagaatctatagatatatgaaatcatgccttttattttattttccctttattgcctgggaagcagtcgtcg

SEQ ID NO: 9600 - DNA, 853 bp, Triticum aestivum
  Clone ID: PAT_TA_9600
gctgttcaagatgctctggatataccagcgtcaatcgaaggtccttcagcatcatgcgagtccactacaacatccaaccactccggcgttgcttcttcctcagataataagcagcaacaagctcaagctactgagatttcctcccaatcacttgtgctggagtctgtcaagcattacagccaacaacagatgattgttcctgaggctggctcaagcattgcaaggagcacatcagaagaggttgtctttgagccgttggagcctatttccgatttgccggatgtggacgcagatggttttgacattgaagaactaatgagaatgatggaagacgacccaattgaagtcgagccggtcactggagccaacactggcgtggagttgggccaacaggaacctctgtacctggataccatggaccaaggcatgctggagaacatgctgcagtccgattgcccttacccaatgtcgggatcagagggtcgggccatgcacaaccctgccttccatgatgctgaaaaggagaagaggtacaatgccgcgtcggaccttgacgctccatcgcttcagggacacgaccacttgttcaaacagcccttcgatccatttgaagcagcatggaaggccgaagaggcgctcgagaaggagaagagggacaatcttcacgctggaccgcttggaggacacaacaacttcttctcgcctgcaagtgtctactaagtccgatgttgaaattgttttcaaagtgtatacgaggatactcactggctgatattattagttcgtccttatacgatggccacacgtgtacctctgagcaattgctccacttgttcatgtaagctaaaactgt

SEQ ID NO: 9601 - DNA, 815 bp, Triticum aestivum
  unsure (1)..(815): unsure at all n locations
  Clone ID: PAT_TA_9601
tcggcacgaggctgatttaggagttgtttcgttattgaaacacatcctcgtcggtgacgattatgagaaacttgctgcaattgaagcatatgatgcatcaagaatacgagaagtgcaagacaagaatgtgtctgcttccgatgattcttctactgctgctaccactgatccccgtagtgtacgtgttcctccagcagcacatattcgaaggcatgccgggcggctgcttaccattctctcccttctacccaactcaaagaaggaaattgtttctgatgatgtatggtgcaagtggcttgaggaatgcgcaaccggacgaattccttgcaatgatataaagttaaaaagttactgcagactaactctgttaaatgtattctgctccgagagtcaaaatacaagaagtgtttctggtgaatgtcctgactcagaatgtgagtataaaagaaagtgtcctcagtttggagatgcgctgttcttgctgaatccagaattacctcttgaggttcatttgggcaacagcggctgtgggacttcaagagatacttgtaaggatgatggatgcattgaacatagtggctctaaaactagaagcgtagaaggtcaagtgctgcatcaagacgtgtctcccctgaagttgatgcctgtttgtccatggccttcggggtgggccattcaactcaatggcggaaacttatgacaatcatcaactactaaagctggccnggtggaaantaanataaaatcctggaaaaaaggactttttggccaanacatggttcaacaaatttcccaanncgtcctcacggcaaaaa

SEQ ID NO: 9602 - DNA, 1180 bp, Triticum aestivum
  Clone ID: PAT_TA_9602
cccagctcccccccgccccccccctcctccgccccgaccccggccgcgcgcctcccgatcccgccggctcgccgggctaggtcactcacgatcgcgaaccccgcagtcggaccccaggccgcgtagaggatgggcttccggcacgtgctgatcgccccgccgccctcgcacgccggcacccgccgccccgtccgctctccgccgcctcccgcactcggccggcagcaagccggcgtcaatttcctgcccggcggccagcctttagcccgattggaggactcgagggcgggtgtgtgaatgcctcaaccttctggcattcttgcctctgcaagttctgaccacacaatcgagattttgggtatgccatgagtggatcgctggaaccgcactgttcaggtttccaggactcccaagtaaatcgccttgagataacccccgacaagcggttcctacctgctgctggcaattctcatatccgcctttttgatgtgaactcaaagtagcccacaaccggtaattagctatgattcgcatacgagtaatgtgagggctgtggggttccattgtgatggcaactggatgtactcaggttctgaggatggccctgtgagaatttgggatttacggactgccacttgtcaacgagaatatgaaagtcgccccgccgtcaacaccgtcgtccggctccctgctctgcacctacttgttgctcgcgtacggtgcggtcccgtacgggtggggggtgcggcgcctctttcacgctcctccgtgttgctcccggaggtcgccacagctctatgttctctcacaggcttgtccgatttgaagaactatgggaaatttagcattcaaccttgacttctacactgatgtccaagatctttcttatttgcaatatcatcttgagcaagctcccgctcaggcaagtacaggaaactgacgaaagagctctgtgatgtgattgatgattttagcttagtcaatttttcgactttggacatccaggacaaggaaagtgttggtaatcttgtgaagttgattgacaagagcaatggctatatattctcttccatagacagcagcgctgttgagttcagcaaaatcgcagctgcgcctcttgactgggactactacagaacagcggcagtgcaggagaagtacctcggccgcgaccacgcta

SEQ ID NO: 9603 - DNA, 1014 bp, Triticum aestivum
  unsure (1)..(1014): unsure at all n locations
  Clone ID: PAT_TA_9603
gacctccctcagggagtgctcttcatcatggttatgacagaggtaatcttcatgttgtcttctagagtatgttcctaattcctctttcaatcctgcagatttctctctctgctcgggcgggggcgcagcaattcttcgtgccttatagtccacaaaggtaaataaaggtggagtgtgagcttcccttcaacgtttgttggtcactggagtttttgtgtcggctaccaagtatttgcaagatgagaactgttgtggattagcccgcatcaatttgttcatggagacgtgtcggacagaaaagggaaaagatttaggcggcgaggcgatgaaggtccgcgcggtagaagcgaagttgtgtgcctccttccatcgaagcctatatggagggtagaagcgaagttgtggaggggccactatcggctaagaggttggcgaccttgggtaggcgtcgtcggagtgactggcttccacacattggtggctaggagtggcggtgttcttcccgcttctttggaccaagaggttggtgcctcggagcgaccgatgtggagtggcccccagtcgtgagcggtaaagctcattgcccgcatgtcgggtactgagtatttgcaagatggaaattgttgnccgggtagcccagcgtcaatttgttcaatggaggagatgtgtctaccaaaagtttggtgcgtgttcgagaaaaaggtgtagaggtttgaaggtgttgctctcaacagtcttgtatattattttcaacaccatgatattagtgtggaaatgagtaatgttattttgaccatggtcagatataatgtgtgttttggtcactcttttcttgcttccatgcaaggtagattagagaatgtagccatttgtgctttaccatagttgttagttttgcagttgtgattttcttatagacttgcttgcattattgtcctgattattaattcaattgtaccaaggtatgttgtttgtatttagcttgcaatgttattctgcagaangattaaggaa

SEQ ID NO: 9604 - DNA, 1054 bp, Triticum aestivum
  Clone ID: PAT_TA_9604
gccccatcctttttatatgctgataaattgcggtggcttaatccagtgtctccatttggcagcatatatccgtgtttgacaaccctgcggagagaatcctttgcagttgccatccttattttttacctttctttcccaataactagtataaaaaactttttgtgggaacaataactagcattgtttggtttattgcagcattgatcaattataacaatgaaagatcatatctacatgcaaattttgagggtacacgagcctctttgccgacccctcaaatgtactgtagcaaatatctctgcatcatgtgttttacgctttgctccacaggtgactatccggccaatggtgcttggaacttggacgaaccggaagaagagcaaatttgccaagggatatgcatgagaatcggcgatgccatctggacgatcaagtcctttcggtcgctctaaaatggagcccgtgcttggggctcaaggattcagcgagacgatggggtctgccaagggggagccgacgtctactctcggccagcggcaagctgactctcaacagtgccatcttcactttgctgcccccggcctcacttctgcctatttaaagttgagcataattcctcgtctgctcagctcattttgaccggtggcctggcctgaccaagcactgcacaaggcgccccgactgacactcggcgaagctctggagaaggacaaattggatgaggttcgagcctcacctgtcagtttgaaggaacgctgcgtaccgacgacaagagctcgattcggtcggtgaaggccggtcctcgaacagaacagatatgttggcgtggttgggtgaaactgcttggccaaagataatttggcgatgtccaacacgccccctgtgcagcctctgtggccgggatgagccaactcgaccggatattcaagccccccttgatacatctatctatctagctggccgtttataccggtacccagcaccgtgttgtctttcttgttttgaacaaagttttagcttgctgtttatactggtatccagcgccaggtcttct

SEQ ID NO: 9605 - DNA, 749 bp, Triticum aestivum
  Clone ID: PAT_TA_9605
cgtccgcgtcgtcaacctcgccgcctaccatcccagagagaattcccccagacaaccagcagtccaccgccgccgacgagccccgggccgcgcatggagctgttcgcgcacgccaaggcggtgcggctgaagagccggcacgacaagttcctgtacgcggacgaggacgagctgcacgtcacgcaggaccgcaacggctcctccccgagcgcgcgctggacggtggagcccgtgccgcacgcgcccggcgcggtgcgcctccgcagcaggtacggccgctacctggccgcctccaccgagcccttcctgctgggcatgaccggccgcaaggtgctgcaggcggcggcggcgcccgggggccgccccgacgcgtccgtcgagtgggagcccgtccgcgacggcttccaggtgcgcctcaagtcccgcgccggcggcgtccgcgggggcggggacaagtacctccgcgccaacgggggcgtcccgccctggcgcaactcggtcacccacgacgtgccgcaccgcaccgccacccaggaatgggtgctctgggacgtggagatcgtgcaggtgctcacccccggcccggccacgcccgcgccggagaaggccgcgtcggcgccccccgccgccctcgcgcccgactcgccgcccgcgcccaagctcaggcccgcccccacgccctacgaggcgcaccaccggcccaccaagtcccagacgtccccgtcccctccgccatacgcgcccgcgcc

SEQ ID NO: 9606 - DNA, 810 bp, Triticum aestivum
  Clone ID: PAT_TA_9606
gttcgacacgcaaagatgaagatatccaggaacattgtcaagtctaatgggcaactgggcactgaatcggagattctgacaatcgatataaaacccggatggaagaaagggaccaagatcacatttccggacaagggcaatgagcagccgaaccagctcgccgccgatctcgtcttcgtcatcgacgagaagcctcatgatgagtacacgagggaaggcaacgacctgctgatctaccagaagatcgacctggtggatgcattggcaggaaccacagtgaatctgaagaccctcgatgggcgtgacctggtgatcaagctgacagacgtggtaacaccgggatatgagcttgcaatcgccaaggaggggatgcctattgtgaaagaaaatgggaggagaggcaatctgagaatcaggttcgatgttgatttcccgaagaggctgtcatcggagcagcggcagaatattaggaaggttcttggagggggagggcagcctcagcagtaatgatgacgttccggaagcaaattcagctctcccatagttgtccatgaaatgcagactaattcagatgttcttctttggttggcttgtatgtctagttacttttggtttgcgggcacttgttcctgatctgctcctttgttgaagaaatagcgatagtaattgttgactactccatacagattacggtgtaatgttaatttgttcacttattgagtcacatatttcaatagcccttgaaaattgtacaaattccaatcttcaccttcctttgtgaattatcatgtgttgcaagtaaaaaaaaaa

SEQ ID NO: 9607 - DNA, 1115 bp, Triticum aestivum
  Clone ID: PAT_TA_9607
tcgcgcccggccaacaccataacttagcaggtaggttcgcttagagttcagccgaggtttctccatcagccaagcgcaatcggactaggaaagtgtactgcgactccggagtgagggataggaaggaggaggaggcttcagccgagacccaagggagaaagatctcgtatcagataggcaactgcagcagtagagttcaacaagcgaagggggaaatggcaattggacagaccatgccgaaggggtctctcgccacgagcttgagcttcccaagcagcggcagcacaaggattctggggaggaagagggtcgctgtttctccggctccaagcccctcaggcccgcactccccggttcggactctgcgcaagcagcgcagcattaggttccacatggacgacaccatctgcctccttgaatcgctgcctcaagatgtattggtcaaagtcctgtgcaaggtgaaccacagcgacctgaggcagctcctcctggtgtcgaagccagtcagcgaagcaacagtggttgctaaggagctgcatttcgccttcgcgacgccctcgaaggcctccgcggatgcggaggaagaagacgatggccccggggcgcccaagcaacacagggttgcacggtcgcgctgccggggcatgaatttggcaagcgtcgccgtcaatctgtcggagtcgttcagcagcttgatgtcagaggtgtaggtgtacataccacggcacgaattttccccgcttgtacttgtccatcggagcgctcttttttcttcataggccacgtcgaacagaaacactttagttagtgatatgtgtagtgatcgatcatcatatgtgttagtagtaagttatatatggtcattcttcaatgctgcgattgaagaggacacgctgttttttttctgtgtactgtatgtaatagtgcaagttatatgtaagtgtctgagcgttggagctcatcggaagagtatttagtgtaagttatatgtaagcgtcagagtgttggaactcatgagaagagaagtctcttctcactttgtgtatgctgtagtgtacgatctctgtatactcgtgtgcacgggaagtttctcttatcaataaaagtaaaagcag

SEQ ID NO: 9608 - DNA, 792 bp, Triticum aestivum
  unsure (1)..(792): unsure at all n locations
  Clone ID: PAT_TA_9608
aacattttcttccagaaaacaatatcgagggtgtatgatctaaagggttccgtccgttcacgctataattcagatacatctagccacaataaagtacttttggactctaatctcatcgaggaattacatacaaagcctatatttttgggccgtaaggcgaagcgaacattggaaagagctgtctggaatgatacatcaattcttgcgtcgttggatgtcatggactactcgcttctggtgggcattgacgaggagaataatgagcttgtgatcggcatcatcgacttcctgcgacagtacacctgggacaagcagttggagacgtgggtgaaggcctcaggcatcctaggcggccccaagaatgagaccccaactgtcatatcgccggtccagtataagaagaggttcagaaaggcatgtcgaggtacttcattgcatccccgacaatggcctcttgaagatcgctccttcatctgtcacctgtcagcagaaaccgcatcgttcatcctcatggtaatttttgcaacacaggggcagccaacggaagcatcttggtgttgggtctttacaagtcacctttttagcagatcgcatcattgtggcagcttacttagctgtaggatattcatatggctcgctccatgtaaattggtgatcgacggcggagttttaacgccgagatgcgccggctccttttgatgtaacccggcttctataccgacagttgtaggacaaagatgagagattttatgacatgtaacagnctcagttacttcatctgtaaaaaaaaaa

SEQ ID NO: 9609 - DNA, 851 bp, Triticum aestivum
  Clone ID: PAT_TA_9609
ctcccccttctcaggtccggttcccgcggtcccacctttcaccccccttgctgcgccttaccgcgttggggtccgggcaaagcggtccccccgcccagctctgcgctcggcgctcgcgagggctggcctcctggtgcctcccgggcggattttgcccggttctgccgatcgcctcgcgttggttcgtcttttccgctcccgtggggtgggggctgcttcgcgctgaagcagttggcggtagcgtttctgaatcgctgatggtaggcaatacggagtcactggagacagcagtgttcaattgctaaggtcctgtatgctgtagttgtcagcaacccccagactaattttgtacagctgtggtattagtgttcacactaaacacagatactcttgagcactcaacccggggggatttcgaccctggggtgttttgcttgtgtatattagctcacggacaggttttcctgtgaagtagctcaaggatggtctcgaggctgcttttgctcgtcgaaatttgctcatggatggtctgtttgtgttctatgtttccccttgcaaacatctagcctggtggtgctaaatttgcagttatgctgaacgtgctacatgctaagcttgtttcgaaaagatttttagttgctgtaatgctaagcttgtttaaaagctgtgtcttgccatgttgttcgggtgcactgccatgttccctcgtgggcagttttatgtggtaacactatgctagccacataggttttctgtttgtttttaataaagtacacagcctgtcatactcttgtacaattttcaaattttatgaaggagcctgggcttgtttttgcccgataaaaaaaaaa

SEQ ID NO: 9610 - DNA, 449 bp, Triticum aestivum
  unsure (1)..(449): unsure at all n locations
  Clone ID: PAT_TA_9610
ggnctgcaggnaattcggcacgagggagagaactagttcgaggacccagacatgcgggactccatgacaggacattgtcgagttcagcacaaccgtggtgatgccctgtaggtccctgctccctctcaccaatggttccctgcagcagggtgccctctttagaagaggattgtggtgctcaaacgcagcaccaaccagatcgatcaacctctggccatgtaggagacctgcttgtgaggaaaagatcatttgttcgcaataaggataagataataaaaactgattggaatgttgtggagacgcctttttattttgggcttgcaaagcgaataaaggtcgattctccgtagttgtagttgcagcgatcgttcttgccgtgtctatataactatttgtagtgctaatgaactagcagtggtagatacatggggcataaagcacacttgcat

SEQ ID NO: 9611 - DNA, 637 bp, Triticum aestivum
  Clone ID: PAT_TA_9611
gcaagcattggtaagcttacaaaattgcggcgtctgcttattaacagatccacagaagtaccagataagatcattgggaaactagaagctctagaagaactggtgggcattgatatctccaagtctccaaatattctgcaagagattggtaccatgccagaactgagggtgctcagcattgccttgtggtcgtgggatgagcatcataccacacttctctcccagattatctgcaaactggctatgaagaaactcagacatctctctatctgctcttgctgtttactagatttgaagccagatttgaagccagatctgcagccggttctccaactggaaaagcttgagatacagggcagcatattcgagaaattaccaacgtggattaacggactcacccatctccgctccttgtccatcgagatctactccttggaaaataatgcccttgaagtacttggggaattagagcttcttttcctatcccttgttgcaaagaggaccgcaggagaaaagctggtgattgtgacaaatacattctgtaccctgcagactttccttctgttcagccgtgccacggcgatcgagttcgaacaaagagctatggagaaacttcaaaggcttaagttaacgctgc

SEQ ID NO: 9612 - DNA, 717 bp, Triticum aestivum
  Clone ID: PAT_TA_9612
gtgttctgatgatagtgaagaagaaaagtgtcttctaatgtggtggtgccaaacaaaagtttaatgcttatgtggagcttacttataatatgtgatcgcgtcgtcgcggccgcggtactgaagttccactccttttattctgtgtgctgagctcaccttggtatgtcaggattttttcttcatctgttacccttcctttggctgtagtttatcttcgtacagaaaccaatcttggtgttcttcctatttgcatttgattatgtttctaaaattccctagcacaactatatataacaatgtgggtatgtgttttcttctttcagtgtctatagtgcatttgcatgatgttgaattatgtgctacagaatatacattagctgatttaaactgctgttttccttcgcctaatcaaatgccctttgttttcgcagtatgcatacccaggtcaagcttgcggtcatggtgaaggtgctgatctgggtttcctatcttcagaagtaaaatgtttgcttgctaccttctttagggtactgctttctaatcaagttcttgaacacaggagttacgcatacaaatcatgtgctatttatgctctggttgccgccgtcttgtctacttagcagaatcatgtctttgtgtactaaacattagttactggtatttggcttctatgtgctaattaaacctgatcagtatgtatacttgtttgatgttgta

SEQ ID NO: 9613 - DNA, 785 bp, Triticum aestivum
  unsure (1)..(785): unsure at all n locations
  Clone ID: PAT_TA_9613
tggcctctttatngcgtatgactcttncgaacccaacaaaagagtgggcttttcctgacctatatgccaaccctaataacaattcagataagcagtctactgcatgttgcctgtctgatgttgctcatgaatcttctactggggaaggtgtttcagctgctagtggcaaggagcacaagataaatacttatagggacagggctgctgagagaagaaagctacaccgcggcttagggataggacccgggcagaagcaaagtaacggcatgagttctgatgaatatgaagaggcaaccgaggacatggactccttgggagctggaccagttgatatgaacttatgttccagtggtttgaagtctgccaagagaatcatggagaacatgggctggaaagaaggagaggcccttggtaaaagcagacagggtattgtagaacctatacagcctactttcaacaaacatggtgctggtttgggatggagtcaaacccgctgagacgttctgatctctgaacccctgtacatggtgattccagcgcacattgtttttacctccggaggattggtgtaacagattcatggtcatcgcggcagtcctgactgttccaaggacattgtattactaatgcagtaaaggtccagaggctactgtggaaattcgatttcagagcggttaccatggattcacggagttcttactccttttgtgaccattctatttcgatttgtaactataccgggcgtttgcatttgatctgacgtctgtgtgcctttctctattcac

SEQ ID NO: 9614 - DNA, 1295 bp, Triticum aestivum
  Clone ID: PAT_TA_9614
gtcaccctgcattgggcggctacatccgcttcctcaatatctacaccggcatcttcatccgcgtgcacatcccatgcttcgaggaccactccatgctcgactgccctgatggcctccttctcctacagcgcaagaaggatgttgttatctgtctcctccaccccttcaccggtgatgttgccgagtttcctccccttgcttccctctgcatgtacatgagtaagtttgggatctttctgaatggcccttatgatcttctcctgcgaatggtccacacggctgtctccgtccatgcgggtggcagtattaccattatgctcgctctcagccacgctgagcgcatggcatacgtatccactggtgacaagcactggactcacacaagctggataatgagtggcatgaggacagcactaccattccttggcagcctctacatggtgaggagctcgaaaaacaaaccctcacaaatcatgcgcgtcgatccaccagatagctccagttcctcctcgtggtcgtctacaccaccgcaaatgatcgccacatgtccagctaatcagatggttaagccttatctggtggagtgcaattctgaacttcttctggttgtctataccgacagaaagtcccggcttgtggttattcggcttgctgacctcctgcttggagtacctgccacgccattgacaagcatcggtgaccacgccctcttcattggcacttggagcatggccgtcaactccaccaacctaccatccgttcaggggaactccatcactgtcctcatcccacgtaagagtggccgactgcggcaatatgatctgcgcacaggtacctggtcgctactgtgtgatggatacttcctcaatgctaacggccccataccaaggccatacagtcttgtccaccacattgtcagttgttgccagcgtctttactggctcagtggacacatttggaccctctaccatcgttctcaaccttgttggactatagtcgctttagcacatagaaatgtttgtgcagtctgcagtgatcagttgaaggctattcatctttccaatatctatgtttgaacgtctctgctttggccacataaggtttgggatgtatttggctgtgtgtttgcctctacagtgtgtctacttttgttaagatatttcagtctaactcggatgaattcagaaatattctccctttgaactgtgttgagccttttatcattctgtcgttcaactggtgaacactgcttttttttatgtagcttctgcctggacttaaaacttgaagtactc

SEQ ID NO: 9615 - DNA, 488 bp, Triticum aestivum
  Clone ID: PAT_TA_9615
gctctgtatctcagtcctcatctccaccaccgacagagtggctcccttcctctcatctcagtcctcctcttccgacagagtgctcccttcctctcagtcctcctcttctccattgctcatccaaccccaatccccgcccctgacacctgtggagcagagtggaacagctagcaagaaccacggagtttccggtcattattcagagcaccacgcatcgaatccactgacctgattgagtgaagcgacttccacgaagcgctgtcttaagccctcacggatctggcctctggtgcccagccccaaccttcgcttcgttgtccttcgaggccaccgaaccaagggcctccgcccgcctgatgcacaaaaaggggccgtgggaagcagcaaaaaaaaaccatcgagcctccagtcattcagagcaccaagcctcaaatccactgacccgtctagctgcctgggtgggatcgtggggctctatatctatctta

SEQ ID NO: 9616 - DNA, 499 bp, Triticum aestivum
  Clone ID: PAT_TA_9616
ggaaaaatgttagactctagagcatcagcaaaaaagataaggacggaagaatcaactattttagcagcagtggagatcaaattgcagcaaaggaactttatcgcataacagatacaaactagctggctcaatatccaaagacaacaatctcaatcatgttttatcacaggtaacatatgctgctgaccgtcttagcgatacaacaacacagtctgaatatgatctccagcaaataaaccactattattggggcctggacgatgatatcgaaggaatttctgctttgagcaatgcaggccacgaagaatagcagttatgaagagttgcctcaaagaggtcgttctaaacatccagcgatacatctgtctaacgtatctttgcctatctacatgccttgctcataacatgtaaatgatcgttcgtaagcttcttaggaaacatgtatcatcagcaaccatctatctatcatcaatccatacttatttccataaaaaaaaaa

SEQ ID NO: 9617 - DNA, 613 bp, Triticum aestivum
  unsure (1)..(613): unsure at all n locations
  Clone ID: PAT_TA_9617
tgcaggnaattcggcacgaggcccctgtcctctctcttgcgtgctagtgctcgccgctgcagccgctcgcccgtgacccgatctgccggagtcacgggtcatgccggtggccggcaccctgcttctcgttcgtgctcttgaccgccagagactgagctctcccaggggccgaagccaagaccgcgtgcctcgcgtgcaatctcgaggagatcctggctcgtgcggaagcaggcggtcagccatggccgtcgctgcagcaacggagcccgtgctggtccgcccgctcggcagctgatgcggaggtggtgggatttgcgaagcccacgagggcgacctctgccgaatctggtgcccacgcgtggtagtcgacgcggcaggacttgcgggggagcaggtgattttggagctggaggtggatggggggatggagcgccgtggactgtgcgaggacactgtctgatcctgtgtgcctactgcctagcgtgagcgactttcctggtgcgtagctagatgcacggcgggtgaacatcttcctcatggagttgtagactcgttttgctctttgtccctgaccgcagaaggtgcatcggtgagtagcttttgccttagctca

SEQ ID NO: 9618 - DNA, 469 bp, Triticum aestivum
  Clone ID: PAT_TA_9618
cgtccgcccacgcgtccgcgcttgtcgtctcccgtgggagttgcaagcactgcggggcagcgggaggcgatcgcgagggagagttaggggacggtagcggtgcgagagcatggcggcgatgtcgtattcgtcgtcttcatcggcggcggcggctggtggcggcggcgccgcggcggcgacggcggccgggctcaagacctacttcaagacgcccgaggggaggtacaagctgcagtacgagaaagctcactccaccgctgtccttcactacaaccacggcgggaagaccgtctcgcaggtacccgtggacgccctcgcggttagggcgcctgctagggggatctcggttggaacaccaagctccagctgtgggatgcgatcggagtatttctggctgttgggttccggggttggttctcgggtacttttcgcgtggtatttaaatggaatttggatgcgttaatttaat

SEQ ID NO: 9619 - DNA, 633 bp, Triticum aestivum
  unsure (1)..(633): unsure at all n locations
  Clone ID: PAT_TA_9619
cgagctacccctaaggaaacacaccgcacaccacttcctcttctcttccacgcgcagcgaaccctagtgctctcaccctctcccggatccaccgccgccgcacaccactcctccttctggatccaccgccggcgcccccaaccccactccctccctctggatctccacgcgccaccgcccccaccccactctctccctctggatctcaacgcgccgccgccccgacctgctcctcatcgggttcctcatcaggctcctcatcgtcctcctcgacctgctgctcccacccatgctcctctcgaacttcctccgcgttggcgtccaccacgcctccgcacacagcctcctcgaccaggctaggggcttccacttccacttccgcacacagcagcaactccttcttctccttccccactgcttccgcctacgatcgatcccaccggagcaccaccacccaccgccaccaccgcgcggatcagagcggagcgccgatggaggtggtgaagagcctcctgaagccgaagccgacaccgcagcagcagctgcgcgagtggcagcgccgcctncgtaaccagggccgcaacattgagcgccaatcacgacgttgagaaggaggagaagaagngggaaggc

SEQ ID NO: 9620 - DNA, 673 bp, Triticum aestivum
  Clone ID: PAT_TA_9620
agaatggcgcgtccttccaagggcaaggtgtgtgtcactggagcctctggctttgttgcctcttggcttgtcaagcgacttctcgagtcaggttatcatgttctagggacagtcagagacccaggtccttctcctctcactctaatgatccactctcttattcctctcgttgctgctaatgatggaacccgttcttgtttcttattgatagtgcgcaattgttgaaagtgatagcaatgtgacggacatattttatttcctaattggataggcaatcagaagaaggtagcacacctctggaacttagcaggtgctaaggaggggctggagcttgtcagggctgacctcttggaagaagggagcttcgacgatgccgtgatggcctgtgagggcgtcttccacaccgcatcgcctatcatcactaacgctgattccaaggaagaaatgcttgattcggcgataaacggcactctaaacgtgctgagatcctgcaagaagaatccattcctcaaaagggttgtcctcacgtcttcgtcgtcgaccgtgaggctgagagatgaagctgaattccctcccaacgtgctgctggatgaaacatcatggagctcccgggagttctgcgaaagcatccagatatgggacgctgttgcgaagatcctcgctgagaaatcag

SEQ ID NO: 9621 - DNA, 1262 bp, Triticum aestivum
  Clone ID: PAT_TA_9621
tcgtccgcccacgcgtccgtcgacgcggccgggcgaatacttccaagggcaaggtgtgtgtcactggagcctctggctttgttgcctcttggcttgtcaagcgacttctcgagtcagggtatcatgttctagggacagtcagagacccaggcaatcagaagaaggtagcacacctctggaacttagcaggtgctaaggaggggctggagcttgtcagggctgacctcttggaagaagggagcttcgacgatgccgtgatggcctgtgagggcgtcttccacaccgcatcgcctatcatcactaacgctgattccaaggaagaaatgcttgattcggcgataaacggcactctaaacgtgctgagatcctgcaagaagaatccattcctcaaaagggttgtcctcacgtcttcgtcgtcgaccgtgaggctgagagatgaagctgaattccctcccaacgtgctgctggatgaaacatcatggagctccgtggagttctgcgaaagcatccagatatggtacgctgttgcgaagatcctcgctgagaaatcagcctgggagttcgccaaggagaacaacatcgacctcgtggccgttcttccgacgttcgtcatcggccctaacctctcccctgtgttaggccccaccgcctcagatgtccttggcttgtttaaaggggagacggagaagttcaccatcttcgggaggatggggtacgtccacatcgacgacgtcgcgagctgccacatcctggtctacgaaacggccgacgccaagggaaggtacatttccaccccgcgggtccgggctggcaccggccgggcccccttgcccgcgaaacggttcccgtcgttccccatcccgaagagtttaccgaacatttacggggagcagacgtacggctacaacacgtcaaagatccggaagctggggcttgagttcagaggcgtggaggagatgttgaacgactcggtggagtcgcccaaggcgcatggctatctgcgcgaggcggccgcgtgatgcggatgagcggacaggatcaatccgccggaggaaagaatatgaggccgtggtgcctgctctagaagcatttcagttattactaatacatgaaaagcatgcgcttccttagatttctttatttttgttgtgtttatttctccttcggctattctgttggcactctacgacaaggaaagaaagaccaggaacacttcaggctaggtttgcaggtaccacacatatacgaaattgtgtcaaaaa

SEQ ID NO: 9622 - DNA, 637 bp, Triticum aestivum
  unsure (1)..(637): unsure at all n locations
  Clone ID: PAT_TA_9622
acgagggttnacttgcacctcaggtgctggaactcatgatgatgcttttcaatgttgaaacatatagggctgctatgatggaatttgaaatcaatatggcagaaatgccccttgggaaattaagcaaggaaaatatccagaaaggatttgaagcattaactgagatacagaatctactggatgacactggcaatcaagaactagctcttcggccgcgccggcttgttgctgcaagcaatcgtttcttcactcttattccttctgttcatccacatattatacgtgataaggatgacttgacaatgaaagcgaaaatgcttgaagctcttcaggatattgaaattgcttctaaactagttggttttgatggtgacaatgatgaatctcttgatgataagtacaaaaaacttcattgtgacatcaccccgctagctcatgatagtgaagattacaagctggtcgagaaatatcttctcaacacacatgcctccgactcacaaggactggtcattggaattagaggaagtttatgtgcttgatcgagatggggaaggcagcaagtactcaagatataaaaataatctccataacaagatgctattatggcatggttcaaggctggtcgacgcggccgcga

SEQ ID NO: 9623 - DNA, 749 bp, Triticum aestivum
  unsure (1)..(749): unsure at all n locations
  Clone ID: PAT_TA_9623
ttttagaggacggtcaacaactttccattaaattcacacaaaacactctcttgtgccagtactcatgagcctacaactgtacacggcactgttaacaacttacagcagcacatcatcgtcaacaactggtgtaggtacaaataaattgttaggtagtagaaatagaaaaccaatagcctctacaaataaatcatacataaaaatgttacaactgtccagaaacaacacgaaatacacgtttttcatcagcccttttgtggtcaaagcttccatcgttactagcttgttggagaaatgtgagtgcttgtgtgctcatttggaagatgatgctctgctcctgctcggtttggaatctgggttgtcactcttgtccgtgtcggagttctcccgttgggagtccatttcggtgctccccccgcggttatgcctcgatctcctgtccacacgaggaattgggtcatctgactccagcatccgcacaacttgacccatcttcggtctcttttctgaatccggatccacgcacctcaaagctgttagaagtgcacgcttgagaacccttgtcgaaggccgtgtctctannnntgggatccaccacctcctctgaacgcctgctagcaaccatcatttttaaccagtcaaccagatttacctcatttgccgggcgaccatagtcaacaggatccctccctgtaattgcctctagaataacaactccaaagctgtaaatgtcacttttctcattcnnn

SEQ ID NO: 9624 - DNA, 568 bp, Triticum aestivum
  Clone ID: PAT_TA_9624
acaataatcaaggggtccatatccatcctgtctgatgcaggtctagggatggctatgttcagcttaggtctcttcatggctctgcaaccaaagattatctctggcggaaagtctgtcgcgacgttcgccatggcggtgaggttcttgactgggccggcggtgatcgccgcgacctcaatcgccgtgggggctccggggagtgctcctacatgttgccattgttcaggcagcacttccacaaggaattgttccatttgtgttcgccaaggagtacaactgccatcctcaaatacttagcacagcggttattttcgggatgctcgtggcgctcccgatcaccatactctactacgttctcccttgggatatagagccataatccttgaagaactaaggctgcacatctatgggtaaggaagaagtagaattctagagacaaatgaccaatgaacatgtggcttgtcctgaatacctgaagatggatgagatgagatcaagccgaaggataggttaaactaagtaggaccctagacaggaattcaaaggaaagataaacatatccttgatt

SEQ ID NO: 9625 - DNA, 589 bp, Triticum aestivum
  Clone ID: PAT_TA_9625
ggctcatatttacaatgcactaataaaagggttctgccaagcatctaaatttagtgatgctgtaagaatatacggcgagatggcaaacaatggttgttctcctactgtcatcacttacaacactctaatagatggactatgtaaggctgaaaagtatcaagatgcttcaagctttacaaaggaaatgttggagaaaggttgtaaactagatgtcaatacttatgcttcattgattcgtggcctttgtagagacaaaaaagttgatgctgcccttgctctgtggaatcaaattcttgataagggtcttcaggcagatgtcatgatgcacaacatcttaatccatggtctttgttctgctgggaaagtagatgaagcttcgcgtcttctctctgagatgaaagagaagaataactgccgcccaaatctagtgacctataacacactcatggatggattttatgaaatgggttgttttgacaaagcagcgtctctgtggacagctattttagaaaatggtctggtacctgatataatttcatataatacaagaattaagggtctatgctcttgtcaaagaacacctgagggt

SEQ ID NO: 9626 - DNA, 1065 bp, Triticum aestivum
  unsure (1)..(1065): unsure at all n locations
  Clone ID: PAT_TA_9626
tgaacgactctcgtttgaatgtggggttggcatgcacatctgcagttgttggtgcagctgttctgaattatgctgaagtggtctccctcattaaggatgaatcacccgcgcggcccattggtgcacgcatccgtgacacgctatcaggcaaggaattcgatgcatttgcaaaggtggttgttaatgcatcaggagcattctgtgattctgtaaggaagatggctaacaatgacgtagtacccatgatcgctccgagcagtggggtgcacattgtacttcctgattattattcacctgaagggatgggtttaattgtccccaagaccaaagatggtagagttgtattcatgctgccatggttgggaaggacggttgctgggacaactgattctagtacagcaataacaatgcttcctgaaccacatgaagatgaaatacagttcatattggatgcaatatgtgattatcttaatgttcaggtgaggcgttcggatgttctttctgcatggagtggtattcgcccattggccatggatccatcagcaaagaacacggaaagtatttctagagatcatgttgtatttgaagactacccagggctaataacaatcacaggtggaaaatggacaacgtatagaagcatggctgatgctgctctgcttgctgcgctctgggcacgcatgttgaagccagctaagcgcggcgtggccgctctcttgctttttgccgggggttacggttgggctcctgctgctttgtcggtgctccccctgcattgcatgccatggatgatgacgtatggtggtacagtgggtccaggccctttgggcggtgctgtatcgtggcacctgcctcttgcgcctggaactttggctgtgtgtgtggctgccagggccccccgggacggcttggcattgcgtcgtcctcccggttccccggtcggggatgctgagctagctggggggccccagcancatgtncaacatatgttttgggtcccgctgctgtatcccaaattccnaatgactggttatccacaangctgaanagctgttaancacaata

SEQ ID NO: 9627 - DNA, 739 bp, Triticum aestivum
  Clone ID: PAT_TA_9627
agtggggtggagctaagcatgaaccaggtgatgcagatgacaatggcaggaggatgcatccacgttcttcgttcagggccttcttggaggtagttaaatggaggagtgttccttgggaggatgttgaaatggacgcaatccattctctccagctaatattgcgtggctccctgcaagatgaagatgctaccgacaacaatgcagggtcaattgttgaagctccatctgatgacatcaagaagatacaggggctacttgaactgagaattgtgacaaatgagatggtgcgcctaattgagacagcaactgctcctatattggctgtcgacatcgttggtaacataaacggatggaataataaagttgcagaaattactgggttacccaccacggaagccatagggatgcttctggtagatctcgtggagggtgattctgttgaagtggttaagcaaatgttgaactcagctctgcaaggaaccgaagagcagaatttggaaatcaagcttaaaacaatgcatcaacaggaaagtaagggccctgtagtcttgatggttaacgcctgttgtagtcgtgacctttcagacaaagttgttggggtatgtttcgtagcacaagatttgacagggcacaagatggttatggataagtatacccggatacaggctgactatgttgcaatagtaaagaaccccaatgagctcataccccctatatttatgatcaatgatcttggttc

SEQ ID NO: 9628 - DNA, 1041 bp, Triticum aestivum
  Clone ID: PAT_TA_9628
gacccacgcgtccgtatatatgctacataaaacattatcgaggacgttggcttaaattggatgactgcaaggggatggcgggggacgcggcgcgaggacatgctcaaggtgcctatatgcttctatatagcaggagaacagctcgtcctgtaccacttcttccagtcaaagaaccaataaaacatgagaaacagtgcaaagtgcctcctttaaatggacaaaatcatttgatacctgaggatatgtcattaaaatgtgaatcattttcaaagtcttcagaagatctacgagaggattctgaatccagcaatgactctctgcatagaatggataccgtcaaccaggtatcagacctggatttgcatatgaacattgagagagataaattcgttgccaatggaagtatacatcagccaatttcatcggcattacatgtccttgaagaagatactagagactcaggttctctgttagaaggcaataataccatgagagctgaccaatttggcaattctgcatgtgaatcctcttcagttaattcctctgaagaggaatgcaaggaacctgccccaggtattgattcagttgactacatggatattgatgtggaagctggaacagaagttgaaacacagaatgtgcaacaacaacctatcttaggtgattcagttggagtgatacgcaacaaaacatcagtcccaacctttgagaattgtatggcaggaaaaccaaaaccactcttttctattggtttccttgacaaaccctcaagaaagaagtccgactctagggaagagtgtcaaaatggtggcagcatggcagtttcctcccaaaaaatagatggtcattgtaatgaacatctcatcaggccagagcaaggacttattgccaactcccttggcggcagcccatcctcagcaaatggaagtgtacattgcaatggggacgtgtttgtgactcctagcaacggagttcttgtcaatggtgatacacaatccgacaattattccttggatgcagcaaagagagatgtaccttctg

SEQ ID NO: 9629 - DNA, 888 bp, Triticum aestivum
  unsure (1)..(888): unsure at all n locations
  Clone ID: PAT_TA_9629
gcaattcttttaatnacgaaagagttctggtaaatgtggacgctcgtggccttgaatatttttgtggccaatatctgaaccaagatgctgtgaagatgaagcggtgactggatgagaatgatgctggttcttcagtttgaggctacgactatctgctctgaagtgacttccacagttgtactagtgtaccacatatctgatctgattgtataacacatgaatcacatgttctgaagtgcggcaaaagcagttgcatgcaaaatttgttaatggcggcaagctgggatgcaactggaaaaagtgagcattatgttcttcagtcattgctttgaagctgacaaagcacatctaaactgaagaatatgtggacatcacaaagagaatcattaggcccatagacagtagcaagaaagaatttgcttgggggcaaagcgatgaaggcagtgaccaactggccatttgcccattttaatcaagtctgtaacctccagaaagagattggtatagtcaacatgagtttgtgtgcctggttgcatgattattatcagatttgtaagctaatcagtggttctaattgcttagaccctttatctgtaattaagttcagtcttctggacagtttcttttgtctctgatgatgggcaaataaatgaactatccacttattgctttgaccatggttgtagtcactatgttggctggccagatttcagtcagtatgagtattgaggtactgctgtatactttgtaaagttgtgtaccctttgggatggctttcttcttagtattacataggaatatatagtatagcactggaatcagcagggtagggattcatggttaatattgtcagtcaagaatcagagtattaataaaaaaaagaaacat

SEQ ID NO: 9630 - DNA, 767 bp, Triticum aestivum
  Clone ID: PAT_TA_9630
ttcggcacgaggctccctgtcctcctctccactccgacgaaaccctaccacctcgctccagtcccaccccgccgccatggtgcgccctcgccacgtattcgcctacgctgatgggacgccacaactggagctcctctgcgcggcgaccacgggcgacctcgctcaccgcgagccggcgcgggggaaactcgatggtggtcgcggccgccttgcggaggcggtggaagccgtcaaggatcacggcgctggggcactgcacctggccgcctcgggccaaaatttggaggtgtgcgagtacctggtcgaggatgtcggggtgaatgtggatgccgttgacgaagcaggaagaacacctctggtttgggcaattattgttaaaggtgggcaagtggatattgttaagtatcttcttgatcatggtgccaatccagataatgccgacagaacagggattactcctcttcacgaggccgtggaacgagggcactgtgaagtagtagaactcttgctctctagaggtgcttatgtcgatccgttttctacgattgatggaacaccgttgcatgtcgctgctgaacataagcaggaatgggccatgaagattttgttggatcatcatgcagattgtaacaagatactaagaggtttcttgacacctctcaacattgctattgaaagtcgctcagtgaaatgtgtgaaactactggtaaaggctggtgcggatgtgaagggtccccgtaatgcgactcccttgcaaggtgctgcaa

SEQ ID NO: 9631 - DNA, 787 bp, Triticum aestivum
  Clone ID: PAT_TA_9631
actattaaatatggagtttctgtgttgtctactgaagcagtcaagcatgcaatctgagcagaatatcattaaaaggtcattgacccaacaaattgaacttaatctgaacctcccctgttcctgctatatatccttatttttctgaacttaacaacagaacaacatgatatattagatcaccagagcttaagtgtaaaattattccttactggttgaggatttggagatgcagtatgtggttggcgaaggatttttgtctcctaagctccacacattctcttccatctaaaacaatcgacgcagtcaagtggtgtagtggttgatggtcgagagctaaaatcaaggcaccatcttgttttaggatttgtgtatatctttagatcccccgttacgatcacaattatttgcctgagctctggtgattactcccaaggattactctaccaaataacattaccgaggtatcactgtgtgcctggctggctattcatgtgtagtacagcagtttgtggccttctctgttctgtcaaatgccagtactgttctgtcaaatgccagtacttgctttgtgacccttgatgtaatgtctgtcaacttccaaagtgtcacgtaactatgtatctgtatcttggatatcgacatgtcgtaaacctgtagccctttgaaacaggacctgttgtctattggtattactggtataaaagagaaattttgtttgtgctgatgcaagagggcagcaaccttgacgcggcgatcacgtcgctccttagcgtggagaagtagtgcc

SEQ ID NO: 9632 - DNA, 617 bp, Triticum aestivum
  Clone ID: PAT_TA_9632
cccccccccgtccggggcctcccccaccccccccccccccccccccccccccccccccccttcctgccttccccccttccccccccccccccgcccatgtgacgcaatgcgtcctggatcggaggaatcgaatgtcgccgctctgccatgtttctttcaggtgccaaaacaacaggccccgcagccggcggccaacagaggtgttgcaagtaccagcagggaagctcaagggccgccaccgccggtgtcggctgccctgggcgcggtaggaaacatgcatgtgctccggggacattggcaacgtccgccccaccccccggccctcctcggcggccggcccggcctgcgccaggcgcccatgcccctcctggttctccgccctcctctcgttgaccgccctgccccctccacccaagctcggcgtggtcccggctccggcttcctccagctgcccgcccggcccggatcccccgtccgctcttccgcgcgggctgcgcgccactcgccgcgctcccccacgccgggccatccatgcagggcgttcaactgattctaaattcctccagcagcgcgggcaaccctgaagccccattcgctgttactcgcaggttgattgg

SEQ ID NO: 9633 - DNA, 883 bp, Triticum aestivum
  unsure (1)..(883): unsure at all n locations
  Clone ID: PAT_TA_9633
gtggcgttcctgctttattatcgaacgattctgtaaatgggcttgaaatgtttggtttcatttccccaccacttattgaggtaatcgaggctctagatcccgaccacaagtgcttagattattggttgtctaagcatacacctcctctgagaagactcctttcggagtctttgatgaccacaacggttgatggcactaataattcctctataaggttacttggggttgatattgccagcaatgaatctgaacgatccagtttccacaataattcctgtgctggggagactaaactcagcaggctccttaagaaggctaaatggccagaagaacaagaactaattgtcatgaacaaagcaatcagcggcaggatggataacagcgcaggtctgcaggatgagatgaagaattatgtagataaatagagccttgaatagataaaccatttttagtaactcatcctagattgcttctctagggaaccattagaaattaaactagaaccaccatttacctgcattcttatagaattgcatttcctgatcttccatttagttttgcatgatccaaatttatttttacttgatggcaaaaggttattttctctctaattgtgtcctgattagccaggatcatggtaaccaatgtaacaagttgaccattcgtttatccaaagtttatgttcaaaaccttgttgctggaaaacaaancaaaaananaaaaaaaaantcgagggggggcccgggtaccaaattcgccctatagtgagtcngtattancaattcactggccgncgtttacaaccgtcgtgatgggaaancctgggttaccattaatcgcttggagaatccctttgcagnggggtanaannaaagcgcagatg

SEQ ID NO: 9634 - DNA, 618 bp, Triticum aestivum
  Clone ID: PAT_TA_9634
gcttgtagatgcacaccagttgatatcacagttctataacacaagagagatttcagatgatgcagccagtgtgcttcaatattggaagcaacggaagtatctccggaagaacatatggcttgaaacttggttgagacgtgaaattcaggcccttacacaggatgaaaacatcgaggccatagtgtaccacatcgacggcatgattgagtccttcatgaaagcgcaagaaaaactgcacgcctcaaagcagacttccccggaacatacaagggaagagttcaggagcttgctgtcagacgctgcaaggccgttcctcctcggacggacagcacggttcgtcacagaggtggagctcttcctgatatcacaacggaacatcgacgcatacagcagagtgcgcctgcagaggttcaaggagtccgcctcgcacgtagcaagagagcaggacacgctgccacaggaccgtcccctcgaggaccactacttgtaccttttaaatgaagagacggattgtgttggcggcgtgatataacctgccgtttttcgttctgtagattctgctggtgttgtgtttccatgttgtactgtatgtaacagagatcaggcttcactgtgttt

SEQ ID NO: 9635 - DNA, 918 bp, Triticum aestivum
  unsure (1)..(918): unsure at all n locations
  Clone ID: PAT_TA_9635
attcggcacgaggggcttcagcccggcacgtccttctccaccgcgcatcccctctcctggcgagcggccggccacggcctgccacaccgcccccgccgcgcccccgcgccgcctgccccgccccccctcccccccccggccgcccggccggccacccgcagccgcgccccccccccccccccccgccgcgccaccgtggcgattctgtcaaacagatccccaattcgccgcatccgacttgatggacggccgccgaagaggcgagcgggaggtgaaccggtggcatacaggtcctgaggaggcgcgtgagagggactccggctcctcctccccggctgccatcctcctctttgccctcatcggcgccactgtcaccaccgctgctgttggtcaactgcgccgcacctttggctggttctacactcagcttagcagatcagaaccatatgtctactgggaagacatacctcgtgggccgaataggtgtggtgatgcgtggcgatattaccggaggacgcgtgagacgaacgaggatcagaggaagagagtgcgctttctgtaggaacgcatcatgcacatgcaagatatgttcaagaaggagagaagtaaatgccgggattatcggactcgtaatggccataatccaacctataatcagcatagtcgaagagaagactggtatgaagatgcagaaacattttatgccaatcaaagaacaaattttagatcaaggccanggaagcatgcagtacagtatgtcacatcactattcgtcttggcctaaacagtcaagacagaacatttcagatgctgagataagatgcttaagagaaacaatggatacatcagacaaaccaaagacaancgttctaggaaatcaagagcaggatctacaacataantngangaaatggattc

SEQ ID NO: 9636 - DNA, 419 bp, Triticum aestivum
  unsure (1)..(419): unsure at all n locations
  Clone ID: PAT_TA_9636
gcacgagggctcccactcccactcccatccccatcaccaacccctcccacatagtcatggctccccacccaccggtcctcctgctactgctcctcgcgccgctcctcctctgctcgctgctccccgatgcggcgcgggcggccggcgccgaggacaccggggtgaccatcgtgcgcaaggacggcacgacctgcacgctctgcgcctcctgcgggaacccctgcaaccccaacccgggatacaactacccgtcgccacctcctccggctccggtgacccccgcggcgccggtgtacccgcctcccacttcctacccaagctccctccggtggaggaggcggtggcgggtggctacttctaccctccgcccaccggcggctgggggacgggaggcggcggcgccggcccgctgcngggtn

SEQ ID NO: 9637 - DNA, 748 bp, Triticum aestivum
  unsure (1)..(748): unsure at all n locations
  Clone ID: PAT_TA_9637
gaaagtggcttcttcttctctggtgcagcagtgcgccggcgaggatgaggagaccactccactctccggcgaccagtccttcttcacagccatcatgtgcaagacccacgtccagaagccttatctgctgatcatcccgacccacttccagcgccggctgccggcaaggcgcgcggcggtggtgctccggtgccgcgggagctcgtggatcatgagctactgcggtgacaccaagctgaagaggctcgaccagggctgggagcacttcgccgtccacaaccggctgcaggtcggcgatgcgtgtgtgttcgagctggtgtccgggtatgctggagatggcggcaaaagggaggtggtgctggaggtgcaggtgcttcgacgcggtggcctgccggagcccgaggatctcgccaccaaaggagacaccgccgacgaggccatcatcatcttggactagtcatcgatagtgagagctggctgcacttgttgctggtgtatgtagattcattcaatgtacgcgtgtcttgtttgtaagacatcgaccaccatattattattagcttgcatttcattggctagatctatgtcttcttgtaatttggtgtagaaataatcattcctcatttctattcgtggatagttatttgctcaagaccaggcatagacttttcgtcagttctgccgatggcatgtgggcacgttattatctgtacgaaggtctttgcgtgcaaaaatatnctagtgcaat

SEQ ID NO: 9638 - DNA, 709 bp, Triticum aestivum
  Clone ID: PAT_TA_9638
cgtccgcccacgcgtccgcccacgcgccttccccaaatcgccaccgccgcggactcccagcaccgcggcagcctccggcgatctcccgcgccgccgcgtaccagcgcctctccgcctcgcctctctcctcaagaccccctgccgccgcgaaatcctccgagccgacacccttctccccaaccttccacgacggcggcgacggcgtgatttagtcggagccccagcatctagtagcagaagctccgcctcgaacggcaaagggctcggccgcacggtggaagcagggcttccgcttcgttcccgacggcacagccccctaaatcctgcgcctaaaccttccaaatctcgagtgggccaagagtttgttcggagtgtcacttgccgcttccctaatcagccggaggcggcggcggtaggaatgtcggacgaagatggcgaccccgactggcttactgccttcaaggcaccaagtactgcaccggtgatgctttcttctgattccgatcgttctcgtggaaatagccctacaagaactgctccatctaatcaagaagaaaaggctccgaggaagaagttgatgctctcatctgattctgaagcttctcctggaaacagcccttcaagggctggtgacgctgatgaagaagaggactcacttgccaataccaggaaaaaagatgatcagcaatctaagggtaaaaaaacaaag

SEQ ID NO: 9639 - DNA, 500 bp, Triticum aestivum
  Clone ID: PAT_TA_9639
ggtccttcggaggcatcctgtggggtgcggcgctgctgctattccagttcttctggctgtgtttcgacgacttcgagccgggaagtgtcgcgctcctggtgctgatcgccgtcgactggggcgtcgcgtgcctcaacgccggctcggcgtgcgccgcccttgccgccaaccactaggccatccagcaccagtacaaggcctgtgacccggggttccccgtctgcgagcggtgccttactgtcgccgccatggtgtgtactgccggggctctcgccgcggtgtcggccctcggcatgctccggatccacaggtcccgctttgccccggctcaggcgccctagtcccctgcctcatgttcttgtcaacgcttagattagagccacccatggaagttctggcgttagggttagacatttaattagcagacgtttgttcttttgaatttgacgtggttgacttctgttgcctgtaagaatgcgttatggagatcaaaaaaaaaa

SEQ ID NO: 9640 - DNA, 1055 bp, Triticum aestivum
  unsure (1)..(1055): unsure at all n locations
  Clone ID: PAT_TA_9640
ggagaaaacctcatctcaaacacgggggtagaatgcagtttggtcttttcctcaagggtgctgggctaaagctggaggatgctctcacattttggagatcagaattctctcagaaggttggctctgagcgatttgacaaggaatatgcatatactatcagacacaattatggaaaagaaggaaaacgaacggattacacttcatattcatgtcaaaagatcatatccgctacacctggtgttggtgatcatcatggttgcccttatcgacattttggtgaagagaacctgagagcagctctcaacaatatgggtgttggtggaaatgctttggaagggatactcgataaagtgaagaacaggcattaccagctagcttgcacaatgacttttgaggcaactcatggtgtctcatgtgataccggaatcaatcatcctaatcagtatttcagcgaaagccagaaagtcttgcaagctaagaaccaaacagtgcagagtcagttatcgacctaagttgggatgctcctgcagaaagcagtccatccaccaagtagaaacccagcagcttggtgtcgaatcaagagtggtgcttgactgcaacgttgccagtacatggagatcaagtttgctcatgtttggcctgatgtgtggagcgagttctgctgcttgctggggttcggggagttccaactgcaggccatggcgtcgcatcctgtactactattagcaacataagagcaaattatctattgtcgtgcaacactactcgccagaatgagagcgaatggagattgatatggattttggtagtactgtaatcttctagcaccaccgacttgtgaacgccctgatcagttgtgctgtttcttggagaggaatattatggagtacgtacgcatgttcttcatttcatataggcatctgttgatgttttgtagtagaaggcagaaaaatcactaaatactgaccagagatatcctactgccatcttactgttaaacatactggaacatcaattttnctgctgttgtttggtactcctccgttcnaaaatag

SEQ ID NO: 9641 - DNA, 969 bp, Triticum aestivum
  Clone ID: PAT_TA_9641
gcttgcccacaagcctaagccttctcgagcaagccggtgccgttcccacccacccagctcctctcggggcccccgctcaaccctattttccttgattgcaagcgggagggcagaaactgcagtccttcgtgaggagcaccgtcgatcactcccagcggagggccggggccgaccttgtccttccagcgcttggcgcggtgcccgctcgccgcgccagtcatgacagatgccgcaacggagcgaaagaaccaccaacaggcgccccatcacgaaaaagcccgccctgtcctctgtcgctcgtcgcacccaggccttccaagggccccaggcgtgcctcccacttacccagcgcttctgaagagccaccgtggcaccttgctccctctcccccaaaccgcggggaggtttgccctttgaatacattagtaggacgagatgaaatctgagagctagagaaaaagcaagagatacataattgacgatggagcgaactccggcgttggtcactggttgcagcgacagaataacagtgctgaaggaaggcagtcatcttccatatcgtccttgacaggcaattggtgcgggtcggctcctatagaacaagcatagaggggattaaggaccgcattcgacagccagaaacgcacccccccgcaacgggcgcacgataacacctatccaacaagcaaagctggcattcaccatccggacggcggaagaagcagcaggctggctgactgactctgacactgcctgctgttttttcgcttagcatttgtaccatcacagaaaggagaggaataaatacagtattttttttaggggaatagtgtgttagaaagaaagagatgcaccacacaggctcatagacattggattcttttgcctgcgcttgacaatacttttgcaaagagcaacgctgtaaattgccatgctttcaactgaaacatcctgtgtgttcgcgtcatg

SEQ ID NO: 9642 - DNA, 837 bp, Triticum aestivum
  Clone ID: PAT_TA_9642
gcaaaggtgtaaagctttgtttgcctacatcacatgctcaccctgagggtgccgccttaacttctccagtttgtgttgactggtatcctgatgtcactatcagtgttggtgctgttggacatgatgttgttgctgttgctacatcaaatccttgttgcctatatattctcagggtcagaccattatcttcactccagtacgagttgtatgagacacagcatgtccaattgcaatatgaagtatcttgcatatccattccggaggaggactcgagacttagaacgtcatcttctgcttttggtggtgattttaggaagagaaaagggaataattctgctgctgaagttgatgttcgcatgtttgctgtcattggaactcataaaccttctgtggaagtcatctcattggaacctgatgaagcatttaggctgctctctattgggtctatatcagtgaacaatgcgctcggtgctccagttagtggctgtatacccgaaaatgttcggtttgtagcatctgagaggttctacattctcgcaggtctaagaaatggcatgctactcaggtttgagtcaggaacaagcaaagaccagtatctccctgcttccttttacaaggagtcttttgcaccttctcttaatgctctccttcagttggttgctataaggcacattggaattacccctgtaggcttggttccggcccgcgttgccgcgtattctcatatcctcggtctcagtgatggggccggcctttcctatgccagtccccacgccttggcgcatgcatccagcccttttctgcccccgtcccatgtgactccagtatcttctgtgg

SEQ ID NO: 9643 - DNA, 535 bp, Triticum aestivum
  Clone ID: PAT_TA_9643
gcttgtttctcaaaacattcgcagttgccgcctaagagctctcgcccagccaggcttgagagctaatgctgctaattccttccttggatgtctgagccttgataacatcccatattatttttattatactttagtttgtttcttcactgcttgtttcattcacagttgctgcctgggttttcgccctgccagattatattgtctcgagctgaaatcatccttttatgcgcttcatttaggtcttagtatgtgatttgtaggtctcgtgacgaaaagcaacggtgaagcatggaagccccctgaacactgttgaacaagcgttcattgctgcccgaatgacccgaaataagttcggacagagcacgaatatggcggttggtctactgcttggtagcagccagataatagtgtacatgcttgctagaagcctttttatccggcgtcctagatactacggcttttgtgttgcatggttggttgatgtacccatggaagcattgctagcttgcctatgcttaagctttgtttgctgttg

SEQ ID NO: 9644 - DNA, 148 bp, Triticum aestivum
  Clone ID: PAT_TA_9644
ggaactagtctcgagttttttgttagctttgcttgaattaactgccctatctttggtactggaaggcatcgtttgtaccatgtacagaatgaattcgaatccaagccaccattccgtgtcaaacttttgtttgaattcaaaaaaaaaa

SEQ ID NO: 9645 - DNA, 501 bp, Triticum aestivum
  Clone ID: PAT_TA_9645
gagggtctttgcaaaggttgatggtcctcatcatgtgagatttggtgctttcagcagtggctttgatcatgagattgtgttgtttgatgacacattctttgggactaagatgcagtttcagcatgtagtcgtggtgaaagcagaggaaaaattggatgtttgcttaaagtttggggaatcactctttcggtggactttccagcatggacatgttggacctgttaggattcctgatgactcgatgtcaaagtatggccagtttgatgtgagggtgttctttgctcctaagaactcgcgaccacagaaataagtgaagacgacaccccgtgctggatgtgtgttttattatctcctaactaagtacctcctgggtgttttttttttgtaatctgtaaatcctctgtgtcaaaacaacagaagtttgaggtcagacttgtcgaaacttgaaaatattctatgtttgtccgcatatcttgcatttggttggagctaaaaaaaaaa

SEQ ID NO: 9646 - DNA, 1112 bp, Triticum aestivum
  Clone ID: PAT_TA_9646
ggctgcgtcgtcgatcgcgagtggcgaggttgactgcggcatgggccacctcccttctctccaccttgcggaggtgcggcgccagctggcggaggccagcgctctcgggatggactctgccaacgcgggcctggggcgcgctgctgtagccctcccgtctcgtcccaccctgcacacatcgctgattcggcgttctcatctgggcggccggtggaggaaccgcgtgcccgtccgcggcgtcccccccccgttcctccgggcctgggcgccacgccgcgcctcgccttcttcgtcgttccggtgacttcctgactgggtgagttcgaggtcgctgccccacctctcccgcctggaaatagatgtggaagaactgcaaggggatgacattcagatcattgggatgctgcctgctcttcggtttctgcggctgcgtgcaagtcgcgtgatgggaaggttggttgtgagggccgatgcattcccatctgcgagatgctgcatattctgggagtttctgacgccgccgtgcctttttccacctggagccatgccaggggttcggcatcttgagttccaggtatctgcgcggtcgatcgcgagtggcgaggttgactgcggcctggggcacctcccttctctcgagcatcttcaggtttctctgtggcgtgagaattccagcgatgaagagatggagacagccgaggcttggctgaggcgggcagcagaagcccatccaaaacgtcccaccatgaaaatctattagacacgagtgctgagtgctgacatgcctctgccgccggtaagggcttgaacaaaatcctggagtcaggtactgtaattccatcagttgctgtgaatgttgttccaacattccgataggcaacaaacaattctctgtgccgtcgcccgtcgcagtcaccaacaatcactgtaccaccgcagctcccaataaatgaaggctcattccctccaacgtatgttcagattctggcctttgctagacggaggcctccgcatgattgttcatgacaaactactgtatttgctattctttctgcatatgctttcagaaactatttgtcaagactcgtacaataaagagctgcctctacgtt

SEQ ID NO: 9647 - DNA, 145 bp, Triticum aestivum
  Clone ID: PAT_TA_9647
ttcgcacgagggtggtattgtcgcttaactagcatgcttccccaatctctgccgacgcggaagtcactgttgtgttgcaattaacacgctgtggacatctaatcctagcaatgaaggaagacctgatatttccctaaaaaaaaaa

SEQ ID NO: 9648 - DNA, 1406 bp, Triticum aestivum
  Clone ID: PAT_TA_9648
gcgtgtatgttggtttgataggaatggacaccctctggaagggggaatattcagatctgcaaatggccgaagcctactgtgtgggacaatttgtgaggctgagaaccaacacttcaagcccgcggttcgaatggcagcgaaagagaggcggggtgtttgccacaggccgtatttcacagatactctcgaatggatgccttgttgtgaccttccctggcaagttgagccttggcgaagtgtgcagctgcttggccgacccttctgaggtggaggtggtgagcttcgacaagtgcgagggggttgtgaagaagtatgagcacctcgaggacttccattgggcggtaagacctctgttcatccccttgggctcctgtaccgctgggaagcccggtgggttcctcgggtggcgcggcgcaaggccgaggacgcgatagctcccctccggctccggtccgggggccgctcctccctatgttcggccgctcctcgtccgcggcggtggcggcccggcggggcccccgccgcccgccgcgtacggccttggcagggacgctcctgcccctcccgggttcggctgccttcgcagcgttggccgcactgccaccctgggtgtatctcgatcatgcgacgctttgaacaagtcatgctgtgtatatttagggctgtaattcgctgcctactgcatgggacaatttgtgaggctcagaactaacacatcaagcccccggtttgaatggccgcgaaagagaggcggagtgttcgccacaggccgtatttcacagatactctcgaatggatgccttgttgtgaccttccctggcaaattcagccttggcgaagtgtgcagctgcttggccgacccttcagaggtggaggtggtgagcttcgacaagtgcgatggggttgtgaagaagtatgagcacctcgaggacttccattgggtggtgaggcctctgttcatcgccataggtttctttactgctatgaagctaggtatctttgtcggcaagagcatcacaaggccaaggagtcgaaaggtcgccagcgtctccgatcagggcggtgatcctcagaaagttcagcagcaggaagtgcacagcagtgtcggcacggcatggctccctccacccgtcgcaaacatgcttttcagggacggtcctgcgccttctgggtaaaactgcaaaagcaatgttgggtgtaccctgaagtatatctcgatcatgcaacgctttgaacaagccgtgctgtgtatatttagggctgtaattttctaccttgccaaaaccttgtaaattagtatctgcctctacaactcagcatgcctgagctcaactgctctaggatcattcctagatgtttctagaagcatgcaactacatgaggttctctcttcatgcaaaaaaaaa

SEQ ID NO: 9649 - DNA, 803 bp, Triticum aestivum
  Clone ID: PAT_TA_9649
ggatggacggatggggacggggtgacgacggcggcagcttctttactgccgtggcggcagcggcggccctcgacaccgatgaacgctggttcttcctcctcatccacgacgcccatctccggccatggcgacctcggatctccggccctggttgctcagatgttgctgctgctgctgctgcaggtggacgtgactgccagctataaaggtcagggaagaatagtgcaacatggattcataaacccatggtgggtggatggtgagctgttggtactcaatggcaaggtcatcaatatgaatttgttatttgattgaatttgtggtggctggcaattattttggcttgaggtcagtaatcatctccctaatcaaggtttatgctattttcctaaccggaagggaaatgcatcctctgcttgaacttatgttttactaattttttgagttcatgcattccttaggttactccatgttaataaaaccccattatttgatcaggtattaatacttagaccatatgacagtcctgccataatcagtgcagcttgatgactgtgtagttgctaggtgcagagggtgttgctaagaaaaggccattacttgattaggtgttaatgctctgctcaaattgcactgatattgatcttaagatgtcaagcatttttatcaagtggtcttcctcgactaaaataccatcgtctttccattttgatcactcgcaacatatgttatgttactttttttgaagttatttggatgtctgaagtttgttgcgcaactgcattagcattggttcaaagcct

SEQ ID NO: 9650 - DNA, 867 bp, Triticum aestivum
  Clone ID: PAT_TA_9650
cggcaccaggctacacggtgcagctctacccgtgggccgtggcgccgcacgagctggaggtgccgctgcagacgttcaagacctggcggagctgggccaacgggcccttcgtgttcaacacccggcccctggtgagcaccgacaccccgtgctaccggccggccatgttcttcctcagccgcgtccggaacgagaccagccggggcaccgtgagcgagtactcgaggcacgctgccaagtcggagaaggagtgcgaccaggccagcttccgcgccgcgtccacggttcacaccgtcaaggtgttcgctcccaagatgaacctcaacgagtggaaacgggcgccacggcggcattgctgcaaaacaacgaggacgaggtggggcacggtgctggaggtgcggatacggtattgcagccgaggagagctcaccacgccctagctctatgtattcttctcgccactacatcaccacggcctacagggcggagagtaggatgttgatattggtagtgaagagataataaggggatggcaaaggtgaataatcccctccatgctcggagggacacggaaactttttgttcccaaaccagcagtacttggtaacacgtagactatacttccctgctggtgctgggcaatgtcgtcctcagtgtgtccagatggctatatgacttatgcgacagacagacagacacacgggcacgtatacatacaaggcagtgcaggcggtagcaatgtataggatctggctacttcccacgtgctgtgttgcctctttcttggttctctgctaccgatgtgattctaccgtgggaagatggctgtttcggaaacgaaatggaatataggttgaaagaaagcag

SEQ ID NO: 9651 - DNA, 1104 bp, Triticum aestivum
  unsure (1)..(1104): unsure at all n locations
  Clone ID: PAT_TA_9651
gcggctcgagcgtcgcggagccactcctccggcgctgcccgtccgcgtcggacatactccactcgcgccgctgcttcggcttgcagtgctgttcctgtccccggtcttgccctctgctgtcgtggttcttctgcacttgcaccggcccctccattcagtggtagtggggtgccggctttcctccgccgtacacctcccaccgggttgcctcctccacggcttcgcccctcgccccccggcctgccaatacttcaaggggaggtgcaggcgttgcacccgggcgacacccgtgtgcgtctttcggctgggtccctgtcggctcacgctagccgaggtgcttcatcccgtcattggggcgcaagcccccggcatggccctctcgcccctgcccgacgcggccgggttgttctggcctctcccagcgcctgggtgctggtgggccgttccccagagacaccagccaagcttcccgaccttgttgaacataatccactcattgctgttgatgttctttcaaagctgatcaattgtcctgacatggattcttatttcaatgttcttgtgcacatggaaatgagcctgcattcaatggaagttgtaaacaggcttactacagcagtagatctaccaccaggattcattcatgactacatctcaaattgtatccggtcatgccaaaatatcaaggataagtacatgcaaaacagacttgtgagactagtttgtgtttttctacagagtctcattcggaacaagataataaatgttgaagatctattcattgaggtacaagccttctgcattgcgttttctcgaataagagaagcagctggtttgttcaggcttctcaaatctctagagtgaagaaggttgtatgagtcaccggagttcagctctataaacaaattttttcatgcggtacattcatagtcttatattctcgtgtcgatctgccaatccngggtggctcttcgttgatccccgctcgtgttgttggctttatcgtcgcctcgccgttgcccgcaccgattcagaggtcccaagcttgcagtcccattccccgcgggctaacaattcntagtggaantagattcttaacgtgag

SEQ ID NO: 9652 - DNA, 692 bp, Triticum aestivum
  Clone ID: PAT_TA_9652
tcaccaccggcgcccttccccggcaggaagagggggatagatgcagcagccagccacgactcaccaccggcgccctctcccggcaggaagaggttggccacgactcatcaccaacgccctcccccggcaggaagaggagtgcagaggcagcagccagccgcgactcgtctgtgtcgcgttttggcccagatgcggccgccccgtgctctgccggcgcccgtcggcctcgatccgacctcggcagtaggagctcaagccgatgagcgcggcctcgatccgggctcggcaggaggacacgcgacatctcattcccatcacttctccttccgcctcccccgtcttcctctttctaatccccttcctctctaatttaattcttgttttaagtgtttcctgctgcctatggttgctgtaggtattttcgtcttccccacttctactcttatactccaatttgactcagtcctaatttctacatctttcacaagtaatcttttttatttcctgaattctgtatgtgctcattggactgcaacagccagggatgccagagatggagactttcatgacatcttgtcacttccaaataaatagagaggaaaggcagatgagaacattggttcgaaaattcaaagtatcaaagaattggtctggcctttggtcatggctgagttcactttgatgggtggtac

SEQ ID NO: 9653 - DNA, 649 bp, Triticum aestivum
  unsure (1)..(649): unsure at all n locations
  Clone ID: PAT_TA_9653
gcaggnaattcggcacgaggggcttggcaacggcgacggacggcagtcgctccgcgacgccagttatattattccaaattgaggggcaccatatatgcaatccctctacggaaggagaataaattcttgcaagtgtttgtgtatttgggaaataaaaaatgtatggcgagtctagcaaacatgaaaaccttgagtgcatactacaagatcaaagtgcaaacccaagtgttgtatcactgaattttttgaaagagatcacaaacaacttttccgatgagcgagtactcggtaaaggtggttctagtgtggtatataagggtgtgctacaaagtggggaaataatcgctgtgaagagacttgagccatcaatggctggttctcagagtttatttcagaacgaggttgatcatcttatgaggcttcaacacccaaatattgtgcgatttcggggctactgccatgaaacagtgtggttatatacagaattcgaagggcaaaaagtttttgctgagatctcagaaatgttgctttgctttgagtatctccctaaaggaagccttgatgtgcatctttcaggtggatcctctgaatttgattggcacacgcgctacaaaataatcgaggggatttgcaatggcttacactatct

SEQ ID NO: 9654 - DNA, 847 bp, Triticum aestivum
  unsure (1)..(847): unsure at all n locations
  Clone ID: PAT_TA_9654
gagaaacccacgataaaataaagagaagacatcacatgacgaatattggagaggtattagtcagtggcactttgatatcgaggacttaaaagcacaggctaagttgtactcggaagagaatgatagtgacgaagaggagtacctgcgtttcctatttgaacttgataccgtggatgaaattgttccgcttcaagatgtgcgtccacaaaatcatgctagtgatgataagaagattgtaggtactgaaaatagtagaaacaccaagctcaacaactcccaatactgatacctcaaagtgggaaacaacttgagaatggaccccctaatggccttgcgcgccatgagtcatttgaacgacattcgaaagtacctaccaagcaactttccagagcagtttccaatgttacgtgtatggatgaacatatagaaaaaacggccattcaaaagggtcgttttaaagtaacaacggaagaaacggaagcatctacacacagggagaaggaactactcgaacgtattgcatgtttagagaggatgctccaggttacccaagatgaggttgtgaggcttaaagaaaaggaggcaaaaggagcagtgccatgcgtccaacaaaataaagtacatgggctatagttgcttaaggtggttcttttcatagctagggaagagttgcaaatttgtgtagatctattgtcataagaatctagcatacggtgccacttacttaaagtagttctcagtagatttgtagtgcattagcttcatttattttggaaatagattgtgcttctagaagagatccaatgtgatagtttacaaatcaatggtgnnatgtatttattacaaa

SEQ ID NO: 9655 - DNA, 593 bp, Triticum aestivum
  unsure (1)..(593): unsure at all n locations
  Clone ID: PAT_TA_9655
gatctcaaatcccctctagccgccatggnacgcctcaggcaccggcgccgtccccaaggcgaagaagtacgtggtggggcgcaagcttggcggcggccccaggaagaaggcggtggcgcggtccgtcaaggccgggctgcagttccacgtcggccgcatcggccgcttcctcaagaagggccgctacgcgcagcgcgtcggcatgggcgcccccgtctacctcgcctccgtcctcgagtacctcgccaccgagctgctcgagctcgccgggaacgccgccaaggacaacaagaaggcccgcatcatcccgcgccacctgctgctcgccatccggaacgaccaggagctcggcaagctgctcgcctgcatcaccatcgcgcacggcggcgtgctgcccaacatcaaccccctgctgctccccaagaagactgctgagaaggagcccaagtcgcccaagaaggccgccaagtcccccaagaaggcttagtcgattactagtgcttcgtgatagaattagtgtttgctgtttaagtgatggtgtcgatgtagtatgctctgttctgctttgaaaaaaaagaagtcagaaaaaaaaa

SEQ ID NO: 9656 - DNA, 743 bp, Triticum aestivum
  unsure (1)..(743): unsure at all n locations
  Clone ID: PAT_TA_9656
gcatgtgcaagtatgaaccaatttgaactgtgaaactgcgaatggctcattaaatcagttatagtttgtttgatggtacgtgctactcggataaccgtagtaattctagagctaatacgtgcaacaaaccccccccccccccgctcctcctccatttccatctccgtcagctccaaggaagccatgtccggccgcggcaagggagggaagggcctcggcaagggcggcgcgaagcgccaccggaaggtgctgcgggacaacatccagggcatcaccaagccggcgatccgtcgtctggctcggaggggcggcgtgaagcgcatctcggggctcatctacgaggagacccgcggcgtgctcaagatcttcctcgagaacgtcatccgcgatgcggtcacctacaccgagcatgcccgccgcaagaccgtcaccgccatggacgtcgtctacgcgctcaagcgccagggacgcaccctctacggcttcggcggctgacctgcacctcctgctgatgctccagccagtcgactctgctacctgctgctgttccatcggtctgtgtagttagtggaaggtgatggatctgaatgcaattgaaattgttggttcttgcaacaaatgaatctgaatgcaatggaaatatattgtgctgcatctcgctatgattgtaccttctggcttgttcctgtacattcttaaatttatcagcaagaacgttgatgtttactctttcnaanaaaaaa

SEQ ID NO: 9657 - DNA, 859 bp, Triticum aestivum
  Clone ID: PAT_TA_9657
gcggacgccctgcagctggacgtcgcccgcgccgctgctgtgcgccgggatcaccgtgtacagccccatgaagcagcatggcatgctacacgctggcaggaggctcggcgtggtcgggttgggcgggctgggccacgtcgcagtcaagttcggcaaggccttcgggctcaaggtcaccgtcatcagcacgtcgccggccaaggagcgcgaggcgagggagagcctcaaggctgacgacttcgtcctcagcaccgacgagaggcagatgcagggcatggccaggagcctggactacgtgatcgacacggtgtcggcgcagcactcgctggggcccatcctggagctgctcaaggtgaacggcaagctggtgctggtggcggcgccggacaagcccgtggagctgccgtccttcccgctcatcttcgggaagaggacggtgagcgggagcatgacggggggcatgaaggagctagacgcaggagatgatggacctgtgcggggagcacggcatcaccgccgacatcgagctcgtctccaccgacgggatcaatgatgcgctggccaggctcgcgcgcaacgacgtccgctaccgcttcgtcgtcgacgtcgccggcactggctccaggctctagccacctgactccggccggccgcccggtccgtctgcagggtagggtgggtgcccggcttccttttccgttctctgccctttccgtgtttggtgggtggtcggccgttattctgtcggcatccaattggacaggacaacgttcttaatttgtcttctgcaattaaattgtggtaaagtgccacaaaaaagggaatttcatcgacatctgtattatatatttattttact

SEQ ID NO: 9658 - DNA, 261 bp, Triticum aestivum
  unsure (1)..(261): unsure at all n locations
  Clone ID: PAT_TA_9658
gnagagggaaaggcgcggggaatcgtttgtaaatagcgattatttgggggatgttccccccttggaggcgagcaagagccttagaggttaggacaagagccttttgtgcagtgaaatgagttaaatcaccatattgttgtatcatttagttgcggcagagtggagtatgcattcttcccctttctgtatgtatgtggacaatgtaaagtacatactgccagttatgagcatccagtcgctttttctgcttcaaaaaaaaaa

SEQ ID NO: 9659 - DNA, 719 bp, Triticum aestivum
  Clone ID: PAT_TA_9659
gaattcggcacgagaggaaacccactcacccgcccgccgccccagccgcgccgccgcccccgccgcgccgcgcctcccgcctcggcgccgcaatacatatggccggcgccgccggttccgcgcggaaggtatcggccgtgctgtaccactacccgtgcccggacggcgcattcgccgcgctcgccgcccacctctacttctccgccgccgccctccccgtccgcttcttccccaacaccgtctatgaccccatcaggagcgatggtcttccgtttgatgaaatcgaagacgtttaccttcttgacttcgtagggcctcctggttttgttgctgatatagccccgaaagttcagagtgtaacaatcttagaccatcataagactgccatggaaagtctgtgtgggagtgccacacttggagaaaacgtgaataaggtgattgacatgcaacgcagtggagcaacaattgcattcgactactttaggaacaagttattaacagaagctagtacttcacggaatcatggaagtggtaattctgtaactgaaatgaaatatctacctgaaaacaagcttgaaatggtgcacaagcttttcaagtttattgaggatggagatctgtggagatggactaaacagaatagcaaggccttcatcagtggtcctaaagatgtgaacattgaatttaatggtagtctaaatgggaaggtatttgatcag

SEQ ID NO: 9660 - DNA, 636 bp, Triticum aestivum
  unsure (1)..(636): unsure at all n locations
  Clone ID: PAT_TA_9660
cnattaatgattttttgtncngtatatgntcattgtatagctatatattttgtatctgatatgcaaggttacctgaatctcctcgcatattttttttgtgttcgtttatttatatggaaaatagcctacttagtcaattttggtttagccctgtatgtggtttgcttactcaatattgacctcagtgtcactatgcctgcttccgaaactctagcactgaaatatatgctctgttactcttaatcaagatgcttttgtaccaactttatgccatgctgcacttactcgggctaaatccttgtgctttatcatgaggacaacaatagtggttacttctcatctgagcttgagctgtggtgaatgcgaccgatgtttcgaccgcatacgaagatgtagttcttttggtttatcagccaatatgatcgtatatagacgggatgcctgtacagaggcgttttgaatcagtatggtagcagactaccctatccttattgtaaattatgtgtgatcatcgctatgagacactccttcggatggatttaccactccatggttattgtaaattatgaacgaattatgctgtagttttagtattggttctttaatctaaaaaaaaaaaaaaaaaaaaaaaaaaaa

SEQ ID NO: 9661 - DNA, 444 bp, Triticum aestivum
  Clone ID: PAT_TA_9661
gatttctgaaagcatccacaaaatggaggaagcaatgccatgcctgacaagcaaagtcagaactccatcgcggcatgtgatgagcgttgtctgaaagaagatgcaacaatgggaactagatcatgctctgaatgtcgtcgctttccccagagattttctctacatgtgtgcattagtgcaggcagatatgtcttgatccattttctctacatgtaaatttgcgaactgtcccttggctctcagaggaacgaagcccatgtctgtgtgcccggtaatctgacatgtgagtgagagcgtttgtgtgtgtttgcacagcccgtccgtgtgagtgtcattgttgggcattgctgtggtgtggctgaggcctggatatataggaggcgtgtgtggtgtataaatgcaggcgcttgtcgagtgtttgtgtttcgtcagtcaaaaaaaaaa

SEQ ID NO: 9662 - DNA, 458 bp, Triticum aestivum
  Clone ID: PAT_TA_9662
ggagacttaacagcaaggaggactcctacgggtgcctgacgcgccggtgtgtgagcgcggcacgggctacgggtgcctcgggcgtcgggcggctgctgcggcttgctgctcctgctgccgcggagccctgcctcggcggtgcgctgcatccacggtgctgcggctccggtgttctccgccgccggacccccgggcccctggtcctccggcgccgtggtgcttgttccaggggcgctctttgtcatggacgctcttgccgctggacgctttgcctccgggacggtttgctgcagggaccgttcctgtacgagaggatatgtcgttcttgaatcatactgtgtttttttatgttatcgttctgtgctgtcgttgctgttgtgggctcgtcctcttgtaccagttgcatactcgttgccgtctcccattatcatagcatttcctctctcataaaaaaaaaa

SEQ ID NO: 9663 - DNA, 1419 bp, Triticum aestivum
  unsure (1)..(1419): unsure at all n locations
  Clone ID: PAT_TA_9663
gtagggttggggccgccgccgcctccctatcagcccattcaagctcctcncgggctggccactggacaaggcattctcagatccgcttctcccccaaaccttctggtcttcacgttccaccatgccgccatgatggttgcagaggaggggaggaaggggatggcatcaaggttctgacggaggccctagctcaaggcggcgagttgcagagtgaggccaaccagcttgtgaagggggtcaatctattagttgctacgccgggcaggcttctggaccatctgaaaagtaccggtggtttgaactacaaagggctaaagtgccttataattgatgaagttgaccacatacttgagcaaaatttcaaggaggacatgaaacaaatatttaaacgcctccctcagaataggtaaactgttctcttttctgccacagactcaaaaggttgaagatattgcaaattttacgtttgggaaaaagaaaggaggacaccgaaaacttgtttatgttggagtagatgacttgactctgaattaaagggtgttgttgtgattgtgagaaccaatctctcaatagagcatcaggctagcaaatgggtcagagttcgagtgtgagtgcgggcaattgaagcacatgggcatgttgagttgtcatgtcctaagggtgatggatgtacttcaccttgaggagattcctgcaaaacacatcgtgaaggggtggatgaaggatgcgaccagaaagaccaatcggttaataagtcttttacatgcaggcattcgactctttacttgcaatctatgaacgttgttcggatgggcgacgcgaccgtggaagcgtgaaggatggtcagctgggctgaaggcattgttggtcagcggagcgccattcgttgagaagagggatggtttgctttgaggaccgccagggaaatatgctagcaggaggactgcttggtaatggagaagttgcattcatggcaaatggggttgcagcccatgaatgcagtgcaggcctccctgtgagtgtcaatgcgcttggagggttagcttggatagagaaccagagaggggtcggcaggccaaggaacagccgggagaaagcactgtacgagggactgagacgaggttcggcagtatatgtccccgtgaacgtcacaagagaacgactttgccctgcccgggaaatccaggaagatgcaagaactgtggactggaaggacagcgccggaacacgtgcacgcccacttggtggtccagagaatcaaatgtgacaactagattttattttctgtatgttgtattatgaagattttctggtgtttcattgagctttgttccacgcttgttcctccagttcgggatgtgagaaactgtaacattgaggacgtgtttgttgtctgcatacactattgaaaaaaaaaaa

SEQ ID NO: 9664 - DNA, 660 bp, Triticum aestivum
  unsure (1)..(660): unsure at all n locations
  Clone ID: PAT_TA_9664
cgcgtcgcgctcccattctatgggaggattgctagtacgctgtttcatgtctatgaatcatgatatatgttcaaagtatgttaataaatgggcttgcatgtgggctccatttcaggcggccccgtggggcatcaatgattctcttctaactggactgcagtttgtttatggttttgaaagtttctttttcgtttctcgatgggcgatgcaccaactgctggttgagtgcccatcaatctacgaaatgctgccaaatccaaactttgagtggaaggaaaaaccattcgttcaggtttggcgaaagaatcctgaaaaggatggaacagtagagctagttttgtatgaagcaactgattgtgtttctctgtttgaagaagctttacaaaataatgagtaccatgcccatggataaacatcatagagacactgctacctggagttgcctggcatcagccatcaagacagttatagaatcaacgagatgtaccttgggaaatggatccagaatctctttctggcacgactggtggttggactgtggaaggctgaaattctctttcccaattctcttcacctttgcacaatcgccttattgcactgttgcctcncagttcactgatggacaatggaacctcaagctacatccgaatttaactatga

SEQ ID NO: 9665 - DNA, 1285 bp, Triticum aestivum
  Clone ID: PAT_TA_9665
ccacgcgtccgaacatcttgttatgttatgcatataaactacatggtttctacagaaatgccaagaaagaatttgacaggaattcttattttaaaggcagggctcagcaagcagtagttcaactacagttgttttttcaatccttgttgtttgctcaatttatgacttatgacatgacttgtcctgactaccaaacaataactgaattgtagagaggggaagatagatacctggctgcctggaaaagtatttttcaaattaaccagaatgagtttgacttggtgtacaaatgtggaacttcaagaaaaggcaggtttaacaggaaataatagtagcactatttcaacaagtggttcctttgtatgatgcggggcgagggcgatgagggcagcgtcgggggcggcgccggtcggcgcggccggggatgagggtggcagtgtgtttgacgccgggcttaagtacctcgaggccgtcaatggcaatgtgcttgtgtatcccaggttcatcaccgatcctttcacgattttgctagacacgttctctggcgggtaactgcacacaaccacaggaggaggtcgtgttgtggaagaatacggcctgggcaaagccatactcttgcatctctttcaactgagaacggcgtcgccggggaggacgggagcggctcgaccaatggccaccgcaatgctcttctgcccgctgcttgcctcgccacccgggcgcaaaatagagctgacaagacgtctgtatgtactgcagttcaatgaggaagtgcgtcactttttgtaaagaaatacaagactatctttcacccaggagaggttaactgaattagggagatggcactgtgcccatggacaaagtcagttgctccgatatggatgagcagcaggtgctgctaccgctgcaggtggacaaggcacgaggtctcatggctcctcccactcttcccaacaacactgttgtgatgtactgaagcctcccgttccacatgttcagtacttgcacctcaacgtcacttctgtgagtggtggcctaggttaggtcgatccctaatctctgttccaatttattccggtgtcattattctcagcatcctttaatttgcgatttatgctgcctttgtattttttggggctagagattgtaggttgatttagattgctaactcgattcagactaccaatactactgtagatatcgatgtttccagagcatcattatcaattggctgttatctcattgtgtttatgagcagatacaacatctcttgtgagactagtct

SEQ ID NO: 9666 - DNA, 463 bp, Triticum aestivum
  Clone ID: PAT_TA_9666
attcggcacgaggcagaccttgtgcttttctttgactgtcctgaggatgagatggttaaacgtctcctaagccgtaaccagggacgagttgatgataacattgagacaatcaagaagcgtctaaaagtgttcgagagtttgaatcttcctgttgttgagtactactcttcaaggggaaaggcacacaagataaacgcaacgggaactgaagatgaaatctttgaagcagttcgcaagttgttttcctccttaaggctatgaggaggctgtcgtcgtcttccgcaggagcctgagggaattagaattgcgcctggcggaaatactcttttctttccttttacttttacatctcttagcacaataattgtacatattctgatacacggtctatgcctgtgaaaacagagggccactggtgaaacgcccagcctgctatgataaacccttaccctcaaaaaaaaaa

SEQ ID NO: 9667 - DNA, 1125 bp, Triticum aestivum
  Clone ID: PAT_TA_9667
ggcacgaggctaagcacagttgaaactctggcatctacggcgatatgtgggaaataccgctattcttggagggcaacccctcctgattgtcggagttgccgaacctaccattataatgtacacgtacctttacaagttcgccaagaagcagccagatctgggagaacagctatatttggcttgggctggatgggtctgcatttggactgctatcatgctctttctgttggcaatgttcaatgcttccaatgttataagcagattcacgagggttgcaggagagctttttggtatgcttatcaccgtcctcttcctgcaacaagctatcaagggaattgtaagcgagttcagtatgccgaaagatgatgagatttctgaccccagctcacccatataccagttccagtggatttatgtcaatggcctacttggtgttatattttccattggcttgctgtacactgcactgaagactaggcgggcatgcgcctcgcgggccggcgcaggatggcttagaagcttcattgccgattatggcgtaccgctgatggtgattgtgtggacagcattttcatttacactaccaagcaaagtcccttcaggagtgcctaggaggctcttcagtccacttccctgggagtcaatctcactgagacattggaccgtagcaaaggatttgttttctgtccctcctacatatatattcgcagccatcgtgcctgctttgatggtcgcaggactttatttctttgatcacagtgtagcttcacagttggctcagcaaaaggagttcaatttgaagaagccttctgcctaccattatgacattttggtacttggattcatggtcctactatgtggtttgcttggcattcctccatcaaatggagtacttcctcagtccccaatgcatacaagaagccttgctgtcctcaaggggcagttgctacgcaaaaagatgcttcaaactgccaaagagggcatgtcaaaccgtgcgagcagtttggaaatctatggcaagatgcaggaagtgttcatccaaatggacagcaacctgaatgctaattctgttgacaaggacttgaagagcttgaaggatgctgtgctgcgggaaggtgatgaaga

SEQ ID NO: 9668 - DNA, 585 bp, Triticum aestivum
  Clone ID: PAT_TA_9668
caccgcccactaaaacccacatcgcgggcggaccggaggacgacgcaaaccctcgcgatgtccggcgatcgacgcggcggcgggcctcccggcaacggcgacaaccccggtggtggctgggagactattgagaagaagaagaaaccagggcaaacatctgggaggggacaatgggcaccatggggttcatcctcaaatgctccacctactacagcacgtcaagcttggaatggcaatggatcttcacgtccttcaggaaacaattgggctcaaccttctgatcgtaggtctgctgccagaggtaatcccagggcatcatcacaaacaaagtctacagaaccagaattgcaagcaccaaacccagttgtgactccacccctggcaaatggttggcagtgggcatccaggccttgcccatctggtcctgaaagcagcaaggatgatgttgcttcatctggtttagaccctgaggcgaataatcctgaagttgaggattcatcagatgatgataatgatgatgatatgagcgatgactatgattctgatgcatctgagaaaagtttgagacacgaaaaatgaataagt

SEQ ID NO: 9669 - DNA, 765 bp, Triticum aestivum
  Clone ID: PAT_TA_9669
ctcacttatgtgaagaacagggggttaagacagagcaacgctctaaagttgtacaaggaaccctggacgttgttacccagaaacttcgagagaccgaggaagagaatatattcgtcaggcgtaaagctaaagagaagcactctgagtacgaggaagagatgaagtcccaagagaaattcttccacgatcagatagaaaacattcacaaggccctagaggacaaggaaagggagtttgagaggttgctgcaggaggagcgtgcgaaggctagacagtgtgacgtggattccgggactaccgaaaatcgcaggctaaggaaggaacatgtacagcggttcatggattgccaggttaaggatgtgcaagagttcgaggctgaagcagaccaactgataaaagcacatgaggaaaagaaggtgcagctcaagaaagagtacgcggcaaaggaggtggagctcgaaaaggaatttgatgctgcttttaccagtctgatggagaaacacaagcccgacaccttccgggcctccaacatctcttgaagatcacagtacatacataggttttcgatccggtttcccttataaactggatcgctctcctggcataattaatgaccgctttgagtgatatattcaggtgtatgcaagattaggaaacctcaacttgattggacctgtcatcttgctctgctttagaatttcagatacaacgtgtccaaattatcgtgtcatcttttcagaatttcaacatttgtaaccttgtcac

SEQ ID NO: 9670 - DNA, 2162 bp, Triticum aestivum
  Clone ID: PAT_TA_9670
gcaagcccgccaaaacccacatcgcgggcggggcagtaggacgacgcaaaccctcgcgatgtccggcgatcgacgcggccgcgaacctaccggcaacggcgacaacccggcgaggggccggcaggcctctcagaagaggcaagaaacccgggccagcgtgtggtagggaacattgggcaaataagaggacataatcaaggcctccatctactacagaacaatgggcttcaaatactacagcgtcctaaagtcctacaggaaacgcttggcatgattggtctgaaacttggacagtcgcctgaagcaaaaaaaaaggtggttcaaaaagctagtgaagagcgcgcggactaagaggaagaaatgaaatcctgacaaaaattcttccaagaacagggagggaaagttccaaaccccaccgacgatccggacatcgagttagaaaggttgctgtgggattagcgggctaagcctagacagtgtgaaatgcacaacgggaatactgataatagcacgataatgaagacgcaggtagagaggtctatagtgtggaaggttatggacgtgcatgagtttgagggataaagagacgaattgataaaagcgcacggggagcaaacggtgcaggaaaagaaagagaaaatggcaaaggaggcggagctcgagaaagagtttgacaccgctctggcccgtttgctggtgaaacagaggcatggcagcttccggaagtttaggaaacgccaactaagattcacaggtatttttgatttgccttcggaattaagatagataatcttcaatgaatcgtgtcgtgtggtcaatattgcccatggttccggttagcctaatgtgactgcgagagagatggctgcaagatcttttccaaagatatcatatgaccaccaggtgggcaagatgatgatccccctcttgaacatggtaactgtattgtcagcggttagtgatggacaaccaagaacttctcgggtatttcagtgagtaggctgcgaccaaagcacgccatgcatatggtccaggtgggcaccgtggcatgagtgtgctaatatttgaaagctctgctgtgggctatatggaggcagaacgtcttcataagcattttattgatcaaagaacagacagggacacttggcagaatcgcagggttcctttcttacctggtgggaagagacaattatacggtttcctagccagaaaggaagacatggagactttcaatagacactgccaagggaaaagccgcctgaaatacgagatgagatctcataatgagatggtagtggcccagatgaagcaaatgagcgaagataatcaacaactcaattatctgaagaacaaggtggttaagacagagcagcgctctaaagttgtagaagaaaccctgggtgttattacgcagaaacttcgagagactatggaagagaatatattcgtcaggagtaaagctaaagagaagcactctgagtatgaggaagagatgaaatcccaggaaaaattcttccatgatcagatagagaacattcacaaggccacagaagacaaggaaagcgagtttgagaggttgctgcaggaggagcgtgcaaaggctagacagtgtgatgtggattctgggactactgaaaatcgcaggctaaggaaggaacaggtacagcggttcatagagtgccaggttaaggacgtgcaggagtttgaggctgaaagggacgaattgataaaagcgcacgaggagaagaaggtgcagctgaagaaagagtacatggcaaaggaggtggagctcgagaaggagtttgatgccgctctcaccggtttgatggagaaacataggccaggcaccttccaggcctccagctccaggccgtgaagattcacagctatctgagatttgccttctgcataacgacatctaaagatgcaagaccatatgtggtgcatgattaggaatcctgaacttgatggaacatgtatgggtggttatatggccatgattaggaaacctgaacttgtctgagtgtcaagtgtcagtagcatgttttacaccactacctaatgactgcctggggagcaagtgtcgaatcccttgaacatgtttaactgtaatgtcatcttgttgtgctttatgtctgaacttcggtgctgacgggcgataa

SEQ ID NO: 9671 - DNA, 532 bp, Triticum aestivum
  Clone ID: PAT_TA_9671
gccgagctcccgttcccttctccgtctcctctttgcccgcgtcccgctcgaaacccacacgcactcatcttccacatccgtgtgctccgctgtgatgttgccgacggtagtttgcaccgtggctatgctccccaggcgtcgcctgccccgacggcccgagggtccttacgcgtcaggccgccttggctggagagatgacggtcaacccttggttgcacggcgcggtggccagccatgggactggacgccggtggacctccacatgttggacgagaacaagggcactgaagaccatggccagtcccgtgaggccgtgacaccatgcctctcccacctctttcggtggctttctactgcccctgcgctgggagctcaacatggagggactcgccatggatcgagcatcgtctggagtctggacgcaactgcccactgccctgcaagttgactgttccaacgcccaccaagtgtttgatgtaatgtttggacggctgtaggtaaaagaaaatcagttttatccagaaaaaaaaaa

SEQ ID NO: 9672 - DNA, 709 bp, Triticum aestivum
  Clone ID: PAT_TA_9672
cgacccacgcgtccgcccacgcgtttggattcatgtgaaaaaaactcggtgaaatttatgatacccatggatctagggaagcagtcctgaatgtactgtttccaggtgaaacaggctatgaagcattcaagaaactttccgctgacagctccgagccttactcagatgtttatggaagcctgtatcactacatcgcagaagctgaagatacaagtcccagcgacaagtacacaggttttgtgttgaaaaaggaaggaggagaatttgtcgaacaaagtgcaaatcttttcaagtatgatctgttgtataacccattacggtttgaaagctggcaaaggctttcaagtttatatgatgaggaagttgacctgttgctgaacgatggtagtaagcatataagcattttggattggcgaacaaatacacctttaattcaaagggttgaggcaggccgtagacatagtcgacgcagcctgatgatgagtttaatattggctagaactattcctgatcaggttgaaatgcatgaattgttggccctagtttactatgacagcgttcaaaacgtggtacctttttatgatcaaagagctacattgcctgtgaaggatgcaacatgggacattaactgccgaaattcgctgaagcaatttgagaaggcttttgaactcatgtctcagtggctccatgcattttaccttggaaagct

SEQ ID NO: 9673 - DNA, 753 bp, Triticum aestivum
  Clone ID: PAT_TA_9673
aatttgatggtgcatgcaaaaggaaatcccgggaaatcaggcgccggtgtagtagtaaggcggtcagatggatctgtgattgctcaactacgtgagggtttgggtattgcaacgaataacgctgctgaatatcgtgcattgctcctggggttgagatatgctgctaagaagggattcaagtatgttcgtgctcaaggcgattctaagcttgtctgtaaccaggttcaagatctctggcgtgttaggaatgataatatggctgacttgtgcaagaaagtcaaggaactgaagggaaattttcttcagtttcaaatcaaccatgtgttgagggaatttaatgcggtggcggatgccccacctggctttgctgttgaacttcctgttggtgaaattcaagagcagtcaaacttcacatgctagtggctgtgcttcagagtagtttgcagcgccttttttcttgctcatttcacattgacagaaacaagaattcattgtcgagcatgcagttggtacgtaatttgcagttgatccgtaagcgtggttacgacctggagtcagagatagtggggtaagcagaggaaacagtgtgtagatttttggatgagcagcttcagtagcctggcactagtgtttagcttatactgatattatgcggactgcatacaacatcagagatactattttgtagcatagttaaattggtatggcctctcggagaagggaaaaaaagatgttactgctgcaaaaaaaaaa

SEQ ID NO: 9674 - DNA, 552 bp, Triticum aestivum
  Clone ID: PAT_TA_9674
ggttttaatatgcatggaagtatgagggtttttctgcaaaactggaaatcctagaataaaagattaaaaacgtagcgcaggaaaaaaatctatgggccgaaactggcaggcccaactgcacaggggaaggtgggcaactgctcaccactgggccaagcccaagtcggtggagaggggagagaccggcaggcttcagctgggccttgaggcgctgcaagaggaggcccacgcacggtcaatgcgagcgctctggcagcgcagctcgatgcagaaaagtactcgctcatcttcagcgcagaggaagcaggggcgcggcggctgggagccgaactccgacgagcggggcaaaggggcggcgagatgagggacttggcgacagcggcggactacaggtgcggcggcctggagcggcaccgatccagtcatcgcagcgggcgttggagcggcggggctcgatgcagaggaggcgcgccctctgctcgacaggaagcgacggtggcagcgaaactggcagcgggcttgacgtgagaggaaccgggcagcatggcggtg

SEQ ID NO: 9675 - DNA, 252 bp, Triticum aestivum
  unsure (1)..(252): unsure at all n locations
  Clone ID: PAT_TA_9675
ggtttgttcttttatagctgtatcttcttgcacacaaccacttctttaaagggcttagcttaagctgattggtttcttgtatgaacattaggattttacaacattagattcaattctatgacggagcttttgcccatagaagatgcttaagcagtaggttttgtacattttttcatcctnctcatgtaactgtatataatattcaattctactatgaatactgggtactacaatttgtatttaaaaaaaaaa

SEQ ID NO: 9676 - DNA, 889 bp, Triticum aestivum
  unsure (1)..(889): unsure at all n locations
  Clone ID: PAT_TA_9676
gctctccttcctcgggatccatcccgatccacccaatccctccatcgatccaaccagccaaccactcccctcctgcaaccacccccaaggccgccccttcctcgcatcgatctggagccgacgctctctctgcgcccgagctcctcccgatccccatggatgccttcccctgcccaagctcttcaactgcgagcctcccgctcgcgtcgcgcctgcagccgcccgagcccctgtctaggagctccttgggcatccgtgccctgccgtccggccaccggttcgagctgccggcgaccaggccgtcccactctccttcctccccctccccccgtccgccatctccctgctctttctcatgtctctctccctgttcacgagcacaggagaagtggagcgtcgcgccaccatccgcggtcgttgccgttcgccgttgttcttcaccggatactgcatccccggccacgggtccggtcctcctccgccctcccgtgaagccctgatgcgccaagttcctcctccggccggtcctgctgcggcaagtcccgccggcctccctgttgtcgcgcctgcgtcgccctgttgccgcgagtgcagacgccggtgaatcccgcaggtcgccgccttgccaagtccgacgcccgagcaccggatctagtcgagctcagcgcccctgccagacctcacctgcatggcctctgcctcgaccgtctacgttgaccacgtccctgcgccgtagcttcctcctgtcgagcacgggctcgatcccctgcttccctgcagcgannnaaccaggcgcgttgacttcgccnnnnccggcctcgcctcggcctgcatccccccccttccggcctcacctcatctccgaactgggccatggcccatgnnnnan

SEQ ID NO: 9677 - DNA, 554 bp, Triticum aestivum
  Clone ID: PAT_TA_9677
atgtggcagcgctagacatcatgcagagctattacccagagcgattggggcgtgtgttcctgatccacgtgccctacatgttcatggccgcatggaagatggtctaccccttcatcgatgaaaagacaaagaagaagtttgtgttcgtcgccgatagggacctcgatgccactcttcgggatgccatcgatgagtcccaactccccgaggaatacggcagcaagctcaagctatagggctacaatagttcaatgtcgtgcaagcccatctcactatcgaataattaacatatgcaattaagggtgccctcaaaccaatgtcggaggagcctaaagagagaagcgacaatcctttcaaagtcaagggtccaactcaccgaggttgacataagtgacatatgaggctatgcatccatccccactcagtggtttgctataattgtttttttaagggtcactcacatacacccatcatgatgtttagatatgagtgaatcctacataaataattcaaatgaatttcatgtgggtaaaaaaaaaaaaaaaaaaaaaaaa

SEQ ID NO: 9678 - DNA, 572 bp, Triticum aestivum
  Clone ID: PAT_TA_9678
ggttttatcgctcgaatcaaatttacttatactgtgctcaactttagctcatgaactgcatggcaaaagctaattctgattggtcttctgccactttttgttttatggctttctacgcaactgaaggcatgcttctagattatgagagtatgtagatagcatgtatggtttttcattgtcttgcacaggtagagatgcatcacacgatcctttgacattatgggtattgcagagtcctttcttacaaaggcaggagctgtaccattcgacttaaagggcgaagagttcatgcaaggggatggtctctaggatatatacacaaaagatgaaatttccttttgtatagaaccaaattatatcatgtaattgaccattatttctaagtgcttctcctatacaaaatgttcatcatgtattaagtacccccttcatcccacaattaaaaccattttgcaagttaacatagctttcaaaaatgtcttatattatgggacggagggagtacattttattgtgtcacgtatgtttacctctctttttaaattcaagtttacaactattcaaaaaaaaaa

SEQ ID NO: 9679 - DNA, 539 bp, Triticum aestivum
  Clone ID: PAT_TA_9679
agggaaggccttgccgtttcaaacagcgattgtgtccatgatgtttcagaggcaacaggacaacctgctagcctgcaacctgacctggcttcacaggtgaagtctcggaggcatggaaccaggaacagacctccgactgcaaaagctttggaagcacttgccttggggttccttggaggaaagcgtaaaggtgaacccaaaaaccctgggacaagcaggcccccccagagagctcgcaaatccttggtttgtacgcctacaagcagtgacacagacaagtccagcatggaggttgatttgcaacagtgaacagattgttacgtgtttcttggtgcaaaaaagggcactatattgacattgtggatgatcaatatcaagtggaacattaattaggtcttcaacttcaactagacttgacgcgagttgtctgcatcgatcttcccttatgaggcaccttgcactttgtgattcgtaatatttacaatgcagtggccaactggtggagtagcttattaagttgtatgcctgtgaagtctttg

SEQ ID NO: 9680 - DNA, 825 bp, Triticum aestivum
  unsure (1)..(825): unsure at all n locations
  Clone ID: PAT_TA_9680
gcgcagnatcgagcacgcacccgaacgatcccggttcgcttcgctagctgactcgccgctcgccgcccgccgccgggatgattctcgtggattggttcttcgacgctctggcgtatttggggctgtggcagaaggatgccaagatcctcttcctaggcctcgacaacgcaggcaagaccaccctcctccagatgctcaaggacgagagactggcgcagcaccagccgacgcagcacccgacgtccgaggagctgagcatcgggaagatcaggttcaaggcgttcgacctcggcggccacgcgttcgcgcgccgtgtctggaaggactacttcgccaaggttgacgccgtcgtgtacctggtggacgctgccgatcgcgagcgtttcaacgagacgaagcaggagctggacgcgctcctctcggccgaggcgctcttcaacgtgcccttcctcgtgctcggcaacaagatcgacatcgcaagcgcattatctgagcacgaattgcgctactatctcgggctggagtaccacaccaccggcaagggcaacgtcgatctctcccacaacggcaggcggcccctagaggtcttcatgtgcagcgtggtccggaagatgggctacggcgatggcttcagatggatgtcgcagtacatcaaatagatggagcagaggaaaggcatctctgtttcttcttgtggcgctacatatgtacagtacattgcagtttccatgaccaatcaacttgattgcttagtggctagtttggctagtctttttgtcagtctgttatattcctaagcctagatccggccnaactttnactccg

SEQ ID NO: 9681 - DNA, 1072 bp, Triticum aestivum
  unsure (1)..(1072): unsure at all n locations
  Clone ID: PAT_TA_9681
catgacccccgccgactccatcttcaacgagtcggacgagtgcctcgagagcgtgctcacggagatccgcctcaacacccgcaccggcagtccacgcggcggcccatcctggcgctgtcggagcaggtgaacctggaggtcggcatggtgaactccaacctgctgggccgcaagacgcggtacgcctacctagccgtggccgnagccgtggcccaaggtgtccggcttcgccaaggtggacctcgccacgggggagctcaccaagttcgagtacggcgagggccggttcggcggcgagccctgcttcgtgcccatggacccggccgcgtcccgcggcgaggacgacgggtacattctcaccttcgttcacgacgaggccgccggcacgtcggagctcctggtggtcaatgccgccgacatgcggctggaggcgaccatccagctgccgtcccgcgtgccgtacggcttccacggcaccttcgtcaccggcaaggagctcgaatcccaggcctgagccgatcgagcccccgccgcgcttgccgcctccacgtttcccggaggacggcaagaagcagaggaggagatggaaagaggaagtcgccagagggagcctcgccttaggcataggagatccccggaatcttcccttccattcccccctgcgcctgcagttagctcacactagtacgtagttggtctctgttcatattcagttagctcacacttgcttcagtccacaccagggtaattaagtagcgcttgtagtaaaacctagctgccactcatggtggcacaggggagtgaggattagagatagagagaggaagaggggtccagctcgtagctgctctgccggtgcttgcttctacagagcgaccgtagctcagctggtgcccgctgctagttactgtacaatatattgttcttcattttatcacaccacacgggttggtatgcgtacaaatatgctccggttgctgtcacacactgttcgctgcccggtgttgttggctccgtgtgtgtgcatttgttgatattatgataatgatatggtgattgtgctgcctnaaaa

SEQ ID NO: 9682 - DNA, 659 bp, Triticum aestivum
  Clone ID: PAT_TA_9682
aaaaggttggcttatctgagaaaatagttgtcagttatgaagtcaaagatattgttaaagatgacaacattgatttggatgatctcttccgtacccctgatgttgctttcggtggcttctcagttctgcatgacccatctgtatctgaacctgattcagcatcattgctgcgtgttggaattggtgccagaaagttaggctctggttcacttttcctgtacggcctaataatgcggaagaatgtaactgagctagctgcaatggaaggcgacgagcagcggttgagtacactgtaccgagattttgggacaaaacttgtgggattggatggcttgggtgatgctggggaaagccttatatcacggataaaggcttcttctaagaagtagcatccaaacaagatgttggatggttgactcagctgtaacagttgtcagctctgagcatttagtttgcaagtccaacatagctactgacctttcaagtaattcattcatttcattgattgctatatacctctcaattctcatcaaggtgtaagctgtgccatgtaatactggttaaaccatgggtagtcattgaagatcatatcaccatgggaaataatggaattcttatcagtactttctgttcaaaaaaaaaaaaaaaaaaaaaaaaaa

SEQ ID NO: 9683 - DNA, 1390 bp, Triticum aestivum
  Clone ID: PAT_TA_9683
cgtcgtacggtccaatcccagtccggcagccccgcatttgatcccctcgaccggcatcccattccatcccctcctcaccccgtccaggaggatgcacaaggcgtcgtcgctgtcggagctgggcttcgactccggcggcgcgtcgtcgggcttcttccggcccgtggccgacggctgcccgtctggcaccccgacctcctccgtcgccccgcaccgtgcgtccaccaaggtctccgtcatcggcgccggcaacgtgggcatggccatcgcgcacaccatcctcacccagaacctggccgacgagatcgcgctcgtcgacgcgctccccgacaagctccgcggcgaggcgctcgacctgatggacgtcaccgagtccgaggccgcgcagctccggcgctcggccaagacgctctgggagaactgccacgctcctcgacctctgacgcgacttgctgtgaaaccgtgcagcatttacacgaacctcaacctctttatgcggaacggttgctgctcccgacacaaatgcctgtgcgttttcgagcactcccccgtaaggcatgtatgcgtcgtcttaacgcctcgttaatttgcacaccaacggcgcctggaggttctccggcttccccgccagccgcgtcatcggctccggcaccaacctcgactcctcccgcttcaggttcctcatcgccgagcacctcgacgtcaacgcgcaggacgtgcaggcatacatggtgggtgagcacggcgacagctcggtggcgatctggtcgagcatcagcgtgggcgggatgccggcgttcaagtcgctgcgcgacagccaccggaacttcgacgaggcggcgctggaggggatccggcgcgccgtggtgggcggcgcctacgaggtgatcggcctcaaggggtacacctcttgggccattggctactctgtcgccagcctcgctgcttccctcctccgcgaccagcgccgcgtgcaccctgtctctgtccttgcctcgggcttccatggcatctcagacggccacgaggtgttcctcagcctgcccgcccgcctcggccgcggcggcatcctcggtgtcgccgagatggacctcaccgaggccgaggccgcgcagctccgccgctcggccaagacgctctgggagaactgccagctcctcgacctctgacggaggaaagccagttgatctacatctacttactgtaaaatcctggagcgtttacaagaactctactgctatatgttgctctgttgctgctgcggccacacgaatgcttgtgtaattttcgagtgtcttcttagggatgttgtagtaatgtaacgcctcttaatttcatgaaataaaatgcgatttgtgccagcaaaaaaaaaaaaaaaaaaaaaaaaaaa

SEQ ID NO: 9684 - DNA, 578 bp, Triticum aestivum
  Clone ID: PAT_TA_9684
gtggatctcgggtgtggtggtgtcaaggtcttggatgccagggtggcggccctggtgatggttccgcggtgctcatgggcagagccagtggcttggtgctgcccggttgccacgaccgtgtgggcggcgtggtagccggggtgtggcgttcggtggcggtgagttgtggccggggtgaaaacctgctctatcttcggacggaccggcgccaacggaactcgttcccttcttgaaggcgtcgtcgcggctctaattgcccgtcgtgttgctccaggggaaactctaatcctcggatcgggcggtggcggcgctccggtgtcgttcctttcctgaaggcgccgccttggagcccacggttcgtcatatgcggcttcacctcttcgtggagtgcttgggttggtattgctgcgctcagcgcctatgtatcctgccttgggtgtgtgtgtgtgttgtgagggtgtgcgtttataccgggtgctattgatcgttgctttatatataaagtggggagaaagcctttttcgataaaaccttcattaatcaaaattatgtacaaaagtatacaaagaaaaaaaaaa

SEQ ID NO: 9685 - DNA, 871 bp, Triticum aestivum
  Clone ID: PAT_TA_9685
aggaagcgcattgcggcgggttgtggttagtgcatcatgaagaatttgaaactgatggtgcaaaagataaattccgtttgtttgaaagtacactgttttctgattgcatgaagcgtttcctgtatgtccgttgttacaatagttccgaacttatagctgctttgaagagtctaaaatctcaatctgaagccaggaacgaaatttttgatattggtgtatatttccttatgttagacagcattggcgcattctactggatagatcgtgctcttcaacctactagagagagtaaagggaaaactctatcatttcagagtatcaccgaaactgttgtccaggagatacacaagtttttgcaacttcaacctattttggtgttggtcacaaaggcacctatttatggtgaaggaatcacgacatcaaacgacttccaaaggggttctccaaagtacatgtcagaggattcaacacctttgggatatccgaaacgggaagaagaaagaaatggttcatgtcgcgaatacatgccatctgcatggcagacatttgttacacacaggataaagttgcaagatttagcacaagaaccagggtttttctctgagcaggaaaatgcaatcctttctgtgcatacttgtgagtgggtgcagccttccctaaactcaaaagagaagttctatatcaaggatgacggtgttggccttatacagtgaagcctatcagtttctgtgctggcagatagcatgacttgtccgacctcctgacagaactgttgtgatctgtgataaacgtatgtatgggaaatgcttaagtaatatctctatcttggtcctcgggtattataggcacagaacccaaaagcaacagggat

SEQ ID NO: 9686 - DNA, 829 bp, Triticum aestivum
  unsure (1)..(829): unsure at all n locations
  Clone ID: PAT_TA_9686
cggacgcgtggggtaaaaatgagggagttggctgtacagcgcgccaaacaattgcaagctgaggaagaagaacggacaaagcgacaaaaggcaaaagctcttgcaaaattggaggagctgaacaagcgttcatcagtacatcagaagaattccagtgatccaccaccagaaaatgacgacgtgcataataagccaaaggctggagttgatgggagtactgaacctgcatcttcaactgctgaatcacatgatgttcctgtattggataatgttagtattcttcagccaccaaatgaacccaaggatactgcagttcctgcacagcccatgtctactctactacaggctgagggtacaggtaaagatctttctggtcataacacttcaacctcaggcatgaacacacagagcaacatgatggagcatatagcccataaaagtatatcacagtcacatgatctcagtgttacaaagcctaggcagggctacagaaaaaggcatgctgtttcagaggataaaattcttggtgagaactcaagtgtggcagtaaacacagaaaatgttaagaaagctgttgaggtttctttggacacatcaactggctgttgttacatcacatgatgatcccccagcccacagcaagaagagtgcccggaactcgagaaataagaaaaaagttgatgatgctcctgctgcttctaaatccnccatggttnttgncagaaaatccccggcnttcagnggccnaaataaaaccgtggngtatataananttttcttcttgtgaaaacccngttctgtggagataccggggggntttnttgatttt

SEQ ID NO: 9687 - DNA, 542 bp, Triticum aestivum
  Clone ID: PAT_TA_9687
ccgtctacgcagccgggcgctgatccaccgtcgtcaggccctataaaaggctcccggctcgcctctgtaggagcaggcgtggtgctggaagtctggaacagtgatgggactgagcggcagtggtggcgctacagcaacatgaccgaaggggcggctctctcctacaaaactggcggtgcccctcctcatcctgatgtatgtgttgttctatttttcacttgcgcctgcaggcggcagctccctccaccacccctcctcacctccgtcccccagccgccccccgtacgcgccgccctgctggtggagctcacctgcgccgccatggatctcgtcggtgttggaggcctgttctgcaacgttggcctccccaaggtcctgctggtgacctggacgctcgccggcgctgctccggttcctcatgccggtgtgatttaagaaccaaccagcgggcactcctattatttgtggtgtccgtccacgcgcggcggtgtggtagctagagagaggagcggcgacaaggtaagtgagaatcccgacccgta

SEQ ID NO: 9688 - DNA, 742 bp, Triticum aestivum
  Clone ID: PAT_TA_9688
cgtccgcgaaaaacaccgaccttttttccagccgagacacgatgatccaccgccattagcagcggcggggaagcggcgatcgatcttccgtggccccgcgctcgcgtgctcgctctcgccggatcgggcctggcaaatggcgcgcgcggcctccctggcggcgctctgcctcctcctcctcgccgccgccgccgccgccggagctcgaatggacccgatttattctggccaactggtgccggactggagcagggaacccaagattaaaccgcagaatttctccctgaatcgagaggataatcttcagctcctaagcaggtcacgagatgtgactcgcaagaaattgggggagaggaccggtgtaataaagatggaaacagtacagcaggatgatgaagccctggttaaacttgagaatgcaggttttgagcgttcaaaagcagttgattctgctgtgctgggaaaatatagtctatggagacgcgaaaatgaaaacgagaaggcggatgcaaatgtccgtctgatgcgggaccaaatgatcatggctagaatatattccgtgcttgccaaatccagggacaagctcgatctttatcgggagctactcgccaggatcaaggaaagccaacgctcccttggggaagctactgctgatgctgatctccctaaaaggcttctgagagagcaaaagcaatgggtcaagttttatcaaaagcaagggatcaattgtttgattgcaagg

SEQ ID NO: 9689 - DNA, 373 bp, Triticum aestivum
  Clone ID: PAT_TA_9689
ggctactcctgaccctcacgttcctcgccctgcctgcgggtgccgcttctgcttctcctgccccgcacgggcccccggcggccaccgcgtgcggtagcagcgtgtgggtccacggatgggcccccgggggggacggcgtgtgctagcagcctgcgtgtggacgtctctgtggtcggtcttccttccgttcacccgctggctgcctgtgctcgtctcgggaggtgcactgccatccgttcgggcactgggtgccctggccctatctgtgttggccacagccatcccctcgggcacggaagagacttatcctaactatgtatgctgaaatggtttcctcattgaaataagagagatattaattgcaaaaaaaaaa

SEQ ID NO: 9690 - DNA, 262 bp, Triticum aestivum
  unsure (1)..(262): unsure at all n locations
  Clone ID: PAT_TA_9690
aggaattcggcacgaggtatacctccaaaactagagaccccatacattctaaagtatgttgttccagttatccattactttatcatgcaaaaaaaaaaataaatacttctcctgaattgcttacagctgtgcttagttgagtttattgattaactgtagttattaatcataaataaaactgtaaacaagctcccaactgaactgccgagctgaatggcagcaagaagaaaaatgaagagcaccttaangaagaaaaaaaaaa

SEQ ID NO: 9691 - DNA, 1096 bp, Triticum aestivum
  unsure (1)..(1096): unsure at all n locations
  Clone ID: PAT_TA_9691
gtgcctggaaacttgcaaagctggacggcaatgaggcgatgaaagctgccgcaagagctcgggcatcgtcctccgtcctccggcctgtaggtgcgcgtggccctggctccactggcaactctcatcctcagagtatcgcgagccaggatgactacgagaccggcacgcagagtgctagcagtttgagcagcccagtccacatccacaagcttgcacctcgcacccagatgaatgtgccgccgcctcgaccgccggagaggcctggtgttccgaccacgcaggcaaccaacccaataatgttccggccagcaacatcctacgctccgcgagaaccgaaagagcgtcggttgtttgggatcaagatgctggtcggtatgtgtctgtggcatccgcacctgcaagacctgggggagttgctgctggttcttctactagagcgccacgtttccttggaaaacccaagtggtgggagaaatcttgcgcgaatgagtgcctcttccttggcattaccatctggacagccgtctgagagactggcctactctggacagtcgatattcttgggcgggccggttctgggtgctgctgctgaatctcgaacgaatgaggccaacacaagagcacggccggatgacagtggggagctcaacgccgatcagcaccatgcaagggggactggggagagggggccaacggccgagtctttcccaccgggaacatttcaaaagaaaccaccattcaacaggtgaagcgcaaagaagcgattacggatgacagcgaaccgtcctgctagatcatagctgcgccatgaggacatgccaagatatgtgagcaatcacaggtccagtgactgcagctgcaagcctagaagactctgcaggtcatctttggggatcatttactgtcaagttatgcatctgaattgagcataacatttctttctcggaagacccagtgacttatgaaacagaaatcaggaaacaaaagcagaacagccagtgggcttcggtgtaacaatttttgttccctcattgtggcgcgcggtagcttcgtttaacaggaaaattaaaacatatcatgatatctaanaaaaaaa

SEQ ID NO: 9692 - DNA, 1174 bp, Triticum aestivum
  unsure (1)..(1174): unsure at all n locations
  Clone ID: PAT_TA_9692
ttcggcacgagggtggatctggagggctggagggggagcggcgccggcggccgcagatctggaggggaggggctgcgcggagccagctctctttttccttcgtttccctctctccctctctgtgaacccgcgtggagagccagctctctttatcctccccaaaatttttttgccagcgcgccccgctggcgccacccgggcgaccggcggctactagccagcgactaatcacggcaagtcgccggcgagtcgcgtgactcgctccctgagtcaagtcgcctgcgtgagccagccacgccatgacgactcgacgattagtcggcgactcaaaaaccttggcaacggcgtcaaagtccgcgacgtagtcctcgggcccgacgactccgcggcggccgagcggagcgggctcctcgggctcctccttcaccgggacgaaggcgaacggcgccggctcctcctcgtcgttcgaccactccctcttcacggagagaaagcccgtgccggaggacgaggaggatccggcgtaggaagacctcgcggaggagaaggacgcgcgccggcggtcgtactcctccgtctcgcggcggttgaagctcgccggcggcgacatcccttggttggtccacttccngggctccgcgcttcctcgtgccgtccgaccggacgcgcagctcgcgctccggggccctctcacggctggatctgctgccggagccgcgtccggagctccacattcggccccacatggcggctggaggcggggccggtggtcgccggcggcgagaaatgtggagaagggaaaggggaatcgagtggctcgcggcggcggcgggacagggtttggacccgcaaaagggtcacggaaccgcagttatactgctcggggcgtgcggtttgcgggctgcggcaaaaaaatttgcgggctgcggcaaatttttttgcgggccgagcaagtatgcgggctctgttctggccgaaaaattgggccgagcccacatactcgccggaatttttgcgggccgggtgttttgcggagtctgctagagttgctctaacatataaggatgttaataagtgttttcagtttcagggatgttgattcctgccatctttgctttgctttgctcctcacatgttaagtgatgccctgtaactcatttcctatcaagatgct

SEQ ID NO: 9693 - DNA, 674 bp, Triticum aestivum
  unsure (1)..(674): unsure at all n locations
  Clone ID: PAT_TA_9693
attcggcacgaggcactgaagcttcaaacaaaatttcagtgatcttgtactcaatttagtggcaatcagacttgatatgcaaaactgaagcttcaactgattttttcaaaatttcagtgatcgtgtattaaattttctacctcacttttcttgagttagttaaaaatttacacagcagtagtaaatgtagtgtgtgtagaatttcaaccacaagactgtgattctcaccaatatccaggagccaatcagttatgtcttcagagaaattcagttgaaatgacagtagttttcagttttcagttttgacaacagtagaacatcttgtcagttttgacagtgtgtgtagttgttgtggagcaaactacacacatttattttctagtccagcagatgttgtggaacatttattcccacctccaccaccatcttgtcagttttgacaatgtgtgtatgcagtagttttgacagcagtataaccactcattcaaaatgaggaacaacaaattactctagtaatggctccaatagtggtgctaggggtgtttgtcacataaagaaatgtagaagatatcttattctaaacccttatgatttgtgacactggactatcattctgatgtatgtcaatcagtatcttattctaaacaatcgnggatttattggngtactgaaag

SEQ ID NO: 9694 - DNA, 331 bp, Triticum aestivum
  Clone ID: PAT_TA_9694
gggcgccacgcgtacgcgtccgagaagatcgatcgatcgatctcggagcctggttgaatccacccaccgccactcgatccaatcacatacagcgaggaaagattaaaccgccgccgccgccgcgatgaagttgcagacggaggccgccgccgccgccgggggggaggggaggctgatgatccggcaggtgtgggcgaacaacgtggagtcggagttccaggcgatccggcaggtggcggagcggtttccgtacgtgtccatggacactgagtttcctggcgtgatccactgtccaagcaagcaccactcgacgctgaccccgtcggagcgg

SEQ ID NO: 9695 - DNA, 1463 bp, Triticum aestivum
  Clone ID: PAT_TA_9695
tcgcgcccctcgccccgcgcctccgccggccgcgccccccggcgcggtcccccccgcccccccgcccccccgcgctcacctgggacgtcttccgccgcatccgggaggtctacttcgccggcaacaccaggcagggccagggcgtcggcaacttcgccggcgtgctctacgggctggggctgaagatcgatcgcaccgatcgatcgatctcggagcccggcgcaccgccactcgatccaatcacatacagcgaagaaagattaaaccgccgccgccgccgcgatgaagttgcagacggaggccgccgccgccgccgggggggaggggaggctgatgatccggcaggtgtgggcgaacaacgtggagtcggagttccaggcgatccggcaggtggcggagcggttcccgtacgtgtccatggacacggagttcccgggcgtgatccactgccccagcaagcaccacgcgacgctgaccccgtcggagcggtacgcggcgctcaaggcgaacgtggacgcgctccacctcatccaggtgggcctggcgttcgcggcgtcccccgacgcggcgccggcggtggcgttcgagatcaacctgcgcgagttcgacccgcgcgtgcaccgccacaaccccagctcggtggccttgctggcgggccacgggctggacttcgcgaagcagcggaggcagggcgtggacgcgcgcgtgttcgcggcgctgctcatgtcgtcggggctggtgtgctccggggccagcgcgccgacgtgggtgacgttccactcggcctacgacttcgggtacctggtgaagctgctcatggggcgcaagctgccgcgcacgctgcccgagttcctgggcctggtgcgcgtcttcttcggcgaccaggtgtacgacgcgcggcacgtcatggacagctgcgccgggctctacggcgggctggacgccctggcggcgcagctgggcgtgaagcgcgcggcggggatgtcccaccaggccgggtcggacgccgcgctcacctgggacgtgttccgccgcatccgggaggtctacttcgccggcgacagcaggcagggccagggccagggcgtcggcagcttcgccggcgtgctctacgggctggacctggagctccacctcgccgcgccccgcccgacaacggcagcggcaacggcaacaggaacaacaacaagaacaagtgcggcagcggcaacggcgccggcgggcggggcaacaacaggcgggccgtggcggcgctgagatgaaccgacccgacccgacccgacccgacccgaccgatgattagttgtagagcggttaaccttgcgttaattgcttatgttctcccgtgccgacccgttccgactccttccctcgtcccttgcctgcccgggccttctctccgttcacccctactgcccgcggggtattccctgtcggcctcctgggctgttttaacatgtctt

SEQ ID NO: 9696 - DNA, 655 bp, Triticum aestivum
  Clone ID: PAT_TA_9696
ggggttctatcatgctgaatacaagtaagggaattcggatttctaaggcattgaatgattccaggactggctgtgaccatctgtctgagaactggctgtttacactcgcggagctaaatagttctcactacatgtcagtttgtatagaggacagctccagaagtcaaggccctgaagacagcccagcaccagtaggattgaaagtatggaagaccataccatttgtcgaagatacactcgtctctggaacagaagctgtaaaacttattgcctgactaccgaaacatcgttgtgaaatacacttggtccagtaccgataggttttggtctctgcccactgaaacatcatttttcctgtgtgttggctctcttctgttggtggaaacattgttggtctgagctgccattcaatggctgttactacattaccatatgtgtcttcagagtttgtttgctcacaacatttttttttatcggagacgaatcttgcgatttgaagctgttggagaagggcttcagagaagcatattggtcgaaaggcctgtatttgcatttttagggcgagtgattgctccatctagtttgttctatacctaaacagagttgccctgttttaagagaaagagttgctcaatttttatcaggaaaaaaaaaa

SEQ ID NO: 9697 - DNA, 659 bp, Triticum aestivum
  Clone ID: PAT_TA_9697
gaggaattcggcacgaggctcccgcgagcgccagcctcctggagctcctgtaagccccaaccacctcgccgctccggcaagtcgacggcgaacagatgagttcgcctccatcgccggattatccgccccgcttcggccacgtccagatccccgcagttcctcatcgttcccgtcgccggagcacctgcacctcgcctatctgcctcacagccacgccggagcgctgcgtcgcgcgacgtcgccaaggtcgtcatccagctaggtggccgaggtaggtgcccggaggcccgagcctcccgcggctgaatccgccggagccaccaagacaaggtggatccagggatggcgacgcagatcttggggcatgaaggcaggggctcggcagcgcgatggaggggaggccggaccggcgcggggcatggaggcttcgactagactggatccggccaggatggaggtcgggtagggacaggcgaccggtggcgaggctcagggtgccatggccgggatggaggtcggggaggagttgggggaggaagaagataggaaggtgggtgggggtgtgggtcccatgaggaagagagagggaaggcttttttctattgtatttaattgggtcccacatgtaagtgtaacttttttctttattttaactaaac

SEQ ID NO: 9698 - DNA, 996 bp, Triticum aestivum
  Clone ID: PAT_TA_9698
gcaagagaaagttagctattgtggggaagggtctaacttttgacagtggtggatacaacatcaaggttggagcagtttgcagtattgaactgatgaagtgggacatgggaggctctgcagcagtatttggtgcagcaaaagctctgggccaaatcaagcctcctggagtgcaggtccatttcattgttgctgcctgtgaaaacatgatcagtgggacaggcatgaggcctggcgacattgtgactgcttctaacggcaagacgatcgaggtagataacactgatgcggaggggcggctcacacttgctgattctttggtctatgcttgtaaacaaggtgttgacaagattatagatctggcaacgctaactggtttctgccgtgttgcgcttggtccaagcattgccgggattctgacaccgagcgatgaactccatgaggaagtggcagctgcgtccgaggtgtcgggagagaagttatggaggctgccactagaagaaagctactgggagacgatgaagtctggtgttgctgatatgctcaacaccggcgctattccacagggcggcgtcatcaccgctgcgctgttcctgaagcagtttgtccatgagaaagttcagtggatgcacatcgacattgctgggccggtgtggagccacaagaacaggtcggcgaccggattcggcgtctccaccatggtggaatgggttctcaggaactcgtcgtgaatcaacgaagatgaaggcacgcagggggagaggaagttgcctgatgttatctcctacaagggaaggggggattttactagtgcccacgttttctatatgtagtgggttacagaataagtggacacatatttgatcaaacttcacacatgcatataatttcgtttagtcaaagtttaattatgcaataggtctgcttcctctagtgtacaagttgtgaaacattgggaggatctgttttcagttgtagctcagcaaagaggaccggaga

SEQ ID NO: 9699 - DNA, 787 bp, Triticum aestivum
  Clone ID: PAT_TA_9699
gcacgaggcgatgctgttatatttgatgacaaggaaccattttcagccaaggtggcaagccagaaggatgctagtcagatgcggactgtctggaatcctgggtctgagttctctctgtgcggttgttcgtggtcaatgcagggcaacctatgtaagcacatcataaaggttaacatgatgtgtgcaccacgcaaggatttccagccctcgctctcatttcaatcgtttcagcgcgtcctacttgatctgtggcaaaaaccactggatgattcattctcactcgatctgtcagtagcatgggttatgcaaatgcaggagaggatccaaaaagtggctgagcttgctgcgtctgatggtattgcccaagttgcaggcaaattgccaattcaatgggcaaacaagagagggagaagaacagctattaggcgcaccagccccatgtgcattcttcctcattccaacggcagtgtgcaaagagatttgactctgaagaggaacagaaagaggagaaggttgtccaacttttcaggctaactactgtttgtactgaccattgttggccagggagttcttttttctcactgtaattagactaactgcgttttgtttcttttctagttcttctccagttgcatttggtgagaaaactcacttaggtagttgtaatcagattgatataggccttggatcattttcaccttctgggaccatcatttggatggttacgtggatataattattccagggagtaatagttgaatttaagcaatgtgttatttgcaaaaaa

SEQ ID NO: 9700 - DNA, 846 bp, Triticum aestivum
  unsure (1)..(846): unsure at all n locations
  Clone ID: PAT_TA_9700
ggcagaacagagtggggaattggtttctcgttcaatggcaggatnaatgatgccaagggaaaacttcgggtatgccgatgcccatacggtgccttgccgcacggcggcagcagcgactggtcccgcagactggcgtgaagctcttgatattgttgcattaggtttgcctgaacagtctgttgaaggaatgaaagtcatatgccacgagctaactcaggcggttgatcctgaaagctctgcgcttgatgatctcattaaggaagcagacagattagtttcatgcttgtctgttatggttccaaaaacatttaatttcagcctatctggggcatcttcaaggtcttgcaaatacgttttaaatactctcatgcagactttccagatcaaacgtctcgctcacgcagtgaaggagggtacactagataaccttatcacagagctactactatggcttttagatgagcgggttcctcttatggatgatggcagtcaactacttaaggctcttaatgtcttaatgcttaaaatcttggataacgccgagagaacttcctcattcgttgtactaatcaatttgctgaggcccttggacccttcaagatggccatcccctactccgtcagagtcccttgctgtaaagaatcagaagttttcagatttagttgtcaaatgcttaattaagttgacaaaggttcttcagagtacaatatatgaggttgaccttgaccgcattcttcaaagtgttcatatttatttacaagaacttggaatggaagagatacggaggagggctggagctgatgacaagccattaagaatggtcaaaactgtgctgcatgaacttgt

SEQ ID NO: 9701 - DNA, 1134 bp, Triticum aestivum
  Clone ID: PAT_TA_9701
aggaattcggcacgcgcgccccctcccgcctcggctcgtctctctcctcgctcgctcgctcgctccctcatgtcctcctcccagcctgcgcctgccatggcgctcttctgcccatttatcttacccagctcgccgaccctcgctccgacggcaaacttcttcctggttgcatgccaattggatccccacccatggactatttcttgtggtgcagcctcaagatgttcacggacggggcggtgagatctatcgattggttcctcaatcaacagccggatgcgtccgaatttctcgtggtgccaacctaagatgaacacggatgccaaggtcctcccccgcttctagctggctctgcccgtccgtggcccctctctggtctctgacggattccaccgcgggcccgatcagtccggctcgcggagttgcccccgggccagtagtgcttgctcgctctggctgaggccccgccgcccgactcccgctcgtgcatgccgccgctggattatttgcatcttcgggacatgacagtttctggtcacatattcagatttcaccgaggaggcttgagttgggcaggcgtgatgcaattgaatatgtatcgttgaattttgagtccaagaaaattcatgtttctaatccttcgttcctgcaatagagttgcagtcttttggcttttgcagatgatagcaagcaaaattgagatgcatagatttccactacaggggttgaatgttcttcaagtcagaaataacaaatctaggtaggggagattaaaaactgtgtacattaataagaaggttacttgaattgcttttctttctgcataatattcttccatccattttctttgtttttaagtcatgttttgttatctgtttgatgcccgtgatggaaaaaaaatgacatgtcttcagattatgcagttttagattaggtcaaactgttgttgtatacgaactgaaagtaataactgtatttcactttgaaccaagaataataccagaatgatttcttacactaattgttcagttttaaccacgcaaaactgtaactgtttccctcctctctggtccttcaccatctgtactagcactagagaagaagaacttcctgcttctgtactttttgttacag

SEQ ID NO: 9702 - DNA, 748 bp, Triticum aestivum
  Clone ID: PAT_TA_9702
ccacgcgtccgcatggttttactagatttggttcccccctttcttctccaaccaatccaattcttcgccgccgccgccgccgccctctcggccgcaggcggtcgccgctgccggattgcctcctcgcctcgtccgtccgtccggcgacactgctgcacctccgccgccgccgccgccccccctcccggccgcaggcgctccccccggctcgcttgcttggccagcccgcccgccctgcgcctccccccccaccccggcgagggccccgcgccggggcagggggccaggtggcagtaacagggcgggatgcgccacctggagttccagaggatgcgcgtgacgctggcaatcggcgtggtcggcctgtgcgccacggcgtacatccttggcgcctggcaaggcacctcgtccgccataaaggacgcccccaggcctgtgtacgccaagacgcagtgcgacgaagctgcctcgcgtgcccccagcaatgcgtcaggcgcccccagcgtcgcctcggtggcatcctcgggcgcccgtctcgatttccaggcccaccaccgggtggccttcaacgagtcgtcgctggcgacggagatgatcccgccgtgccagctcaagtacagcgagtacaccccctgccatgacccgaggacggcgaggaagtttccaaaggcgatgatgcagtacagggagaggcactgccccacaaaagataaattgttccggtgcctgatccctgcacccccgaact

SEQ ID NO: 9703 - DNA, 1310 bp, Triticum aestivum
  Clone ID: PAT_TA_9703
aggaattcggcacgaggctgggatcttattcccgcatgtccgcacaaagaataaaacagagtgcattgctaggcttattcagttgccttttggtgaacatatgctgggcaacataaataatggtaaatctgatagtaggttccatacaaaccaaactactgatggcaaaacgaaccactttattgtgaaggaggcatcaagtcagtcggccgatatggttgatggcatgcagattgatggggaggaagatggtgctgataaattagttgaagaccatccttcaaagcgtcggcgtttatgttcttcaatagatgtcaccagttcattaatggagcagttagcactgctgactaccgcggtgagcccagatgttgtggctgcagctgcagccgcatcaattaaagcattgggtaatgaaaatccccaagcaaagaaggcatttcatctcagcgagaaagaataccaagtcaaatcattctcttctaaccatgtccaagagagtgattgcaatgttggcaataaggaagcagaaatgcatggacagactgttcctgataagaaaacggaaaaaaactttatttctaccgcatatcaagtgagggcagctgttggaacagctgttggtgcagctgctgcccgcgcgaagatgcttgtggaccaggaagagcgagagatggagcttctaatggcgtccataattgaaactcagctaagaaagatccaatacaagatcaaacactttgaggagctagagttgatcatggagcaggagtacaccaccatacaacaaataaaggagtccctgatgaaggaatggcaaacggtcctggagcgagcatttcagactggagcaccgcttcagagggacgaagtgctcacaaggctgttcctggacaggtctactccatagagaagctgactggagccgattatccctcctcctctgatccgccgcctcgccctctgactgtagtccctgtaggtaaagcagcattgtgcgtgcgcgcaggagggcgggcgcatctgtaaaggtgctaattcatctagatatgttgtgcttggggccgcccctcagccccctgtaccatggtgtgcaattgcgcacagcagcagctctgtttgtaccaacatccagctagggttagatagcaagggttgctgatagtctgctgtaacttcattttttccggatgcacagatgtttggtcggttcggggtgtccgtattgtcggccccgctgtactgtttggttgaacaaatagtcgctgtataactttccagtgtgagcttagagtacataccgtgagaat

SEQ ID NO: 9704 - DNA, 596 bp, Triticum aestivum
  Clone ID: PAT_TA_9704
ttcggcacgaggcgcttcgattcctcgccgcggggaggctctcctcacgcccgatccgcgcaggaggaccagcgaggcggctcctccaccactccaggagccatgcggacggtgcccggggatctggcttctctgcccgtttgccgatgggaggcaacaacaagctgcgtgctagcgtcgcggcggtgggggccttgtctgccgccttgatcggagcaaagctgtatctcagaaaacaaaaacacagaagcaaccaacatctgaatcttcaggtaggaatggcaaggctggagggctgaaaatagaagactctgctggctgctgaagatgtgtgcctttatatatgttgctgccgtgttttagtagtttatttgctgttagtttctctggtgccctcgtgaactttgttatatccgggatgatgatgataggcagacttgtaggcctgatggtttttggtgatgttggttcgtgtagggtttgcggcgctgccttgcattatgttagtcgttaggttgaatattgtggttctgcaagctggttttcagtgatgaaaatcggaagggggaaaccccttctttgatctaaaaaaaaaa

SEQ ID NO: 9705 - DNA, 1068 bp, Triticum aestivum
  Clone ID: PAT_TA_9705
cggcacgaggctccctccctccaccagattaagcctgccgctgcgctcctccgcctccccctcgtctctcccagatccgcccgtccgtcgatccatggcgccgtcgtcgccggcggcggcggcggtggcggagggagacgagcagcagcagcagcagatcgtggcggcggcggcggcggccaagaagggcggcgggaagaggggccggcgcgagatgcggcggatcgaggacgccaccagccgccaggtgaccttctccaagcgccggagcgggctgctcaagaaggccttcgagctgggcgtcctctgcgacgccgaggtcgccctcatcgtcttctccccccgcggccgcctctacgagtacgcctccgcgccagatttgcagaaaacgattgatcgctatctgaaccacacaaaagggacatctgccaatgagaaaactgttgagcaaccagctgctggcgtccagatgtgtagatccgaagctaccgccttgaagcacaagatagacgcaattgaggcataccagaggaagctatctggagaaggactggggtcctgttcggcccatgagctgcaagagctggagctgcagctggagaagagcctaagctgcatccggcaaaagaagcaacagaaaatgctggataaaatcttggagctgaaggagaaggagagaaagctgttgacggagaacgtggtgctccgcgaggagtacaaggcgctgcctctgctagagctggccactgctgctgctgctgaaagatcgcctgacggcgccggagctgaagaagctgaggaggacgagcggcggctgcattacatggaagtggagactgagctggtcattggaaggcccgggtcgtctagctagcagcagtagaaaattgattgattaaatctgctcaatcgatgaagatcgatgcaaaaatcgatcaaatatgtttgtccatatataaaatcagtttaattaggtcggtgtgagactggaggataccgtcgcaatatttcactgcccggctccggcttgcgtgcagggccgctcttagaaaaaaaaatggtcgcaac

SEQ ID NO: 9706 - DNA, 713 bp, Triticum aestivum
  Clone ID: PAT_TA_9706
ttggagttctgttctcttgtgcttgtatgaagctggaagacatggcaaagtgcaacttttagatattttctgcgaggcaatcaatccagatctgcacactcagaatgattcaaataatgaactgcttatgtctaaactcacaagtgggaatctatcaagtggaaaatcaggtgctggtagaagatgtatagctcaggcattggatacagcaagatacatgcctatggaaacattatttcgtgttcttgaagtttggagcacccacttagaaggaatgaatgagattaatgccaaggtcaaagagcttcagtcaaccacaaccagtgaagattgtgtgacaatcacaaaggataagtggcctaggagatcagcaaatatactgcaattggacagtgccattaaacgataaagctgccatgctattggatgatattacgagaaatctttgggccgtggagtgttacctttcacgaaacattgctcaagaatgttggtgttctccaatctgcactacttggaaacccaagaagaatggttcagcttgatctcctgaatccacccagctgatgccgttgctcctccggcacctgaaatggaattgctgtgtcagcatccttgcatgacacatcagttatgtgcaacctagcccaagaatatggtgacgtaattaacctccatgactggtacctgtcttttgatggaattatcaattc

SEQ ID NO: 9707 - DNA, 318 bp, Triticum aestivum
  Clone ID: PAT_TA_9707
gtacatgggtgagctgcaagtttgaaatgattaacaggccagttgctccagtactagttcttctgcacaagaaatgattgcagttccagtgaagctctaaaagtttgagactccccgttccggttcgtgatgaatgaaatgccacaacgcatactgcgatcctgaatttctgattatgattatgagttacgagaaggaaattctgtaaaggctacagttagttttttttgctacagttggttgtaactgaatggttaaggtgttctggtgattgctcccaaggattactccacgaaaatatcggcactaaaaaaaaaa

SEQ ID NO: 9708 - DNA, 456 bp, Triticum aestivum
  unsure (1)..(456): unsure at all n locations
  Clone ID: PAT_TA_9708
cgtccgcccacgcgtccggtgaatacaacagaaaaagaatggggcattcgtgcgcccactacgcgttcgtgcgcctgccgggaaatcattgtgtctgtgtgtccttcttcctcctccagtcctcttcctcctcgagtgcaaggcgagtgcagaggcgagagagagagggcggcaacaacaatttgtatcatgagcttggtcatcttgggccatgccggaggcgtgccggcaatggcggcgttcgtcggcggctgcgcggagctccgggccgtgtgtcggcctgtgaaggtgcgcggcgctacagctgtcatggcggatgcggaggtggtgcacggtgagtccgcgacgagcacggcggacatggaggtcnaggcggtgtggctgcggcgcatggcgatgacgacggcggcgggccgggcgcgaccggtgcgtgttatgggtgcgcactggacgcgt

SEQ ID NO: 9709 - DNA, 1019 bp, Triticum aestivum
  unsure (1)..(1019): unsure at all n locations
  Clone ID: PAT_TA_9709
aaaaactgccgccacacgcgcacacacacgtcgcacgcccccatctctccccaagccacctcgctcccgatcccgtctctctcgaagaaaaatcatcgccgcctgtgctcgccatccatcccatgagctgcatcgtgagttcgtgacccgatgtcccgtgccgtctggatctagggaaggggatgccttccatcccgtcccttccgcccgccgtcgaagcgatagagatagcagagagaaaggaaggagcgcagcggcggacctgcacttagcgccatacaggaagagtggtggtggggcggcactgctgctgctgggacaacggggctcctcgtgtagaggccataaaggaggcggcggtgggaagcccatcttcctctctgtgtctccttccgcaggtcctcctccacgtcgggtacacttgacatccacctcttcttcccctgcgcccaggcatgtgcatatcagcctatgccattgacccctcatcggcggaggtgtgcgaggattccgtctccgagcagcacgacggacgtctctttcctatcgctgctcaacaccgagctccacacaagagaacccttttgccatcgaggccttctactactggtccacagcctcgagttcttcctcttcgtctggattgggagcgcaaccacccattattgctgcaaatgtttcttagacgggaattaagttgttttcaagaaaggctttgtagttctttaccaatggcgttcagctactacaacgtctgatacacattctggtggtatatgcaaccatgctttacaaagctaattaccacatccctctttcactaggatatgtgccgctctgtttgatatacatcgtgactttgtgctcctccatggttctcagcatctccttgatcactccagtcaatgacccatggactgatctgttcaaatcagcaacattctagcaagttgttacttgttacccatgctaaatgtaatctctctaactgcaaattgtatgcggcacncggttactca

SEQ ID NO: 9710 - DNA, 945 bp, Triticum aestivum
  unsure (1)..(945): unsure at all n locations
  Clone ID: PAT_TA_9710
tccgacaggccgaggaaaaccgtatgcgccttctgcatgcagatatgcagaggcgggccgcactgaaggagagaacagagaggtccctcgtgcagaaggcgacatctggcagcaagttcgccgcgcgggtgcgatctgctatcctggcaaagcgtgctgctgctgagcaagaaacggttggcgttgttagaagctgagaagaggaaggctcgtgctcggctcatgcatattcgacaagcagccatgactgtaagcagccagagagaagcagagaggattaaattgaaagaacatctggatagcaaacttcagagggccaagaggaagagagctgaatatttgaagcagcgaggaagtccatgcagttctgctcatgccgattacatcaagcatgccgattttctttcaagaaagcttgcaaggtgctggagaagttttgtgaagtccaggaagacaacacttgccttagctcaagcttatgatgctttgggaattaatgaaaaatctgtgaagtcaatgccatttgaggaattagctatgttgatgggatctcccacagctcttgaggctacaaaggcattacttgatcggttcgagaggcgtttgactctttgtcagtcagcaaattcatcatctgcagataatgccgttcctcgcccgcggggcccctgcggcgccgccctcccatagggcggaaacaagggttgnacaaaaaggcaccagacttttgacagccggtgctanaattcntgngggggacttggctaaangaaccgggtatctangntgttaagggaaaggggacagacnctctttggancanccnactttgcggggttggctttnttanaaattttngggacnagaaaacctagggnccttttggggggtnaaattantnccaaanttttttgtgccnccaanaaataaaaataatggttattt

SEQ ID NO: 9711 - DNA, 837 bp, Triticum aestivum
  unsure (1)..(837): unsure at all n locations
  Clone ID: PAT_TA_9711
gctccatcccctctttcccccgcctccttcttcacctccggccgccgccgcggccaggccggcgtggcgacgcgccacccaacacctctacctgctccacaaccccgcagcacctccacccgtgccatcgcgctcccaccacatcaccatcaccgccggcaccaccgcgcgccaccactctcctcctcctacaccatccatccatcgcagccgcgccaccgcgccatcaacagcatccaccatcatcgatccatctccaccttcactgtgccatccctccaccatctccagccaccgccatacctcgcgcgaccaaccagacaaatgggagcataggcgtctggtcatccgcgtgagggcgcccccgttttgctgctctacttctcctaactcatgatgttgctcttctctccacacccccactgcatcttctttttccccttgacctcctgctgctatctcctcttcttcctccctgaaccataactgctgctgctcccttctcctcacgcctctgctacaggctgctgctccttatctgaaccaactgctgctgcttctcttcccctacttgctactctgctccatttcttctgcgtcccctgctgctcctaaccttgctgctgcttctctcttcttcccttatctctgctgctgctcgtctccaactgaacctgctgttctctttctccctctctgtaattcatggaaattgtaatgtattaagtattttgtttagttcagagacctatacttttctagtagtattattcaatatatgtgccctgtttatcaattagtgttttgtaagaactaagattacnagtcaatttntgt

SEQ ID NO: 9712 - DNA, 633 bp, Triticum aestivum
  unsure (1)..(633): unsure at all n locations
  Clone ID: PAT_TA_9712
ttcggcacgagggcagggnagcagcacctcgggtgcccctcgtcccgcggcctcgtcaggcccccctcgtcccgccgctgcttcaggccccgctcgtcccaccaccggttcagggccccctcgtcccgccgccggctcaggtggcaaggcgagccataacgcatgctgacgtggttgacgcgtttgaggtcgtgaagtgtgactgggctccggttcgtgctggggtacctgagattgagaacactttctatgagtttgacaagagaggagatgatactaaaaatcgtggcgggaacctcataaagagacatctgttcaataggcggaaccatgtgggtaataagaggcgtgagatttgccactatctgcctgcctacaagaagtacgcgattctgctcaagaagctgagcaacgacctgcaaggcttagagcacaggctggacaagaaactgttggactacaatcaatacatgcctgaggccccattgacgaatccggaccatttttcgaggtacccagagttgttgaagccagcaacgaaggggaagaaggcgacgaagaagtaggctacacttgtactgggtccaactttttggtagtcatgagttgggtgattttgtctgggactatttg

SEQ ID NO: 9713 - DNA, 706 bp, Triticum aestivum
  unsure (1)..(706): unsure at all n locations
  Clone ID: PAT_TA_9713
ccacgcgtccgnnnagnngccttgctgattggaaatcgaccatccaattccgagccctaatccttcgcatttcctggagcgctatcttcatctgtccgcgtcgcgcgggagatgatgggggcggcggacaaggccgagctagggttcgaggaggaggatgatatggcggccggcacgccgccgccggccaggaagatgcagtcgctcgatttcgagcacatcggctcgctcgcggcggtggcggagtcgctctcgccccggagcaagtggcggatgacgctcaggagcatacgcatcgtcatcttccaggccaagatcaatgtgctcctgcccttcgggcccctcgccatcacgcttcactacctctccgggaaccaccaaggatgggttttccttttcagcttagttggtatcacgcccttggccgagagattgggatatgcaactgagcaacttgcttgctacactggcccaacaattggggggcttctaaatgctacttttggaaatgcgacagagatgattatctcgatatatgctctcaaaaacggaatgattcgtgtcgtacagcagtcactactaggctctatattatcaaacatgctgttagttcttgggtgtgctttctttgctggtgggcttgctcatcctaatagagatcaggtcttcaataaggcatcagctgttgngaactctgggttgttgt

SEQ ID NO: 9714 - DNA, 663 bp, Triticum aestivum
  Clone ID: PAT_TA_9714
cgccgccgccaggctctgctccggcggcggcggcggcggcggccatcctggagtaggccgccaaatcgcggttccagttgagaagttccacgtctcccctattgcagccatgccccaccggagcgcactctctccggcgccggcggcctcccgaggagaggaatctcgctgccttgcagatccgctgccgcctcctcatctaaggactgaaaatggcatgaaattcggcctgtaggatgcatgattcgctgatattctcagcgatataaagtcgcacattgcactttgtgaaatacggagtgctcaattgtggaacagcagaataaggtgtcaggtgctaataggtgggaaagatcgaaatgtattcagtgctagtgctatggattgccgagatttttaagataaggcatgattaattaaactgtagaatgatcctgtgatattctccgcacaatgaaagtggcaatcaaaggggagcccagtgaggaggaatgcactgcaggaaaatactgagttggagatacatcagaggaaaagcagagcaagattttgtaaaacacctgaggcttggattctctgttcgattccctctgctggcgccgcccgtgtgccctctggggccatccctgagtgcctaatgaagttggtacgcggacttgatga

SEQ ID NO: 9715 - DNA, 811 bp, Triticum aestivum
  Clone ID: PAT_TA_9715
cgtccgcgtaccctcacacccacactcccactctgctaccaccttatctagctcctcctgcaagctcctgcatcccagctagcagagcttgaagctcgaccaggatgagcaagccatcgaggtgcagggcgctgcggacgcaggtcgccctgctcctcgtcttgctcgtcgctgcctccctgctcccggctggcgacgctgcttcagggttctgcgcgggcaagtgcgcggtgcggtgcgggcggtcgcgcgcgaagcggggggcgtgcatgaagtactgcgggctgtgctgcgaggagtgcgcctgcgtgcccacggggaggagcggcagccgcgacgagtgcccctgctaccgcgacatgctcaccgccggccccaggaagaggcccaagtgcccctgaccgccctatcgacggcccaccgtctcaagtctcaacgccccaacggcttcttcaacctctactccaccctaccgacaggagtagtagcccagctactctatgtatgtgatgtcggacgcgcgtgcttatgtcacttccctgtgctcgctcgtgctaattatttgtgtgatgcgtattgctgcctgctaaagtgctaagtatgtgttgtcgttgtacaccacgatcgacttgtagaagtactctgctactagctgggatcgtcgggtctccgtgtgtcccgcctggagtgtacactggtgcgcggcggcctgcgcacgcctccgggcctggtgtgcgtgccagcgcctcgttgctcgcccctccgtgcctgcatgtggctacgctgaaaaaaaaaaaaaaaaaaaaaaaaa

SEQ ID NO: 9716 - DNA, 283 bp, Triticum aestivum
  Clone ID: PAT_TA_9716
cacgagggttataaatggtgccgtcatcccagcaaataacaaacaatacgtgacttatacaagaaaacatgggcctcgcataccccagtattttctacatattatttttgtggatgctcctgtcctgagttgtgtgccatttgcaggatctccctcctgtgggtctctcaaccgggcctggagctggagtcagttgggcatcagccgatttggtgtccacacggctttcgtatgcctgaataaaacttcataaagcaatacctttttggtccaaaaaaaaaaa

SEQ ID NO: 9717 - DNA, 677 bp, Triticum aestivum
  Clone ID: PAT_TA_9717
ttcggcacgagggccaatggtgcaagaaggtgctttgaccgctttagcgtcagctgcagattcttcgcaggaacacttccaaaagtattatgatgcagtcatgccatatctcaaggctatactcatgaatgcaactgataaatcaagcagaatgttgcgtgccaaatccatggaatgcataagtttagttggtatggctgttgggaaacagaaatttagggatgacgctaagcaggttatggaagttttgatgtcactgcaaggatctcacatggaggctgatgacccaataacgagttacatgctgcaagcatgggcaagactttgtaagtgccttggtcaggagttcctcccgtacatgagtgttgttatgccccctctacttcagtctgctcagcttaaaccagatgtgagcatcacttctgcaggcgaggatggtgaatctgatgatgatggtgttgagactattaccctgggagataagaggattggcatcaggaccagtcttctggaggagaaagcaacagcatgtagtatgctgtgttgctatgctgatgagctcaagggaaggtttttttccatggattgatcaggttgcaactacctctggtacctctcctcaaattctattttcatgacgaagttaggaaggcagctgtttcagcgatgcctgagct

SEQ ID NO: 9718 - DNA, 569 bp, Triticum aestivum
  Clone ID: PAT_TA_9718
attcggcacgagggccaggtgacgctcctgtggttcaaacagtttctcctgggtgtcatgtgctttctaatgctgctattgattccccttggccaaaggtgttgcgcttgggacagagcttcaacggatttcttgcagcacatgatgacgcagaagtctctttgaagcagatggttgaagaactgatgacagatacggtcaaagctgacagatctgtggtgcctgacactggcgtggatcctgactgggaatacgagttgagctctatattcatcgacacgaaaaagggacaggcaagatacgggacacgaagcatggctgccattggggtgaaactggatggtgaggtaactttctacgagaagtccttggccagcagcttgtggaatgagaatgtagtacagtttgaaatggagatggcacaatagcaagacgcaaggaacatatagtgggtgtgagtgtttgcacagggaaactgagggtgttagacacgattgtatgataccggtggttgtgactcagaaagcagaaaccgatgcattgcaatctcaaagtctttgaagtccaaa

SEQ ID NO: 9719 - DNA, 779 bp, Triticum aestivum
  Clone ID: PAT_TA_9719
cccgcgtccgccccgcgtccgcccacgcgtccgcccacgcgtccggtccccccgtccaaaggcaggcgagatggcttcccccgaccggcggcggcgccgccaacggagcccgaaaggtggagagacctggacatgctcctctcccgccccggcaacctcgtccactccaccttcgatcccagccccgggctgcgggaccttattgggagcgtcgtcgaggtgctggtggtgggggcgggcgggctgggctgcgagctcctcaaggacctcgccctctccgggttcaagaacctgcacgtcatcgacatggacaccatcgacgtctccaacctcaaccgccagttcctcttcaggattcaagatgttgggaagcccaaggctgaagtagctgcgaagagggttatggagcgagttagtggagtgaacattgtgccccatttttgtaggattgaagataaagagctagagttctataatcagttccaaataattgttcttggtctggactcaattgaagctcgaagctacatcaattctgtggcttgtggtttcttagagtatgactcagacgacagaccagtccaggagacagttaaacctatggtagatggtgggacagaaggtttcaaaggtcacgctagagtcattataccagggatgacgccttgctttgaatgcaacatatggctttttcctccccaggtcaagtttcccttatgtacccttgctgagactccaagaactgcagctcattgcattgagtatgctcatttgatcaa

SEQ ID NO: 9720 - DNA, 1743 bp, Triticum aestivum
  Clone ID: PAT_TA_9720
cgtccgctctcgtctccttcccccacctcggccgcacgcccgcaccctcggcgcctcgactactatacatcctacagattcccccgtccaaaggcaggcgagatggcttcccccgcggcggcgccgccgccaacggagcccgaaaggtggagagacctggacatgctcctctcccgccccgggaacctcgttcactccaccttcgatcccagccccgtgctgcgggaccttattgggagctacgtcgaggtgctggtggtgggggcgggcgggctgggctgcgagctcctcaaggacctcgccctctccgggttcaagaacctgcacgtcatcgacatggacaccatcgacgtctccaacctcaaccggcacgtcctcctcaaggctcacatcggcgtgtaccaccaacgccgcgctagttcctcttcaggattcaagatgttgggaagcccaaggctgaagtagctgcgaagagggttatggagcgagttagtggagtgaacattgtgccccatttttgtaggattgaagataaagagctagagttctataatcagttccaaataattgttcttggtctggactcaattgaagctcgaagctacatcaattctgtggcttgtggtttcttagagtatgactcagacgacagaccagtccaggagacagttaaacctatggtagatggtgggacagaaggtttcaaaggtcatgctagagtcattataccagggacgacgccttgctttgaatgcaacatatggctttttcctccccaggtcaagtttcccttatgtacccttgctgagactccaagaactgcagctcattgcattgaggttatgctcatttgatcaaatgggacgaggttcacagtggaaaaccttttgatgctttatgattatacgtaacatatggcagtggattttattcagaggctttaaagagagcagaactttttggtatttccggagttacgtattctttgactcagggtgttgtcaagaatatcatcccagctattgcttcaacgaatgcaattatttctgctgcgtgtgcacttgaagctttgaagctcgtctctggctgcagcaaaagtgtgtcaaattatctcacgtacaatggtcttgtaggaactcatattaaagtcacagagtttgttagagatacagattgccttgtatgtggacctggtacccttattgagctggatacgtcatcgacactttcagagttcatcaagatgcttgaggagcaccccaaactgctgatgtcaaaagctagcgtaacgcacggaggcaacaatctgtacatgcagtcgccagaagttcttgagcagatgacacggccaaacctgagcatccctatgtttgagctccttaaaggaaccccatttgctactgtgcatgttagtggtatggcggagagcaatgggaagaaagtgtcatcgctgaggaagctgcgtgtagcctttaagggcgtcgaggaagcttcgaagatggatacaactgagagctcgtgatatcatcgttttagataatattaacctcccatttcgttgagagagtagtgtatttcgaagcagatgaaactgaagctgaaatttacacttgcacaatctcttcggggtcaacttaaatatatttggcaaaacttagtagtttcgccagtagaaaggtttgtatctcagtggtagactgctatttcaccagatctggtttaagacgcagcagttctgccgag

SEQ ID NO: 9721 - DNA, 626 bp, Triticum aestivum
  unsure (1)..(626): unsure at all n locations
  Clone ID: PAT_TA_9721
ggnctgcaggnaattcggcacgaggtgaaaatgaaagtcagaatgctgatcctgcttgctttacaccagtgaaggatgttcttccacctgaggcgatggatatgatggctgaagtaagtgagcttccagagaaaagcaaagaggtgaagaaagctagaagagaagtgaatggtgaagagaatggtgatccgtcttgttctacccctttgccggagaatcaagaaatgcaaagacctgtgaatgctgtggagaatgtggtgtctgcagatcttgatgaaaatcatcctgtagtcgaagaatcagaaaatgggttagcggtaggaaaaccgaacacaacactatctgtagaaattcctgacatcgaggaacaagagtctctggaaccttccactccagagcccttgcgagagggagcctcagaaaaatttggtgttgcaacacctgctcaaaatgagaagcgccaggttaccagaaaaaggaggagggggttatacaataagagaaaagtttgggtgttgtgggatgagaatgttgtccttgataatgacacgatgagagaaattgtagacggggttggtgtagaggatctagttgtcaaaagaaggaaggcgcctcacacttcgcca

SEQ ID NO: 9722 - DNA, 803 bp, Triticum aestivum
  unsure (1)..(803): unsure at all n locations
  Clone ID: PAT_TA_9722
ttcggcacgaggcgcacccgtgatggcgccaatcccggnncgtggcagcttccctttctagccctccgcggccggaggcgcggcgccatggccaggaactccccgagcgtcggcggcatcaagcggagctcctccgcgagccgaacatcctcgtcgtcggcaatgtcggcccagcgcaggccgcgctgcacccaggccggaggagcagaggacagggaagccggatcccttctctgcccggccaccacagagtccatggcgttggcggaggcggacggaaccatcaggtcgccgtgtatccgccttggttacgtgcattcaggattccaggtctggtggttcggtatgtgcttctcggctcttgctgattccgccgctgtcgcatgggcggttgaatgcatgagagagcccacggctgcttatgtgcttcaccggcattgtaaatcaacttcaagttcaaggaatcaaggatggaaaggtagaatacaatgaaaatagacttgtgtttcaagcccattgctgaaaatgcaaatgcacccgaggaaatagctgcaaaggtcatatctgatgagatcatcgacatgatcgacgatggtacgtattcttgtgtggtgcctttggaacgattattattttccttgcacccctcatgtccaaatcctagctcagcccctgattgtttgtgttagatgtaataaacagaaaattacagagtgcatgagatgcttataagttccttaggtaatcattcacggttctttcatggaaacatatgatgttactgtttgttattggggttcaac

SEQ ID NO: 9723 - DNA, 396 bp, Triticum aestivum
  unsure (1)..(396): unsure at all n locations
  Clone ID: PAT_TA_9723
ggnctgcaggnaattcggcacgaggcacaagnagtttctatcggnatgtggttccacgaggtacactgagnagtggatgaactagcgaagttacttgcttagatatggctgctctttactcttacgctggagggaggaggaagatgaaccagcagccttggattgcgttggatttcaatggcaaaatctaaggaaactgaacttgccccttaatttttagactcaagaattgtttagaagtactcagtcaattgcgttggattttgttggattgcgttggattttaaaggcaaaatccaaggaaactgatttttgtattcttcactggcgacatttaggcggagggtgtgatgttggtgacaataaaattacccttgttctcctccaaaaaaaaaa

SEQ ID NO: 9724 - DNA, 310 bp, Triticum aestivum
  Clone ID: PAT_TA_9724
gcatcaattgatgatttattgtccagcagcacatacgtaggaggccatggggcttgtctgtatagcttaatagtgtgaggagcaaacagatttgtagatacgtatatacttcctctgttctaaataggagtataagtctgtttagagatttcaatatggactacacacggagtaaaataaatgaatctacactctaaaatatgactatgtacatccgtatgtagtctatattgaaatctctaaaaagaattatatttagaaatggagggattagattgtaaagaggcagggttcggcagcaaaaaaaaaa

SEQ ID NO: 9725 - DNA, 1451 bp, Triticum aestivum
  Clone ID: PAT_TA_9725
ccacgcgtccgggtagggacagcgacgacgaagacttccgagatagggactatgatgtggctgcacttgctagcaatctgagccaggcattcaaatatggtatttaccctagtgaagatgttgacgaggctcaagcatcacaagagcgggatgacgaggatgtgtattttgatgatgaagctgctgaagtagttattaactctcttcgtcttggtgacgatcctgatagtggctccctctttacaaactccacttggtttgcgtttgatgaggatacagcactgaatgatggcccagaagcttccctttcagcaaatttggagtcgccttcaccaaatgtggatgatgacgatatggatgaagtcgttcttggtgaccctatagatgacacaaaaggctcggattcacttttagcaacctctgacagggacttaaatgaagggtctggtcaaacagtactgtcaaatggccctgttgataaattggaaaatgacatcagaccatcaactcctgatgtaaaagagagtccagctgagtgtgttgaatggacggaggaagatgctgaacctggcgaggtatcagagaatactgccgttccatgtagtgagattggaagtgagaaggtgatggatgccactgatggcgttatgcctggtacaggacaagtaggagaagaacaaggaagtgagaatttggttgaatccttggctcctgataccacagtagaaaagacattaccacattcgccggctgtcaattcaactggccattctgaaccagctgatggaagcgctaatgtggaatctcccctgggtgaacagaagcaggaaaaggaggaaagtcaggagaaataaagtggatccgggggtagctgtatattcacagttctgttcaccatggtgctcgttgccgggatggcttgtgatttcatggaggtgcagtgcaggtgcttggggaaccggcgagaccattcttgtctaaatagctcaggggctgatgtattgatattctgctgtacaatttgcattagattgccctgccttgcgcccaagatgcaaaagtggtcgcttgaattgaacatggtctagtcgagctgctcgagcttgtcttgcctcagaattttttggaggtctgttgttatggtgtcactgtactcggtctgttggcggcatatggcgcagcatgttgataaagtagacatctctttctttctgcaatcacggtgccgggttgtactgtgtcgcgtccggtaaataactgattattggtgatatccggttctgatacttgttcattattcctctaggtggtgctattattagtagtactaaaattttgactggaattcagacagcagattattattctcgtatgcacaatatgtaatactatggataccatttttgtttttctaagtgctttttactcgctgtgtctgttcaaaaaaaaaa

SEQ ID NO: 9726 - DNA, 442 bp, Triticum aestivum
  Clone ID: PAT_TA_9726
cgtccgacgagatgtgtcgtcgtcatagcttggtttggaaggtggccagcaattatcggagcatcgccgagttgggtgctttggaggcccgttcatgccaggaattattgttgaaaacgcgagacgctggggattcaaaccaaaacattgcctccggtctccgggcaatggtgcaaaatgagagagacagactgacctgtggcgacaaatccagtccgtccgggatgagattgaagcttcagggaagggtgagagcccttcgattgccgaggagaccgccctgctgagaggtcggtcaacgcatgtcggtggaactgtcagaccaatacggccaaatagccaagctccaggaggccgcccgaggtatttttccataaatgtatattgtgccggatcaagacagccttggtgtcgtcactattgttcttcaacagatgtccta

SEQ ID NO: 9727 - DNA, 1078 bp, Triticum aestivum
  Clone ID: PAT_TA_9727
gaggctcctcctcctgccgccaccgaacacctcgcgcgcgccgccgccggtgacctcgcgagccccatgatccccaatctctcctacatcttgcgcgcgcacaccccaatcgagacctgcagctggcgacctcacgcgccgtcatcgcggcccgcccggccgttgctcctgctggcgcgacccgccgcccgcatctggccggttgagcccctgagcccctgaatcgtcgcgccacacctccagctaagtagcttccttttgccacgtccccgtccgccggcctggggccgtcccctccggccgctggtccgtgctgctacggagcatcttctcttgcagagatccatcgacgttccttgctgatggctgcccgagctatgagaataatcgtcctccaaccgcctcggccgctcaccaacacgcccacctgcagttcagcacacagccctcctcccagtggggcccatcacgctcaggtcgttcgtcgctgcccccgcccgtcgctctactacgctgcccccaggcgttccccgccttcagattcagccacgggcgccaccacgccccctcgccctcgctccctcccccctcttggctcaacatgttcctgtattcctgtggcctaggtgccgtgaggccagctcgcccctcctcctgaggctgcctaccccagctgccagagcccgtccaggtgctggtcatcatcctcgatcttcaattacgggtcagcaacggcgctgcgaatagaaagagaaaggttgcttcacttgcactcctctatctaatcctatgtggtgatctccttgactcctcctcggttcggagctagcggcggttcttcagcttctctgctgcgttgtcgcgattgttgcagagacaaattttatactttgttcatctacggtgccaagttgagcggacaccgtagcactcgagaagatggggagaggatgtgtggtgaagagaaaacatagggtttcaaattgtccattggtggtagcatctaatcattttaccaaagtgtaatggacatgtgtatgtatgtatagtagcatattttactcgaaccgagttattt

SEQ ID NO: 9728 - DNA, 719 bp, Triticum aestivum
  unsure (1)..(719): unsure at all n locations
  Clone ID: PAT_TA_9728
accaacgccgtcccgcccaacgccgtccgattactactctcactcatccatcataagtccacccaagtatatggccgtccgcggacgcgtgggcgagtccttcgtggttgatgtgccagacggcaacacaaaggatgagacttgctacttcgttgaggccgtgatcaagtgcaaccttacatctctcgctgaggtatcggagcggctagcagttcagtcacctacatcgccgcttgaacaatagcatcctcacgggcacggacttgtgaatcagcatgaataagaaagaagcttcaaaggctagcaggaaatttctatcttttacagaccggtagattctccattttcttccatatatatatgtctctcgtaaggattagtatgtagacttgtgtgcttgtactagttgctagtgatgctttagatcttagcaactgcacctagctacctcatggttatgtatgcatacctagtatgtgtatgtaacagggaagcatatggagtggttttgcctctttggtgcatttgagacaactagatgcctattctactactgtatgttcttggataacattccactaacgcttgggggtgaagattttgacttgtagattttggaatggcgctgtaatatatacattggtggaagagttctcctcgctgttaaaaaaaaaaaaaananaaaannnnnaaaaaaaanannannngggggggggcgg

SEQ ID NO: 9729 - DNA, 1474 bp, Triticum aestivum
  Clone ID: PAT_TA_9729
aaagacagccggcggcagaggaggggaggccaggccaaccaccggtcggagcggcggcggcggcggcggtgggtatccgagtttctgtcatggtgggcctcgtaggtggcgattagcccaacccagccattccccaagcagcagaggcggagaaaaagacagccggcggcagaggaggggaggccaggccaaccaccggtcggagcggcggcggcggcggtgggtatccgagttactggcatggtgggcctcgtaggtggcggcgcgcgggcctggaggctcagcgacgaggcggctaacggcgcaggtggaggaggggcggcgacggaggcggactacatgcggcggctgcacggccacgcgcccggcgagaaccagtgcacctccgcactcgtcaagcacatcaaggcccccgtgcacctcgtttggtcgctagtgcggagcttcgaccagccgcagcggtacaagccgttcgtcagccgctgcgtggtgcgcggtggcgacctcgagatcggcagcgtgcgggaggtcaacgtcaagaccggtctgccggccacaactagcaccgagaggctcgagcagctggatgacgacgagcatatcctcagtgtcaagtttgttggaggcgatcaccggctcaggaactactcatccatcataacagtccacccacagagtattgatgggcggccagggacacttgtgatcgagtccttcgtggttgatgtgcccgacggcaagcatgaatatgaaagaagcttcaaagggctagcaggaaatttctatcttttacagaccggtagattctccattttcttccatatatatatgtctctcgtaaggattagtatgtagacttgtgtacttgtactagtagctagtgatgctttagatcttagcaactgcacctagctacctcatggttatgtatgcatacctagtatgtgtatgtaacagggaagcatatggagtggttttgcctctttggtgcatttgagacaactagatgcctattctactactgtatgttcttggataacattccactaacgcttggggttgaggattttgacttgtagattttggaatggcgctgtaatatatacattggtggaagagttctcctcgctgttattgagatggaagtaagtggataatttatctctagcaccgtagtcaaaggacatgagggtatatccgtttcagcaatttttggttaatcatgggttcttggggttgtaattgaaatgattggtgagaaaaatgtctgagttttcctgtgtaaagttaggttgccaaccgtttgaatgccaatagaaagtcacgaggacgaggaaagaagatcatccttctatgcttctctttcatgcttgcttggctaggctcgattcacattgatacattgatttgaagtcaaacaattaaagtctcgtcgttctaatcctcttgttgtacctcggccgcgaccacgcta

SEQ ID NO: 9730 - DNA, 561 bp, Triticum aestivum
  Clone ID: PAT_TA_9730
caatgtttctgatgatatttgagatgacaatttgtaatgagatgatatatatgatgctatctccattagcatagcgtatcgccataatagtcttgttgctgcccttgctaaattaaatgatcctgtaaatggtttcaacattgatctgaaaccaataatttgagaatcgtctggtgagaaactcaggattaatatttttttgtctttcttccaatgctcatttagctgaataaataaagcacttttacctgtccctcgtctaccaacaacaatggtcctgtcatcagtttcaattagagtcctaaagtcagcagtttcaatgaaagcattactcaacatctttttatcattttctgctgtcgtatcaccaaacggattagactttgaagtaatattcaattccatattcaaccttttatgttagttgctttcatttattactttatatactgttgaacgagcaatattcattgtttttgatatatgtgaggcacctaacccctgttgccacatatttaatactgcatctctatctatttttctttttctaccaaaaacaac

SEQ ID NO: 9731 - DNA, 449 bp, Triticum aestivum
  Clone ID: PAT_TA_9731
ggatcatgggaggaattgccctctctggtgtggacccattcgtggtcttgctgccggtgtccttccggtgcttctgcgttgtgctttgtcggtgtcctgcgtagtgccttgtcgctgtactccctactggcttctcgttgttctgcgttgtgccttgccgctgtcctcggtagttctttgtcggtgtactttgtagtcccttctcgctgtacttccttttgctttgtgggtgttcaccgtagtgctttccggtgttattctgtgcagattttctgggttggttctggatttttagcggtatttacagtgtaattttagtggattttacagtgtaattttagtggattttacattgtaattcttagtgcacataaagattttctatagtgcatttttcagtggatattacactgaaattctttagttgaactattagtgtaaaaaaaaaa

SEQ ID NO: 9732 - DNA, 870 bp, Triticum aestivum
  unsure (1)..(870): unsure at all n locations
  Clone ID: PAT_TA_9732
gatnnagaacctcaagtgccgcatcagtggaggaaccagtagtccatcaaagtgacacatctactgagaagccatctgagtctcaaggtgatgcagctgctggtgaatcatcaggaccgccatcagagcctcagaacgatgcatccgccggggaaccctcagaacctaaagttgacgcaattaccgaggagcgatcagagagtcaaattggtgcaggtcctcatgatttaactgagcagccattggaacctcaaaaggatgggcgtattgagaagccactcgaaactgagactaacgttgttactgataatccatcagaaagcagcttagctactgaaacactgcctgaaagcactccaaagatcagcactaccaccgaggaacctgcacagcgtgaaatttctgatgagacactgcctcaaagcattgcattagatacaacaccagaaagcaccacatctgtcgaagaacccacagatgtcggtgaggccattgttgagatatcagaggacagctcagctcctgagaagccatcggaggatgctgtaactcctgagaagccatcagatgaaggtgaggcagctgtggagccagcaggagacaatgcggctcttgagaaaccttcggaggaagttgaggtgggtgctgatccatcaaacaacctagtggatctcgagaagccatcagagaaagaagacgactctgtgaagccagtagaggacagtgtggctcttgagaagccaaccaccgacaaaccctgggaggaagataaggtgagtgctgaaccatcaaacgacagagtggatcttgataagccatcggagaaagaagctgacactgtcaagccatcagaggacagcatggctcttg

SEQ ID NO: 9733 - DNA, 803 bp, Triticum aestivum
  Clone ID: PAT_TA_9733
ggtatacccccggcctctgcatcatgatgatgcatgcggcccttttattaaaaatccaggaagtatcatcgtaaaggtcttacagctcgcaaacggagcaaaacatagcacataaacctgaaaattacaagtggacagagacaaccgatacggtaataataaggataagctccctagactcctatcctgttatgcgaacgccatccgaaccggttgaatataacccgagccaccatctcccattggttgcacccagtaaccaagggctccctggagtccataggagtgagtaaggaccacgtacggatccaagctgtagctctgaagataacccctcgcctcctgcagtctcacctgacagtgacagctcttctcctctgtattagtaacctcgacgccatacctaattgagatgccaagtgagcttgctcatcctgtacgcctcgcattcgtgcgccgctgcctcctcccaccttcaggttcgccagactcgccacgagctcctccagcttcgtccccatgtgggaaggcgcgttgctgacttgtccgctcgcgcaccgccctcttcctatccgccggcctcgccgccagctcccccgacccatctccatggaggaagatgcgggctgctgcctcatccgcccgcgcaccgccgttcgccgtggacggcatctgaggatgggggaaatcggcccggaggtcttgtccggctcgctggatctgacaagagatggtggtgttgggaggggcgttgacaattcgagaagagagagctgggtgagctgagtgagtgaggactgggc

SEQ ID NO: 9734 - DNA, 535 bp, Triticum aestivum
  Clone ID: PAT_TA_9734
gaataacaggcgttgtttgccctctgctgccgacaaggccctattcctcaattgtaaggatgttttgactttcaattctttcccatgaccataaggtgcatcagagtaggcagtagctatggtaaaagtagagaatgctgacttgggaatgtaattggtatgtcttggtggttgattaaaatgtcggggtttggtagttcatagatgggaaattagagatcattagtttcttctggttgtgcactctaagagatgcgagaaagctcatagtcgtaacaagagctcatttctgtgataaaggtctatttcggtttatctgctgcactagtatgtcattcagtggcggtgctaggagttggaagctagtgatgtcaaagctatatgcatacccatatatgttgataattttttgttaaattcaagtgtattagtgcagctatcacaaattttgtgatgtcacttgacatcacaaacaacacctagcgccaccacttgtcattcctttggtcttgtgatgagatagtcatatagacaa

SEQ ID NO: 9735 - DNA, 660 bp, Triticum aestivum
  Clone ID: PAT_TA_9735
ctggggcgccgcccgccgtgataaacccagcgtcctcgtcaagagcttgagagtggagaatttctacgccgggcgaagggacggacggcaccggagtgccgaccaagttcgtcacgatgaactgctcgctcgagattgacgtccacaacccctccaccatgttcggcatccatgtctcttccacctccatccagctctactattcccagatacccatcgccagcggtcagctggacaagttctaccagccgaagaagagccggcacgtcgcatcggtgaccctgcacggcgagaagacgccgctctacggagccggggctaccttcgtcctcaccgacaccgacggcgtgcccctcaccgtggacttggcggtgaggacgagagggtatgtcatcggcaggcttgtcagggtgacacacgccaagcgtgtgcgatgcccggttcttgtgagctctctcaccgacaagcccatcatgatcacccagactgcttgcagctactcttgatttggtaatctattgcttgagatgttgttaattttgacaagtataagagcgtataatggttgtgatcgtgtagatattgttgtggtcgttcatggcattggaaccatctggttaataattctccagcatcagtgtttgattgagaaaaaaaaaa

SEQ ID NO: 9736 - DNA, 1085 bp, Triticum aestivum
  unsure (1)..(1085): unsure at all n locations
  Clone ID: PAT_TA_9736
caccgtcccttcaaaccctagtcctggccnccctgtgctccccccccttgtgcggcgccgcccctacctctcttcctccgctgacctcccgttcggtggaagcagcgcagccattgccggatctggccgcgctggtcatcggtgctgttcggatctggccgcgctggtcgtcggtgctgccggatctggccgctccgggcctcatccacgccgccccggttgttcaactctccaccgccacttcccccatcatcatcccatatgcctcgcccggatccgtgagagggtaagaccgggagtgtagccgcttgtctcccgaggagctcgtccccgacggcctctctatggacttcctccaccacactcccaacgccactgccttcagaacgcggtccataacccagtactttcgcgggaaaagcaccagatcgtccatcgaccgcgagctgcatcgacatcgagcgttcctcttcttggtggggcgtgcaccttctgggggtgaaggcctgcagcacctgctgctatggagaacggatggcgcggtggtcgtagggctgctccaaaactcctctacagttgtcaccagtcacaccacgacgcctctctcttcatcgagctcatcacctgtataagctggcatcttcatttcaaaaatagataaaagaggaaaaggggataccagaagacacaagcatctggaagtattctaagtgtatggcagaagcaagctgaggtatctcaaagatacacaagttgctggaggtttggaagatgtacaagttgctggaggtttggatgatcttacaagttggtggagtgataatatatattacctccatcccaaattacgttgtcttagactagaaggtgttttggtacatccgtatctagacaaataattcgggagatagggagtatgtaatatgccttctttgttgagcctgaagattttgcaagtttcactttgctcattttggtggttgttttggcacataagccatggaatgctcattttggatgtgtggcacaatttcttttcctagaaacatatgtactttgcattgggcagaatgttcttatgtatt

SEQ ID NO: 9737 - DNA, 874 bp, Triticum aestivum
  unsure (1)..(874): unsure at all n locations
  Clone ID: PAT_TA_9737
aggaattcggccgaggtgcggagatggagcngttctgggagatgaggttcgagcagggcccctcccgagccgaaggaaatgacgagcacactgactgtgccaccgtgctgccatggggactgaactgaatgatccgaaaccgtcttgagcttcccaaacatgttcttgctagtgacatgaatcaatgctgtacacatgtgggtttggctgggaagagccagtgtggcactctcctgcagacgcggtgacgaagttatgtcaaaagcaattgaggaattgtttcccagtacatggccgtcactgganacattcaaaagaatttcacatctcgccttggtgcacttgctgggggttcgaaagcatttaataagatgttcaccaaagtgtatgcagggatgcgactctgaagtagaattcaaggaaacatggtctagtaataagttgctgaagcggtggaccagagacaagctcttggtattaagaatgtgttgagaattccagaaatatatatgctgaggcggtggagcagagatgctaagcagtgacttttctttcagtccaaagcaatatgaatcgtcatataaggaatgtatggatgatgaagctgcataccgcaaccatggtatgaggtacgcttatggccttgtgatgaagagccgagggcaggagggattgagaagatctctttgggagagactcaagggtggaattatttttggggagaaatacctcgaaaaatgttacccagcatgcacattcttatgccacttgaaagaagcatcatttaagccttttggtgttaccactcaggaaggaaggtatagatgggtaactgggttcggcataacacgtgtgtacaaatcttcttttatgc

SEQ ID NO: 9738 - DNA, 1178 bp, Triticum aestivum
  unsure (1)..(1178): unsure at all n locations
  Clone ID: PAT_TA_9738
gctccaacggcaaggtgggcggcgagaagcgctcgttcgaggtggacgcgatcgtgggcgcggacggcgccaactcccgcgtggccaaggacatgggcgcgggcgactacgagtacgccatcgcgttccaggagcgcgtcaagatccccgacgacaagatgcgctactacgaggagcgcgccgagatgtacgtcggcgacgacgtgtcccccgacttctacggctgggtgttccccaagtgcgaccacgtcgccgtcggcaccggcaccgtcacccacaaggccgacatcaagaagttccaggccgccacgcgcctncgcgccaaggacaagatcgagggcggcaagatcatccgcgtcgaggctcaccccatccccgagcaccccaggcccaagagggtgtcggggcgggtgacgttggtgggcgacgcggcggggtacgtgaccaagtgctccggcgaggggatctacttcgcggcgaagagcgggcggatgtgcgcggaggcgatcgtggccgggtcggcgaacgggacgcggctggtggacgagagcgacctgcgcaagtacctggcggagttcgaccggctctactggccgacgtacaaagtgctggacatcctgcagaaggtgttctaccgctccaacgcggcgcgggaggcgttcgtggagatgtgcgccgacgactacgtgcagcggatgaccttcgacagctacctctacaagcgcgtcgtgccgggcaaccccatcgaggacatcaagctcgccgtcaacaccatcggcagcctcgtcagggccaccgcgctgcgccgggagatggggaagctcaccttgtgatcgccgacccgccgggacgttcctgacatcctgcttgggtcgctcgaaactgcggcggatcgaccggtatagcagagatccgcggctgatcgagcggatttgaggcggaggagatgagaataaggtaatggcgtcgatccagaggtcgtgtcttggtcgatcctgtccgattttcttgtacaacgtacgcatgcacggtgatgttcagacttcagagcagttcgtctggattgttgaagcacgccaatattcgatatgtgaatgaatgtagtataagctaaggcttcaagtttttgttcatgattgttctcacgaacgagaaatggaatgaaatgggttaacaac

SEQ ID NO: 9739 - DNA, 1880 bp, Triticum aestivum
  Clone ID: PAT_TA_9739
ggctcgcccatccggcgcgcgcgcgccgctcatccactgcacgccgcacatccccctcccgccagccgcggccctcccgccacgcaggcgatcacctctcgccctgcctccgccgccgcgccacacgtcggcctccaccccgccgccggcttcgccctcccccgtcgccggcgacgtccgccgcacgctcgcgccgcagcagcacattcgcatggccagccgcgaggcgctcggcgacttcctccggccccggcctcagcaggccggcgcggtcgtggtcgacggccccgcgctcggccaggccgcggtggagacggtcaacggcgcagcgcaggagggacaactccaagccgtgaggcgcaaccgcaaggctctcggcggggtccgcccgctccatgcggctgggcccggtcgaccggacggcgacaactcctgcagatgcatgggcactgaagccgcccggtcatcgtccgccgcaacgtcgccgcggacgaggacagtcccctgggccggcacgaggtccttggcgacgtccgccgtgatggcctgcagcaacgccgcggccaccgccttcaggggctcggcgtccggcatgtggccccgcggcaccgcaggggccggcacccggagccctacgcccacgaccacagatccaacggcaaggtcggcgccgagaagcgatcgttcgaggtgggcgcgatcgagggcgcggacggcgccaactcccgcgtgggcgcggacatggccgagggcggcgtcgagtaggccatcgcggctggaggagccggtcaagatcccggacgacaggatgcgcgacaaggaggaccgcgcagagaagtacgtacggcgaggagcgctccccggcgtgcgtcgggaggacgtgtcccccgagctctacggctgggggttcccccagagcgaccacgccgcgttcggcaccgctatactggcccgacggacaagctgctggacgtcccggacaaggagttctaccggcccaacgcgccgcgtcgagggccgctcgatcagccgtgtcccgacgcccaccagccccgcgcgaccggcgaccatggtggtctacgcgcgggtgacgttggtcaacgactccggcggggacgtgaccatcgcggtcaagcgcgggcggctacgcgccggcgaggtcctggccgggtcggccggcggacgcggctggctggacgggggacggctgcccgactggtgggcgagagccacccggctaagttcgcggcggaactcggccggctccaccgggcagacgttatactgtcgcggaaacgcggcgcggggggcgctcgcggagatatgcgccgacgacggcgtgcatgcggatgacgtgccgcaggctacctccaccggctcgccttgccgagctacccctacaagggacttctagctcgccatcccatcgagcggctcaagcttcagcgccaacagccgcgggaggccgggagatgggggcaaggctccaccttgtggatcgccgcccccgccgggaaaggttcctgacagcctgcttgggtcgctcgaagctgcggcggatcggtcggtatagcagagatccgcggctgatcgaacggatttgaggcagaggagatgagaataaggtaatggcgtcgatcgagaggtcgtgtcttggtcgatcctgtccggttttcttgtagtacaacgtacgcatgcacggtgatgttcagacttcagagcagttcgtctggattgttgaagcacgccaatattcgatatgtgaatgaatgtagtataaactaaaggtttcaactttttgttcatgtttgttctcacgaacgagaaatggaatgaaacgggtcaacaccacccagacagtagttgattttaaaaaaaaa

SEQ ID NO: 9740 - DNA, 1132 bp, Triticum aestivum
  unsure (1)..(1132): unsure at all n locations
  Clone ID: PAT_TA_9740
gaggaattcggncgagggtggtgtccaatggctgccagaacagttggttttcttggagggatgcagttcaactttgacttggaagacttactgagagcttccgcagaagtccttggcaaggggagctatggaaccgcctacaaagctttactcgaggatggcactatagtagttgtcaagaggctcaaggatgttgtggcagggaagaaagaatttgagcagcagatggagcttatcggaagggtaggcaaacatgcaaacctcgtgcctctgcgtgcttactactactcaaaggatgaaaagcttgtggtttatgaatttgttactactggaagcttttcagccatgctacacggtattaagggccttgtggagaagaccccattggactggaatacgaggatgaagatcatacttggaacagcacagggcattgcacacatccatgcagaagggggccccaagcttgctcatggcaacatcaagtccaccaacgtgctcctcgatcaagaccacaaccctcacgtctcagactacgggatgagcactctgatgagcctcccgatcaacacctcccgggtggtggtcggctaccgcgcccccgaaacctatgagtccaggaaattcacccacaagtcggacgtctacagcttcggcgtgctcctcatggagatgctgaccggaaaggcccccctccagtcgcaggggcaggaggacgtgatcgacctgcccaggtgggtgcattccgtggtccgggaggagtggaccgccgaggtgttcgacgtcgcgctgatgaagtaccacaacatccgaggatgagctggtgcagatgctgcagctggccatggcctgcacgtcgcggtccccggaccggcgccccacgatggcagaggtgatcaggatgatcgaggacctccggcagttcaccgcttccgagagccgcgcctcttccaatgaaaaccccagggactccaaccctccatcggcgtaaacgctggctctggctggcttgttcgtccagaagcaactcaagcactgacttgtattccatgaacaagccttgtatccctataactgtgccaatattccacgcgtgcatgttaattggtagtgtctttaacataaaaaaaaa

SEQ ID NO: 9741 - DNA, 1423 bp, Triticum aestivum
  Clone ID: PAT_TA_9741
aaaaaaaagaaggggaggagaaggagacagcaggcagggagggggtcagtcttcttcctctctccctgtgctgctgctgcctttgcgtcggagattgcccaagtctagattcgaggagggctggctccctcgccctccctccctctctctccccttcccgtggctccactgtatcggaatccgcgaccggctccgttccaagcggccctggattattttacgcagggtcctgactttgttgctggaggaatgtcctcagccagctcttctcagttcccagcatcaacagagcgagaatctacagctgctaatgataatgcaatacctcatgatccaggtgctgattctgctggaccagcacaaagcagactttcgcttcagttggatcaagcggtcattacatttttctggtaatgcttgggttcttattgttgcgttgatcggcatcattccactggcaacacgacaactgcaactcaagggatatcggttgtcacttcttggcacaacctgtaccacagggtatgccatatttgctctttatgggctacccagagtagggaacacacaggctgttcaggcctggtgccaccatgtaacttcatcaaaggattttattccattcatgtactgccttatgtttgttacatctaaactacacttgaagcttgttttggtaccggtaatttgctgggcacttgaacatgtggccagatttctacggcgccattttaccaattcctctctctacagggcatacctggagccgctttgcgcgggcgtcccgccaagcacctctgctggcaaccctctgtgggcgcttgctgagattttcccggcctttcttatgatcttatccctgttctcgaaacaacgcaatgctatgcaaacattcatgtactggcagttgttgaagctaatgtatcattctcctttcactgctggctaccacagagctatctggctaaagattggccggacagctaacccctacatcagcaagttaccccccttttcttcatgacccgataaacgccggcatgagatggtggttcaggtaggatggacatggtgccggtagtcatgtaaagggatataaatgtttttggtgacgatttcccagttaacccaagagatttctttttcttaccaaaggtgcagcttgtgagggacttgttattagtcctttttggcgggctcgagcgggttgagctaggttagtgatgagtagtaatttttgtaatttcccccgtgattgtagaatttagtcaagtttttagagactataatttgtttggcataaagttaaaacgggaagtaaggtgctgttgggtaattctttttttgtggacccaatagaattaaattccattatgcccgtgacccaaaatgtggttggataattaggaggccagtggttttc

SEQ ID NO: 9742 - DNA, 573 bp, Triticum aestivum
  unsure (1)..(573): unsure at all n locations
  Clone ID: PAT_TA_9742
gaggaattcggncgagggctnattgggtnngattgttttctctgaccnngaaaaacgcaagcttctaaaccggtataacttctactggcataaatatcaccttcgattttctttctttctttctgttatgcttgcccaacatatttttttattcagttaatcagtttatttacacggcagttacatttttctttccttggccaatagattttttatccagtttatatactccctccgtcccaaaataagtgtcttgagcttagtacaaatttgtactagagctagtacaaagttgagacacttattttgggacggagggagtacatggcaataactacataattacctatttaaggaaatagttccacctatttgtgtctcacatctcatcatgttctgctttgttaaccgtgtgccaaaatatatagttgtgttccatacatggatgatgaaatgcaacaaggtttacctttaacaatgctctttatgtcatttataaaataaaaaaccactgcaaagtgggtataacatttcattgcatgcttatactctgtcattaatatgatccctgaa

SEQ ID NO: 9743 - DNA, 1750 bp, Triticum aestivum
  Clone ID: PAT_TA_9743
tgagcggcgggatcgacgacaagtacgcgctggaccgggagctggggcggggcgagttcggggtcacgtacctgtgcatggaccggggatccaaggagctgctcgcctgcaagtccatctccaagcgcaagctgcgcacgcccgtcgacgtggaggacgtgcgccgggaggtggccatcatgcgccacctgccccgtcagcgccagcatcgtcacgctgcgaggaggcctgcgaggacgacggcgccgtgcacctcgtcatggagctctgcgagggcgggcggcgcttcgaccgcatcgtcgcgcggggcccgtccgcggagcgcgccgccgccgccgtcacgcgcaccatcgtcgaggtcgtgcagctctgccaccaccacggcgtcatccaccgcgacctcaagcccgagaacttcctcttcgccaacaagaaggagaactccccgctcaaggccatcgacttcggcctctccatcttcttcaagcccggtgagaagttctctgaaattgtgggaagtccctactatatggctcctgaagtgctgaagagaaactatggacctgaaatagacatttggagtgctggcgttatcttgtatatattgttatgtggtgttcctccattttgggctgagactgaacaaggagtggcacaagctatccttcggggaaatatagattttaagagagaaccctggccccatgtttctgataatgctaaagatctagttcggcagatgcttcagcctgacccgaaaatcaggctaacggcaaagcaagttcttgagcatacatggcttcaaaatgccaagaaagctccaaatgttcctcttggagacattgtaaagtcaaggctgaagcagttttcaaggatgaacagattcaaaagaagagctttaagggtcattgctgaccacttgtcggctgaagaagttgaggacataaaggagatgttcaaagtgatggatactgataatgacggtatagtctcatatgaagagttgaagagcgggattgcaaaatttggttctcaccttgcagaatctgaagtgcaaatgttaatagaagctgtggatacaaatggtagaggagcactagattatggtgaatttttggctgtctcacttcatctacaaaggatggcaaatgatgagcaccttcggcgggccttcctgtttttcgataaggatggcgatggttttattgagcctgaggagcttcaggaggccctggcggaggatggggcggtagatatcacagaagtggtgaaggacatattgcaagaagttgacaccgacaaggatggcaaaattagcttcgaagagtttgtagcaatgatgaaaaccggcacagactggcggaaggcttcacggcattattcgagaggacgattcaatagcctaagcataaggcttatcaaggatggatctgtaaagatgggaaatgagtgaaatcacaggcttgcagctgatgctcttattccggtcacgtaagtccggccgttggcccactaagcatagaccctctttccttctctgatgattattttggcggaaatttaattagataggcttccccccctgattggcttactcgtgtaagtagctttcccggtatcgccgaggtgaggagcacgcacgcaccgaatgatgcaccaaccgctcctgcctgatgatatctccttttgctgtacctgatgctaagtgttgtacaatattttgttgtttccccctcacaaaaaaaaaaaa

SEQ ID NO: 9744 - DNA, 521 bp, Triticum aestivum
  Clone ID: PAT_TA_9744
acagggctctctttgtgtcatcggctcattggcagtcggagtctcgatcatgaacttgtttccatcatgtgtagaaggtacactcagtccgatatggaagccaatagggaatgtccatacctcaactggaggcacaacatggaaccagagtttgcgacaattgtgttgtccgaccatgactatgtaaacaacatttcgattcagaagcaactagtcggcaaggacattccttatgatataacttcatctcagatgttcttcctgccagtacccctcgaagctggttgggttattttgatgtgggacatgatgtcgaggaagacccatttttggacccgaatatcaaagggaatggccctgatgaattcacgaaggataagcatgaacttattgcatggaagcttcaccatgcgctattccattgcctgaatgagtattatgcaggatggccatcccaggatggtcagtggcaaacggtctaccctgtagtagctgaagaaacattccgcagcgaagaatca

SEQ ID NO: 9745 - DNA, 390 bp, Triticum aestivum
  unsure (1)..(390): unsure at all n locations
  Clone ID: PAT_TA_9745
gaggcgggtgcgcgcagggggctgctagattcggaagggcgccatgaagaaagtgttcgacctgacggtccgggacctgaagcggggggtgaataaaaaggtcctcaaggtgcctggcacggaacaaaagatacttgatgccacaagcaacgagccgtggggcccacatggatccctcctggcggagatcgcccaagcaacgcataactatcatgagtatcagatgataatgaatatcgtgtggaagagggtcagtgataccggtaaaaattggcggcatgtgtacaagggattgattgtcctagattacctggtagcacatggaaccgagcgagttattgatgacataagggagcattcttatcagatatcggnactagctgacttnca

SEQ ID NO: 9746 - DNA, 554 bp, Triticum aestivum
  Clone ID: PAT_TA_9746
tgttgagagagagagagaagcgtagagtacacggcggcggaggcgatggcgaagggcgggaaggggttgaacgcgacgggcgagtttttccggcgccgtgacgagtggaggaggcaccctatggtggggaaccagctgcgccacgccactccggggctaggcatcgccatcgtcgcctttgggatctaccttgtcggcgaggccgcctacaaccgtctctaccgacccgccggagacaaccaccactagatctcccccagaggtaaagtagatggagcaaactttaccgaagcaccaatgttgatcttttctggtttgatctcataaggtctgcatgaccaccttgtaattcgcgatcaggagacgtgctgttggtccaactagttttcctggaacgcgtgtccttcaaatctgatactattttgtggttatgctcggcatttggacatggcattgtttttcttttaccctaggacatggcattgtttgttcttacattactgaactcatatatctacaagttgaagttgagtgcccgtgcgttgccacggaat

SEQ ID NO: 9747 - DNA, 819 bp, Triticum aestivum
  Clone ID: PAT_TA_9747
gcgactggtggggaaagaagagagagagagagaaggaggaaacagcggcgggggagatggagagggccgggagggggcggaccggaggcggggggggagtgtggctgggcgcggaaggcgaggggtgacggccccatggcggggggacgagtggcgccagggccctcaggcggcggcaccagccccctccggcgttgggcatccccatcgtcgccattcgtcatctacctggtctgcgcggccgccgagaaccgcccctaccgccacccccgcgacacccaacgtaggaggcccccacgatgtgaacgcacctaggaggaaaactagttggtgtgatctctggttgaatgcaataatgctttgaacttcgcccggtgtaatccgccaagatgttgaagtactgttctttcaacgtggtctttctgatacgtgatttttttttgatcctgatattccctggaacgcgtgaatatttgtctcggccaaacaaatgtgattgttacatactacagttctgagataaggtcattacgtgtttatttttgctgcacgttatgccggatggaggtagtactattttgtggtttatgctcggcatttggatatgacctttttttttattggaccctaggacatggcattgtttgttcttacattactgaactcatatatctacaagttgaagttagtgcccgtgcgttgccacggaataaaagaaacattgtgatcaaataagtattttaattttgaaataatattgcatatcaaataattttactagcaaaactcgaaaaaaaaaaactcgaacctcggccgcga

SEQ ID NO: 9748 - DNA, 582 bp, Triticum aestivum
  unsure (1)..(582): unsure at all n locations
  Clone ID: PAT_TA_9748
cgtccgcccacgcgtccgcccacgcgtccgtcgcactcgccagtcaccacctctaccgagccagccagagcgcgccgacgacggacgcacggccatggagctgctgccgctgctgacggtgctgctgctggcgcacgcggcggcgtacctggcgtggcaggccctggcgcggcggcggcgggcgcgctgctacctgctcgacttcgcctgccacaagccctccgacgaccgcaaggtcaccaccgagatggccggcgccgtcatcgagcgcaacaagcgcctcggcatgcccgactaccgcttcctgctcaaggtcatcgtcaactccggcatcggcgagcacacctactgcccgcgcaacgtgctcgacggccgcgaggagtgcgccacccactacgacgcgctcgaggagatggacgccttcttcgacgacgccgtgcgcggcgtgttcgagaagaacggggtctccncccgggacgtggatttggtcgtgcttaatggcgggtccttctcgccggcgccgtcgctggcggcgcgggtcgtggcccggttcgggatgcgggaggacgtgcaggcctacaa

SEQ ID NO: 9749 - DNA, 436 bp, Triticum aestivum
  unsure (1)..(436): unsure at all n locations
  Clone ID: PAT_TA_9749
actgctgccttctccccccaccatggctgccatgtggtctctgatcatcgctctcctcctgcttctgctcccactcgtgccgtcctcctcctccgncatcacgctcccgctccatggcaacgtctaccctgtcggccactactatgttacgatgaagattggtaaccccccgatgccctacttcctggacatcgacaccggctgcaacctcacctggctggagtgcaaacacccgcaactcggccgccagcactgcacccagcatccaaaacacccacattactcgccacaacttatcaacttgaaggtggaatgtaataacaagtactgtgatgcactacggagagacctggcaggtggtaaccctatatgccaacataagaagccgcatcaatgccactacaacattcaatacgttgatgggacgtcagatggt

SEQ ID NO: 9750 - DNA, 902 bp, Triticum aestivum
  Clone ID: PAT_TA_9750
ggcaaagcaaatgagatggatgaagatccagttgaaaatgctggatctcaacaggatggtcctgaatcatgggagatattatttaaggagcagatgcagcacattatacaattgtgggatctctgtcatgtatcaatcatacacaggacccagttctacctgttattcagaggggatatggctgatcagatatacatcgaggttgaagtcagaagattgacatggctgcagcagcatttcgctgaggtcggtgacgcaagccctgctgcacttggtgatgacccagcagtttctctagcctcaagcatgaaggcgttgaggaatgagcgagaatttcttgcgagaaggatgggctcaaggctgacagaagaggagcgggagcgcctcttcatcaaatggcaagtccccctcgaggcaaagcagcggaagttgcagcttgtgaacaagctctgggcagatcccaacgacaaagcgcacattgaggagagcgccgacattgtggctcggctggttggcttctgtgagggtgggaacatcagcaaggagatgtttgagctcaattttgcgctccctgcgagtaggaagccatggctgatgggctggcagccaatctcaaacatgatcaaggagaaaactcgccagttggtttcgactccattacagtgaggaaaaaggagctgatacatttcatactggggatgggattcaccaaggtgaactggcactgagatgttctatgttggtgatatacgtagatagctcaaaatctttgttggtcatcaaggaaggctgcgcaatttgcttgggatatgtagatagctcaaaattctttggaatgttcatgacttgttgtcatctaccttctgcatgtattaattttgtagaatgttcataactgtcag

SEQ ID NO: 9751 - DNA, 883 bp, Triticum aestivum
  Clone ID: PAT_TA_9751
gaagatatcctcttgcgcgggctaaaatggagtaagctgttggatcctgagaaaaaagggcagtggtggttgtcaggggatgtatcgtccacagcaggcaatgttgaagatgttgcagcagttatcagcaaggaggttgtagaggcacagaaactggttcagcttgcagccgcccagcggatgaacacagatatacgaagagcaatcttttgcatcataatgagcgctgaagactatgtagacgctttttgacaagatcctgaggctggacctatctgggaagcaggatcgagaaattatgagagtcattgttgactgttgtctgcaagaaaagactttcaataaatattacacagtccttgcctccaagctatgcagccatgataagaatcataagttcagtttacagtactgcatctgggaccgttttaaggagctagatgagatggagttgagtcggtccatgaaccttgcaaaactagttgcagagatgctcgcaaacttctccttgtcgctagcaacactgaaggttgtcaacctggcgaacccagtggagatgacccccaaaaagaccatgcatttcaggatgatgtttgagaccttgatgcagaaagaagactcgcttatgtggaacgtctttacccgtatcgctgggaacccggagctcgagctcttgagagatggaatcgtgatgttcgtccgacagcatgtgatcgccaaagacgcagggaaggagttggctggcaaattcaagatcgccaagaaggcgcttgataactctgctggagttttgatgtaatttgtccggcgtgtcttccctgtctcggttacatgacacgcgggctctcagttttgttcggtattctgaggaaatgtagacaga

SEQ ID NO: 9752 - DNA, 639 bp, Triticum aestivum
  unsure (1)..(639): unsure at all n locations
  Clone ID: PAT_TA_9752
cgtccgcccacgcgtccgcccacgcgtccggacctcgccttcctgctggacagatgccccgtcctggagaagctcatgatcgccagaggtcggtggccagtgtgcctccgcatccacagccgcagtctacgaagcgttcaggtgtgcatggctatcgtgccagaaatcaatgtggtgcgcgctacacgcctggagaggctctttctgtgggaagcttggggttggggcgaccgtgatctcaccaacatgtcctccaaagtcaagatcggccatgcacccaaactgcgcttcctgggattcttgggtgccctggaatgcaccaactttagattgggaacacaccatccatggctaacaccaaggcaattccaacaccactgtcccaagctttcaaatgctgggattcaaatnaaacttggaccacttttgaaccaagatgctcctantcccccaaatgcttccnaantcgagagcctattcaatccgaaaatgatgactcaagttcggggaccaaaacggtgganaacaaagcatcacctcaattttgaaggatctggcctatatcatcagggcaatcanaatttgtccctattccgggagaaacaanttattccataattcacatccatttgngaaggg

SEQ ID NO: 9753 - DNA, 570 bp, Triticum aestivum
  Clone ID: PAT_TA_9753
gaggaattcggacgaggcggtcatggactcgagcgccatcattacgcggctgccccccacagcgtaccgcgcgctgcggctggcattcaggaacgccatgagggcgtacaggacgcgcgccccgacggggaacctcgacacctgcttcgacttcgtgggggtcaccagcgtgacggtgcccgcggtctccctggtgttcgacggcggcgccgtcatcgaacttgaccttctggccgtgctgctggacggatgcctcgccttcgcgcccgtcgccgctgatttcgccctcggcttcatcggcaacgtgcagcagcagacgcacgaggtgctctatgacgtcgccggaggggctgtgggcttccgccgtggtgcgtgttagctggccctgagctagcgcgcggcggctggcgcacgttcgatcctcttttttttttgaaacaacgtgctcgatcctctttctttaaatgtcactggctttgcactgtcactggctagctatgtaatcctaattaaaatcttaatagaactcttagataaactctctagtagagagtcgtcgtaaaaaaaaaa

SEQ ID NO: 9754 - DNA, 839 bp, Triticum aestivum
  unsure (1)..(839): unsure at all n locations
  Clone ID: PAT_TA_9754
agactcgggcgactccgctcgccgcgcaccgcagagagtacatgttcccctgcacatccagtcgcgcacgacgccattgcagacctacagagttttctcctggaagacacggaccttagtgatggcatgatgccgggtaactttggcctggacggagtcgaagcatcagaggacatcggggctttggttcaggtatttgaccagcaagatcccggaaccggggctgagctgcttggaattcctccagtttctggcgctgctcattgccaagacctcaccagttggcaggtccaaggggaagaatgtcatgtgtccaggaggaacggatggcacgtcgtctcaagccgactgcctcgtgccattaccgggcaacgtgggcaaactgatggatgcagatggtgagcaaatttggggcgccgataccttttttcaaagttcttgcagcggcaccagtcaacaaacctatgttagtgatccctatctaatagcgattcccgacaagcatgagaaattctgggaagtcgattttgaggcactggatgatggagatctgcacctggacaagtgcgttatcggtgaccctgctcttgagcaacacaggggaaacatgaagccatagatcaattgcgaagcgggggagtagtaggtctgatgctcgatccacctatcttaataaccatacttagctgtgagaagtgccatagttatttgatatttaggaggctagtgaactcctggatgtgctcactatggcactaagaattagtagtagtggnggtactagtactagcggtttgtttttgttttccattcattcaccctactgttttgaangaaaa

SEQ ID NO: 9755 - DNA, 646 bp, Triticum aestivum
  Clone ID: PAT_TA_9755
gcgcgggcgtacgaggttatcatggggatgcttctgttcacaccaattactgtcctctcatggttccccttcgtctccgagttccagacgcggatgcggttcaaccaggcgttcagtagaggtctgcagatttcccggattcttggcggtcagaagaaggagagggccgctagcaccaaagactaaggagctgttcggcaatcctccctccctgaaatctcagaatctgtggagctcctttttccccgctccgtcatttttagcaacagctccagggcggacttggggagcggagagtctccgaacaggccctaacttggcttgtttgcccaattgcctgacattttcaagatctagtgcttctgctataaaaaatatatagatatagtgctacttcagaatacatagggtgtaaatattccaggatatagaaatatttcctgtgatcacagcttcacacaaggtgcaatgtatggaattgtagtcatttcttgtgtaaatactacagcacttcagcaacggccactggccaggagctggggacattggtccttgagtacattgatcgtgcgacgcagctagtaccggtacatccatgctaccttttcccccgtgctgtgctacggtaatcatttcaaaaaaaaaa

SEQ ID NO: 9756 - DNA, 452 bp, Triticum aestivum
  unsure (1)..(452): unsure at all n locations
  Clone ID: PAT_TA_9756
aggcgtgatattgctcttactgatgaactagnatgctttggtctggtagtatgaaagcaaagggccatattctagtagttccctttatcatgtaatcaactttatgggtgtgaagactgtctatgttcctattgtttggaaattacatgttccacctaagatccatgtgttcctttggttgatttctcataataaaataatggagataaccttaggaaaaggcatatcatcaaacctctagattgtgtgttctgctctgaaactgaatctttccatcacttgttttttgattgtgtagtagctagatatgtgtgggcaatttttagggagcacttcaacataaacttggggtctgattacatgtccattgccaagttttggctctctaacaataaaaaatctgcccttaatgtagcatgtgcaactgttgtgtggtgtttgtggaaaattag

SEQ ID NO: 9757 - DNA, 1086 bp, Triticum aestivum
  unsure (1)..(1086): unsure at all n locations
  Clone ID: PAT_TA_9757
gcacgaggatctagattgtcagagagctataaatcttccaaatcagtgcgaatataccccatggttttccgacgaatatatatgtacttctccaaatacacttgcaattctgctgtagctgttggggaattgttaaaagacacattgtttgttgttatctgtgaggcaagtcgctttgggtttgtccaaaggttgacttttcaaggaatgcatgctttcgaagttccggttggactcactgatttgatggataatattattcatgattacaaggatttgtcattaggggcactgttgatatatctgtatgacctagaagagaaattgagcgtggctgagagatcacgctaccaaactgaagatcaactagcagctgcactagttggattcaacagttacgctctgcatgtgaatctcaggggatctgatggtctttatgctccgatgttcgatagtgaggttgttaggcttatccatatgaggcttcggaactttgacaaaaatatccgcaaattgactgatgtttcttattgattgctgctgatttgctgagaaatggctcctgatgatgattcaatctttattccaagttatccatatgaggcttttgaagtttaatctctggtgctgtgttgtccctccctcatatcaattgctttgaaatggctccttatgatgattcaatcttgatgatggcctctgcttcttgatggccgttttctatgatgtccctgcttcttcctgatggtagcccatgtgattttggctgctgtagatgacactggccttgttatttgttcattttgtcctttctcagacagtggctttgccgtttttgagcttgtggctgatactccttaggctatagtttactgaagtagaatttcgtcatgcctgtgctcagtgtattttttgttgattgtgccttgtgtaccatggaattgctggctgatactgccttgggctgctagtttactgaagtagcattcctctatgctcagtgtaatgttgttgctactcactgaaaagctcactttatcatttcgggtggccttggtgtaatacatccgctcgaacnaaaaaaaa

SEQ ID NO: 9758 - DNA, 1125 bp, Triticum aestivum
  Clone ID: PAT_TA_9758
tagcgtggtcgcggccgaggtactcaaaaaagcatatgaatgattttcctgagctaattgaaatgaagaggagggcaaacactcgaagtctcaaggaaatggctttgcttttacgtgggggttcacatataatttggatagctccgagtggcggtagagaccgtcctgaccctttgactggagaatggcacccggcgccgtttgatgcatctgcagtggataatatgaggaggcttctggagcattctggcgttcctgggcacatatatccattatcattgctatgctatgagattatgcctccaccacaacagattgagaaagagattggtgagcaaagggtgatatccttccatggtgtaggcttgtcagtagctgaagaaataaagtatggggatgttactgctcaatctcggaatgctgatgaggcaagggggacattctcagaggctctgtacaattcagttgttgatcaatataatgtcctcaagtctgctatctttagagaccgtggagcagtttcgtcaaaccctgccatctcactctcgcaaccgtggcgatgaaactaagctttcccaggccgggatttctcatttcttttcgatggagtagatgaactgctatagtgcaaagttgtgggtttttgctgggaaggccttgttaaactttgatgtcgtcacagttactaatcgtggatgaggctgcgacggcggccctgcagaccctgtaagttgttgaagtcgcgtgaaggaaaaaccgtgtgatatgctgctgcctacaccgtgctcatgtggtgacaagaagtctgcggctattgtcagtctaatcctaaatagcacggcggaacccagcagcagatgatgcatgtgttccatcttttgtgaagagctactgctgtatgagatggctatcatctcgcccagattggtccagcaaatacagattggtccctggatcctggcaggcagtcggctcgatttcctttttgtgctaaaagttaactcgtcctattttttgattagttttgtgtacctcggccgcctcctcctccaaaatttggagacacatgacatgatatatacatacagagcccaatatgtgtcgccttcctatttgtctggctcc

SEQ ID NO: 9759 - DNA, 1396 bp, Triticum aestivum
  Clone ID: PAT_TA_9759
tcgcctcgtcgcccccgcggtccgcactgcccgcgccgcgccgcctccccggccgctccgccctcctcgccctcgtctccgatcggacctccgcgcaccactgccctcagcccccgccgcgccgctcctttcctgcgctgccctcggctcctcctcgccatgggcaaggcctccaaagacaagcgggacatctactaccggaaggccaaggaggaggggcgtccgggagaaagtgggaactccttctggggctgatgatttagattgcagaagcggatggttggagggaccaaacaaggtctacatcccgtttctggcttgtggcgacctcagcggttacgattcggaccgttcataccccctcccgagcacagaaggcggcacctaccagagcctagatccagtccagcctcccatcgccccgccgtacaaaactgcgttggagatgaagaaggcgtctagccacggtgctggcgcagataccagcaaatcatctctcgacccctaaactacattatagctgcagtttatgctcatctacccgatcgctacatggaaacatgtgaatcggcatgcagcgacgttcaccacatgctgcagagtacatgctgaagttgaagctgaattttcgttattcatggaatcttgaatgcgaagattttccggggtagagatgcgaggctcctgttccgccggtttgcgcgcctcggcccacgcgtctctgttgcgaacccagcctgcggccgcgcccctaggatcgtcgcctttgctggttccgcgttctactcacctccagagggcttcaaagagaaagatttatatcacctgctggagaaagtgggaactccttctggggctgatgatctagattgcagaagcggatggttggagggaccaaacaaggtctacatcccgtttctggcttgcggtgacctcagcggttacgattcagaccgctcatacccccttccaagcacagaaggcggcacctaccagagcctagatccagtccagcctcccatcgccccgccatacaaaactgcattggagatgaagaaggcgtctagccacggcgctggcacagataccagcaaattatctcttgacccccaaacaacattatagcttcagcttatgctcatctacccaatcgccacatggaaacatatgaatcatcctgcagtgacgttcagcacatgttgcagagtagatgctgaagttgaagctgaattttggttattcatccaatcttgaaggcaatagcatgtggaagagatggtataaaccgaggggtatgcatgccatgggctaagcaaactcttgaatgaactataagcctggatcaccattgtagtactttgccttggtgtcatttctggtatttccatattggact

SEQ ID NO: 9760 - DNA, 943 bp, Triticum aestivum
  Clone ID: PAT_TA_9760
gcgtgaaatctttttattgaaccaatttaaaagcggtgccttggtggtgcgctctttctgtcttttggggcctttgcccgctgccatccccttgttgtcttctggggctgtttcccatcgcgtccgagcaattgaaacaagcaaactgacttgataatttcattcttctattgtactctttatctgcgggccctagtttgtacttttggtttctctttacttctttactggtttcaacttaagggtcgtatagggcaagttcagctgtcaagattactggttttgtgtttcatgttcatgaatggcttttatgatataatctccctgtgagagcttctatctaatacctgaattgaattacatgttgctaaactaggattgcttgtgtcacagcaagtagccagtgtaggggctagctattgctccctaaagggcagcacggtgcacgtgcttgcgtagggctgtttctagaactcgaacccatgagcaagtgaccacattagtgcctaactgttactccctccgttcacaaatataaatgttcatggtcattctaccagaaattcagttatggtgtcgagatgggggtatatctgagccatttacttatgcatgtcccagtttttgtgtccaccagatcatgatttgctcctgatatagtgattttttctgctttcaccatttctcgtgtggtttctggtcatcttttctttgttgacaattggcttcggtctgctactctctttgtgggattcgcgctaagtgatgttgatggtggtgatgagtaaggctcattcagaggtttactgatatcagataccatcgcttgtttttattgtatgggttatattttgtgttactaggttggagcgtgcaaatcgggatggcttgctgcactatggcgctgcaagcatcaccagacgtgatgattgcatgttggctt

SEQ ID NO: 9761 - DNA, 900 bp, Triticum aestivum
  Clone ID: PAT_TA_9761
aggcaaatcccgcgcccccctcttgccggcgccgctctccctcacgccggcgccgctacctagctcgcccgcgtcgtgtcgccccttctccctttcgcctgcgccgccttctccctctcgctggcgtctcctgcgccaccttctcccgctcgaggcaaagttgccctttttaccaaggtcgaggaggagcgggaggacagccttgtcctgctcgacgacggtgacgtatttcttctgcttgacgacgccggcaacgaacgccggcgctcctcgtcgccctcgacctgcaaggaggagcgcctaccccatgttgggccggagatctgctggagcaaggagtgcgtgaagaagcccctggagcggcagaagcaggggcgggggagcgagtcggacgccgggggtcgtccacggcgtcgtcgaagcagagcagcggtgggtcctcgttcaggctgcagcagctcctccatgcgccccgccatcttcctctgctgcgtcgacggtggagtgcggcgaactctgtgtctgcatgtactcttcttgcttcttgcttctgtatggatgtatggatgattcgaggagtactattgtgagaagtgcatacaagaattgctctagggactcaccgatgctagagtggtaggcttgctgcttttactccagaaataatcatactgtatctaggagtaaaatgccaaataggaatgccaatgatgatgtgctgcttcttttcatactgtgcttctattcatactcagtttgtatcggcaatttttgcaagaacacatgtgctatagcaaatgcagtggagcaggtatacccaaccaatcacctgtcatttgctattgcgataacaagtgcagtcttatctactgcttctgtgaatctttgttcgagaacaaa

SEQ ID NO: 9762 - DNA, 1150 bp, Triticum aestivum
  Clone ID: PAT_TA_9762
tagcgtggtcgcggccgaggtcttgcaccaactaacaccgatgttttactcattctttgcaggttgctacctgtcttcatatcattcttaccacagctgaaattgtatatccagtgcttgtcattcttatgtgtgattctgcggttgtgtctggttttttgttgatgtttattgcctgcattgtttggctgaagctcgtatcttttgcccatacaaaccatgacataaggcaattaaccattagtggtaagaaggttgataatgcacccagcacagctgacatggataatttacaagctccaactttagggagcctaatatacttcatgatggctccaacactgtgctatcagccaagttatcctcgaactgaaaatgttagaaaagggtggctgattcgtcaaattattctgcacttgatatttacaggtattcaaggtttcattattgaagcagtacataaatccaatcgtcgtgaactctccaacatccattgaaaggcggacttctgaatgctgtagagactgttctgaggctctcattaccaaatgtttacttatggctttgcatgttctattgctttttccatctctggttaaatatacttgctgagattcttcgtttcggtgaccgtgaattctacaaagactggtggaatgcaaaaacaattgatgagtattggcgaaaatggaacatgcccgtgcataaatggattgttcgtcatatatattttccttgcatgcgaagtggtatatcgaaggaagttgctgtttttgtatcattttttgtatctgccgtgctccatgagcttgttgttgctgtcccctgccgaattctcaagttctgggcattcctagggatcatgctgcagatcccccttatcacattgacatcatgcctcaaaagcaaattcagggatacaatggccggcaacatgatattttggttctttttctgcatctacggccagcctatgtgcgttctcctgtactaccatgatgtgatgaacaggattgggaagacagaatagagccccatcttctttcttattccactttggaccaacggattcagagaagcaataatatgtacaacgtgaaaccgcataattttcttacaccgcaacaatctttcttggaaaatctagcag

SEQ ID NO: 9763 - DNA, 1310 bp, Triticum aestivum
  Clone ID: PAT_TA_9763
gtgcgtccgcacctctcctccttcccgtcggcaccgccgccatctttgctaggtcttcctccagatccaactcacagcttccatgcccataggtaccgccgcaaccaccatgcccaccgttgcctcctggatcctcctccatgtccatgccaccgtccgccaacctcccaaaaacgcctccgccgtcgcccactcgagcaataacgagaaaatatatgcttcccttctccgccagcgcccgccggttccctccaatctgtacgtgtactgcgcagacggcacattcggagagaccccccgcgtgctgtcaatggtggacgacatcatcctcttccacgcatacatcggtcctgcgttcccctcccccaagccatggaagggggacttcttcatataccggtctgactccaatcgacggtctctggagcgtctaccgcacccccaaggtatgatcggaagggacgatccattcggcatctttccccgagagggcgacagctacacaatcgcggcgctgttacccagcatatcctctatgtacgattttgaactccacctcttcgactcggagactcggatttggagcaggaagaatctgactgttgggtcgcgacaggaaaggttcaaggttgatatccccatcaacataagtcagatcttacaccataacacatccactgtgatcactcttggaggctccatgtgctgggttgatctttggcgtggtatattgttctgtgacatgctctccgagaaacatgcactcacaggtgttccactgccactgccattgatctactattctggtgatagaagcaagatcctaggacctgcgaagtgtcaccgtagcattgcttttcttgatggatgcaccaggctcgttgaggtgaattctgatgtcagtattgccgaaggaactgaatttggttgtggccgaactgaagactggacgattaccacatggtacaacaataatgtgcataataattcttatgatgattggcatccggacatcacactaaaagcttccaacatcatcctgggcaaccactccgtgaagctgccgttaggcttgcagtacctttttgtttctgacccaactattttgcatgaacaatagggatggctatatggtttacctgactgcgagggagaagtatatcctccctaagtcatggattattgctattgatttgaaaaagcgcaaggtgcaaagtgtggttctgtctggtcctgtacctccgccaatgccgcgcattgacactaactactgcacttgtagtatctccaagtactgtaccagcacttca

SEQ ID NO: 9764 - DNA, 777 bp, Triticum aestivum
  Clone ID: PAT_TA_9764
gccggcgcgggggtgaaagagatcatcatgctaagcgcgtccgcgaataagctggcgaggcttaaggagcaagcagaggaatacgccgcgctgatcatggaggagctagaccccgaaggcctcggctacattgagctttggcagttggagacgttgctactgcagaaggatacatacgtgaactatagccaggccttgagctacacaagccaggcactgagccagaaccttgctggcctaaggcataagagcccgatccgaaaaatgagcagcaaattaagctattatctggaggacaattggaaacgcctctgggtacttgcactgtggattgggataatggctggattgttcatttggaaatttatccagtaccgcaaccggtacgtatttagtgtgatgggctactgtgtaacaattgcaaagggggctgctgagacccttaagctgaacatggcactcatcctcctacctgtatgccgcaacaccattacttggctgcgtaatacaagagctgcacgggcattaccgttcgatgacaacatcaacttccataagactattgcggcggcaattgtggttggtgttatccttcatgcaggaaaccatcttgcatgtgattttccacggcttatagattcctcagacgagaaatatgatccactgcgcatgtactttggggagaccaagccaacatatttggcgttagtcagaggagtggagggtgtaactggagttattatggttgtctgcatgctcattgcttttactctagca

SEQ ID NO: 9765 - DNA, 469 bp, Triticum aestivum
  Clone ID: PAT_TA_9765
tgtccgccaaccagggcccccggcaggtcgccggcggcggcggcgaatgcgacgacgcaggcgaaggaagacgacgcggggggcctcttctcctcgcgctcctccgcctacctcggcctccaaggtggctcctcatctgatctgagcagggaagcatacaccttggttgttatattaagtagcagcacgatcagatcagaatctttgaggagggagaggacggttatctgtggactgtggtgttgatgtaaactacgtaagtcttttgttcccaacaatagccatggtgattgtgacagaggatgctccagattgcaacagtcaccctctcgattaatcctaggcctggctacgcgccagacatgtaagaaaaaactgtcatatctgacagtcattctaattttatggataaaacagagcacgtcctaacgtgaccgacgtggtcgaacgaacaagcgaggaaaactat

SEQ ID NO: 9766 - DNA, 340 bp, Triticum aestivum
  Clone ID: PAT_TA_9766
gcccagatccagattagaaagaagctccagcatatcctcatggcaaccctcggcaagagtactagcgttgtgtgcctcatagccctagtgctcatggccaccgttctctcctcacgtgccatcgaccatggatgcgacatcggtccatttcccggggataagtgtcccgagctatgtgaaaaagcatgcggtaagcccggcgcttgctcatcagacggtcccgtgtcttactgttgctgcgaaccagtacgtcaagatggatccataaggcctcaggaggttgctgaaatgatacaaacatagtgtcacggatgaccagaaccatgtcgaataaatgtgc

SEQ ID NO: 9767 - DNA, 520 bp, Triticum aestivum
  Clone ID: PAT_TA_9767
gcaatgacatcacgcatcactacttgtataccatttacactacattagacattcataagagaaacgctctcaaggcaaaaatacaacctgtctctattgcatcaactttgtacccaaagggtccatcaattaccccttcggaggtacctttgcattcatcaacaaaggacaagacatttgccatcctgtgcgacccggcctaccgtgatattcaacacggcgttagcttgaagttaatccgcagtgcattggacatcagccaggacgaaataatgcaagtcattacagagcagatctacctcgggatgatatacactactcttgatgacaaccacttcaagtcctccatctgattggtcgatggtccacgtgttaaattttagagtttaattatgtaatgtgtgtctgacatttatggttaagccctgcaatgattttcatttagacctctcatgtttgtacaatatatttcaaccccggttcacacattgcaattctctcagttattttaaaaaaaaaa

SEQ ID NO: 9768 - DNA, 1200 bp, Triticum aestivum
  Clone ID: PAT_TA_9768
aggtgcacaaggtcatcggcttctccatcctgtccatggcatgcctccgcaggggcttcggctcgaggggaacacaagcctggaaaactcctctcccgatgcggagcagtccacggcgctgtcatcgtcgtcctgactccttggccgctgccgctcccaagcgagaagacaagcttggcttgtggcggtggcgggtattactggagtggaggcacattttgttttccgttctcgtcattcttggaaaggcacaacatgtacgaggaggaagccatgagaactaccagagtggagatggggatgcgcggcgagctgtgggacgactcggcgctggtcgactgcttggaccacgccgtgccacctacaaggcatgccgcaggcaccctcgcccccttcggtccgctggcccggtcctccttgctgccggctggtggtggtggtgggctgtcctggaccctagcgttcgtgcgggcctgggcccggcaccttctgttcggcaaggcccacgtcctgtgtgccctgtgctttcttgcaccgggtctctcttggaaagatacgggtgtgagctatgttaaggacaaacaattgcaactgaatatgaagataaataaacttcagcgagactgtgaaggtacaacaagaagaggcaacaagccatggaggttctcagtgcaaatcatacttgcgagcaatctacagatctaggcctgatgattatcagttgtgttgagatccttgtgtgctatgtagttgcaaatggttgcaaagacggctgggatagaccatgaagagtggcttgcgaatgcggatcgctgggtggctaacttcttggagaagttcgcggagcactgccttgtgatggtgtcggccttcctgggccgcttaccgggggccaaatgcaggggggtgccattggtagtggtggtggtggtgtgaacaaacaccgagcaagtgacaagttgttatagttgtgcttgtgtcatggaatgtgatgcttgtgcgagttaagtgggtgagttagctgagccaaaccttgggctaggggccccctgacctccccccgcttgccgcaagggaggcgccccccccccgcgttaagggggtgagtttgccgtgccatcccttgcttgcagggtcgcactaactgccaccgtgggcagaaagggagacgcaccacacgtctttaatgtaaatagatta

SEQ ID NO: 9769 - DNA, 581 bp, Triticum aestivum
  Clone ID: PAT_TA_9769
gccctgggtcgggttacgacttcttctcacgtttccttctgcccaaaatttgggattgatgaggatcctgtatgtggcagtgcacattgtgttttggcaccctattggggtgaaaagctggggaaacaaaaattgatagcgtttcaggcatctccaaggagtggaacactatatctggagctggatgttgcaaataagagagtgctgattcagggagaagctgttaccatcatgagtgggacactcttcgcctagctagcatactgacatctactcaaggcacgaccatttgtggacttgaactatgaactatggcgagatggttatatttgctgcaatgtgctggtctaacactgagtcgaccagtttatgggaataaaaaggttgtagcattgtaacaaggtcaggcagaacaagctgaagctgcattgtagcatccggctatttcacctctcccgtagtgataattttattgaagtgttgacccaccatgcatcaagatgttatgtctactaggacaatgcccgtgcgttgctatgggcaacatttaacaattttatcgacaaatcagtggggagttt

SEQ ID NO: 9770 - DNA, 924 bp, Triticum aestivum
  Clone ID: PAT_TA_9770
cctgcccccccacgcacgcaggccgccttatcccccattctccggcggcggcagctgatggcggcgggggcggcaacgggctgcctccgatggacttcctccctcgcttcgctcgcgccgccgagcacgcgctcgttctctcgctcttcccgcccgccggcccgcccgcgcctgcccccccggacgaccgctcccccacccaacctctccgtctccgggctaagcaagcgtacaacaactgatggacttagagaagcttttgcaaagtttggggaagttgaacacgctcgagttgtcacagatcgagtggtttgtttaacgaggggggtctttgtaaggtatgtttcggtttgaagatgcagctaaaggaatagaaggaatggatggaaaatttcatggatggatgggttatttttgccgaatatgctagagccaggccaccgccacagcatgggaggggcaactccgcagccacaacaatcatggggcactcctggttcctggggctcacagtagatgaagggacgatcattctatctggggtgtgcgactgacagcgtatcacccagccatcgcagtctacatttagatcatagctaccatcgtgttgtccctaggtgtgaacacccttgcctgatccaatattcttgtcgtgttggactggtcgtttacggcctccacatggagaagcacttgtggaaccttatatggaccaagcaggtattactgtcagcatgcaacagcttcggaccattgctaataatgtcttcttgtcccttttatttgaattgtcgtaagccttatcagctggtcatggcatgtgctgctcttgtactactggataatgaatcatagctcggaataagaacacgtttgcaagcgaatctcgaactgaaaaaaaaaaaaaaaaaactcgaactcgag

SEQ ID NO: 9771 - DNA, 1185 bp, Triticum aestivum
  Clone ID: PAT_TA_9771
ggccgccctcgaggctgcggtcgaccgtgcaaggcctgccgccggcccgcgtcgtgccgcgcgcgacagtgcccagatatctccactcccttccgatctccgtccttgtgcgcttcttatgtactggaccggggcttgcacccacttgcgaatagtgctcgccccgtccccccagccacagcagtcacattgatcaagcaggggtaggatcttataatcggcaacttgggggactctagagctatattggccactaaagatgaggataatcacctttttgctcttcaactgacagtcgatctcaaaccaagcatcccaagtgaagcggcacggatcagggaacgcaagggcagagtattttctctcccaaacgagccagatgttactcgtgtttggcttccgaagtccaactccccagggttggccatggcaagagcgtttggagacttttgtctaaagagttatggtgtaatttctgttcctgatgtttcgtaccatcacatcacagaaaaggatgagttcgttgtgttggcgactgatggggtgtgggatgtactttcaaacgatgacgtcgttaagattgtcagtgaatccacttcagaggcctcagcagcaaggcttcttgtccaaacggctcaccgtacgtggagaacacggtttcccacagcaaaagttgatgactgcgccgctgtctgtctattcttgaaaacagatttgacaaataaatcgtccgattcaggaaccaaagatttcgcaactaatgtggaactggacggtggtaagcatttctcgactgtcaaatcaagcactgtggttcctacagatcttgctaccgcattcgtaacaggtaatgagtggcctgtccttagcggcgacccaatgcctgccactccgacaaatttgctgacgcctacttcagctgcaaaccaaagcatgaaaggttgaacttgcctgccagctgagatgctcagttagttcaagagctgtgtgactttgttttgcttacactggccaatgttgatgggaagccggtgcgagttctactcgcaagtgggtgtaagcctcgattttgttcttttgtaaagtaaaaggtcagttataggttgtgattggttatatttgttctttgtccatataataatgacccgtccccgttgacggcattgctagattcatctatgcctc

SEQ ID NO: 9772 - DNA, 604 bp, Triticum aestivum
  Clone ID: PAT_TA_9772
cgaggggatttactggaggttacagtgctgaggctgtggcaatggcagcgccaccaatgccggagccggcactgccaccagaattgggcaggattggagtgaagagaggtaggagggatatgcctatggagattatagaggtgaatcaggcagaactggtcaagaaccgtccgagggaggacaaatccaagctcacggggatggcctttggtcctagttaccaggccgccccttcggggaagggaaagccctccaagctgcagaagagaaagcatcagatcggttctctcttctacgacctgaagcagaaggagatggagcttaccgagaggcgtgccaagggcttcctcacgaaagcggagactcaagcaaaatatgggtggtgagaatggtcacgaagacagccttgtatatcagaaattcagaatcgagctgtaactgtttatctatcttgttgtttaacattttgttgtagtgcctggtgatgtgaacccgttgtacgattataaccaaacaaatagttcattcaacctttgcttgtaaactgtgcatcaatttttacggaccatataaagaaggcaaagtgttcctgcgaaaaaaaaaa

SEQ ID NO: 9773 - DNA, 786 bp, Triticum aestivum
  unsure (1)..(786): unsure at all n locations
  Clone ID: PAT_TA_9773
anaagtgcataccattcttaatcctgtctctagttactttaatgtccaaggaagtgtgaccctcaacaaccttattatcttgagtgattcctgatcttccatcttagaatacctttccgcggccagtacgactcccttcttttcgttgccttcggcgcgctctagcccgtctgccctaccagaatgcgggacgtcttcggaggccgtcacaattgtcttttttctgctgtcggcgcgctgtaccctctgtccgtaatcctgttcctgtccttgtttgtcatttggtgtgcgggtttcgcccgcccggccgctgcgcagtttcttggcctgctccccggctccttgcggtgctcccctgtcgtaccccgtggcccctgccccccctccctaccggctgacaaaaagtggacggagggcttctatgacacatccatggcctactgctggaagtcgattggcggtctccatgtcctgaaatgctagttctataattaggaagcaaccgtaaggactagactcacaaagacccatgaagccgtactggactcacaaagaaccatgaagccaacagtccacgtcaactggatgtttgagcttccattttgtacaactgatgtctcatacttgcatttttatctatccttttctgatcatgatgtatggtgtcttagtggttatgtttagaatagactgaagtgtatatatgtgacgattagttaatgaataaaaaaatgtttggtgcacatgaaatacggtgccttggtgattatgcttcgaaaaaaaaaa

SEQ ID NO: 9774 - DNA, 750 bp, Triticum aestivum
  Clone ID: PAT_TA_9774
ggaccccggcccgtgggttcgaccgcgtgccatacgggctgttcctcggccccaaggtgagcagcagatcagccgctctgagtcccgtgttgttgatccatggcaggatttgcttggaaatcgggatcggtcgatcgctcgtggttgatggttttgcaactgcaggagctggaggaggtgggagggacggaggagctggagaaggaggtgcagaggaggatcaagaggaggcagaaatcagacgccatgcaatgaggatgcatgctagctggagtacttaactcttttttgtttttgataacatgccagctcttgcctgccttgcgatatatagtatatgcagattttttttcctcttcttctgattgggattagattttgtgtcactagtttaggtagccagaaacggaggcgacgtgcgtcaggtcggtccgtggagcacactggtattagaaaatgttgtgctggtattatgtgcagtactgtgtctatgactattgtcatcttgcggcctcccgcgcctgacttggtgtgtgccgctttttttccctcgtcctcccattgggattagattttgtgtcactagtttagtagccagaaacggaggcgacgtgcgtcaggtcggtccgtggagcacactggtattagaaaatgttgtgctggtattatgtgtagtactgtgtctattactattgttatcttgcggtatcgtgctgctgactgtagtgagacactatatacagtagtaaa

SEQ ID NO: 9775 - DNA, 402 bp, Triticum aestivum
  unsure (1)..(402): unsure at all n locations
  Clone ID: PAT_TA_9775
aggaattcggcncgaggattggcttgggatttacagaactctccgcaccaaaggtggactgatgaaggtggtgaagcttaccatccgtgatatgtttggatgggtcaataagctctaccaggatgatgcaaatgatgggtgaaaagggatgacccaaatggataggtcgctcgtttagtcagtttgttgctagctttgtttgctgcaacgaacttatactgtatttataccaaagtagataagtttggtaacaatgaaatgtgcatgtaggtatgggacctctattgctggtgaaatgttctgatgtgggagatttgactcctggtttatttttgtagaaatacccctcatcttttgattggccggtcaattcatatttggatcttttttttaaaaaaaaaa

SEQ ID NO: 9776 - DNA, 2338 bp, Triticum aestivum
  Clone ID: PAT_TA_9776
ctcaaccaagtcgtttccccacctccccccccgtccccccacacccgtccccccagatcgcgccgcgcgccgcccctgaccgccgccgggaaccccaccccgccgccgacgaggtccgaccccccggggggcccagccaagatggtgctcgcgcagctgggcgggagcatctcccgcgcgctcgcgcagatgagcaacgccacggtgatcgacgagaaggtgctcggggagtgcctcaacgagatctcccgcgcgctcctgcagtccgacgtccagttcaagatggtccgcgacatgcagaccaacatcaggaagatcgtcaacctcgagaccctcgccgccggcaccaacaagcgacgcatcatacagcaggccgtcttcaccgagctttgcaacatgctcgatcccgggaagccggccttcacccccaagaagggcaagcccagcgtcgtcatgttcgtcggattgcaggggtctggaaaaacaaccacatgtacgaaaaaacgcatattatcatcaagcgtaagggattcaaaccgtcgctggtttgtgccgatacattccgagctggtgcttttgcgaatcatccggatcgctcagagggtctggcaggcaaatcagagacgtgatggacatgctggaagagtacaagaggctagccaagatgtggagcaagatgaaggggctaaagatgccgaagaacggaaagatgagtgacctgtcccagaaccttaacatccagcagatgaccaaggcgctcccgccgcaagtgctgaagcagatgggtggcatgggtggcctgcaggcactgatgaatcagatgggcggcatgtgcatgagcaaaatgcttggtggcatgggcctgggcggtgattagcctggtcaaatgatgggatggttatcccaagggacgtaggtggcgtggctgcgttgttgtggcataatgtctatatatatttattggaactggagatccaacctaagaatttgagatttttgatgtgaaaccatttgtcagccgtctgctaggtatgggagacttgtctggcttaatggacaaaatccaggatgttatgcctgctgatcagcagcctgagcttctggcaaagctggctgaaggaaccttcactctcagacttctgtatgatcaattccagaatcttctgaaaatgggtcctattggccaggtcttctccatgttgcctggatttagttcagagttgatgccaaaaggacacgagaaagaaggccaagcgaagattaagcgatacatgacgattatggactccatgacagctgcagagctcgacagcacaaacccgaagctgatgaccgagtcgcgaatcatccgtatcgctcgagggtctggcaggcaaatcagagacgtgatggacatgctggaagagtacaagcgactagccaagatgtggagcaagatgaaggggctaaagatgccgaagaacggaaagatgagcgatctgtcccagaacctgaacatccagcagatgaccaaggccctcccgccgcaagtgctgaagcagatgggcggcatgggtggcctgcaggctctgatgaagcagatgggtggcaaggacatgagcaaaatgctcgggggcatgggactgggtggtgattaaatctggcaaatataggtagtttcttgtggcataggtggtgtgcttgctgcgctgtggagtttgctatatttatatagatctctaaagatttccatcctgacaaagatacttcccaactcctcaaaaagttatgtgaaatttctctgcaactaacatctgctaggtcatcaaatttacaggtactatggcttttctaaatttttcgtgtcattgcgtttcggaagacgcctaggaggaggtgaacttggtgacggccttggtgccctcagagatggcgtgcttggcaagctcgccggggaggacgaggcgaacggaggtctggatctccctcgacgtgatggtgggcttcttgttgtagcgcgccagcttggcggactcgccggccagcttctcgaagatgtcgttgatgaaggagttcatgatggacatggccttggaggagatgccgatgtccgggtgcacctgcttcagcaccttgaagatgtagatcttgtaggtctccacgctcttcttggccttcttcttgcccttcttgtccccgccctccttggacgccggcaccttcttctccgccttgggcttcttgcccgccggggtcttctccaccggcttcttctcggctgccttcggggccatggatgcggatgcggacgcttcggcggggagaggtgctgtggtgtacctcggccgcgaccacgcta

SEQ ID NO: 9777 - DNA, 294 bp, Triticum aestivum
  Clone ID: PAT_TA_9777
ggctgcaggcgccgagcggttcatcgagaggttctacgaggagatgaggctgcagcagaggcgcctcctctagctctaggccgtggtgccggatccatggacgactctgtctgctctgcatttcgccttcgtcttggtcttcactggtagaattgtcgctagctatcttagctgcagttccctcggttacagtgtgtttgctcttgcttcctcgcacagcgttgttgtccaagtagtaagtatcatgttcgctcatgtgtttgaatttacccaaaattccgtctaaaaaaaaaa

SEQ ID NO: 9778 - DNA, 630 bp, Triticum aestivum
  unsure (1)..(630): unsure at all n locations
  Clone ID: PAT_TA_9778
cgagcgagcgtgtgtgtccnggaaaggttaagatcgcgtctctcggatcgtgagaccccacgaggaaaaatcgggcgatcgtcgttggattcttgttctgtggcgcgagtgcggatcgggggagttctctggcgagtgaagggcgagcgagggatcctggaggttgtttgcggaggagagggatctgatctgaccagtgaggcggagatatggttgccgggccggaggtcatgcatcaggtcgttccgatgctggaggcgcagttccgccggtgccccgtcagaggggccgaggaggtcgtcgtcggggtcggggtcggggtgtcgtcgccgccgccgccggtcgattcgcaagcgcaggtcgacctcgaggtgcccgatctggtcaagacgcctttggagacgctacagtttgtccccaagattagatctgggagcttcgctgatattggacctaggcggtacatggaagatgagcatatcagaattgatcatctttctggtcatcttggctcgctgttgctgtgcccgtcccctaatgccttctatggggtttttgatggccatggaggttcagatgcagcagcctacatgaagaggcatgccatgaggttgttctttgaggattcag

SEQ ID NO: 9779 - DNA, 765 bp, Triticum aestivum
  Clone ID: PAT_TA_9779
gcgggaagaagcttaccagaaacccctcggctggtacaaaccggaggctgtctgttggcggtgggccagtgcgaactccaaaatcagtgacacctcagtcaagatccgtccgttcagccaagaagacagaagatagtggcactctgtcccctggtagtagaggcaaaggcactgccagtcctccgatcaagaagttatcattcaaggcaagtactcttggtgagactgaaacccctcgtaaacccttcacgcagagcgcacccggaaatagcaacccagcgacgcccgtgcggtctgcctccaatggtaccgaaggcgagaaccgaactcccaagatactcgcagcaccaactcccaagacgccgatgatggtgacctctcccatgcaaatgaccacaacgcctgctctgactgctgcacctgtctgcgtctccaatgacaagccagagctgtgtttgctagagagcaccgagtactcctttgaagagaggcgccttgcctatctcgctgcgcacgccgcttgattctcgaggaatgccggggaatgctgtgtaggtaactgaaagtatgtcatcaggcatggcagggccaatgttgggagagacgcttggctaagttgatacaggcacatatttttctgatcaaagtcacaaccatatgtcatgtttctgttagttggtaacagatttacattgctgccttgtgctgtagttccgcagaagatttgtttcgacaggtcgacggagatgcttaactctatgtatc

SEQ ID NO: 9780 - DNA, 799 bp, Triticum aestivum
  Clone ID: PAT_TA_9780
gctcgatgtcgccggcggcgtccacgagcgcggggaagcgcgtggtaggccgtccccctgctccccggccgggccggcagatccgctggggatggccgctcctcctcctactctgccggggccggtgccggcgccgccggaaagaagagcccgacgggggccccggcggtgcgggctggcggggccctccggcgcccccggcctggcccccgcagcccccctcaccgcctcccccgacctcgccgtcttccacggatgcaccagcaaggcgatcgacagggctagcgagaacccagggcttgtgcaagggatcggggtccctatagctagagcgccgtggttcgatgcatcggtcgttttcggtcatcggcgccgagccgtgtcgtgcacgttcgcgctcggaggtccggagggttcgggattgtgtccgttcgaggccgtgcggaatggagaggatggtgtgtgctcatttctgccccaccgagactgggcgagaatggccatcggtgcttgccggtcaacggcaggtggaagctgcagcgtaaccatcagcggcgagcagtcctgctgagcctcaagctgacgagcaccgcaacctcaggggaactcgtcgtgtggaggatatctgatactgctgggtggtggggaaatcagttgagagtcgtgcctttcttacttttcttcggtcctcccgtccgttcctgccgtcccatctggtgtgatggacatggcagttattgatttggttggggcatcgcttcactctctgcttgctctatcccaaaaaaaaaaaaaaaaa

SEQ ID NO: 9781 - DNA, 485 bp, Triticum aestivum
  Clone ID: PAT_TA_9781
gatacttaccaccaagtgcagccagagtgaagaactgctatctgaagaagcaagcagcaacaaggctgatctactttattttatccttcacttcgccacagtttcggctcagcaaggtcgtaactcatgtaactttgaagtagtgccctgatataacggtgggcgaagcactggaagacgcatgcattcctggttttcttccactgatccttcaggaaaagaatggaaaaaatgttcgacacatttttcgtctttgtggaggggatgtcattactcgaatcaggagggcaatgcctaacattgatccatacttcaaaatgtttcaactccgtgtctcatctgtaatttcaattttagtcatgtacctggttttgtatcaataaaagttgagcaagtttttatatggtgtgtaaaggggtagagacccaaacagctaggatataatcaagcgcaataatcactatggttatctgacaaaaaaaaaa

SEQ ID NO: 9782 - DNA, 622 bp, Triticum aestivum
  unsure (1)..(622): unsure at all n locations
  Clone ID: PAT_TA_9782
ggaattcggcncgaggctttattggccagcgaaaagttggctgtcgcttttgcattactcgtatngaatccagcatgacaataaggatcgtgaaaaacttgaggatgtgtttggactgccacaatgcaattaaattgatcaccaagttgcatatgagagagattgttgtgagggacaggacacgcttccatcattttagacatggactctgctcttgtaaggactattggtaactcagcatgcatcgatgatgtaaaacaaggtaatatcagttgtcctaaagtctgagtgatcactcaatgattaacaagcatttttcatttcaaatgatgcactggctgcaaatctgtacttcagaggacgaagtggtaattaaaacaatgttctcacaccaatggaagccatacatgttaagttctcatttgggatcatccccaaacatcttggtctaattttctctgttgccgaatgatgattgttatattgacagtttggcgcaacttctattcaaagaaatctgatgatcatgttgcaacagcgttctgccattcacttggtagcaaatctgggtgtctgctgaagctttactgtttggtgcttagtgaaaccagggacgagaagc

SEQ ID NO: 9783 - DNA, 1356 bp, Triticum aestivum
  unsure (1)..(1356): unsure at all n locations
  Clone ID: PAT_TA_9783
ccccgccgcgccccacgaccaacagcaaccaccctgccaggtccgcccacagcaacgacactgccagttgccaccggaaccggagcgtcctccctcccccgcctctctccctcccggaatatatctcctccgagccaacccagcctcccgcgctcaccccctttgcctccggccatggcggcggcggcggaggaggaggggcgtgcgccgaccaagtacgtgctgattaccggcggcgtcgtcagcggcctcggcaagggcgtcactgccagcagcgtcggcgtcgtcctcaagtcctgcggcctgcgcgtcacctgtatcaagatcgacccatacttaaacacagatgctggtactatgtctccttttgagcatggtgaggtgtttgtgcttgatgatggtggagaggtggacctggatttagggaattatgagcgtttcttggatgttactcttacgagggaaaataacattaccactgggaagatatatcagtctgtcattgagaaggagaggaagggtgactatcttggaaagacggtccaggttgttcctcatgtaactgatgaaataaaacaatggatacaatcagtatcctctgttcctgtggatgggcagactcgtccagctgatgtttgtgttatcgaattgggcggcactgtaggtgatattgaatcaatgccattcattgaagctctacgtcagttgtcattttctcttggtaaggacaatttctgcctcatacatgtgagccttgttccagtattgggtgtagttggtgagcaaaaaactaagccaacacaacacagtgtacgagaactaagggccttgggtcttactcctgatcttctagcgtgccgatcagcacagccactaataggatccgcgaaggagaagctttcacaattttgtcatgtaccggttgagaacatacttaacatccatgatgttccaaatatatggcatgttccccttattcttagaaaccaaaaggctcacgaggctataatcaaacaactaaacctttccaggtctgctgccccccctgaattacgagattggacgctgatggccgagtcatatgataacctcagtacctctgttaaaattgctttggttgggaagtacactaatctgtcagattcttacttatcagtgngtgaaggctctcctacatgccagtgttgcatgttcacagaaacncttctagccagtgggtttcagcttcagatcttgaagatgcagctgctgcaagtgcaccanatgtcantgctaaagntggganactcttaangggtcctccnggatttgnaacctggaggatcggagatngngganactggagggactgggtga

SEQ ID NO: 9784 - DNA, 996 bp, Triticum aestivum
  unsure (1)..(996): unsure at all n locations
  Clone ID: PAT_TA_9784
gtacttacttgccattattnatacctttccaacctatttttgtaaaggtgccaaggcgctgaaggtngcgacaaagtcaaatttggccggataacagcttactttgttctgctttattcttgatcccacttaccgaaaatgcattatcaatgaatgagtccatcccaaccgacagtgtctacatgagtgattcaaataccaatgtcaaggatgcaccagcttttcatgagaacccttactgcaaggcactaaacaatgctaaagacattcaatttgatcatgccgatgttgagggaaatgctcaaaatggacccgttgtcaggctgtcttttgcatcgctgtttgatgctcttggcacatgcttaaaagatgagagctcagttctgttgctctattctctggtccatgggaactgcgattttcaggagtatgttctggttcgaacggacttgcatactttgcttatgcctatgttggaaatgctctacaatgcatcaaggaagacttccaatcagatctacatgctgttgataattctcctgatactcagtctagattcaaccttcaatgctagtgtgcacaaattggtgcttcctagcgttccttggtaccaggagcgcctcatgcatcaaacttctctgggatcattgatggtcgtagtactaatccgaaccattaagtacaatctctccaagctgcgagatgtctaccttcacacaaactgtcttgcaattctagcaaacatgggtcctcatgcgcataggctgagtgcatatgcatctcaaaggctggttagcctcttcgacatgctttctcgcaagtatgcgaaattagcagagttaaaaaatgacaaggctctcaaagttacgcctgatcaaatggaagcagacatcatttcagatgatacgtcaacggagcttcacatatacaccgacttcttaagaatcgttctggaaatcatcaatgccaatccttacatatgcattacccagaaat

SEQ ID NO: 9785 - DNA, 1293 bp, Triticum aestivum
  Clone ID: PAT_TA_9785
ccccgggcggcgcgaggcggtcgcgccgggcgcccggccgtgcgcgcgctggaaggcgagcgctgccgatgccggcaagcgcggcgctgcctacgttgaaaatactattggaagcactccacaaatcaacacttggactgctgactggattgagttttactcgaagcatagactgggataccagttgaagttgatatcacagcggttcggagattcagctatatatgaaaaaggtcagcgattgattgacaatatgcatccactgtttgatggtgctgttattgagccatgccttcttcatggagatttatggagtggaaatataagcgctgatactaatggagatcctgtaatactggatccggcatgctactatggacacaatgaagcagagtttgggatgtcatggtgtgctggatccggaggggattccttcagctcctgtttcgaggtgatcccgtagcccccatactatgagaagaggagggtcctgtatctcctatagcagtgcctggaccactccaggaagaaagctggtcgaaacccctcatccggcaaaatctgacaagggatatggtttctacgtcgaaaatactattggaagcactccgcaaattaacacttggactgctgactggattgagttttactcgaagcatagactgggataccagttgaagttgatatcgcagcggttcggagattcagccatatatgaaaaaggtcaacgattgattgagaaaatgcatccactgtttgacggtgctgttattgagccatgcctgcttcatggagatttatggagtggaaatataagcgctgataccaatggagatcctgtaatattggatccagcatgctactatggacacaatgaagcagagtttgggatgtcctggtgtgctggattcggaggggaattctaccgctcctatttcgaggtgatgccgaagcagccaggctttgagaagaggagggacctgtatctcctataccactacctgaatcactacaaccttttcggctctgggtaccgctcctcagctatgtccataatcgacgactacctgcggatgctgaaggcgtagcctcgtcttctctgagaacaaggattttccaacctctgcttctcagtgaattctgctaacaaagcaatgcatgtataaatggcatgttctatgtgtaccccttgatatgttggggatcactagtgacatccttacattctgttgtaaattcactatcaactaaatcttccttatatgggtaaaaaaaaaaaaaaaaaaaaaaaaa

SEQ ID NO: 9786 - DNA, 644 bp, Triticum aestivum
  Clone ID: PAT_TA_9786
ggaattcggcacgagggtcgccctcccctctctctctctcgctgacccctctccccccccccgtgcaagccgcccctgatctggaggaagaggagagatgcgggcgcctcccgtcccactcgcctcctcctcctcgttgccctcctctctctctctctcgctaacccctctctccccccgtgcaagccacccacggatttggaggaagaggagagatgcgggatctggaggaggaagaggagatccgagcgtcccggcggtggatcgaccgatgccagatcgggcggaggtcgccgccgtgggaggagcagggaagggtgaggcctgggttcgaccagcagcgcacgctctttaggctggtgctaggctgcatcttttcctgcccccgtcctggtgcctcctcctacccgcgtaaatggcgagcagagggcgtgagtaccagagtttggatgtggatgttacttcagggaggaagttggttacaattttcatttgtatgatgcagcaggcacaaactaatttacagaatttttggtgttgcggtctctccccatcttaacattgtcttccgctggaaggagaggaaatttgtgtatatcacacctatcagctacatcccatggagtggaattttgtgtcaggct

SEQ ID NO: 9787 - DNA, 716 bp, Triticum aestivum
  unsure (1)..(716): unsure at all n locations
  Clone ID: PAT_TA_9787
gagcagaaacgcatgcacacaaacccttgccagattctggtagctacaccgggaaggcttaaggatcatatggagaacacaccaggattgcccgcgggattgatgggcgtcaaattccttattcttgatgaagctgaccgcttgttagatatggggttccgaactgatatcgagagaatagtagctgcactccccaaacagcgccaaacactcctattttctgctacagttccagatgaggttcgtcaagtatgtcatgttcgtctgcccagagatctggaatttgtcaacactgttcaagaaggaagtgaggaaacacattcacaggtgaaacaaatgcatttggttgcgccactagataaacaattctctatcctatatggtcttttaacagaccatatttcggaaaatgttgactacaaggtgattgtgttttgtacaacagcaaaagtaactagtcttgttgctgaactcctgtctgaactgaagttgaacgtacgtgagatccactccagaaagccacaaagttacagaaccaggatatcaaaagaatttaaggaattaaagggtcttattcttgttagctctgatgtatctgctaggggtgttgattatcctaatgtcacactagttctgcagctgggagttcctagtgacagggaacaatatatccaccgtcttggtagaactggccgcaaanntaatgnnnggagcnn

SEQ ID NO: 9788 - DNA, 290 bp, Triticum aestivum
  Clone ID: PAT_TA_9788
tgcatttcccccctcaagtgcaacgctaagttcagtagttcagttagttgctttgccccccgtccttcgccaggtcggtagtgctgtttggatctatttgcgaccactcaactgagacctgtttgcatttgggttaaggtagttctgcatgcttggaatggaatatttagtagccccaaacttctgttattatattgtattgcacactgttcatgcttttatggtactttttgttgctattttggatattcaattcctgtattctgactctgaggatgcttctaaaaaaa

SEQ ID NO: 9789 - DNA, 591 bp, Triticum aestivum
  unsure (1)..(591): unsure at all n locations
  Clone ID: PAT_TA_9789
tcggcacgaggctgagctgcgatgcagagcacacctatgcggagcagcgcgacctacaacaagcgttgctgcgcgcaggaccaggagcacggcaagcaccgaaagtgccggtcgatgagcgcaggcccagaagaggaccatgacgctgccaaggaggtgatgaacacaacaaacagccggcgttcaggcttcgtgacatcccttgaggatgttagaggatccgcttccggagcgtaaggccctgctgccgttagccctggaaatgttaactctgtagggagcccaacataacagaagcctgaagatgatgcctagaagattgaggtgaagaatggaagatgatgcatggtattacatgtgcttacttgatgttgttctatgccattttgtgagaaatcaagattgagaaatgatcttgttttatttctatgtcattctgcgaggacggataattgtgaacttatgtttatttgatgttacatcattttgtgagaatctgagagcttatttggtgatgtaaacttgtcctatgtcattttgtgagaatnctaagagctcatttgatcttgtgcacttttgctaaaaaaaaaa

SEQ ID NO: 9790 - DNA, 726 bp, Triticum aestivum
  Clone ID: PAT_TA_9790
cacgcgtccgaatcgaccgttccccaaatcggcccgagccctagctcctctaacgcaagccgccgccggtcgcctcttccacgccgccgccggacgctcccccctttctcctccgctgctcaacctccacggctccacggccacgggcacggctgcacggccgcctcctccttcacgcaaagcttgctctagagcatgtgcgtgagcagggcattgtgaagaggccaagttgaggccgagaggagccagccgtgttcttgtgctctttttcgagtattacaccggagatgggtcgcaagaggaagagcacaatgggtggaaagactccaccgtcaaagggccggccttgctgcaagtcggtggcggtgcccagtctagttgccgtagaggcgccggagccggtggcagcgtccaacgcaatggtgccacatcatcagccaaaaggaggaccagggctactcaaacaagcctgcagtgcagtcgcggtatctgcggcgaaggaaaaggtggtgaagctcgacttagatgttccgatgagggtgctaaactgcgacgtgtgctatggcctcctgaaggctcccatcttccagtgctcccttctgcggcacgtcgcgtgcaggtcctgcagtgagttccacggcggcaagtgccgtccttgtgcagacttggccgcctccgctgtctacgtccagagctcctacctggacaccctattcggctacatca

SEQ ID NO: 9791 - DNA, 697 bp, Triticum aestivum
  Clone ID: PAT_TA_9791
tccacctcttcccctcttccttcctcgccagcagcagcagcactagggagcagcggcggcggcaagcgagcagcagctccgcacgagcaacagcgagcagcaaagtagcagaagtagggagcgccggcggcggcggcggagcagcagcgtcaagataatcgattcttgccggaaggaacacacgtacacagctcctgaatctgattctttttcgtttattgtacacatgcgcacacaaaaccggtgcattgccgcaagctcgaatcgggcctgcttcttttcgcttgtttctcgtcactgttcagtgtttacaaagggatatacatacgtacatataccgctggtggcccacgacggccctcgttttatgtataaaccgggcggctcaccccggctctcggtttatatataaaccgggctgttcaactcggcccttggtttgcacccggcttacccctgataagccggtcatctgtaagccatgtactataagcaaggagttttactcggcttatatataaaccgagttcaaatcggcaacagccgactgtattaggtacatggcttataatttttttcttctagtgaaactagcttgaaccaagtcaagtgtcaaataggtagctcaaattggcacattatgaagcataaaattagttatatttcattgtttcgatgttattatctttttttcgat

SEQ ID NO: 9792 - DNA, 1335 bp, Triticum aestivum
  Clone ID: PAT_TA_9792
ccaccattcactgagccccgtgccctcgtccttctatcagcgtctcctctctcaagggttttattacatcagtgggcaatgtgtttcaggtccggttcgtgctaaatatttgttggcgcttcagtgatttcctggagtcaactttcttggacaattaccctatgctgctatagaaagcacatacatggatcttgaggtcctgcagcgtatacttgatagaagggagaagccaacaaatctatcattcgagcttttgaagaatatcacagaaaacttctcggacgatcgagaaattggccatggtggatttgcaacggtttataagggagtgctcccaaatgggaatgtcgcggtaaagaggataaggaacggttatacaatcaacgagacacttttttctccggaaggtgaacgcccgtttaaacatggaccacaaaaatctccaaggtttccttgcctttttgccggccccaaccaaacagccccaaacacccaaagaaccaaaacaccgtgtgtcgcgctcctaggatagagactcctcgggtcccggtttgggcgcaagccagcccacatgcattagttggccagggagcctcaaatatatgttggtgcgagtgttgtgttactcacttactaaatctctttattgcatagcaccttcaaattcagctagacattcttttaatgctcacgagaagttaaacagggagtgctcccaaatggaaacgtcgcggtaaagaggataaggaacagtcattcaatcaatgaggctttgttttatcgtgaagttgacagcctgttgaacattgaacataaaaatactgtacggtttcttggcttctgtgctagcacagaccagacagccatccaaatcgaaggatcgaaacaacatatttacgcgctgaggtaagagaaagactactctgttttgagtatatcagcaatggaagcctacaaaaatatatcactgatgaattaaggggacttgaatggagtacacgatatggaataattagaggcatctgtgaaggtctgtatcatctgcacaaggaaaagcaaatatatcatatggatataaaacccgacaatatactcctagataatgatatggcgcagaaaatcacggattttggcttatcaagacttgatgaaaagaccaaaaccatgagtaaataccgtcctggatcattacgatattgtgctccagaatacctacatcaggggaagatgtcattcaaatcagacatgtacagtttgggtgttataattaccgaactagtgacaggagaaaagagatcccgaataataataacaacaagtaagagggtcttatcc

SEQ ID NO: 9793 - DNA, 1262 bp, Triticum aestivum
  unsure (1)..(1262): unsure at all n locations
  Clone ID: PAT_TA_9793
ctggtacttcacntttgcaattggtcgctactcacaaggacttggcggtgtacctagacagttttcagtttttcactctttgcaatccttatttcaaatagcatatactctcagaaccttacatcagttacgatattaatttagttgatagatcatctgctgagccgcatgagaatggtactacccattggatccaacttcatatattcagatgtcaggctatcactgaaagatggaacaaagattcttcctttgcttgatagccgtggcatgtggtacaactatggaactacacaacacagtagttgaaatactgaatggttgaagctatagtggagtcagatccatactgtcagtggagctaattactgccagttatgatgttactagagttttgttgatcaatgtcatttgaggcaacggatcgaattggctaaaagatgtggttgagccagccagtttctcctactgtaacttccacaaaaaaaaaggttttcaagttgtactgcaccgacttctgaaccaaacacatcttcattcttcagcccacaacactggtggctccttgatcgaaagccggtgcgatgagagaactccaaccaggccaatcatttctaccttcgcatcatctataagatggaaagcagtggcgaaatgatcagtgtttgcttcacaacaatggaatgctgctcgtccagcttccttgaagtctagcggcttactctattggatataggcactgttgaaagttgaaacaaggtggaggggcatgggagatgaagaagaggtggaccaagtgcaccaaatcctgggtgcagatggaggcggcgattggtagttgcaaaaggtgaaggggtaggggacggcggtggaagaggagtgcgccgcaggcgcaggaggagaatgacgctatcagatcatgaggaactacagtagcatttactgcacattggcatcttttcggaagtggaacagcaagggggggagtttgtattaattctcttgcttattcctgtgtttcttccaaaacagaaacagaggaaaaaagaaactgaggactttttctttcagcaacggtgggatgtgttagtagactaaattactcgttaactgtggaaagacttgacttgctgtcagaggggatcccttccttgatgaacaatgaatgtttggatccatctgtcaacgaacttgctccttgagacattgttaatcatcacacccctatataagacaatattatctatatttgaccactatca

SEQ ID NO: 9794 - DNA, 1129 bp, Triticum aestivum
  unsure (1)..(1129): unsure at all n locations
  Clone ID: PAT_TA_9794
gcggccgtcccctgcctgcaaccgcaactcaaccagtcagtcgccattactcttgtttctcatcacccaccgcgagcgcgaagcaggaggagcagcaccatgcgcggctgccgtcccctgcctgcaactgcaacccaactcaaccagccagtcgccattactcttgtttctcatccgaccagtgaccaccgaccgcgagcgcgaagcaggaggagcggaggagcggcaccatgctggggcatctggccgggctggtgaaggtgcgggtgacgcgcggggtgaacctcgccatccgcgacctccgctccagcgacccctacgtcgtcgtccgcatgggcaagcagaagctcaagacgcgagtggtgaggaagagcatcaatccggagtggaacgacgagctgaccctctccgtcgaagatcccaccattcctgtcaaactgggacgtgttcgacaaggacacattcttcgacgacccgatgggcaacgcggagctggacatcggcccgctggtggaggccgcgacgatgaggatccagctgcagggcgtcgccgacggcaccgtggtgaagaagctggtgcccaaccggcagaactgcctcgccgaggagagcgccttatacctgtctgagggcacggtgaagcacgacgtggtgctcaggctgaggaacgtcgagtgcggggaggtcgagctccagctccagtggatcgacatcccaggctccaagggcgcatcaggcttttaattaactctctgtgcactctctgctttttgcagagttctttgtcaagtgaaaagctggggtaaattatgtttagaatcgaagcttaagctaggatttagatgttgcgatagtatgaccgccgtcagtgtggtcgaacttcctaagacggaccgaagaaacaaagaggtgatggcaggggcgtaaagtgtctcaggcttccaatccatcctccttgcttgcttgatgtgttctgcatctgcgatcgcgagaggaaaggctacaatgtgctgaacagtcttggcttttccgaaccttggttgccgatgctagtcagtcggtgacgggtgattaattgcagttgcagnatcgaagagtaggtctggtttctgaaaaaaaaaaaaaaaaa

SEQ ID NO: 9795 - DNA, 1066 bp, Triticum aestivum
  unsure (1)..(1066): unsure at all n locations
  Clone ID: PAT_TA_9795
ccacgcgtccgggatctggatctcaacctccgctctcctgagtcgcaagaagaattctcatcccgtcgacaaagtgtaagatcgatggggaacaatctgacgcgccgtcccgaacggatctttgatgatgggcgcggagaaggaatagggaccgttctgatcaatagcggctgcaagccaagcttgatttgccattgtaaattatcccgcaacgatattctgaagccgattatttggcagcacatggacgacaacgattctcatccccaaccaacccgccccgaagtattttcagatccatcaggcggctccccccgaaagttaaaccgcagcagacagatagcatcaaaagatccgtttggaatccttccagaggaattgttgtgcactatcctgtcaaaactggatctgaaagaggctgcaaagactagtattctgtctagtacatggaggcatacctggaaacattatcctaaactaaccttcgatattttgactatgtgcggtggtaaatacaagaccagggagcagcggcatatccagacgcccgaatgtgtggacagggtgcattatgtccagcaattcgtcaatattgtgaacacaatattgtaccagcaccagggcaagacaattgaacggtttgagctcagattgactgttgatgtgcttgcccaactatttgatcagcttgatgattgggttcgttatgcggtttcatcacggacaaagaatctaattcttcatgtgtcgctaacccctctcgacgtgttccattataaacggtatgtttttccagtgcaattgttggacgctggaagttgcctgcagcatattcagcttgcccatgtattgctcaaagtgccttctcagtttgtcggttttccaaatctgaggaggcttggtctatactccacacgtgtgtctgcaagtgatatgcaatgtatggtgtccaattgccctaatatagagtggttggatctgtttatggttcatctaaacgatgaactcaaagtggacaggccattgncctgcctgctataccttcgnntgagtgactgcagggtaa

SEQ ID NO: 9796 - DNA, 1257 bp, Triticum aestivum
  unsure (1)..(1257): unsure at all n locations
  Clone ID: PAT_TA_9796
cccgcctcgggggtggtcggccttggccggcccgtcttgctagtgccctttctacctctatgttgcaccctattgatacaatgaagacacgtgtccaagcatctacgctctcatttccagagctaattgcaaagcttccacaaattgggattcaaggactgtatcgaggttctatccctgcaattctcggacagttttcaagccatggtttgaggacaggaatttttgaagcaagtaagctcatattagtaagagtggctccaacacttccggagattcaggtgcaatcgttggcttccttctgcagcacaatcctgggaaccgcagtccgtattccttgtgaggttcttaagcaacggttgcaggctggaatcttcgacaatgtaggggaggccattgttggtaccatgcaaaaagatggcctaaagggtttcttccgtggcactggggccactctttgtcgtgaggttcctttctatgttgccggaatgtgtctttacggtgaagctaaaaaggcggcacagcatgtcttgagcagagagttggaaccatgggaaactatagcagttggagcattgtctggagggcttgcagcagttgtcaccactcccttcgacgtgatgaagacccggatgatgaccgccccaccaggcacgccagtctccatgcagttgatagtcttctccatcctccgaaacgaggggcccctcgggctcttcaagggtgcgatcccgcgcttcttctggatcgctcctctcggagcaatgaactttgcaggctacgagctcgccaagaaggccatgatcgaagctgagaaggagaccgccgactctttacaagagaagaagaacatggtgggttcgagaggatgacagacacgctaaacctgggtcgggttggctggttacctcctctatctatgatgtaaagagagaactggagacatgcaacagaagtttttgtgcccttgttgcaaaggaacaggacagatattacacacagccttcttaccaaatgatgttaggttgtatcctttcccctcttgaggaaaactttttttgattttccatctccataggcctttacaacactgtatgtatagtactctagacggcaggaactacaggagttggcatgctgctctttcttcctgcggagcttactttcacctgtgcttttcttgtcctgggctatgatttgtttncttgtttgaggnattaagnataaataaaaagnaagaaacaacaaaagatactg

SEQ ID NO: 9797 - DNA, 576 bp, Triticum aestivum
  Clone ID: PAT_TA_9797
tgcactggacaggtctctccacacccgcggctgcagtccacacccaaaccctagccgtcgcgtcggcagcttccaccggcgtggacgaccccgccgccgcagccaccgccgccgccacggaggttggtgcgcccgcatccccgcccccgccggccgccgaggaggccgatgcctcggcggaggcggaggccgtcccggaggcgaagaggtggcccgggtggcctggggacaacgtgttccggatggttgtgcccgtgctgaaggtcgggagcatcatcgggcggaagggcgagctcatcaagcgtctcgtggaggagaccaaggccagggtccgcgtcctcgagggccctgtcggcgccaccgagcgcattgttttggtgtctgcaaaagaagatccgggcttggagctgcctccagctgtggacgctctgattagagtttttaaacgtgtcaatggaataacagatggagctgctgaaggtacccagacagctgctgcacctggtgtatgtgctgcccggttggtggttcctggagctcaagcaattaacctcattgggaagcaaggtgcttcaa

SEQ ID NO: 9798 - DNA, 1569 bp, Triticum aestivum
  unsure (1)..(1569): unsure at all n locations
  Clone ID: PAT_TA_9798
ccccgcgtccggctgccccgtcatcaccttctacaagcgcattcaactcaactgagtcttcacatgaacctggcagcagtgcataccctcgtattgaatcgtcgtcacgtgtggccgatatgctgcaacagctaatagccatgcagaaggatatgcagaagcagctaggtactatcgttattgctcccattgcgaaggaaggcaaaagaattgaaacatcactaggccgtacaatggagaaatctatcaaggctagcattgatgccttgtgggcccgtttcctggaggagaacacaaaacgtgagaaggctgaaagggaacgaatgcagcaaatgaccactctcatcacaagctcaataaacaaggaccttcctgctatgttggataagttagtaaagaaagaagtttcttcacttggacctgttgttgcacgggcaatgacacctattattgagaagttcttaacctctatagttgctgatgcagttcagaaagcggtgggtgacaagatggtgaatcagctggacaaatctgttactgcaaaacgcaaagctacacttgctaggcaaatacatctgcagctccacactggtcctatcaagggcccgccagaggtcgaggcaccattagacccgatgaaggagctgggaagactgctagctgaacacaaatttgacgaggcttttacagtagcacttcaaagaagtgacgtgtcaattgtgtcttggttatgctctcaggttgatttgcgtggattatgtacaatggccccagtccctctgaaccagggagtcctcctagccctactccagcagctagcagttgatattggcaccgagacatcccggaaaattcagtggatgacagatgttgccatggcgatcaatccgacagaccaagtcatcgccatacatgtgaggcctatcttcgagcaagtctacgccaaattggctcaccaccggtcgctccccaccaccagtccattggataacagcaatcttcgcttgctcatgcatgtcatcaactcagttctgcttagctacaagtgattctagctggctgcagaaacagtgggggagtatgatggtctattctttctttgtatagagagaaaattttgaaaagcaagggaaacctagaaggacgatgaaaactgtcaccaagaaaaattgttaagggctgatgtgcccgccccctggtgtaaattaggcttgtatcggacttaaattggagtatttccatgtggactgtctacaagtctctttgttcttgagcacacagtcgtcctttgtagctccaagttttgatagtggtagcagccgcttgcagtggtgagtggctgttgctttcacccaaaaacataactgctggtgtttcaagctggctgcagaaacagtgggggagtatgatggtctatnctttctttgtanagagagaaaattttgaggaaacctagaaggacgatgaaaactgtnaccnagaaaaattgtnaagggtgatgtacccgccccnggtgtaaantaagctngantggagtnaaatggggnattncanggaacnggngagaag

SEQ ID NO: 9799 - DNA, 906 bp, Triticum aestivum
  Clone ID: PAT_TA_9799
tcgacccacgcgtccgaatggcttctttgctgtacacataccgtagctgtgttaaggcgctacctcagctgccagattcaatgaagcatagccaggcagatttgtacctagaaacatatcaagttcttgacttggaaatgagtcgtttacgtgaaattcagaggtggcaagcatctgctgcttcaaagttggcagctgatatgcagaggttttctaggcccgagagactggtcagcgcccccgctggcgctctgttggggcccaggccggcattgctcgtcgtccttcttcagcctggtcctcgtacgattgcctgtgcctgtccgcctcttgtgttctcttgctgcaagcggtcgtttgccctggtcagctcccggtggctgctcactctccctatgagtgtggacctgcttcatcttctgttcttgctgggcgcctgttgcgccttcgtccttgactggcacgctgccctggtcccgacgaatactgttgaggacattctacaggtccttatagtattctgtgtggagtcattggaattagactttgctcttcttttccctgagcgtcacaccctacttcgtgtcctcccagttttggttgttctagcaacctcatcggagaaagagagcgagtcactctataagagagtcaagataaaccgtcttctcaatatttttaagaatgatccagttattccagcatttccagatctgcatttatccccagctgcaatgttgaaggaattgtcatcatattttcaaaatttctccagtcaaattcgtcttctcactcttccagctccccatgaaattcctcctcgcgagctacaggaatatcctttctgcaaagtcttctaatcatgtttttgttgacggggcaggtggaggattcaacaaatgttgg

SEQ ID NO: 9800 - DNA, 1229 bp, Triticum aestivum
  unsure (1)..(1229): unsure at all n locations
  Clone ID: PAT_TA_9800
gnatgagtgtcctacagaattgaagcctcatccaaggnaaatagttagcaagtgcaaaggcttgcctcttgctattgtgtcagttggtagcctcttgcgtgtgcgtgagaaaaccgtggaagaatggagaagaataaatgaccaactaagctgggagataattaacaattcaaggctggatcacataaggaatgttttgcatctgagcttcatctacctcccaacatacttaaaaagttgttttctgtactgcagcttatttccagaagactatcattttagaaggaaacaacttgtacggttatggacagcagatgggctcatcggggagaggggtgaaagcacactagaagaagtggcagaagactgcctgaaggagttggttgacagaaacatgctacaacttgttgagaggaactcatttggtaggatgaagacattcagaatccgcgggctcgtacgtgagctggcagttgatttgtgccagaagaactgttttggtgctagttatgaggatcagtgtggggggtctcttgagatggatggacgtcggttggtgcttcacaaactaaagaaggatattcagcagccattttccaatatgcaccaacttcggactgtcattacactgggcggtagcaagtcatcatgcaccttactacctctgctatgcacggagtcaagatatatgacagtgctagaattaagtggtctacccatggagaagattccagatgctattggggatctttttaatctccgccatttgggtttgcggggttcaaaggtgaagatgctcccgaagactattgagaacctttcaaatctgttgacactcgacctttatgaatctgacatacatgagctgcccagtgggattgtgaaactgaagaagctcaggcacttatttgctctgatagcaattcatccaagatggagagagcttgctagttgcagtggtgtgcgtatccccaatggtcttggaaatctaacaaacctgcagacgctacaggcattggaagcacaggatgagtctcttaggcatttaggggagctgaggcaattgagaagcttgagggtatggaatgtgaagggaatctactgtggacgcatcagcgaatctctagtccagatgcagtatttgtccaacctatatgtgaatgcaagtgatgagaacgaggttctcttgctgaatgtctgcctgccaagcctgcaaaagctacttttga

SEQ ID NO: 9801 - DNA, 641 bp, Triticum aestivum
  Clone ID: PAT_TA_9801
gcctcgtcttgaggaccaatgacggttggtagtgacttaattcgaggcgctacgagggcataaatcatggtgaatatcagaaactgttggcggatatcgcaacgttgaaggcatgagcgtgaccacctggaggccagcgtgaggaggcagacaggagaagacctgccgtccggtgcaaccgcgggcagagctccgcagtctggagcacaagctagagtgcgcgctgggtaaagtccgtgaaacgaaggataaactgatggagaagcagctggatgaatcacaccacagggtgcacatcctggaggagcagaacagcttccttggccacatgattttgaaggtattgaagcacaacctttgtacccaacctgcaaaatgctagtataagattcttagataaggagggctccaggcgctcaaacaatttcaactacaagcagatattttgcctaaattcaagacaaaagaagatgttcaaagaagcgccaagacatttttgtatagcaagttatgtaataatagttgggttatctgggcattgtgaactccagaatttcatatatcttctctctgttttggaatgaaatgttgtatgttttagaattataatttttgtttcatataaatagtaattatgtatg

SEQ ID NO: 9802 - DNA, 1329 bp, Triticum aestivum
  Clone ID: PAT_TA_9802
agtaatcaactttcaaaattcaactattatgttgatattctctttctgatgcagatatgctatttcttctacaagaatgtgacttttggagtcaccatctttctgtatgaagcgtttgcatccttttcagggaagccagcttataatgattggttcttgtcactgtataatgtatttttcacctccctacctgtcattgcgttgggcgtatttgatcaggatgtttcttcccgtctatgtttacagtatccggagctataccaagaaggtgtgcagaatgtattattcagctggcgtcggatacttggctggatgtttaatggtgtcgtgaatgccatcttaatatttttcttctgcactaccgccctgaaggaccaagcatttcgtcaagatggccaagctgcgggcttggatgccctaggtgctaccatgtacacttgtgtcgtatgggtcgtcaactgccaaatggccctctcggtgaactacttcaccataatccagcacatattcatatggggtagcattactgtgtggtacatcttcctcatggtttatggtgctatagacccaaagtactccaagacagcatacatggtcttcattgaacagttggccccagcgctatcatattggttggtgacacttttcgtggtgacggccacactcgtcccgtacttctgctatgccgcaattcagatccgtttctttccaatgttccataacaagattcagtggaaaaggtacctggggaaggctgaagacccagaggtggcaaggcagctatcatcacggcaccggacatcgtcacaccaaaggatggttgggatctctgctcgtcgcgacggcaaggccatgcaagttaaaaagggaaccgacgtagaggttgaaggatgacattctctcagtagattttgtgttttgtacagattatagaatgtcatctcctgaaagatgacagaagatggactggctagaacttgtgaatattcttggattgttgcttctatggttccatgcagttcttccagttcagaggatagagctagatcacagaatttcgtagataggccacaagaagaacaagagaagacctgctgtaaagttcatgtagcaatttaaggctgtgtgtgtgtgtgtgtgtgtgttttcccccttctcttttgctcttacccctgtttatgctagtgctctgatggcagaattcactttgtttcaaggcttttgcgttttgccacgtaactgttgtccctctgttttactctaaaccaataatgctatggtttctatataatgaaatgattgcactgcatttcgcagaaaaaaaaaaaa

SEQ ID NO: 9803 - DNA, 667 bp, Triticum aestivum
  unsure (1)..(667): unsure at all n locations
  Clone ID: PAT_TA_9803
gacggcgcaacagnattattgtaacctaaccataccttctgtgtcattcacaaattcgcattaatggcgattgtggtgcggttgacatcactttagcacgcatttacaatgcagtggaagccacaatagatgtcctcatattgaaagtgcagaatggattcaatttatcgctcagttcgtttgtgcttgtcggcggatcagatcaggaaattccgctctttcgtggcactactgctgagtcatgtggcttaagaagatacgtgattgctgtaaagatggatacttggatgcagttgaagttcaaggtaagtcagaacggctctaaaaatgatcatcttgaacgcagttgctacttcaaagcaaacattcatggatgtgcctgtcaacaaatagtgcttcagcatgccgccctctctgtgaaggtgacttggtcgaccgtgccagcataaagtcatcgtgtttcaaattcgaatttaagttgcagtatttgatcttggacttggtctgtgtaattttcgttttttgagaaacagatatattttactctgcattggatggatgttttagttaatttttgtgtgctagaagtcagtattgtacgcaccttcactagttcagtgaaaagcaggcaatgtgttgtacatgttccctaagcatggcttatctt

SEQ ID NO: 9804 - DNA, 838 bp, Triticum aestivum
  unsure (1)..(838): unsure at all n locations
  Clone ID: PAT_TA_9804
tacaccgtgntncagtgggnaacccatacataaagnaagtcagggtggagaaaaatatcgtgcttctacaatatctcgtttgaaatcaaggaccactctattgaatttgatgacagccacaatgtcaaccgtgctgaatttcttgtcagggcatctatgcaaagtggcaggttctcagatggttggggttcatgtgatcggcgagaaaagagattcaacaagccaaaccatgatatccccagtacagctgaaaccagaagctaaaaacaaagcttgtcaggatcttcttggcatcggccacaaccgtccgggatgagcgaggcgttggtccaaggtctggctgagacactagcaactcttctgtcctggtgaactgaagactgtatatacactgtaagctgaagactgtaaacattgaggcacaagtgccttaacgcaggaccaaggatgataggacaccagatgtgagctcactcgttttcggatgcttcgagaaagcgcgatcgttgcgtcgctgactgtacattccccattagcagcgaagtttcagtggcagacatgagaatgtcaactgctacctcagccactgtggatctctgtagactctggattctattacgcgtgggagatcgcagccaggtggtggtcgcacatgggaagagtctggcttcacgttttggttgtcatgctgttcttgggcacggatgcacgatgcccggtgactcagatggtagggctgcgacgggtgtcgattgtttcagttgtttggatgcgtcccttcagagatgcagtgggtatatgatgcacatttcttctgtcattttttgtgtgtgagggg

SEQ ID NO: 9805 - DNA, 1256 bp, Triticum aestivum
  unsure (1)..(1256): unsure at all n locations
  Clone ID: PAT_TA_9805
tcgcccacgcgacgcgaccctccaggcgccgccacaaccctacctcccgccgggtcaacgccggcccgggggggaggagcgcggcgagaaggggtttcccgctcaaagaccgtgctggcgatggagctcaaattgaacactagccgccgaggaggctgacgacagcggcggcggcnctacctttgcctgcgacgtggtccgattagcggtgctcttgttcgcgtccgtttgcagcttcgaaacgttggaggagaagatgcgggcaatggccaatctgaggtaccgcgtgttgccgccacagttgctgctcaagtggcccaaggaagcatccttctgccagttgatgatgcaccctgtaccggacacccgacccaagatgagtgaggtgctacaaagtgagttccttaatcaatcaaggaatagtttggaagagcgcgaggcagctcttcggttacgtgaagagatagaagaacaagaactgctgctggattttcttctccagttgcagaaaagaaagcaggatatagcagacaatttgcaggacactgtcgcctttctctcttctgacatcaatgaggtactccaccggcagtcagccctcggtcagtgtggaaattcgcgtactgagttgggtaaagaggtgtcctctggaactgttgaagatcagagtgactgtggatccagaaagcgtttcagacctgaactgcacgctgttgatatggaggaacacagtcgtagtctggaagaatgttctagaacagtgccatcatctgtggtaattcaggaaagtgtgttgtcaaaaagctcaaggttaatgaagaacttcaaaaaactagaaacagcatattttctagcaagatccaagttggcaaggcaagttggcaatccactgagaagttgcgatcaggttgtcaagagaactactggttcagctgttggaactgaagggagttcaatagatgattttgctttagaagggcattctggtagaagacaaggaggttggatgaactcttttcttgaaggattgtgcaggctttgaccgggataatgagtttttcgcaactgctggtgtaaataagaagataaaagtctttgaatataatatgatcgtaaatgaacaccgtgacattcactatcctgtggttgagatgtctaataaatcaaaattaagttgtattagctggaacagttacatgaagagccatatagcatctagtgactttgatggtctcgtacaggtttgggacgttact

SEQ ID NO: 9806 - DNA, 1069 bp, Triticum aestivum
  unsure (1)..(1069): unsure at all n locations
  Clone ID: PAT_TA_9806
tcgcggccgcgtcgacattggatggccggagaggaagccatatctaaattcaattgggcagtacaacttccacaggtggttggatgcaggcagcgaccagccaaggtcatatggtcgacgagcaatgaccacagtgatcaaaagcttggtgagtttggttggtgtcaaagaggataaaatgttgttctggatgagcaggttgttagacaccgagcacgtggaggcagataaggatacgatggagtgtcggctcgagggaattactgacttcgatgctgagatcaacagnagatccccggcattggccaaaacttggcggcatagtgcaagagctacaagacattcgtgaagattttggtggaaaggttgccttagtgcattttatcacagaggcacacttgagaaaatatcctcttcatcctccttcggacatggagacagacacaggtacgagctgcattgtcttggtggaagtatgtcggaaactatccaactacatggcataccttttggtcacccaccccttcgatgctgccgctcaatgacagcgccttatatacgctggagaaaatggcacacttgtttccacatcttatagatgagcagcaggattctgaaggtttcttcaacatcgagccaagcatggaaacactgcaggagttggtagacatatggacgaagctgctcatctatgcggccaccaagtcccggccggagctgcacgcggcgcacttggctagaggaggggagcttatcaccttcgcctggctgttcttgagccacaactttttgggagattccgaggtgatcaaggtgcagcttaccaatgccaatcaaagagggacgatagcatacgtcttcggaaatcctgcaccaagataagagcatcagatccaacacaagccctgcagagtgcagactcctccgttcttcattcgatttgattttattcctcttctgtttgcgtctggagtatcncncgacacaaaacagtactgaagtttatacagnatcgcagctgacatctagaggtatgtgacatttttttttttgccagtaatggcatcac

SEQ ID NO: 9807 - DNA, 579 bp, Triticum aestivum
  unsure (1)..(579): unsure at all n locations
  Clone ID: PAT_TA_9807
ggggcgatcagctcggcggggatctccaacacccacgtacgcagggtgggtgaccatgggctagcaatcaatcagccagcctcatatcctcctggccatattgcgctaagcagtactggcgctaaggtgtggcatctgatagtaggacatctgaggaaaaagatgccttgttcagggggttgatgcccaggaaaccgagatcgccaatgaaactggaaccaggctgatcggtacggtggtttcggaccatccatcctgggctgaagccggtgctgatgctgagcatggtggccgtgcttctctgagctacctgatgaagaatcgacaaaggagtgatgaaatccatgtcgtctcggactgggagaagctcgaagattgatgctgctagcttgtctgtcttggctagtgttgctttacatgttgctttctgctccatggagtttgtaacgaacttaattgttttacttttgcgttgcgttccttgcccctctggctcggggggagagatacgtgctgtgaaagctaattccaaatagctgtttcgatgtgctgtagatcatgtngcanacaaaaaaaaaa

SEQ ID NO: 9808 - DNA, 449 bp, Triticum aestivum
  Clone ID: PAT_TA_9808
gctgggctcctctgccggcacgagtggaggcccaagtcgtacgtgaccctctcggccgagtacgaccccaaggtggtgagctcgccgtcaaggttcggcgtggccgtggccctcagcccctgatcacccgccggcccgcatcctctccctgtacaacagcgccagcattaagcacgccgctccgctcgtatatgtcggagccataactcgccgatgattctttttggtctctttttttttgggtgacaacggtattggtattggcccacggaaaccttgtctaggagttgggctcatttttgcgggatttctccgattagcctgccggccggcgaagtaagggggccgggaactggaaatatacagaggttttgtatcaggcatgcgcttttggccaccccacccgatgaaattctgacttggtgctcgggtttgctcgaaaaaaaaaa

SEQ ID NO: 9809 - DNA, 743 bp, Triticum aestivum
  Clone ID: PAT_TA_9809
gacagcacctgatggagaaagtaaaacattggcagccagtggtggggcagcgccgccggaccgtctctgctccgccgggttcgctcctggcccacggtcgcgtctgggatcacctcctgttgagagccatgggtactctgcccggctctgcactgcgcgcgcgcgccgggaggctgacaggtggcgccgccggtcctgtgtgaaccgctcctgcatgcctggctcggaggcagcggccgttggagtttggactgcattgccgcccgggggtggtggtgccgcatctcctccgccccgctccgccgggttctccccaacccctcgagcgcttctgtcacccgcgtctggtcagatgtacgggaaataaaatcatctctggacagcatgcacaggccaaaaggaaaataaaatgtgctgccgaacttgtatgaacctgtgcttcttccaggcttaagactggatggccattgtattttgactgcatttccgcagaaggtgattgttccatagattggtgggggttaaggaaagcttcacattgtcggatattgcgccctggctgaattctcaactgtaattttgttggtggggacgcccaagatactgtaattttgtacccacttagcgacaatgtacaggtgtagactagtgcgtaccattaccaaaacagtcgctgcgtgcagtgttctattgtttgaccgcggaaataaatttatgatggagaacagcttaaaaaaaaaaaa

SEQ ID NO: 9810 - DNA, 807 bp, Triticum aestivum
  unsure (1)..(807): unsure at all n locations
  Clone ID: PAT_TA_9810
cagtggnggcagcacgatttcttgtagatccagcaggcaagnagctcttctgcgagatattgtttgatatcggcagtcgatttgcactgtgattacttgagtaacaacaacagaggtccgttcaataattgctttgaagtcctacagcatgattggacggccagtgtgcagaaaatcccaccaatgaagaaagtcctaactcataagatctgggacattgcaaatcagaactatgttatcttcgccttccatcctcgtcttactcgacatgcatggaagtttggaaggaactgggtaacacactctcacgctggggagctcttgtcgaaatgcaccaaaactttgctctgcgactacaccgacccagccccgcctgaaggtctggatgacaaccaaacaaagatgaaggaaatactgtatatgcagtgattgtcagggggctcaggcgtctcaggcgaacagaatgtctgaagagcgttgctacacgacagtctgtacgtgccatttttgcagggcagtctgtacgcgccattgataaatgctggtgcatggtggattgcttggttgttctcgcgtcggctgggaatgtgccgtgtgtaaagtgattttgatgtctgaaatatgtagagactagggagagtgtctgtaatgctatcaattctgcagagtactgggcagagtttgccacgactttaaaaccatttagttctagtccatcgacagtacagttaagacttcagtcaatggccaatggtctgtaatgctatcaattctggtgctcatttgggcacgtttatatccattcat

SEQ ID NO: 9811 - DNA, 848 bp, Triticum aestivum
  unsure (1)..(848): unsure at all n locations
  Clone ID: PAT_TA_9811
gcggcgagggtcgagnagaggcggacggcggaggacgggttcatatggaggaagtacgggcagaaggagatccacaacaacaagcacccgaggctctacttcaggtgcacctacaagcacgacatcggctgcccggcgacgaggcaggtccagcaggcgtaggacgaccccctccctctacgtcatcacctacttcggcgaccacacctgctgccagggcgacgccgctggcgccgtcctggaggccgaggacgtcaagatgcagccgttcgtcatcaacttcgggtcggccaccgcgagcagcggctcgccgtggctctcctcgcccagcgacaccgacgatggccggaggaccgacagcggggcctcacactcgtcgcaggccgtgtgctcgtcagaggaattcgaagtgaaagaggccaaagttgagtcaacgtcggaggactcacagacggtggatccggcggcggcggacctgagttcgtcggccgacttctcatgtgcatcgccggcatgggatcctctgtccggctgcttggactgggaccacttcggcgacagcccattcgattgcgagttcatggattttgacgccattcctctgttccaatagcttagtgtttttgttttcgggtgttccaatagcttagttgctgttctggttctctcagagcagatgtttttgtgaaatacgtatgtgtttctatctatatttgtcgtagcacccggtgatgaacaacatgagattgagtgtttgcacaatcatttgatgtactccttttttttttcaaaaagtgggtctccccggcctctgcatcagaacgatgcatacgaccaacttaataaaa

SEQ ID NO: 9812 - DNA, 738 bp, Triticum aestivum
  unsure (1)..(738): unsure at all n locations
  Clone ID: PAT_TA_9812
attcggcacgagggcctactctagtcccagatccggtggccctgcctagagtcgcctgcccggattgcgggaggatagtggtgacgttcgtggcgaggcgtggtcaattcgcgggggagcatttctacaagtgccgcaatcacaatccgggcagagatggttgcgacttccaccggtggcaagaagcatacgcggaacatctggcttcgcttggaccggcggcacctccattggcacaaatcaatgcagacgagaacgaaattgggggagcaaatcaaggtggtcatctgcaggcggcggatggcgaggccggaaaccagggcggaggatcggatgggtcgcagatgtcggctgcaggcggtgctggaggatctgtgcttgatgcggcggcaagcggcgctggaggatatgtgcttggtgcggcggtggttggcccggcgtccggctactgtcgcactggaccccgcatctatcaatctggttgtttctgtgggaaacatggtcatttgcatcgccatccttgtactggttgcagcttcaagcatgatgcgtgtgtttgattagcgattaggtgtgctaatcttagctgggtatgggtgcccagtagaaggctttataattagcggtagcggagttgcgtgtcaggtctatgtttatggcttggtcagtttttgggtgtgtgttcgggtggcttgatcagctttaggttgtatgttcggctngacaggccagtattaa

SEQ ID NO: 9813 - DNA, 733 bp, Triticum aestivum
  unsure (1)..(733): unsure at all n locations
  Clone ID: PAT_TA_9813
atggtgctgggnaaatggaccatggtgaagagtcactacttctcatcgtcagttcgagacccaacacattctcaaggacaaatggaggaaccttttgagagcttgtggggtcatgtgcgcctccaaaaggaaggtcatattaattatgttgtattctctacgtagttactccatgacaaattccaagtatattgcattatcaatttatcatacatgtattgattttgtcttcgcaaaaaaaaaacatgcattgaatttgatgcaggaaaaggcacaaaagactatgttcctgcccctagatacaaacttgatcgaacagatccaagggttagctattgattcagccttcgcatccaaaatgaagaaatgccatgggaaaggaacaatccgtctggaaatgataacgaaatgatggtcaaggctttataagtttacataggttaacctagcaacctctaaatgtgttaattcttttgaaattgggaagcatatgcatatattatgtaagaaaaggcagagaatcatgtgcaactggccctgcctttgtccttgcatatataccgtaggtagaaattatgtattgtaaaaaaaatgtgtggtcggtgctctagccgattccaagcttcttgcttcttcttagttttccttctccttgatgtaaacgttacacgatcaacttgttaatgcattcttactaagaaaactagaagacacctcgcgtgttgcggcggga

SEQ ID NO: 9814 - DNA, 1059 bp, Triticum aestivum
  Clone ID: PAT_TA_9814
gccgccgatgcctcctccttggcgacggcgacggcggcgcccgcgaccgcggtcttctccaccacccaccatggctgcagctccacccacggccggtcgtctatgctgcaagcgtggatggatggatccttcctaggtggaggtggagcaggctgcagatcccgtctggccctctgcagcgggccatcggatgtcgcgccaccgggctatttgtggggatcacgtcgtcaccaagcacgagctcccgccccatccgccggaccgcaaagggcttcagggaggagacggtggaaacaaaactgccctcccctcctctcctcctcctcaagcatggtggatgaagacctcctctcctctcctctccagctctgaggatgacgagctgcttcctactccgctcatagccaaccagccgtcgccgtcaagatgttgcctgcgcgctctcatgtccagcgtcaccgccatcatcatgatgcagaacagggggcacaagatcgacaacatctgtcccatggaccagatgctcaggttgctagggcggctctgattcatggtgcggtcactctccggccagcaccgttggcagtcaacaaccacatgattttttctctccaaggcaccgttgtattccgcgagcgcgaggtcatcgtccagctcttttccatggaggtagaacctttggcactccgtcgggacaccctcggcctcctgcaggcgctccttgatcctgccggcccactgtgttcgtaacctcaatatagagctcgaccgtccttgttctcctgttggcgggccggcagatgaagttcagcgtggagtcgttccggacgccgtagtcggcgtctcggcgagagtgtggccatccttcagctgcttaccggcgtggatgaggcgctgctgcacgggaggacagcccacccgctcttggacccttgcccggaagctctcgacggtgtcactgcttgcgatgtctcacggttgtatacgcggctaaaccgctaaattagcgctgccaaaatcactttccctagattatcctaggcgtcgatgtattatttg

SEQ ID NO: 9815 - DNA, 1094 bp, Triticum aestivum
  Clone ID: PAT_TA_9815
ccgccccggcgtgcgcctgcaggatttgcatcaaactgcgaattctgaggttgacacaatgatgttgactgatgcacctcttctctatactcctggacagttggctttggctgctctgtacaagtccaacagtgcactcagtgtcctcgattttgaaagatacttggaaagtgttttttcaaggcaacactttgattgtcctgtcgaacaatttattcagataatcagttcaatcaatcacctggttagccagcttcaactacctggtacgaaagaaatgaggcatgctgatcgcaagctgaagcattgtttggatccaagctcaagctctcatgatgaccacaagaagaaagaaaagaagtcaaagcacaaatcgaaaaggactgccagtgatgcccagctcaacagctagaaatcgtgcagttggacagctgtgctgtgtaagaaatcgtgcagttggtggcaaggacttgtactgtgctaggcgcgttagctgctttatcatgcaaccaagttctactcaagctcttcgattgatgcgatttcaattccgactttatccagccatcggatcagtgatgctgagcggatctcctcaccagcctaagtcttggctaaggacagacagttttcggatgaggcgccttactgtaaccttgcacgtcctgcgccagcgagtgctctgcgctctgatcctcaaggactgccagtgatgcccagctcaacagctaggaaatcgtgcggttgggcagccatgccgtgtaggaactagctctggaaagtgtggtggctctccggttgatgaggtttcgattccaactttctccagccatcagattggtgatgctcagctgatctcctcaccagcccaagtcttggccaaggacaggcagttttcagatgaggcgtcctttaggcccttgcacgtcctgcgccagcgagtgctgtgcattttgtaactcaataataattttattagagcggcttaaatcttgggcgcgaggggagagaaacttcgagatgtaaaccattggatgctattttgttgtaactttattttattagagtgacatagcataactccaaaaaaaaaa

SEQ ID NO: 9816 - DNA, 1045 bp, Triticum aestivum
  unsure (1)..(1045): unsure at all n locations
  Clone ID: PAT_TA_9816
agcgcaagcctctgatgtttgtgatggtgacgaagctcgaggttcttcacttctttgtgagcatgttcctgttatggagaagaaacttgcttctgctgctcctcgggaattgatggcttcttctgctgtcgggaatgagatcagaaaagaatctactactgccctggttgaacaaattgagaggcaaatgtcttgcacccagattggacgaaatacagatatggaagtggatgtcagcctgcaaaaccctgcagtgtcacaagtccaggatggtccagataaagaagaaagtgagggggtgcgattgggttccaagacatcaaagctgctgctggtacatgctgaccaacagcctggaatggaggaccggctagtagtctcttcaaaaccaaggaaaggagatgtgagcagttcttgccctaagacaggttccatgtctgcagaatctgatgtgagccaggacagcaacagagaacaagataagatggtggcaagaaaacatgctgaagataaacctggtgctggaggacacactgcaccctcacataatgatgttgccaccacagactacgagaaacactgcgttttcgctagtgaagtcaaagataagctgagtgatatacagaaatgctggttgcaaagtactgtcaaccacgaggtgcctgaaataccgctttatgtttgtaaaatgaaacaaggtctgctaagccaaatgtatttcagtgtcccatatacgagagatcatttcagcaagcatattcgtgggagtagtggggaaatgaaaatcagcgctactaatggtggaaactcagcgcgcatgaaatttaatatctctgtaagtaagagtcatagaagattaaccttcggagaaaaagaatggaaagtcttcgtgagcgccaacaggatggaagagggtgctttgtgcgccttcagttttaaagttgagagtgggaagccttcggtaagtgtgtcttatcatgagtgaccagcatcaatgatatgtgcaattggttcccattnccgtnaagtncttaaaaggatcccc

SEQ ID NO: 9817 - DNA, 876 bp, Triticum aestivum
  Clone ID: PAT_TA_9817
tgatcgagcaggttgacaaccaccggagaggacaacatgctggaattgttcaggtgatactaggccatccaagttgtaaaccacaactgggatcgccggcgagcgccgacaatccactcgaacttcagcaacgttgacacgaggctccccatgctcgtatacatgtcccgggagaagcgacccggttataaccaccaaaagaaggcaggcgccatgaacgtgatgctccgtgtctcggcgttgctctccaacgcgcccttcgtcgtccactttgacggccaccactacatcaacaactcgcaagctctccatgcccctatgtgcttcatgctcgacccccgcgccgggcagaacacggccttcgtccagttcccgcagcgcttcgacgacgtccacccgacggaccgctacgcctaccacaaccgtgtcttcttcgacggcaccatgctctccctcaacggcctccgggggccttcctacctcggcaccggcaccatgttccgccgtgtcgcgctctatggcatggagccaccacgttacagagcggagaacatcaagcttgcaggtaaggtcaatgagttcggtagctcgacgtcgttcataaactcgatgccggatggggcaatccaggagcggtctatcacgcccgtgttggtcgacgaggcactcagcaatgacctggctaccctgatgacgtgcgcctacgaggacgggagttcatggggcagagacgtcgggtgggtgtacaacatcgcgacggaggacgtggtgaccggatttcgcatgcaccggcaagggtggcgctccatgtattgctccatggagccggccgccttccgcggaacggctcccatcaacctcaccgagcgcctctac

SEQ ID NO: 9818 - DNA, 975 bp, Triticum aestivum
  unsure (1)..(975): unsure at all n locations
  Clone ID: PAT_TA_9818
cggcacgaggattnaattgcataattagtatgagatattcacatatatagggaatgatcggatccatctgaagtagaagacttttggtagtaactgccttctctgtatgttagttttaaaaatgctgaaagatagctatcataaacgtggaacttgtggggactatattgaagtgttaaataactaatattattgtatgccaattctgtcatttgtgcctaatttaggtctgctgtaagtggcactaattaagcctgaaggacttgaagatgattcacttcaggtttgagcaagcagcagcagtggtgttcttagctagttatttagttatgtgtgtgaactttgtatcgtacctccacttttttcaagaatcgtattataacttgtctattctgttgtgttcgatgtgttagtcaccttgactagccgaaactactaaaatgacatttatgcactttcataataaatagtggaaattaattttcatatgtccctactaaacatgttgaccttgtattgtaaatccctgagttgcttacctgccttttttattggaaagggctggctttaatgctcgatcatctgtactaataccctgttactttaatcatggatattgttgaaccattaaattatggtctctgcttatttctctcttggagaatatattatatgtgttgcaactcttgcatttggacctcttgctttgtcatgccaataatgtttgaatccggtatttttaacaatatgggctgggagcttttgttaatctctagtcaagaatgaaataatctatccgtaagtatttcttttggaattagataatgttgttaaggatgtatagttttgtgaagtttgaactggatttatgtcatctcttgtaagacttattatttaattgcataattcagttattccaatatgacatcttgttggatgattggatccaccnaattaggagactttggtaagcaa

SEQ ID NO: 9819 - DNA, 1107 bp, Triticum aestivum
  unsure (1)..(1107): unsure at all n locations
  Clone ID: PAT_TA_9819
cataataggacaaggggnacttaaacatttgaaagttgggaaatctggagttgcaagttgtgaggtgagggacacaagtaaatacaacttgcgacatgttgtgaaaactgaccaaagcgagtgcacgtgcttggagtggcagcagacagggaagccttgtgagcatgcacttgctttcttgctagatagaaggaaccccagatgggaggattatgtgcatgactatttctctctggagaagtttcgggcagcatatgctggagaggttgagccattgacagataggtctcaatggccacatgtacaatttccatttgacatggaggctccattagacaagaaaagaggtgttggaaggcctagaaagaacaggtacaagagcttcctcgaaggtggagatggtggtcctaaaaagaagaaagagccaaaacagctaggcagcaagaatagatgcaaaagatgccacattttaggccataggcagtccacgtgtccgttgaatggaccaaagccaaggaaaataaagaagagagcaccaagatatccagctgatgatgatgccgtcggcaccggaacctgaattgacatcccaacaacctgaagttgtcactcccaataggcacatgatcactatgccacaaagtcttcaaggcagtcccaatccagtgacaagaagcatgttggcttcggggtggctgattaggcaacacatgcagcaccacaacttgatgtggccgtcactccaacaaggcacatgatcactatgccacagagtctccaaggaagtcccaatccagtgacaagaaggatgttggccatggcattggctgatgaggcgtcgcagaaacctacccctaccatggaggacaccatgatagcatacgacatggcctcaagctcaaaagctagaaagttgaccccgaagagaaggaagtactagtgatgtgcttggtcttctctatacttttggttgtaatatgacagacttagcatccttcactttggatgtaacatggcagcatggcagcttctttatgcttttggttgtaacatggccagttactatggccttgtgctttggttgaaaaacaggcagtaagaatatat

SEQ ID NO: 9820 - DNA, 1037 bp, Triticum aestivum
  Clone ID: PAT_TA_9820
tatggtttctcattgggaggttttgggatgccaggggcaaaagaacacccctcttccgcctatgcctggaccaaccaaagctgggtttggtgtggttgtccttgacgggaagctcatcgtcattgctggctatgctgctgaccatggcaaggaatgtgtttctgatgaggtttaccagtatgattgtttcctcagcaggtggaccgccctttctaagatgaatgtcgctcgttgcgacttcgcgtgtgcagaggtcaacggtgtgatatatgttgctggtggatttggtcccagtggtgatagtttatcaagtgtcgaagtttatgacccagaacaaaataaatggacgttgatcgggggccttcgcaggccgagatggggttgctttgggtgtagctttgaaggcaagatgtacgtcatgggtggccgttcgagcttcacaattggtaactcccgtttcattgacgtgtacgatacaaatagccatgcctggggtgaatttaggaatggctgtgtgatggtcacggctcatgctgttcttggtgagaagctcttctgcatcgagtggaagaaaccagaggtctctggcgattttcgacccagcagacaattcctggcagaaggtcccagtgccgcttactggtagttccagcacgcgtttttctctcgggacacatgatgggaagctgctgctcttctcactggaggaagaacccgggtatcagacgctgatgtatgatcctgccgcgccaaaaggctctgaatggtgcacgtctaagctcaggccatcgggattatgcttgtgcactgtgaccatcaaagcctgacgctctagctcgggggtcactgtaggatgatacctaagtttactacctgcctcatcttccgcagttaagatcaggctttgtttggtttatcatcctacttgctagggtttatatctgcttgttgctccacccaataatagaatgttcatgcttcagttcattcggttgcttgctgacagcgaaccttgccataatgtctctgttctcagt

SEQ ID NO: 9821 - DNA, 616 bp, Triticum aestivum
  unsure (1)..(616): unsure at all n locations
  Clone ID: PAT_TA_9821
agatcgccatggnaccgcctcagcgcgaagctccgcgacagcctcctctccgaggtcgacatcctccgccgcatcacgcatcccaacatcatcgcgctccacgactccatcagggatggtgggaggatatatctcatattggagtattgtcgaggtggtgacttatacgcctatcttctacggcataaaagggttcctgaaagtgttgctaagcattttattcggcagctagcatgtggtctcgtccggcttcgtgaaagcaacgtggttcatcgggatcttaaaccacagaacattcttcttgtttcaaataatggaacttccatattgaagattgctgacttcggatttgcaaaatttttgcaaccttctggtctagctgaaacactttgtggttcacccctttacatggctccagaagtcatgcaagctcagaagtatgatgcaaaggcagatctttggagcgttggtattattctatatcaacttgttactggatctccaccttttaacggggatagtcaaatccagttgatgaaaaacatactaaagtcaggtcaattacgatttccatctgattgtgagttgagccatgattgcattgacttgtgcagaa

SEQ ID NO: 9822 - DNA, 553 bp, Triticum aestivum
  Clone ID: PAT_TA_9822
tccgcgccagaccgccgtcgtcttagttctccaggatccaacaccaagctcgcgacgaagggcttggagctggcggcgagaaggtgctcgaggtcgcctccttctccacagccgcgccccgggatgggagcctccgcatgctcctgctctggcgatgacgcatccattcttccacttgaccactccatcccctgctacttgtgtgccgcctcggatctccatctcgatctgtgatgtgctcgctggtgccgttgaagccggatcccgtgcttctcaaatcggcgggtcttctctccctcccttctttctccaatctccatcccctacccgttggtaattctagacgatgatgcatacttcatgtaaatccaatgttgtttgttcggatagtaatgcacaaagttcggcgtatgctgttctcggttcagtgctaacagatcctgtaatgtctcaatttcatttatcctatcatcatttgggtctagcaaatttatgttcatgcctacatctatagtagccccttcagagttgtaacttataatgtaaactgtta

SEQ ID NO: 9823 - DNA, 827 bp, Triticum aestivum
  Clone ID: PAT_TA_9823
gcagtggggtattgtccggacatcagataaaccggacttactcaaagtataaatttcttcaaacttgcatcaaagttatgccttgttgatttgcccggatatggttttgcttatgcaaaggatgaagttaaagaatcatggcaggagcttgtgaaggagtatgttttaaacagggttggtctggatagagtgtgccttcttgtgcacactaaacgtggaatgaaaccattggactacgagcttatagatctaatggaaagatacaagacaccgtaccagattgtattaaccaagaccgatttggttttccctatagacgtcgctcgccgtgccatggaaatccaagagagcctgaagaagaacaagtcggtcgtaaagcctgtgatgatggtgagctccaagacgggagccggcatacgcaacctgagaggcgtgcttgggaagttagctcgcttcatcaaaccatagggaggcgataacttgtcgcagagcgcgtgtgattcaggagagataagtggctaagcaattcggcttttaggccttgaggtccttccttgtcaggataggatacgatgccattttgtatctaagatttggattaccgaaccatttttctgtctgatggaggagagattctatcatttagaggctactactagaaggatactgtgaggttcactgcgctgggttttttgtttttatggcgaagtgtattggcctcgtagtcgtagtactagcaaaaaccatgtcataataaacctagtaccacacgattgaggaggatagcgagtacacaaatttaaaaatgggcgggtgcagaacagaag

SEQ ID NO: 9824 - DNA, 912 bp, Triticum aestivum
  unsure (1)..(912): unsure at all n locations
  Clone ID: PAT_TA_9824
cggcacgngggtttactnctcggctccacttgcgaggttttattacaagatggcaagtctgagcgtctgactgttagagctggtccaaatactacatctgttcaggatgctttgacagaatacagagtgattgaatcttgcccccgagggttcacttggttggaactatttcctctcaccggaagaaagcatcagctccgagtccactgtgcagaggttctcggaacgccgatcgtaggggactacaagtacgggcgtcaagcgcaccaggactggacgcctctccccgtgccgcaaaccgtcgacgaggaactgctcaggaagcaaaggcttccctttggtcttgtcctgggcggcgggagcgtcgcggaggagcagcctcagctgcatctgcactgcaagcagatgatgctccctgatatctcagctgccgtccaagggttgcagtctgaagacgccgagcgtgacttctcgggtctcgagaagctcagcttcgttgctccattgccgctgcacatgcggctgagctgggaggttttgaagtccgttgacaagtaatcgaagagtggcgtccttagtgtctgttctctacgccgaccgactgtgatacggatgatgtgttgctcaagtctacagccacagaagcttcaccaaaagatctcattttagtactatagcacagtgacagcggttccttttttccttttgttagggaattcactatccaccacattttcattttttgcttggagccttaacgctcaagggatgtacttctaatggttacattgttttcaatcggcatcatagaatacactagctcagctaagtatgaagcaatcattgaatatctccacatctcatcagccaagtatgaaattgtagacacagtnaccaataacaggtcaaaat

SEQ ID NO: 9825 - DNA, 1048 bp, Triticum aestivum
  Clone ID: PAT_TA_9825
attctgtggagttccctgaactggagactgtagatgaacagaaagaggagaaggccgcggtggcaacacgcggctggaagaggaagaaggctgagtcctctgaaccggagaagggagatgaggggaaggaggaggaggctgtggtggtgacatgccgtgaagggagggaggttgcaacggcggttgctcctccgccgctgcctccaaagccaacgtccagaagggtccagggaagggtcacaagggctcgtgcaaggaaggctgttcttgaggaggaggaggtggctgcaccaagagagaaggagaagagtgaggtggctgctggggatgaagaagtggaagggacttcaaatgcattggaggaagtgcctgttgctcagagggggctggcacgtagagtgccaaaagggatgacagataccgagtgctttgcttctgacaacggggataaggagataaatgaaggtggaggagaggaggagaatggaaagatgaaagcagttaacagcggaggagagttagaggatgatgagaagggtgagaagcatactgggagaagcagcctggatactattacattgcaggagtggttcgagcggatggacaggtacgttccatggacgatcaatgaggctgctgatgagatgatagcgacactggaggagaaacatcggcgcatcaatgagtacatttcagtgctcgggaatagttgcaatccttctcgagattcatgtgtagtcaggaatgatggtcggtctaccgtagggtgatgcctggaaataacattggggacaatatttagttgcaggttttgcaaacagtagggtttgaggtattaccaccattcactggtgatgattactgaaattattcattccagcagccacaccagaagtgcctgagaaatgttttcgttcctgtttgatagtattgcactggccatgcggtgacatattatactagtagtagtaggctaaagcattaaaatggaactctgtaattgatgatgcatcctgtaggttcacttctgataagattactactatgt

SEQ ID NO: 9826 - DNA, 1016 bp, Triticum aestivum
  Clone ID: PAT_TA_9826
ccccctgcgcggtgttcctgggctccctcctcctggcgcctcgtccgatgttgctcctttgttccctcctctccgtggcttcccggacctccctcgtgtgcacgtgccgcccagacgtagtggtgacaaggcttatgctctgtgctttgtggagttcagtgacgcaaaatgtgcagggactgctatggaggctctccaagaataccgcttcgacgagaggaagctcgacggcccattccttaagatccagttcgcaaggttcccgttccgacctccgccagcccatgaagatcggaaacgccttagcgctcgctgatcgccgtcatctatatatctcccccctttgccagcagtgtatcgtaggcagtgggccattgtagatcagctatgtttgttcagcctgtagtagcaacctgtcacgggcctttgtcagctggagattggctagctagacagacttgcctggtacccacctgcctgccctggcacattcgccgtgttcccgcgtcccctttttcgcgggtggatatgctagaaatgatatgacattcggcgtgttcccgcgtaataacgcaaaaggtgcagggactgctatgggaggctctccaacgaataccgcttcgacgagaggaaggccgacggcccattcctcaagattcagttcgcaaggttcccgttccgacctccgccatcccatgaagatcgcaaacgccctagtgctcgctgatctccgtcatcctataatatccccccctttgccagcagtgtattgtaggaagtgggccattgtagataagctatgtttgttgagcctgtagtagcaacctgtgatgggccgttgtgcgccggggatccgccagatggcccgactcctctgacccccggccccctcccttggcactttccccgggttcccgatccacgttccttgcgggtgggatatgctggaaatgatatggatccccgtgttcccgcgtcacatttttgcgggtgggatatgctagaaaaaaaaaaaa

SEQ ID NO: 9827 - DNA, 663 bp, Triticum aestivum
  unsure (1)..(663): unsure at all n locations
  Clone ID: PAT_TA_9827
tatctatgatnctattttctaaccatctaagactgtagtcatatatactccatacagtaaaaatatatgttgttgtcagtttgctgattatttatctctcccagcttgtttttatgtctggtcagattggaaatgtagctttatgggcatgcatgagattcatattataataaagtttgccttcatactataaatccattcattggagctatatatcatatacagtaccatttaggctggttcatgagtaaaatgttgtttttaataaatttaagggtggtccttggttgctttttggttgcttgcccttatgccgattgtaagaaaccaaagtatagttcatattttaaatcatttatgtccatatcgtctgatgctaatgtatgaactttatatggtttggtctaaacgatatcaataaaagaatatacattgtggaaattaaataaatcctacaaatcgaattaggaaactattgttactggcattcgacgaggaaaaggagaccccggaggaagttactgcgtcgctgtggtggctcgatcgatgcggattttgatgttcattgttttgatctcgacatggattgggtagtggagaattggtactggggatagagaaattgttatttgtgttgctgattttttatttgggcatggatgt

SEQ ID NO: 9828 - DNA, 641 bp, Triticum aestivum
  Clone ID: PAT_TA_9828
cctcccttcccctcgcctctgcacccccctgagcactaccgagccgctgggatctgcctcccctgcggcgatttgaggccaccgacgagagcgggtttttttttctggttggttgggcgagcgggtggtatgtggatctcgcacccactgtccgacgagttctacggagggccccgcagagctggggtgggtagcacgctgctgctgtcgctggagcggacgcccccgtcctcgccaccgccgcccgcgtcctgctccttgcctgaggacggcgatgacttcctccagcacgaggtgtcccgcatggacacactcgccagcatcgccatctagtacggcgtcgatatcgggaccagggcgacgtcttcacgacttacatttaagagtagggaagggccacggtgagaggaaggagtaacgaggtcaaatctgagatggggtcatcggcgtgttcaagaagccgcggggacagcggcccatcgcggtggggtggacctgtagcgaagatggaggaggccagcaagagtggatgaaaaactgctaatatggtactccaaagagagggaataaagtctgagcttgagttctgtgtcgagtgtggttcttggacagcaaacgacaaaccttctgtgcttgcattg

SEQ ID NO: 9829 - DNA, 589 bp, Triticum aestivum
  unsure (1)..(589): unsure at all n locations
  Clone ID: PAT_TA_9829
ctcgctttcccttccggncacgatccatccatcccatcccaaaggaacagggagctgctgctgctgcatcttccgtggtcccggttctagggactaagcaagtacaagatcctctcgatggcttgttctgatggtgaggctgagcaccaatggatacagaatgtcaagtcaggaggagcagttccttgtctaccgcccgaaaactgtcctaatggttgggctactcctcctggtgacacttttatggtcagaggcccagaatattttgcaaccaaggcaaaaatacctggtggggagtatcttctgaagcctcttggagttgattggatcaaaggcccagtaaaaatctgtgaggtcctgaaaaacaggaaccatcgtgtgaggaaagccatcgatgaggaggtttctcacggcaataaaccttttgtctgggccttcaacttgcaactgcccagcaaggagaactacagcgcgatattttactttgtctcactggaacctgcacccgagggctcgctgatggatcaattccttaaaggggatgatgctctccgtaaatccaggcttaaactgatagcaaacatagtta

SEQ ID NO: 9830 - DNA, 635 bp, Triticum aestivum
  Clone ID: PAT_TA_9830
cgtccgcggacgcgtgggcggacgcgtggggtcgccgcccacctcgcgctcgatccacggtccggacgccatcgccgccggcctcgcgctcgatccaaagtccggccgccatcgccgccggcctcgcgctcgaccccgtcgtcaagccgtcgtcccggaggtcgcaccccccctcccccaagctccaccccacatccacccatcctcgcactctaccccctctccccgagatcgagccgcggtccttgcactccacaatccgacggccgtcctcgtgtcctcctgacatccagccgtcgtcctcgcgaatctccatccctgctacctccggggctccatcgtcgtgctcccgctgctgccggatctgctgctatcggggctccattgccggcctcccgctgctgccggacatgctgatgccagggatccatctccaggctcattacgctgctaccggacctgctgccggggctccatctccttcgagctatgcccctcccgaatccagcgcgtccccgtgccttgagatgagtcgacacccaagctaggggacgtgatatggcgctcggtgtcttaagccatgttgggcccgaagctggctgtcacaaccggacaagaatggatttttggtgctt

SEQ ID NO: 9831 - DNA, 572 bp, Triticum aestivum
  Clone ID: PAT_TA_9831
gcgctcccgcacggggcacatccgcgccttcggccgcggccacgcgccctgcggcatcgactgcttcgacctcgacgacgacgaccgcgacccttcctccgaggttgaccacaccgttaacaccgccgccgccaccaccaccaacggcgccggcagcgaccgtcgccattggaaggccaattaaccgatcgagccggtccatctctagggctacggcctactgggtaagtatatatgcatgtgagctgaggtgtgggagcgcaagctattactggcagtacgtactatctgtatacctgaagcttgcaggcaggcgtatatagttgatagtgcgaacagtgaagggtgcgttttaattttgaaagaaagatggattatacatttggagctggattaatcaagggatcgatcggtgcatgtatggttatgacttatgagagaggtgagtgaatttctaattgtttgggtatatagcctaccctagctagcttcattgtatgtgtagactttgatttgggatatggtgatacagattatcaaatattaattcaaaatttcaaagaaaaaaaaaa

SEQ ID NO: 9832 - DNA, 928 bp, Triticum aestivum
  unsure (1)..(928): unsure at all n locations
  Clone ID: PAT_TA_9832
ggnctgcaggnaattcggcacgagggggtgtcacaaaggnatgccaagnagnaaagtgggaaatgtttgcagagcaagcggagaatgactgcaaagttggctccagcttctcttcagctaagcattgccgcatggaaacaattatgcaggagtgtgcatgcactgtcgactctgctgctcaacaatggaaaaaatcccatgctgcagttaatgatttgtgcacaaaacaagtggctgaagttgaagtacttgtcaggggtgcaatcgaaaacaacgagcagcatgaagcggagattgcatcatctcgcgccttggctgaagagcaagcatccaacagtagcaaagaaatactccaggatatcgacaatctactggaagaggcacgtaattcaacatcgagagttgtgtcgacggtggaagcacattcggtagagatacaacatttgcaggagaaccactctgggcagacttcaggcgtcaacacacatgccgagaaggctttccaaagcagctacagggactatgagccgactggcgaaactccgatgaggtctgagccggaagtcccgagcaaaggcacgatcgagtcgttgcgagcgatgccaattgagtccctgatggatgagttccgtgagaaccatccctatgaatcgagcaaggaacccaagccgtcgctcatccctcgctcgccacttgcgacactcaactgagaaacaacgatatacttttctgtgtgcagtgtaatcttattaggacatcaaatcgctgctggctttgatgtccttgttgtgctatgtgttttgtgggatgcgagctatcttagccctcacccattgtctttcacattcctgctagaatgtagtatcaatttgttgtgtgatattgtggagctgccgattattcttgttgaaattctatgaagggacat

SEQ ID NO: 9833 - DNA, 616 bp, Triticum aestivum
  unsure (1)..(616): unsure at all n locations
  Clone ID: PAT_TA_9833
tccacctgctttcacgtgcacggatgaaggataccctgctctagcttccatcggctctggggatcatgagcagcagcagccggnacgacgccacagcgagcagcgcaacaacggcggacccggcagagtggagtcgtgtccggcgagaagcgggctcagcagggcgccacgccgtgcggccatgtcggaagattccgtggattgccaaagggaaggaaccaggaggagaggacacttcagatggtgagagctgaccacggtgcgtggggccgacgatgggcacggcgagcagcgacaacgcagtgtgttgttcgtgtacaaaggaagtccgcaaggagtagcgaccagaagcaacacaagacgacaggagcgacacgatgctctcacctcaggtctccccttcccgcgcgctgcctccccgcgtccacgcggccgccttttctcccctcgaccgcgggctgtcgtccgcggccccggttggcggtccctgcgccggccgggacgccgttcgggctcnaacnacgcgacggctgcngcctctggngtgtcaatcaccaaccanccnttgattnttangtanagaaaaccccaataatnantggtagtttgttcccnc

SEQ ID NO: 9834 - DNA, 433 bp, Triticum aestivum
  Clone ID: PAT_TA_9834
caccctcatgtgccttctgcttctgtacaccagccttcatgtccatggagaagtggacaccagtatcagaacaagcagcatcctagtacagccagcaaggagggttttgcaagctacgtatgtacctcagacaactataacaagacagtgcaacatatgccactgcagcgatgatggtgatataacttggtatgtaacaacatgctgctctgaggcaatttgcaatgatccagccgagccatctggcacttgtacttctcgcagaatctcatgcggcggttgtgatgaaaaaacctacaagtagtataggctgctaatgaaagatggatggcagtttttctatatcgagttaaattacaaaggttgccttgtgtcatctggatattgtaaagagaaatgaataagaataagcaagaattgagtaaaaaaaaaa

SEQ ID NO: 9835 - DNA, 1135 bp, Triticum aestivum
  Clone ID: PAT_TA_9835
cgtccgcccacgcgtccgttggatacatgctatctgacatgctgaaggagaataacgggaacaaggaagggttgctatttgatactcatgctagaacagctttggcatttgtgacacttcgaagtgacggggaacgcgaattcatgttttatcggaatccaagtgcagacatgctgcttgaagaaaaagagcttgaccttgaccttatcaggaaggcaaaaatcttccatcatggatcaataaatctgataaccgagccatgtaaaactgcacatattgcagcttccaaagctgctaaagatgctggggtactaatttcatatgatccgaatttgaggctcccactgtggacatcagctgatgatgctagagatggtatcctgagcatatgggatactgctgatcttatcaaggtaagtgcagaggagatttccttcttgacaaatggggaggatccatatgatgattctgttgtgaagaaacttatccatccgaacacgaagttgcttcttgtcactgaaggtccagatggctgtagatattattccaaggaatttagtgggaaagttggtggattgaaggtaactgctgttgacaccactggtgctggggatgcctttgttgctggaatattatcacagctagctgcggatttttcactccttcaggatgaagctcggttgagagaagccctgaagttcgcaaatatctgcggggctctcactgtgacagagagaggagctattcctgcactgcccacccgacagcaagtggctgatgccctgaccaatgtcgttgcttaagtctgccaggcaggtagttctcatctggtttgctgtgtaatctaatgcaactagcgttggcctgtcgagcatcgtgagtgttgttagaatagttgtaagttggccgtgtgatttggtttacgctgtttgttgccttgctggtgtaccccaggctaccggccaaccaaataagatgcaagacgcgagttgcggtccaatttcacttgtgaaatttgtgtttggagcctcagagctactacttgctgtgtaatctttgtatatttttaccgcggttatctgctggtgctgtgaggaagtacattcgggctatccatgaaaagagaaaaaaaaaa

SEQ ID NO: 9836 - DNA, 1328 bp, Triticum aestivum
  unsure (1)..(1328): unsure at all n locations
  Clone ID: PAT_TA_9836
ttcggcacgaggcactgttgtgaaatttattgaattggttgtagcgcaaggtgataagagaggaaatccaaagagaataaagagatcagagaatcttaaccgtgataaccattttgaagagtattttggagaacaccctgtgtcttctattctcacttctcttctggatattatttttcttatgaagaatgtgaatgaaaggctatgtttactccaaccactttgccagattctatcaaagcttctttccgatcaatggatttcagggatagtttgtcaatataacaaaggctcttctgaaactcttgatgtacccagttttgtaaaagaaacccagcagttggtactactgacactcaaagatatcatcggtacactacaatcgggccaccaagataatctgctcaacaatggaaatgtaaacctccttatcaatttcataaggtccacggaggatgtaggaactcgtaatcatggattgtcgttgattgcatccttagcaaaggcattcccgcagctggtttcagaaaatattattgatctgtttgttgctattggggatgcagtgaaacaggaggatagccactcgcaacatgttatggaggatttattatctgtactagtgccatgttggctatcaaagaccacaagtatagaaaagcttcttcagatattcattaaatctttgactgatgttgccgaacataggcgtgtgaccctcatgatgtaccttttgaggaccctaggagaaaatagtttgagtaccgtgatcatgtatctactgtacacgttgattgagcggggttcacactctctttcgaaacacaagaagagtcattgtgtcctatccttgagtgccatgtcacaggagtgggaatatggtctggcagtcaatatgacgggccaatattcctataaattatggtttccttgtctgtgtaagctactacaagaaatcaaggtgcatcagaaacaagttttacttcctatgctacatttggcgttgcagtttattctacttaagctgcaagatacagagttgagatttgagcttgaagctgaggaagctgctaattctatccagaattctcttggaacactcatggaggaagttgtgttgtgcactgtctctgtcaaagacaaaaaaggggacatttctggtgatattctaaaggaagtcaggaacaattcaaatactgttctgaaaataattacgggatggatgcatgcttcaacatatttcaaaggaattactcagttgttagaacatccagaaggtcttgtgaaaagaaagacacttggaatattgtgnaaactgcaagggcgaa

SEQ ID NO: 9837 - DNA, 736 bp, Triticum aestivum
  Clone ID: PAT_TA_9837
cgtcctgggacgcgtgggcaggcatcagtttcccctgacgatgtatcaccagcagtgcgagctcctgatgccccatgagggcctggacatggacgccggccagtcgcaccaccttgccgccgcctcagccgtcccggcagagctcaacttccatctcctatcctacgtagacgccgctgtctcgccgcagcagcccaccgttgagtacttcttcggcggcgccgaccagccccatgcgcagttcgagcagctggccgccaaccaccaggcgatgaccgtgctgcgggactactacggccagtaccccgccaccgccgacgcgtatctacccggcggcggtccgaggaccggttcgtcgtccctggtgttcggtgctgccgaagaggagtcggcctacatggtaggcggcttccaatgctcccccaagccgcgggcgagcggcagcaggaagcggggcccgggggcgccggcagcagcttccacggctttccgggcaacgggggggtcgagaagaaggggtagcagcgccgaccgagcaccacccggacgttcagcgccctcatgcgtctcatccccacccgtcccaagggggtccgggccccggtgatctatgacgcgatcgagtacatccaggagcttgggaggacggtggaggagctgacgctgctggtggagaagaagaggggccggcgggagcaccagggggacgtggtggatccggcgcccctggtggtgg

SEQ ID NO: 9838 - DNA, 1143 bp, Triticum aestivum
  unsure (1)..(1143): unsure at all n locations
  Clone ID: PAT_TA_9838
tgaactcgngtatttcgttgagtgagatcatcaccatgtcgtgctgcggaggcagctgcgagtgcggcagcagctgcaggggggctcagtgtggggaacaatccattgactcattgtacggccatgatgacatccacggcctggattactgggctaagaagcgcgcggattatttgtcgtcagagccacctgatggatggagagctcagggacgactgctcgcaggagagccgctcatttaaaaatcctgctcttgcatggagacgctgatcctgaagtaccatacgaaaccagtatatggtacgctgagtttctgcgaacctcaggcttttcagtggattttagaaccttcaacggactgcagcatttttggacgtgccgtgagatggattatgtcgagcagtggctccgccctaggatcgcccgccccaggatcgcagtgcccagacgccatggaaggctgtagtttagtactccctctgtcttctcatagaccatctgtccgagcactcatctcgcgttctgatcaagccgggaggccgtcgtttgagagcaccaccgttcgatgttctggacaccaaaatggaataacatacactcctcgcctgttttgccctcttccgtccagattctcacccgggaccctatagatatagttccaccatagctatgtgtaccagcaacagcaacagcaacagcagcagcagcagcagcagcagcagcattgatcgatcatctgtgacccgatgacacacaccacgagctcctccaatggcacccatataatccgggtcagggaggcccacctggccaccgttatctggttgtaacggcaagaggtatatatactctgtactgcattgctctgctttgccatgctgagtccatttctagtgactgaactgttgtgatggcgagaggtatatatactctgtactgcactgctctgctttgccatgatgagtccacttctagtgactgaactgtgagaggtatatatactctgtaatgcactggtctgcttctggtgccgaattcctgcagcccgggggatccactagttctagagcgggcccgcccaccgcgggtngaagctcnagcttttgttccctttagtagggttntttcgagcangggcatatc

SEQ ID NO: 9839 - DNA, 793 bp, Triticum aestivum
  unsure (1)..(793): unsure at all n locations
  Clone ID: PAT_TA_9839
cgtccgaacattagcatctccgatggtcaaggaaggagtctgggctgatgttgatgattatctactggtggaagcgcttcaaaaggttgatgctgtctgtattgaagatgttgactgggacagcctacttgatcacaggtctggggaggtttgtcgtcaaagatggaaccagatggtccgcgccattggtggccacagggagaagcctttcatcgaacaagtggaagtgctgtcgaggcgctactgcccagaaatgattgaatacaggaagtgaggaaaaagtgtaggaattatcacccgtcaaacttgtaagcccagacaaaacagcaagcatgatctgtgtcaaatcttgctcgtcacttccatggtatgtggagtagcccgtaggatgccaggcttgcgggatttatggggtgtagaaatgtctcaacggtacatggttcgccagtgagcaagctaggttatggtttcgttttccttctattttcctcacaaacatctttactcagacctgcttcagggttacctatttcatttacttgaaatgcgcagtcacgacgcctgattgcttcaccgcggtcgccccccgctcatcacccagcgtggtccccctttngnngngtccccctttcccnggcttacctngnggcangagggccccagccagtcgcccttccnngaggtttacacgcctaangtgncagntgagccccccctangaccncangtagggcccgcccgctctgntnnnggcccagcaggnccnnagagntttcngacccccagacccccc

SEQ ID NO: 9840 - DNA, 767 bp, Triticum aestivum
  Clone ID: PAT_TA_9840
cggcgccgtctctcaaggctccaagcagcttccggcctccgccgcagccgtggcggagaagcagcgagccgagaaggccgaggaagggctgaggacggtgaatgtacctcaagctgctgggggccaaattagcagctgcaagcttggtacagcaggctgcagcttggtactagctaggcgtgttagtgtttgctgcaacaaccatggcctgaaatctgtctggcttcccgtggaatcccccgttgcaaaataccaccacaatgatgatgatgaaaaatgatgttacttgaggcccatgtctatttgcttatttatgatcttggtgaggaatatgcatacatgctctgatttggtgtctgcttacaacccagcaaattgtgacggtcaacgggtcaaggacctagtggcaggacactgagtagggtcagatcaaattttcagtgtccaacaagaggatttggggatacagggacagcaagaagaggagagcaagtgagttctatctcagttctgaataccaatcttcagttacatacagtaggcatcagcctccaacctggacacggccacctcacgcacacgcaacacaatgatttgctaagcaggctgggttgtctccgtttcccttcgatctttagttaatacagtggcccggcccacgggcgcgacacaaacatgctgaatttcttccatctgcggcactttgttaaagtgacacacgcgagaatcctcgtatctgtgctcaaggtgtcatcaatcaaccaatc

SEQ ID NO: 9841 - DNA, 204 bp, Triticum aestivum
  Clone ID: PAT_TA_9841
cggcacgaggcttttttttgtgtgtgttttttgggtactggcaaaagcactgtgagatattgccatattggaatgattctacttttcattgtttgtctagctaatagtttatgcatcctaccgcaagttacatgtacagtgaatgttatgaatcttgtgagaaatatcaataagaggattgttttcaattggacaaaaaaaaaa

SEQ ID NO: 9842 - DNA, 519 bp, Triticum aestivum
  Clone ID: PAT_TA_9842
cgtccgcccacgcgtccgcccacgcgtccgctctccctccctccctcccccgcgccggggcgacgggaagccacctccatacaaatacggaggagggacgctccaccctcctccttctcctccgcgtccgctccaccgacccgtccgcgcaaccgcagtgagtccctccccacccccgcacctcacctcatccgccgaatcgcgcccccgcgccgtgaggccgcaattgccgcgatcgcgcgggccggggtgtttgctggttgacgcacctgccgtcgggctcgagggctagggcgccatggggacgtacctcagcacgcccaagacggagaagcagaccgccgacggcgacggcgcccgcgtacgctacggcctcgccttcatgcagggatggcggaccaccatggaagacgcccatacttgtgtgccacagcttgacgaacgcacatccttttttgcccgtttcgatgggcatggagggaaagcggttgtaaattctgcgcaaacattacacatgca

SEQ ID NO: 9843 - DNA, 981 bp, Triticum aestivum
  unsure (1)..(981): unsure at all n locations
  Clone ID: PAT_TA_9843
cctgcacttgtctgctttgctcgcggcacgctgcagtaatgcggtccacgagtctgacttccgtgacgctcatcttccctgcccggcggtctgtgctgtgcccactggagctgcgcgccggttgttgtcagtcccagcaaggcccttcggaaacttccaagcagtacaacatttgtcagctcaattagctgcaagattaagaaatgaggacgacgagtttgacatcctaaatgctcttcatccaagcccagctgtttgtggtttgcccactgaaggaagcgcgccaattcatacgagattatgaaatcttcgaccgtggaatgtatgctggacctgttggttggtttggtggagctgaaagtgagtttgctgttgggattagatcagcactacttggaaaactgtcttgtccagggatatagcactttagtttatgccggtgccgggattgtcgaaggtacaaatccatcttttgaatgggatgagcttgatctcaaagcatctcagtttgcaaagttgttgcagtatcaagaacatcatatttgctaccaagaggcaggaaacatggggacattgatttgaactgtaactaggaagttttgatttgttgggaagattccaaatggagttcatatctgtttatgtgccgtgcgttgtaaacttcaaaagatttcagcctgatttgcatggctcttgaagatgcaatcacagaaatatcgaaatatcgattcgaggagatgacagtgatgatagtcgtggagcgtacaaaagattaaataaaagcatattaaataattatgtacaatgattgtaacaagtcagtttagtgcaaagtgtatattaccattcttttgacttcttctctggccttgtccaattgcttatatgatctggatgcttcttgttgcaagcataatgtacctgatgcattattttcatctgatgggcaanacatagatcattcatttatatttgtaagaa

SEQ ID NO: 9844 - DNA, 689 bp, Triticum aestivum
  unsure (1)..(689): unsure at all n locations
  Clone ID: PAT_TA_9844
ttcggcacgaggcgcacgctcctccttccgcggctgctttcctcgagtccactccgggggcctacactaccgcgcgcgcatcctccaccggcctcatcttctggtggccacgccacctcctccgcctcaccgactccgcgcgcctccttgcccaatcccacccccacctcctcggcctccctgccccaccgccgggtaccctctccacagcgcccatcgagcctctcgttaaccaatccgtgcgggtcggcgtccacgagatgcggagccggatgctggcgcttggggagtgctgctcgggggaagatatggcgctcacggcgttggttcgagctggtggggcggcggatgggctggaggtatgcgtccacctgggtgtgtacgtgcctccggtgttcggggacgccggggcgaggcttgtagtggccgggagccggaagggaggccgccgccgccaagtacgctccttgggccaggatgaggaagagtatggagaagatgaggcctcctggagccacggagctcttgctgaccaacgatggggatcatcctcttgaaggcagtgttacaaccccccgcgccgccggccgggacnnancaataancctgttgtcaanaaggaaagaatttgataaaaantccaaaggnggnttcctgaatttccaatnncattggagcatntttgatca

SEQ ID NO: 9845 - DNA, 756 bp, Triticum aestivum
  unsure (1)..(756): unsure at all n locations
  Clone ID: PAT_TA_9845
cctgcactttcgcctgtcgggcccgcagcacactccgccttgccccttccaaagaaacttgctcagctggccaagaagtgtcagcggatgttggttgccagagccggggcccgccgccggcatcatgcctcggacacagccgacgatgaatgctgcatcacaacgtcgtctgtggttgccgatgagggccactgcgtggtgtatgccgccgacggagcacggtttgaggtccctctggtgtaccttgggacgacggtcttcgccgagctcctgaggatgtccgaagaggagtttggctttgcaagcggtagcgatggaggcaggatcacgctgccctgcgatgccacggtgggggagggcgtccggcgcctgccctggcgggaggccgccctcgggggcgggtgggcgggcttgcgcgccctcgctggccgtgccctcccccaccgtccgtgctgggtggcgcccgccatcggtcgggctctcccccctctttgcgctctctgcgctgcgcctcgcgtttcgcgtgtgtttttttgcttgtgcctggagatctctgtacagtctgatgtaagatcctactatcatgagaaatgataaaatgtagtattcctcccaaaccactctccctatccccntgtccanaagctaccccccggctccantggcggcgaaggaaccgatgcgcgtgctcgtcaccggcgccgcaggacaaatccggatatgctcttgntccatgantgccaggggagttatgcg

SEQ ID NO: 9846 - DNA, 849 bp, Triticum aestivum
  unsure (1)..(849): unsure at all n locations
  Clone ID: PAT_TA_9846
cgtgcgattagctgttgttcatatttgaactagcgcttcatacagaacaattttgagagcaaccggacgcgtgggaaaatacatcaactataattgttggaatcctgaaggtagttccatcgaagtttgtgagtatatttgcaaacctctgtctacctatgaatactattatcgagatagtttaaaccatgttgttggcctgctacaatgctcaattggtttacccttgctcggatcaattctggtgtgtttgtagtgggaatgtgggatgatgtatgaagagataaagaaaattatgctcgcggaatatgagtatgtagtaacagttctctgttatggttcgcgacaattgttctggtacatctattggtagtttatatgtaatgcaatgcccgtttataattatcatgctaaaaaataatgtacattagacattcaacataaatgagttggacactgacccacaatatatactatgtatattgggacacaaccgtttgcttntgggtccagatgacccggcattcgtcagttaaaatcccacaaagagttatgtgggttgggngtcgccanagtccatcatngagttanaccccggttntgaagnggtacggggacacggnactacanaatatttgatcttggggtntgatnanggcttcctggctgnngggtgnaagattcatgnggntgaacatggacanatttttgttcctngactgggannnaaaatanggtgacaaagggaaccgatncttgcttcaaatatnannttaantccccccaaaccggggaaaaatgnagggnngncttttatttaatgnttnttnntaagggggnnacnngcca

SEQ ID NO: 9847 - DNA, 1119 bp, Triticum aestivum
  unsure (1)..(1119): unsure at all n locations
  Clone ID: PAT_TA_9847
aggctgaatcgacctgttgtttcctctgaattttagtngtacaacgcactgatcatttcacttggagtttgttcatgggggatttttcataggacacagatgcaataagtcattctgaacggggagaaggtttactatgatttctgtgaatgcagtacaacatgtatggaaatgttggatgatctcattgaggatttgggatatgagcacaaagtgaaaataaagacctatttgctactgcttggtagtcaaacaaatgaagatgagcttcggttgatctcaaagaacagtgacacaagctgcatttgcgcaatgcagaatgggatgatgttttttaaaaaccctgctacacacttgcgctattatcagtcctatttagtgcagaagagaggagaagcaggacagtggtgcagatatgagcattgggccagatcagagcattggggcatgctgttttgcagatggcccaacagaggcagagcaatcgtagaggttgttcaagatgatttagaggaggggactgatgatgactcctctgactctgactatgagccagaaatagtggatagtgactatgacttaaaggaaggtgatgatgatttggtcaacgataactgtcaaaccgatgaagagaacaaaagggaaggaaaatggaagcaacttgagaaagatgacaattacgaagttgacggacttgagcttccagattcagatgacgaagatatgaaattcaattctagatatttcacagatgcagatatgaatgaacccatactccatgtggccctggccttctcatctattgacccgtagagaaaagcaatgagggcgtaaagcaggagaggttaaacatcacatttccgaagaacaattggcacaaccctagttaatggtaatgtaatagggtagttaagcataacatggcatcatatttaccttttttggaaatttgaaatcgagggaaattcaagcctcatgttaattaaaaagggtaaaaaccctaattttgtttataataaatcccaaatgcccttcttacgccctaaggtttaggcctaagctcatatgtgaccatgtgggccccatcctaatctttnggaattttaagggaattatttt

SEQ ID NO: 9848 - DNA, 800 bp, Triticum aestivum
  unsure (1)..(800): unsure at all n locations
  Clone ID: PAT_TA_9848
gccccgctccgctcttcccccgccgacccacgcgtccgagaaatagcactagactactagactctgcgcaagatcagtctgctctgctgccaaagaagcgagatggcccggctctctttcgtccccatctccctgctgctgctagctagcctcgccgccggcgccggcgccgcagcagccgcggatccaggggaagggggccccagggtcagcgtgcagtacgcgagcgaggaggagtcccggtggctggaccgctggacggagaagcatctggcccaacaagggtccggccaagccatcgagattcagccgggcaccgacgaggagtcggcgcaactgagccgcatgttccccggcaacgcctacatcggccacattgagtatgacaaggaccatccctttggcagaatcgtcgtggatgccttccactccaaagctcgccaggcgaagccgaacgatgatctgcagaagcagggccaggaggagtctcgctctcacgccgagcacgacgtcaaggatctttaggagccggcgaggccatatccatgacgaccttgtcgatggacggaataacggtggatgactgtgaggagttcgagttcttgtcgtagatctttatccagttttagttgcttgttagggagtcgcagccagtactatggggatttgtcctcagagagattagtcgagtcattgtctactgtctagtagtagtagtaattctggtttattctgccgtgtgtggtgctctccatttgcaatttgtcgttgcttagcgaaaatccatttggttaaaaann

SEQ ID NO: 9849 - DNA, 846 bp, Triticum aestivum
  unsure (1)..(846): unsure at all n locations
  Clone ID: PAT_TA_9849
tgcaggnaattcggcacgaggtagaaaatttgttacctctaaagcctattttctgaaatgaaatttgatcattcctatgccccctccattttcttgaattgaagttccatcatagtttgcagaaatcagcttattagttgtcctcttagatcaatcctcaagtttgttataagttgtttgccaccttatgactaatgacaatgttctaaataaaacaaattgtacttccatatgtgtctagctctccatgtttcaatttctcagaagtaaagacgcacttcaataattttaagctaagcttcttgcttgctttccggaataattattttgttatatgtgccaactggctacattcaatttaacctttgctttatggtataataatattcaaatatttcatgaggtcatgggtttgagtcatgcctcttgcagaaatgtagggaaagactgcatagtacgacccaaagcagtcgaacccttaccggaccctatgcaagcgggagctacgtgcaccgggccgctccctttatggtaataataatattcaaatatttcattatgtgatgaggtgacattattagaggctaattcaccttggattgttctattcctctccagaaaagatttgcatatatacgacatgtgcactgtgattggattgcaactgagttgcatttgtccttatcattctattgtactagagtgcatgcattctcacttttgtattgtctatttatacaaacaaccgtagataacttatgctactccacggtattaacatacttactaatnaaaaagcaccttanatctgtacaattgccctnatatgtccactaattttcctaa

SEQ ID NO: 9850 - DNA, 1405 bp, Triticum aestivum
  Clone ID: PAT_TA_9850
ccacgcgtccgcctagcgccagggggagagcgtcggctcgatcccccactcgccccccccccgcgacacacgcgcgcgcccgccgccgccagggcaccttgcgccttttgcccccgctaacacaagcgatctgtgccttgcaccgccgagcaagagcatctccatcgatcgacaccgccatggcatcgatgtcgtcgagcctctcgctgccgtgcctcgccctccagtgcgacttgggccggtcgacgtcgacggtgctgctcagcgtgccggagaagaaggtcgtcgccacggcggccgacgtcgacgccctcatcgcgccagcgctggccaacaagagcgtactgcccacggcgcgtggctacgtgctcgcccgggaccccgcctccctggccaccttcctctacagcccccagagccgccgcaagatcgacctgccgccgctagccatcgaccaggacctgctcaggcacggcgcccactgcctgctctcccacgagcccaccgatcccagctgcgtcgtgctcctcgtcgagcccaacaccaccttcatctggcacctccgcctcgccggtgaccagacgcagtggcagagacacgagtacgacatcgggtcccaagtgtacgacgacgacgaggatgacgaaaagcatccggcctgggtcgggaagaccgtgatccgccagatcggcgcgtgccgcggcaagttctacttcaacccgccctcgcccgagctgggcgtcctcgacttccccgcctcaccagccggcccgccggctttcggctcgatccccgccggctgccacgacgaaggggagtatgccgtggtgggcagggtgttcctggtggaatccgagggggagctctacatggtaaagctgctgatggacgaggccaacctgaacaagtacacgggcttgagcgtctacgtgatggatttcgagcggacgcggtggcgcagggtgggtgatctcggcggccgcaccttcgtcatggcgccagtctacgtcgggcgcctcgtgcgacgccggacggctgcgagccgactgcgtgtacgtggcgtgcccaatgtcgagggagctgcaggttttcgacgtcaaggacgggagcatcgagacgcagaggcttgacgaagctcccttctcgaacaaagcattttgggtgcttcctactggctgctaaatatccatatccattatcaccttgcgtttgccatgctataaccatgattaattccacaataaattcttcagaaagattgcatcttttcagctaccatgtttttctcttggaaaagctactatgtgttgtttaagagagcaaagggaaaatcaccatcatctaaaactgtttgttggtttttgatctgaatatatctggtgtatatcagatttggggagatttt

SEQ ID NO: 9851 - DNA, 710 bp, Triticum aestivum
  unsure (1)..(710): unsure at all n locations
  Clone ID: PAT_TA_9851
tatacncgtcagcgatgggttacggatnnangggctcattngtgcttggtngactnggggaagcncttgcttacctctagcttgaaatgtaccatgaatgcaaggattgtttccatattatctctnggactggacgaagtgattgcgnggaaatgtacaggagggaaattcttgtttgcgggtacccttcatggggaaaaactntantgaggcaaatcctgatattggcatgcccgctgtgcggcacgaatcaggagaggcgagctgcaatggaagcggaaggattcaagatacttggaaactctggggatcaatggagtgacctgataggattgccaatggcaacgagatcctttaagcttccaaatccaatgtacttcatcagttgattctattggcggcgctggagaaaatagctattcttcttgtacaacactacaaccatttttatggccccactcccaaagttgtttaagttggcggccttaatttgtaaagaattcttgaatcaatcacgtcagtcgctggttgggtaccagtgaatttgccactgatgtctatggatatattgctcagaagtgcatggtttgtgtgttgtgcccgagaggattggtgatacaagttcaaaaattgcaccacaagttgtactgagatctacagatgagatttcagttaaataaacatcacattgtgctggactaaaaaaaaaa

SEQ ID NO: 9852 - DNA, 802 bp, Triticum aestivum
  Clone ID: PAT_TA_9852
ctctgcatcaggtgccctgacaggcatgggtgacagataatatcaagagataactctcccaagccagtcagtacagtaagaaatacacttgctttcatgaatcatgactaaccttgctcaattaactgtagaaaaacgttgtatcttgcaactattttcatttgcgtaggcatccgtttcacgtagtttaacactaactttgatcttttatgcttgcaccatgtgcgaaattcttgagcacatctgcagatgtcacctggcccttcacatgcctaagtgtaaagccgacactctgctctccagaacaaacacagggtacgccacatcttcagcattagcaatctcttcgacaatttcttcctatttgttgtatgcaaagagggggaggagacattctctatgtaacaggatagcagttcggcacccaccgacaatattcgcgatggcgcctcaggagactgacaacgtccatgtcacctgcttcccgtcgcgatgggcatgtccagcaggcaggacaaggcgcaaagcgagtggcgagagggatatggtgccagcccggacggctactaggttggcgtggtgagtgccttgatcgattcagatacaaccagataaccactgggcaatttggtcctttcatgagcctataaatttgaaaagaaaagaaatgaacaaaatgaggtgctaatggcacggtaatcaagatatcaacgagctatgtggaggttctacgaaggaaatctgtaatgtcaacattccgcagagccacacacaggaagggcaaaaatataaatactaaaac

SEQ ID NO: 9853 - DNA, 1065 bp, Triticum aestivum
  unsure (1)..(1065): unsure at all n locations
  Clone ID: PAT_TA_9853
gtttggatctaaccggacgagcagtttttcggaggcgagcggcgggaggtttcgacggcgagctgccggcagctgctgctggacacggatgcgtgtggcactggtggtgccccgtttgccggaggcagcaccgaggcgagcggctggtgctgcaagaggcttcacggcgggtggcggcctcttcggcggcgacagtgtggcgacccgcctccatcccccgctcccttccttgcccgtggcgatggacgaggaccatggcccgacctccttctccataacccgcacccgtgctcccctatttttgccactggactcgtcgccacggcggcggcggcccctgcctccactccacgctcctcttctcttcgtcgcgcacggcggcagaaggaggggttctgatgggagcaaggcttgcgacccctccgtcacaactgctccggagcccggacaaagccgaggccgtctctgtgaactctccagcgagctgaccattgccctcctccatctaagatgcaaggtagcagcagcaacacaggttccatggcctctgtcgcatagctgccacccaagccgtccccagggtacggtggtggttggcattatgtttgatgcgggctgcatctactcccacgacaacggtcagcaactaggtgttcaccatcggagttcttcagtatcgccccctctccgtcattagcaaaattcaggattggccagaagaaaagtgaacataaaggcttcagatctattaataggatacgatgttgcttccaacccatggatatgaatgttccggtcgccggagagattgttggacagatgaaattgatgagaaatctttgcccccctgcaaattaagcagcttgaagaccaagctgaaacctgtacgatggcactgaagttgcgcctccaaatctctttgcatcttgatgtaattagcccagtagtattcagttttgtagtaatgatttgtgatttttcctgctgctggttaccgagtgccaagtggcatttagtttctccaaggaatttcatttgnactcgtaggatatttttattacgtag

SEQ ID NO: 9854 - DNA, 585 bp, Triticum aestivum
  unsure (1)..(585): unsure at all n locations
  Clone ID: PAT_TA_9854
tgcaggnaattcggcacgaggaacgggagcgtgtacggcgacaggcgcgacgtccaggtgggctgttttctgcaccgcaggccccccagcggcggtggcggaggcggcgggtggaagaaactcggcgtcaacgagaacggcgaggaggtggtgtttgccggcagggtggcggtcggcagcagcgtgcagggcggcgcggcgctcgaggaggagctggtggctatccaggtggacaggttggccgagggcgtgtgggagcgctacttcggtgggagctctgggtggaactacgtgaccgctgagtctgaggagatcgaccgaagcatcgagcagctagcgtaagtaattactctctgcgtcatggcatgtcatgtcgcatgggttaacttgatgttactccgccactctgctgtgcatgttgccaaatgtgaccgcactttttttgctgcaagctacttagtttatttggctccataatcgacgttggtatacgtgactacgtactgactactgagtatagccatttcgttgctacttttatcgaatcctctcgtcaatccccaaaaaaaaaaaaaaaaaaaaaaa

SEQ ID NO: 9855 - DNA, 427 bp, Triticum aestivum
  Clone ID: PAT_TA_9855
ggagcccacgcgtccgccgcccacccgcccaccagtcgccgactgcgcgtctccggcgacccgcccactcgcaggaagctcggagcctcgccgcggcggaggccagaaggaaggagatgagggccgtggtgcagcgcgtcctctcggccagcgtcgaggtggaagggcaagtggtgtcggcgatcggcccgggcctcctcgtcctcgtcggcgttcatgaggctgacaccagctccgacgccgactatatctgtcggaaggtcctgaatacgaggctgtttactaatgagaagactggaaaagcatgggatcagagcgttatgcagcagaactttgtagtcctgttagggtaacaagccatattttcatgtggctatgccccctgcgaaagcaaaaacctttctactcttctttgagttgtgaagtt

SEQ ID NO: 9856 - DNA, 610 bp, Triticum aestivum
  unsure (1)..(610): unsure at all n locations
  Clone ID: PAT_TA_9856
cttttgcaagttctggttattagnagnagtgcccgaaaatcttggggttgcctttctcaaaccacattgtttccccagattggttccccaagctacaagagcttgaggtacatgactgtcccaaattcttgccagtgattcccatctcctggatcgaaagtaagcgttctgtcactgtgaaatgtgtaaagatgctaaaggagtttgcatactcaaaatcatccactggagcacaattgaagattatcggagagagtgatctgcttagcatagaccaagtgctggtttttgataaagaaaccggtctagagacgctgacactgagcaagtgcacacctctggagttgaagcaccttctgatgctaacctcgctgaggacattgattgtaaaagattcagttggtctagttggaccactaggaagaggtcagagtgatgtggaatggcagctccctgttgagtgtatcaagatcgatggcttaactggtaatactggcgaggaactgacagagctccttccccacctcccaaagctctccaaattggaaatacaggattgtaaaaacataaaaaacctggtagtgggggtggatgtgcaacaaacagcaca

SEQ ID NO: 9857 - DNA, 224 bp, Triticum aestivum
  Clone ID: PAT_TA_9857
ggaacgatcaatgtagaatgctcacaacaagcaagctaaaggtcggcattaatttccaagatgggaattggttagtcgttgtcttgttaagcatgagtttgtacctgcacaaaagatatcgttatacttcctatgaggtatacttataccgtagatcatgatcttatgttatctcgcaaaaagaagagaccatgttcttatgtacataattgacaaaaaaaaaa

SEQ ID NO: 9858 - DNA, 859 bp, Triticum aestivum
  Clone ID: PAT_TA_9858
cctcttggtcggatcttctctctcgagtcttgtcctgcccgggccgccgcacccgcgccgccccgccctgtagttcttccctcccctgcccccctcctccttcccaccggccgcctgcgtccaatccgcccggctggttccggatttccaatcgatccttctaacaacagcagcagcttcctctcccctctgcgcacgcggttcctctatccgcttgctctcgcagatggagacgccgacgggtcctgcgcaggcaggcggccgcttccccgtgccgcacagatccctctccttggacatcaagggcaacaagactgacattgtcatcagcagatacgaggataactttctggtcatcgtgacgcagatcggatgcatgggaaccatattagctgctaagaaagatgaaagtgttttctctgatccaacctacgatgtatctgttctttttgggaagagggatgagccactcctgctagcttgtgcacgtcaacttatcgagcatataagtggtagtggctcagctcggccgttggtgatctctcttggtttgaaagatcattcccagggaacattgaaagatgtagtttctgccattgttgacaaccgcctatggtgataactttgcaaaggttgggatgggcacataaatgttcagttcatttacagagacattgacatacacaagctgtcagagcaaaatcagccctcccttatcatgcatgaatctctagaaattatgtaattagaatttattccagattcagttatcatgagatgattttccccactaaaatgcctaatgatcaatatttccctaatgtaacttgaggggttgcgacttgaaacctattcaatc

SEQ ID NO: 9859 - DNA, 431 bp, Triticum aestivum
  Clone ID: PAT_TA_9859
gggaacttgttcatggtcttaccagttgccgctgaaccttcagtctcagatgtgttgttgatcagtcggatggtgtgcatgcctgaattaacttgctcgacagatgttgctgtttgttcacttcgtgatctgctccatgcatgtctggtctccagtccagcatctcatgtggttttcatttcattgttgcttccaccatttggagtctaagttagaaaggaaagaactctatttcacaaggtatgtattgtaatttttctctaaaaaaccagtgtaatttttgtccaaagttgtaccatgttttagctaggagggtcaagtgttctacaacttgccataaattactgaatctgtagctggctgtttctgctgagtgtgttgtttaatggaagttttccttcggaaagtaattttggcaactaaaaaaaaaa

SEQ ID NO: 9860 - DNA, 2230 bp, Triticum aestivum
  Clone ID: PAT_TA_9860
atttgctttttcatgttcgctccggcgcatttgcattaacatgaacaacactgtcagcgctcaggatattttatccgagcgtttcgctcgattcgagttcaatatgagcttttcattggattggacgctccacaaaatttggcaccttgaaaacgaagcgcacagcccaactactatagcttcaaactttggtgtgaacatgacaactcagctgctagttaaaacaaacaataacccagatttcattggttatgcgtccaccatataacctgcttacatggttcacggattagaaattgcagagcagcgtcactcttccatactgcatggccggtacaaccacccatctgacagggcgatgcgcctaagcacatccttctgacaggtcaagacgcctcagatacggtgtcagtggcagctctccatacataagagtccgttccacagatcggagcgaataatgtggatcgtccagtcttttaggcagcaattcttttacaagactgctgagcgccacttttacgacatccaatattttgaagtgtgtgatatcgacaaaacttgcatactcgtcattgtccataaatgggaaagtcttaccacccaaaatagaaaacccttctttaagtgcgtcaacatggtattggatgctggttgcaggtaaatgatcagtgtacgaactaataccatgggccatctggccaagcatttcaacagaggcagagcaattctttagccatgtttgatctagctgtgtttcatccggcctttctggtttcatcagtattgcatctaacgacgtgagcctttgaatggcaacaaggatgttgcggagcactgctaatttaaccaaaccaatccacctcagattttcaccaataataaacctcggtgcagctttcttgttcttacttttgagaggcttccctgcaacagaggtgttgttgaagtaacgtgaaacagtacatggccggtagttgggatcaatatatgacatcctttccgtagaaaaagacacaagcctcatgtccttatttttaatgtcaagagaagcaaacagacccaatggcttctcattgcttccaagtggccgggtcatcatgtaaagatagtcatcatctatgccaagggtaggagctaaacactccaacttactcaaggaaagttggcgtgcatcatcatcccgcagcctgtgtgacaacaaatcccaactttcatcggttaaaaggatgtcactagtatctacactaaagcattcagtccactctgacccgagattcctcttctgagttgtcgccttccaaccatggtcagtattcgaaccatagtcagtatcatcttcaccttggttatactccacctcaacaaacttcagtgtgttgccaatgcagatcacatccctaaacggcctaggacatgatgttcccaagttacatgcattagacggcatggggcaaggaaagctcaagaagcggaccactggattctcatcaagcacattgcagaaaagtataccacgccaaaggtcaacccaccccaatgaatccactccaactgtgattaccttggtggtatggtggttaaggacgtgaatcaggtcagcgtccctggtacactcaagtggtatcaccttgctgctccatgccttggtctgggatgtgtagagaaagagctcataagcaagatagtcaattttgagcttgcgcgtcaaggcagccacaacgtatcccttgccatggctgaggatgccaaccactttggttggatggaatttcagcataggtcggtctggaagcacctcaagtgacggattcccttggtcaaccctgtagacgagatagcgctgcaagttgaacattgccatggtaatggctagcagaacagcgttgccatcggtgctaacgacggaggcaccatacgacaacccgtaatccccaacatggacgacgaagccagatacatccggtgggctggcgaataagaaggaaacctccacctccaccaccacttcttccttcgactccgcctcacttctgacatccacgaatgttctggctgtggtagccaaggaagcagaacactcagccattgacattttctctccagtcgtagtttgccccgcgcactacggtgtcgaggaggacccagttagcatatatgccggcgtgctccggcggcggccgccgccgggcgaagaggggacgaaccatagatcgagaggggacgggat

SEQ ID NO: 9861 - DNA, 1188 bp, Triticum aestivum
  Clone ID: PAT_TA_9861
cgtccggcttgctgaggcaacacttgctctgttgcgtcaagaatcatgctgtcagcaagtcgagtcggatggcgaagatgatggtgacatcgatcatgatgaagtcctcatggacgcagtttcagatcttttgcctgcttttgcaaaagtgatgcgatcttactttgatcctatctttgcgaagttatttgaccccctaatgaaatttgctaaatctccacatcctccccaagacaagactatggttgcggccactctagctgaggtcgctcaagaaatgggtgctccaatttctgcttatgttgataagataatgcctttggcgttgaaagaacttgcatcttctgaggctacgaataggagaaatgctgctttctgtgttggcgagctatgcaagaacagcggtgctgcagcactgaaatattatccggatatactgcagggtctgcaccgtttgtttgctaattccgaacaagaccttgcagttagagataatgcggccggtgctattgctagaatgataatggtgcaacctcagtcgattcctctcaaccaggttcttccagtgtttatcaaagctttgccactaaaagaagatcacgaagaatcaatggctgtctatagctgcttatgtaatttgttgctatcatcacatccccagatcctcactctagtgcctgatgtgatacatgtctttgcccaagtggtagtctccccagatgagagtgatgaagtcaaaacaactattggcaaggctgtttctcatttaatatccgtttatggtcagcagatgcagccaatactaagtgctctaccacctgctcatgcgaatgcattggcagcatttgccagtagaagatgatcttcaggggaactattaccttcgatttttgtgtgtcgcccgagtgttttctcaagattgccctttgatgaaaggtttttcgggtatggttggggtcacccaagttttgtcatattagtgccatttgctgaagtatactggttagctggagattgtttgatcagcaaaacctccttttcgagttattatagtgacattgcattggaatggtgtttactgcggttgaaggtgcagtactttggctggcggctgcttcggtgagtcccgtgtgtattcaggttccttttttggcaacttgttatttgtttcagttttgcaattctttt

SEQ ID NO: 9862 - DNA, 846 bp, Triticum aestivum
  Clone ID: PAT_TA_9862
cttccgcggcatggccgcgctccgccacgcctacctcaacgacaacgccttcgacgccctcccgaaagacttcttcgacggcctcgacagcctcgaggagatctgcctcgacaacaacccgctcaacaagaccgccggcggctgggagatcccgcccgcgctcgccgcctcctcgccgcagctgcagagcctgcgcctcaccaactgcagcctcgtcggcgggatcccagccttcctcgggggcatgaccggcctgcagatgctcaccctctcctacaacagcctcacgggcccgatcccggccaccttcgccggctccggcctccagaagctctggctcaacaaccagctcggcgaggccaagctctccggcacgctcgacgtgctcgccgggatggccgacctccagcaggcgtggctgcacggcaaccagttcaccggccccatccccgacgccatctccaactgcaagcagctcgtcgacctaaagctcaacaacaacgacctcgtcggcctcgtgccgcccggcctcaccgccctgccgctgctccgcgacgtcaaagctcgacaacaacaaccttcgtcggccccgcccccgcgctcaagtccggcaacctcacctcctcccataacggcttctgcgccgtcaagcccgacgacaagtgcgcgccggaggtcatggcattgctccagttccaagccgaggctggttaccccgtcaagctgaccggttcatggtccgggaacgacccctgcaaggcctggctgggcgtcacctgctctcagggcaaggtgtcggtgctcaatctgccgtcctctggcctcaatggcaccatcagcaagagc

SEQ ID NO: 9863 - DNA, 577 bp, Triticum aestivum
  Clone ID: PAT_TA_9863
ctaccaacccaacccaatccagccccaggtcccagctcgtcgcggctctgactgaatccccccccttcaccaccggacagctaccgccgaccccccttcaccaccgctctcccccctccgacgccccgatcccacccgcctcccccctccccctcccctgccgccgcccgccctccctcctcgccgccacgtcggttcgcgccccggccgtctcctgcccgtccgcgatctcaggccgattggagatacgctcgtcgattcagccatcgtccagcgagcaggagagatgcaggcatctagagctaggctcttcaaggagtacaaggaggtgcagcgagaaaagtcagccgacccagatatccaattaatctgtgatgattcaaatatattcaaatggactgctgtaatcaagggcccatcggagacaccttttgaaggtggcgtatttcaacttgcattctcaattcccgagcagtatcctctactgcctccgcaagtccgcttcatcaccaaaattttccacccaaatgttcacttcaagactggtgaaatatgcctggatatatcgaagaatgca

SEQ ID NO: 9864 - DNA, 1133 bp, Triticum aestivum
  unsure (1)..(1133): unsure at all n locations
  Clone ID: PAT_TA_9864
ccccgtccccaacccaacccaatccagcccagctcgtcgcggctctgactgaatccccccttcaccaccggaacagctaccgccgacgccccgatcccgcccctctccgctccccctcccctgacgccgccgcctatcacgccccctcctcgccgcgacgtcggtcgcgcccctcccgtctccgccccgtccgcgatctcaggccgattggagatacgctcgtcgattcagccccgcggccgtcgtccagagaggaggagagatgcaggcatctagagctaggctcttcaaggagtacaaggaggtgcagcgagaaaagtcagccgacccagatatccaattaatctgtgatgattcaaatatattcaaatggcactgctgtaatcaaggggcagcgagaagactccgccgacccggagacccaattaatctgtgatgattcaattatattcaaatggactgctgtaatcaagggcccatcggagacaccttttgaaggtggcgtatttcaacttgcattctcaattcccgagcagtatcctctactgcctccgcaagtccgcttcatcaccaaaattttccacccaaatgttcacttcaagactggtgaaatatgcctggatatattgaagaatgcatggagccctgcgtggaccctacaatctgtttgcagagccattattgcgttgatggcccatccggaagcagacagcccacttaactgcgactcaggcaatcttctccgctcgggcgacatcagaggctaccagtccatggcgcggatgtacaccaggctagctgccatgccaaagaaagagtgatttgcagggttgcaaaggtacaccagagcagtggcgctggtgctggctgattgattcatgcatgtatcaactctctaagttgtcaggtgtaactcgtatgaacttgtgtggcctgattttcttacccgacttgtcgttgtgggtgaaatgttgattctgttgggctaaaaaggatttaagcgtaaacgcttgattcatgatgatgtgtaataaataatcctcacagggatttggtacactcctgtacacttngagttgctgaagcctcnatgcccctanatatacncattggnccttgcagttaaaaaaaaa

SEQ ID NO: 9865 - DNA, 748 bp, Triticum aestivum
  unsure (1)..(748): unsure at all n locations
  Clone ID: PAT_TA_9865
tcgcaactcgttcactctttctcgcgccacctcgtgcgggattcagtgtgtttgtctgtgaggcatggaccgcagcagtggcagcggcgggatgggggccggcgtggggctggagctgcagctgtacctgccgccgccggtggggatggacgtggacggccacgacgacagcgggtcgccgacctcgagctcctccgtatcgtcaaaccgcaggacctagttccacgttgccgatcgtgacctgggcccggacccggtgcctcatctacggcatggtggccgataagccttaccccacctgctgcaactgcacgcagctcttgctcgtggacctgctcgacgacggcggggccggcgggggccggtcagggcgacacgacaagaagcgcgccaagctcaagtgaagaaaaagcagccggcgctgggggcgcgtgcctgtccagtggcggctcatacgcacggttagcccgatcaggcattgtgggaatgtaggagtgcgcgacctgcctcaccgccatccagtcctcccccgtggacctgtgggtctccggctaccccgctgcgggcgttacctgggtccgtgcctttgtgttgcgggggctcgtctgtttaaatagcgtcggtgcctggttccgaattgctctgggggtgccgggggcctcctaggttggtatcccccggttgcctggagatgcgcgacccctctctcgcggtctgcagctgcgctgccggcgangttgtctccaat

SEQ ID NO: 9866 - DNA, 995 bp, Triticum aestivum
  unsure (1)..(995): unsure at all n locations
  Clone ID: PAT_TA_9866
ggnctgcaggnaattcggcacgaggctctgctcctcccctcgtctcttctactgctgctccctcttccctgctgcccttctctcaatcccacgctgctgctccttcttctcctcatcagccgatccccttttccccatcctctccctctctactcctaactgtagatcgaggtccgtcctcatcagccgatcctcttttccccatcctctccctctctactcctaaccctagattgaggtccataacactcctctccccgaacaacaatggcggaagacggtctcaacgactacgagcgccttcgccaggagaacatccggcgcaaccaagaaaagcttgcccccatccgccgcaaggccgacgagctctccgcccccatccggctcgctaaacctaagcgaccgtatcaggtcaggcccaaggccccgacgggccccgtccgctcctccggccgcgcccgcggcatcgctcccgacaacctgcccccggatctcagcctcacaccctcgctcgcctcctccatcctcgggggcggggctgggaccaatgttcgtgcggcggacgacttcaatgctgggaggggcatggtgctgatgcgcgcacacgtgagaaacgtggtgccctgtagcatagagtcgatgcgggtcctcccgctcgccgaccagaccgtggtggcggcgggggacaaaagggggaatatcgggtactgggacgtcgacggtgtctcggaggatgccgacggtgtggatggggtcgtcttcagttattggccacacaagtgccctgtgtcagcaatcgtggcgcaccaggtggcaccacacaaggtgaccttccttcggctcttttttcattttcttgggactcctcgttagagtcatccaataggtgcatctgctaatcatgatcaaggtagctaaattaggttggatttatcccatttccagtgcgcaaatagttatttgatgttgtatatctcatnaatttctctatcaat

SEQ ID NO: 9867 - DNA, 604 bp, Triticum aestivum
  Clone ID: PAT_TA_9867
tgccgagcagattgggatgaaaatgtactcctggaatgatttcttaaaaatgggaaaggataaaccagttcaacctcgtccaccgcaaccaaatgatacatgcaccatcatgtacacaagtggaacaagtgggcaacccaaaggtgttatgctgagccatgagagccatgggatgtatgtaaaaggggtggacctcttcatggaccagtttgatcgcggccgcgccgccgaggatgtatttctttcttttctcccacttgctcacattctcgaccgcatgatcgaagagtatttcttccacaaaggagcctcagttggctattaccatggagatttgaatgccttgggagatgatctcatggagttgaaaccaaccctactagttggggtgcccagagtgtatgaaaagatttacgaaggtattttaaaggccttagcggatctcagacctctcaggagggtgatttttaatgctttgtacaaccgcaaactagcaggcatgaaagcaggctacacacaaaaaactgcttcacctttcgctgacatgctggcttttcgcaaggtcaaggcaaggctcggtggccgtcttcggtcgacgcggccg

SEQ ID NO: 9868 - DNA, 1107 bp, Triticum aestivum
  Clone ID: PAT_TA_9868
ccgcccccgtccccgcgcgaccccgcccccccccgtccccctcgccacccacgccgccgtcccaatgcccccaccacgacacctccccatccccttcgccattaccgcctctgcttcgcgttgcacggcagctcggcctcttgcttcgaaggaggaggtccaagtgaaatgggtttaagattccacatctgttgtttggaggagcttttgatcaccatgcgcttgcctttcaatgttgaatataagctaatcgctcttgaatctcttgtgatgtatggtgtgaagatgctattgatggtcactaaaagctcacagctgaagaattgatatgatgttgcaaacgatttcttttactagccaggtgatctatcaagtagaccaaccctagaaaaccgcgcagagatcacacaacaaaacaagcaagtgctgctccccccggcgcctctaccggcactcctccgcgctccacggctgctcagccgcttcctccgatggaggtggttcatgaggatctcaagtggcggccattacaggctctcgcctgcggaactggtaggaggttgcaaacgatttcttttagtagacaggtgatgtatcaaatagacctgtgcgcgaaaagcgtcctctgttctcccccctctggctccaagtgctggtcccacccgtggttcaacttggtaccatctctactccactgttgccccactgactctgcgattgggggtggttcggtaagttctgaagaagcaaccatcacagccagtggcaatcgtcacatgtagaaggtcaccggtataatacttttgcatccacaagttttaagagggtgttttgtgagctaaaaggatcttctgttgtactccctctgtctcaaaataaatgtctcaaccatagtacaactttgtactaactctagtacaaagttgaggcacttactctgggatagagggagtatatgtttctaactaaaaccaggccttatattttgctcttttttctatgatgtaatattggacttatcagaacctacaaatgtatgtatgtgcatgtagacatgatggatctttgtgtttctggctatcatgtaatactggacttgtaacccta

SEQ ID NO: 9869 - DNA, 917 bp, Triticum aestivum
  Clone ID: PAT_TA_9869
gcacaagagagaaatcctaccccgagcggagagagcggagggcgaccggaggactgctcgctcgctcgctcgtcggtggtggttccgccctctctccctcccttgtccgcgctgcccaggtgttagctgatcactacttcactaggagcgaaaaggagctaccatgggtatttcatccaagtggatcaaatcacttgttgggataaaaaagcatggaaaagctcaaaatggcgaaagcagcagagaaaggagctctgctgctcaggtgctacacaaacggaaacattctgtggatactgaaggctcccttgcagttgcagaacacacagtgcaaattgaaccattggctagtgacaccaatacacagacaatttcatctgagactgaactaaatacaaaggagcatcaggctgcaacagttattcaatcagcctttcgagcattcttggctaggcgagctttacgggcattaaaaggattagttagactccaggctctcgttaggggccatgctgtacgaaagcaagcagcagaaacacttcagtgtatgcaatcactagtaaaggctcaagctcgtgtcagagcaagacagggttcgatttgttttgaaggggtcaggtgccccagaaaaaagcttccgaaccaaaatgcttcggaggatcaagctcgaaaaaatggaggaacgctggtggtggtggtaattggcttcggccgggtgtggcgccagcggatcggcggaagaaatgcaagctaaagtattgaaaaagcaagaagctgccgctaagcgggtaaagagcaatggcatatgctttaacgcacccgggtttccaaggaaccacaaaagggtgggcgccagctggccccgggccagaggcggatgataaccagtgggggcggaactgggtggagaggtgggt

SEQ ID NO: 9870 - DNA, 861 bp, Triticum aestivum
  unsure (1)..(861): unsure at all n locations
  Clone ID: PAT_TA_9870
gggcaatttgcgaacttggaggaagatggaggaaaaggcggggcacccgagaggaagcatgtttctctgccgaggactacaacagttcactctaccccagttcctacaacaaatggtccggcctaccaagctcctcaaaggattccaacagctagaccaggccgagtgattgcctcagcgacaccgaccaagaacgcggccttcgccgaccgacaaacgggccgaaggatggcgagggaccccgcggctcccccagcagcagcggctgccggctaccaccagaggccggactgctccgacaggcaacaggaggtggagaaggaccgcgcgcactacaggccggcgcaccatttcagggacgccagggtggcgcccgaggccgaggcgcggccctcggcgtaccacattcccccgttcaacggcatcgccgcggtcgccggcgggtacagcaaggtcggcgtggcaggaaggatgtactagcgcaattgctgggcgagtttgccgggagctggaggacggccgcgatcgatggccgttgtggggaatgcaggggctgggagggtctcaaatttaggacgtaggagacagccggacaaggtggtgctcttgtgtgcatacatattaccggcagccaaattggctggttctggtctgttttttctgggtggatagataggttcaaagttggaacagtgtgctctgctctgaggaggtgaaagcgcctctgttgaggaggggggagggggttgggggctgtagagtttttctttcctgttttgtttccggatggtgttaatacgaggatggatgantaantggatgatggaagctctgatgggnttgttcntcggtntaaaaaaa

SEQ ID NO: 9871 - DNA, 1175 bp, Triticum aestivum
  Clone ID: PAT_TA_9871
tagggttgatataatatgtaatgctgcactttatgggtttggaattgaacacaaaatacagggttatatacgtgatgctgcatttgatcctcgtcgatggcttgcaccaggacagctctccattcatcctgttccttgtaattgcctagtaaattctgaggttggcactggggatattaatgtgaaagtaggccagctgtgtgataagggacacagatggatgtgttccaaaacaatttctgattgcgtcgaagctataatcggtgcgtattatgtagaaggtggcttaagagcagctatggctgttctcaaatggttgggaattaatgttgaagttgaggaagaattgattggtcagttcttgagtgcatctgtgcagacttatcttccaaaaaatgatgtaattgaaaaggttgaagcaaaactaggctatgtatttttgatgaaaggtcttctgctagaagctcttacccacccatcactgcaggaatcagcagaaggatattcctacgagcgtctggagttccttggtgatgctgtcttggatattctcttaacacgacatcttttctatagtcataaagacaccgatgagggggagctgacagatttacggtctgcatcagtaaacaatgaaaattttgcacaactcgcagtgaagcataagttatatcagtttctccagcattcttctgggaaattaccagaaaatattactgaatatgtggatagtttagagaacccttccatggacaaagtcaaccttttatcagatgcggcattaagagggcctaaggttctgggtgatgttgtagaaagtattgcgggtgcaattcttatagatagaaaacttgatttggaggtagtttggggtattttcaaacctcttctttcccctattgttacacctgagaagctggagttacctcccttcagagagcttctcgaatggtgcaacaaaagtgggtactttctaggaattaagtgtacagatggaattaagcgtaccgatggagacaaaatagaggctactctggatgtgcaactcaaggagacgctccttgtcaggcaaggttgtggcaagagcaaaaaggatgctaaagcacatgcagcttccatgttactcaaggaccttgaggtggaaggacttatagtaccaaagaatgcaagcaaca

SEQ ID NO: 9872 - DNA, 455 bp, Triticum aestivum
  Clone ID: PAT_TA_9872
gcttctgttagcggcctatggaaaaggactcgtgctaccatcaaagaagttcagcaaaacacaaagagtgctgaagcaagaaaccaacttgacattgacagggatgcctgattgaatcgtcagtaattattagttggtattgacaattgctgtaaataatttggttattcacaggagccctatcatgtactacctccatatcaaaatataagacatttttgcagttcaaattgaagtacaaaaacgtcttatattttggtacagatgtagtacataataactcgagagagatcttaagttcttaactcacttcacggaagcattattgatctaccgtagagtttaacaagctagtgtacattgaccatgaatattgttaacttttggcggctgagaagtgaggcaattgtactgatttaattgatgtgatcaattttgcacatctaaaaaaaaaa

SEQ ID NO: 9873 - DNA, 1191 bp, Triticum aestivum
  Clone ID: PAT_TA_9873
cactgtttagcctatcacttgtggatgagaacaaggtgacgataggggcttctggggcaattccagctttggtgctgctattgggtaatggaagtcaacggggtaaaaaggatgcagcaacggcactatttaacttgtgtatctatcagggcaacaagggtaaagctgttagagctggattggtccctatactacttgaacttctaacagagactgaaagtggaatggttgatgaggccctggctatactggcaattctctcgagccatcctgagggaaaggcagccatcagcgctgccgccgccataccaattctagttggagttatcaggaatggatcctcgaggaacaaggagaatgctgcggctgttctggtgcatctctgtaatggcgaacagcagcaacagcatcttgcagaagcacaggagcagggcattgtgaccttgctggaggagctagcagaaagcggcacagacagggggaagagaaaagcgatccagttgcttgaacggatgaataggtttctgaagcagcagagccaagcccagggagacgcgatggcacaggcgcatgctcagtcccaaaccctgtcccaggctctggttcaagttcaagcagatactcagctagaggaatcactgcctcctacttcatcccatcttcctgagagatgaggtgaatgatcattagctccccattctaggtagtggtttgtttttgggccgtctgccaggtggaagacctcctgcaattcttgctctgcaggtgtgcgttttggctgtacaatgttgtcaggaataggaaggcccggcagcgcagcgtgatttagggctgtgagcatgttgacaggtcagttttgcaaccatggttggtgctgttaacccgtgtttgtttgtagttggtacaatgtgtcggtgattcaaggtaggatcctcgagttttagggaggtatatcgtcatgcttgtactgggtgcctggtacatgactaatttgtggcttcctagggtggtaattttacttgtctgagaaagaagagagcttcagtaaagcctagtttttgtgttcagctaagtttctgctctggatactttccaagagaatagctggagcatggattgttcttgacgtgtaacttcaagaaatccatgtggtggtgttctgacttaaaaaaaaaaaaaaaaaaaaaaaaa

SEQ ID NO: 9874 - DNA, 728 bp, Triticum aestivum
  unsure (1)..(728): unsure at all n locations
  Clone ID: PAT_TA_9874
gatcttcacaagncactctcgattgcgcatcatacatagagatctcaaggccagcaacattctcttggaccaggacatgaatcctaaaatttcagattttggtctagcaaaaattttcagctccaatgacactcagggaagcacaaagagggtagtgggaacatatggttatatgtctccggagtatgcatctgaaggcatttactcaatcaaaaccgacgtgttcagctttggtgtgttgcttcttgagatcctcagtggaaaaaggaattctcgtttccatcaacgcgaagactttcttaaccttcttggatattcatggcatctctgggaaggaggaagttggcttgagcttctagatgtatcaattgttacggaggtccatacaacagaggctagaaggtacattaacattgcactgatgtgcgtacaagagagtgcggatgatcgacccaccatgtcagatgttgttgcaatgttaaacagcgagagtgttattattccagagcctaatcctcctgcatacgtcaacgtaagagtatctaaggtacaccaatcagctagtgttgttgttccatgcagtaataatgatgtaaccatcaccgaagagccagatggaagatagttgataacttcgtatcagttgttacatctgagttgtacactaatccacaccaaactctagatgttatcgctacattatctgctgaagacgcttaaaaaaaaaa

SEQ ID NO: 9875 - DNA, 1532 bp, Triticum aestivum
  unsure (1)..(1532): unsure at all n locations
  Clone ID: PAT_TA_9875
gggagctccgcgctcccacccgccggccgctctccgcccctctgcaggtcctccaccacccgtcccgtcccttccttactctcctcccgcgaggccccgtccccgccccgccttctcctctcctcgccgccgtcgactggacgacgccagctcgccgccgtccgcgaaggcgacgaccggcagcagcggcccgaatcgaggagcgagggccctctcaggtgttgagtgggccaaatggcacagattccaaacctcgataacgccgcgctcaatcttactgccctgagggagcagtcacagaaggaacttctcagcataatcaagagtattagggggaagaagtgtctggtcattgatccgaagcttgcgggtaccctctcgctgatcctgcagacctcggtgctaaaggaatatggcacggagctgcggatcctctctgctgaccctcttcagacggaatgccccaaagtggtgtatcttgttcgctcccagctgaacttcatgaaatttgtggctaatcaaattaagaatgacgaatccaaagggctccagagggaataccacctctattttgtaccacgccgtatagttgcctgtgagaagattctggaggaagagaaagttcatcaaaagttgacaatcggagagtatcccttgtatctagttcctttggacgaggatgtcctttctttggagcttgactattccttgcaggaatgccttattgaaggagatacaagttctgtctggcatgttgcaaaagctatccataagttagagtttgccttcggggttatccccaatattagagccaagggtgtagcatcaaccaaagctgcagaattgctgaaccatatgcaactcgaagacccggtcagcatggataatatggggattccagagatagacaccgttattttgctagatagagaggtggatatggtgacccctgggccctcgcagcgatcgtatgaaggtctattagacgagatgttggaaattcataatggatctgtggaagttgacgccagcattatgggtgctcaacaagatggaaaaaaggtcaaggttccactcaattcaagtgataagttgtacaaggagattcgagacctcaacttgcatgttgtagttcaggtcgtccgccaaaaggcaacgtctattcagcaagattatgcagaagtaaaatcaacgaatacacagtcggtttctgagctgaaggattttgtgaagaggttacactcgctaccggagatagctaggcatgttaacttggcacaacatttgcaatcatttgcggcaaaacccgcatttcatgcccgagtagagattgagcaaataatactggaggcgcaagacctatgaaacgtgttacgagtacattgaggaggatttacagaagcangnncctattggaaacggnncttcccttccaaggnnntttccctnaaaaagggggggtttccnaaaaaaaattttggcccctngngggggaaaatncgncaaattanggnttnggcaaatnccctggt

SEQ ID NO: 9876 - DNA, 244 bp, Triticum aestivum
  unsure (1)..(244): unsure at all n locations
  Clone ID: PAT_TA_9876
nccgggattgatncgcccaagnaatgcggcctgcagtagatctgagcaacggcgaagccatccttctgaataagtggatcgggactcttcttattttatcttcttttatttacaagtgagaaaggagatctggaccttgtgttgtttgtgtgtacgatgcgaaccaaagtttggcgtataaataacactgtactactccctccgtttctaaatataagcgcttttagagatttgaaaaaaaaaa

SEQ ID NO: 9877 - DNA, 688 bp, Triticum aestivum
  Clone ID: PAT_TA_9877
taccggtccggaatttccgggtcgacccacgcgtccgccatttcgcacggaggcaccgaggacccgagccatggcgctgccgctggtcctgctggttctgctcgccgctgtgacggcggcgagggaggcgcacgggtacgtggcgtacaacacgagcgcggggacggtggccgggctgctgaacgtgcacctggtgccgcactcccacgacgacgtcggctggctcaagaccgtcgaccagtactacgtcgggtccaacaactccatccagggcgcgtgcgtgatgaacacgctggactccgtggtggacgcgctggccagggaccccggccgcaagttcgtcgtcgcggagcaggccttcttccaaaggtggtgggtagagaaaagcccacaaatccaggccatagtgcacaagctagttgattctggtcagctggagttcataaatggtgggtggtgtatgcatgatgaagctgccacccattatattgacatgattgatcagaccacacttggtcatcgggtgattaaaaaacaattcaacaagactccaagagctggctggcaaatcgatcctttcggtcattctgctgtgcaagcttatttgctaggaacagagcttggtttcgactctgtgcactttgcaagaattgattacccagatagggcaaagcgtaaagaccataaa

SEQ ID NO: 9878 - DNA, 961 bp, Triticum aestivum
  unsure (1)..(961): unsure at all n locations
  Clone ID: PAT_TA_9878
tctctcatgtgataaaaatgtagcttaaactgttgctaatgtcgtcacttcacttcctttcatctttcttggactgcagacaccaagttctgcagaaagaccttgaatactacactttatgctaactcactaattggagttggagttgcatctagcttgtatcatacttcacgaggagaaatcagaaaatacatgcggtgggcagactacacaatgatcgccaccacaacactgtgcctaacaagagcgcttcgggatgaacatccaagattactaatggcggcatcaacgttgctcctgccattccagcccttgatggtcacagcccttcacactgggatgatggaggtttcatttgcgaaacgagcatcgacagaaccagagctcaagacggcacataacctccacaggatgtcgtctctgctgggtggtgcgctgttcatcgccgatgatgtcttcccgcagaccccctacatccatgcggcatggcatctagccgcagcgttaggcgtctgcacatgcaacaaactccttgaatgacggcataatgagcttatatgttcttgcattgcccctccagctgtcaacaaactgttgatagcaattcatcaacctgtcgacattttcaactgcacattgcataggatcggtttacattgagccgaagaacattggagaattactagagtatattgctctctcggggttagacggcctaaggtataagtttgtaactgtatttgttgtatatgtatattgtatgtcgtaattgttttcccacaaatactgtgattagatgtaaagatattttgtacttatgttctatatttgctgttgtagtttagtagaatgaagacaatttggttgttggcattttcctttctgatcattaccttaagttgatatttttccnctgttgacatttcgaagaaaagaacatattaggttaataaaaaaactt

SEQ ID NO: 9879 - DNA, 590 bp, Triticum aestivum
  Clone ID: PAT_TA_9879
tcggcacgcggcccgcggcggcggcgcttcctgtagccaagacggcaccggatccgccggaaatcgatctgattagctctctccccggtgagatcctcagcataatcatatccctcctccccgtcggctccgccgtgcgcaccacatccctctcccgccgctggcgccccctatggcgctcctccccgctcaacctcgacgtctcccacatcgacgggcgcggccgcgaccgcgccgccgccgtgtccaagatcctctccgaccacccgggccctgcacgccgcttcctgaccgcctgcctccagatcaccgaccccgacggctggctcggctcccccgccctccgagacctccaggagatcgacttctggctccctcggtacgaaattccgatgccactgtccattctccgcttcgcggcgaccctgcgcgtggcccgcttcggcaattgcaggttctttgagtacgacgcgccaccgtcgtttaacttcccttgccttgagaagctcaccatgagatttattttcgtacgggaagacaccctccactgcctgctcgatggctgccctgtcctcgagagcctgctgctg

SEQ ID NO: 9880 - DNA, 1199 bp, Triticum aestivum
  Clone ID: PAT_TA_9880
tctcacgcgtccgctggaattgctctgaagatcttccttatactactcccaagcatcgtccggtttatgtcaaaggttgaaggattgacatcagtgtcttcattggaaagaagatcggcaccgaagtactatatcttcttattctttaatgtattcctggcaagcatcattgctggatctgctttggagcagctacaaacctatcttcaccagtcagcaaatcaaataccaaggacaattggtgtagcaattccaatgaaggcaacctttttcataacgtatgtaatggttgatggatgggctggggtagctggtgaaatattgagattgaagccattggttattttccacttgaaaaactttttcttggtcaagactgagaaagacagagacgaggcgatggaccccggaagtattggttttgattcaaatgaaccccaaatacagctctatttcttacttggtctcgtctatgcagtggtcacgccgtttttgcttccattcatattggtattctatgtgctcgcatacgtggtctaccgccatcagataataaatgtgtacaatcaagaatatgagagtgcggctgcattttggccaagtgtccatgggcgtataatcacagcattgatcgtatcacagctgcttttccttggattattaagcacaaaaggcgcaggccagtcaacaccagtgctccttgttcttcctgtggtgaccttttatttccacaaatactgcaagaaccgctatgaacctgcttttgtggaatatccattacaggaggcaatgaggaaagacaccctagaacgtgcgcgagagccagggtttgacctgaaaacgtacctggcaagtgcgtacatccacccggttttcaaaggcgacgatgacgatgagaaattctccatgatggatgaagcggaggcagaccaggtccttgtggcaacgaagcggcaatcgagacggaacacccctgtcccgagcagacacaacggttcagaagcaccttctctgcctgaaattgtaaatgatcagcgactatgatagagagtttggaagtgtacattgagtaaaaagcacagtaattcgtttcggtattgctttttctttttgagttgccggtattgctttgtcacaataaggaacaatggccaatgttatattatgtacttggaaaaaaaaaaaaaaaaaaaaaaaaa

SEQ ID NO: 9881 - DNA, 646 bp, Triticum aestivum
  unsure (1)..(646): unsure at all n locations
  Clone ID: PAT_TA_9881
cggcacgagcattcgccaccaggcagcgatggggcgacggggcggacagcgatgccggcgttcttctcgagcgaatttgacctcgacctcgacctcgacctcgacctcgacggggcaacgaggtggaaagcgtcgccggcctcctcctccggctaattcgtttgtcagtatagctgctgatttggggaatcatgggttgatcatggtgttgtttgagacaccctcgggctttgcaattttctattttgacgggatcagcctctacgaaccagatgccatggagaatatatgggcgcacttcgtcacggaatatagggcaagacatgtcatttggcgaaaagactttcaagtttttaaggacaagtctgatgccattaaccatgatagtggtcttaacaatcagcttactaacatgctcttgaagtggtaccaacctgggcagaaacttgctgttggcaagattgagtataaaatagtcattgaagcaaacttgggaatatcctgcctgtttgatgaacctgtaatggagctgatgcgtgggctgaactatctcatgcatagtgtagttcctgaagaaaaatcaaagctagccgaggagcactgcctccagacgagtcaagggctgaaaatgctccttcatcgntat

SEQ ID NO: 9882 - DNA, 720 bp, Triticum aestivum
  Clone ID: PAT_TA_9882
gcctcgtgccgattcggcacgaggtatcccttctcttcatatccactcgcatctccctccccatccacccacagccggggccgcgcgcggcgccatggccgccggcaactggatgcgcctcattttgaatcgtgtgcggatcacccgcaccggatgcattcctctccatggccgcccacagccaggggcttgctcgtcgccttgtccgcggcaactggacgcgcaccctttccatggcaaccgcagccagagcttcgctagtcgccatgactaacctgcaatcagccgcggcggcgacgagtttgtgctggagcccagggttgctggaaccaggttatttttttgctggatccacccactttttttgctacaacccctttcttttttgctaccatccccattcgatttgatgaactcttttcgtttttgctggaaccggtgtctcgatttgcgggaagcatttggtggacgtgctgcaaggttgacagctcgccggaggaagctgcatccagtggcgaggagggctgcatccaacgtcgttcaaacgccgggagttgcaaccatgtacgccggagctacaaccggtgaccaggggtgttgcaagagggagtggccgtttttgctgatgcgtctttttttggtgaaccaaatttttgtttttgctggaaccgatgaatttctttgctggaatagatataattttttgcttcaaaaaaaaaa

SEQ ID NO: 9883 - DNA, 636 bp, Triticum aestivum
  unsure (1)..(636): unsure at all n locations
  Clone ID: PAT_TA_9883
gtcgagcgccggcccgggcaggtactcaatatttcaattttttgttgggtcgatttcaaagcaaagcgagatgaaactgaccagaatgttaaggactgaaaggaaaaaaggaaattaaatttctactaggtaaaggataggtgaaattttctttccatagttgaataacctttgagtcgcttaatcctgtaatcattgaaaccatttattttagatatcgtgttataattgttttttattttttttgggtccaaaattttatttgataacaaggccgcgaccacactactttttgtttgctgggcctcacctccaagcatgccgagccggcccactgtgctttcggccttaagggtagtaggaatttaaattcccacttggtaaatcataagtgaaatgttctttccatcgtcgaataacctttgtgttgtttgttcatgtaatcgatcaaaccatttgttttagagatcatataataattgttttttgttttttcatttataatttatttgagcataagtctatattaatcgggccgacccggtgacattcggtccgggacaggggaaaaancctgggggttanccaaaattaaatcnccntgganaaaaancccccttccccannngggggtaa

SEQ ID NO: 9884 - DNA, 369 bp, Triticum aestivum
  Clone ID: PAT_TA_9884
gattgtgatcgccattgtataatgtctgtgttggggtatctgcttctttcatgcttggaaacattgatgaggggatgtctgtccacaaaatatggtaccagtgttcatagacatgttgaagatgtcgtatatggaaacagataacaaaaaatacctgatgtaaagctgacttgtgaaagagtttaattgaactgaaggtgacgacctgtgaaactgacaggttaattgtaaagctgactcgtgaaacagtttaattgaaccgaaggtgtcaacgtgcgaaactgacaggtcaattgaaccaaagacctgggattgtgtcacataaaaaatcattggagataggatgtatttgtagcaccaaaaaaaaaa

SEQ ID NO: 9885 - DNA, 1483 bp, Triticum aestivum
  unsure (1)..(1483): unsure at all n locations
  Clone ID: PAT_TA_9885
ggccatgcaatgatctggcttcttctcttcctcccacaaaaagagtctcgtagagccgtaaggctgtctgggttccggccctacacatgccatgcaatgatctggcttcttctctccctcccacgaaaagagtttcgtagagccgtaaggctgtctgggttccggcaggaactagttctggacggcgaagccctgccggatagatgacaccgtatgtgtgcaactctgtagagagatcgtagtttcggtcttagttcgtgagtgcctcccgaagggctgtccgtgtgaccgtccgagtttcgaaggtcctcccgaagggctgtccgagtgaccgttcgagtttcgaaggtcctcccgaagggctgtccgcgacaccgtccggggggctgttcgaccgcctcccggagggctgtctgacgagcagatgagggtatacatcctcgcggttgggaggttgtaaatcctagctgcggggatctgcaccgccgatcgtcatcgactctacttcccgctgcgctacgagtcggtaacgaaaaagatcaaaccctgtatgcagtctccatagtggtcctgggctggtgcgtaggtcggaaattttttgttttctgctgcgttcccctacagtggcatcatgagccgtgctatgcctagatgcaggtttcgatctagaatacatggagatgtatgggtattgcataatataattaggtagtagatgagatctattgctgaaaattatttatgcgggtgacagatgaaatctgttacccgaggttcttgttgcttccctagaatttgcgtttgcccaatctcgagacagcatggtggaatttgacaaagttctggcaatccgtgatcctgattgatcatggaagtgctatcagttctttgggttctgccgtagtcaaaagaaagatgaaattcgcagatgaaagggcattgcagatatgatctgcacgggggtcatgcgtatgacgaagtttagtatggggctcgagatttaattatcccgtgtttcacacaccccgagatgttaatctagcaacctgaataatcatacttgctgataaaacgttggtagctgcggtttaagtcaaaaccttagaagccacgtaaaataaatttttgcataaacctattagaggcgtctaacttggttttgcaggatgtgcatgtgatgtggtatagcagtgctcatactaattcgattatgtatgagatgactatatgatgtaatttgattaacatgacctgcgtgtcatgattcggcatgatggctggagccatatgattgcattttaatgacctgcgtgtcaaccttgttgtaatgcattattgtgttagctatagagatagcaatattatctggtgcatcgacaaggtggtggcaatcttcgtgaaggtgaccaccgacacgaatgccgaagacgaagaaatgaaatacttnctccgtcagaaagggctataccatatcatgctatta

SEQ ID NO: 9886 - DNA, 647 bp, Triticum aestivum
  unsure (1)..(647): unsure at all n locations
  Clone ID: PAT_TA_9886
ttcggcacgaggggaagatacatctcccgtnctggcagcctgcttgcttccccgagttcttattctgctttgaattcgtgattttactttatttgctggtcgagttccggttccgtcttccagctctgcggtgcgtcagtttcggctgctgtgttcgctcttgatttgccggtgagatctccgattcgaggcttgctccttttctttctggcccagttcatgtgttggtttggtttcggcgtgccgatgatgatgcaaaagcatccggtgaattctggatgaatgcgcttgcgcaccaccattgcgcacagctctcgtgatatccactgcgtaatactctgaggcacacatcctttgaattcgtgatttcattttatttggctggttgagttccggtttcgtctttcagttccgcgctgcgtgagtttcggctgctgtgttcgttgattatgccggtgagatctccgattcgaggcacgctccttttctttttggttcagttcatgtgttcttttttcgtggttttggtgtctgcgtgccgatgatgatgcaaaagcttcggtgaattctggatgaatgcgcttgcgcaccaccagtgtgcgcggctctggtgatatccactgcgtaatactctgaggcacgcatcc

SEQ ID NO: 9887 - DNA, 781 bp, Triticum aestivum
  Clone ID: PAT_TA_9887
tcggaacaacctttcgtgtccccgatattatctcgtttcctgaacaatattattttatttgctttatctgccaccatgaattcctagagttcctttctctccttccaaatgacattcttagatgtgattctattagaaattttgtgccatgacagaagtaatggttgattgctctggtttagcctttatgtcagttgttgctgagggtccagtttctcatttttcagaatctgtagtagcagggatgtgtataatatggataactgaactggtgtttaggggtttcagtgcaggactgctacttgctcgattagttagatcaactggtgtttagagatttcagtgcgagtgatgttcctcgattgcagggcttcgagatgcaccatgaggattgaaacaagtcttatatagggctgctaaattattatgcttttggtcttttctgaatttagttagcataaatacttccagaatacctcttataatatggaagtctgttggtaacaacactgattttgcaagtttgtggaacatgcttcatttttgcaggtaaaagaaggaatagaacattggagaaaaaggcagcaggacggattctctaagctttctcaaatgtttgaacaattagaagatagttacaatcatttttctcttgccttattacatcttgatgttaataggctttggaaggtactatgcgccccgttcaaggtttacagaattttcaccatcctgtggccgtggcagctgatacccgccccgcccagggccccctcgcgtg

SEQ ID NO: 9888 - DNA, 684 bp, Triticum aestivum
  Clone ID: PAT_TA_9888
cggcgacaaccccctcccctctgcttctatcccgccgacccgctcccgttagaaccctgtctacacacccccatcccatcccaggattacccgtcctcctcgccccgatccgtccggagcggccgagagacggcccccccctgcccaaatccggagcttcgtctctggctgcgaggcatcgggctggggattcctggcgcggcgcctttgcttgcttggcccgttacttggagtgcgagctcgctcacttggagcggcagatctcagcgctgagccccggcaaaggcagtgtgccattcttcgctgattctggcaagtatttccaaggggaaagtttggagaagctttttcgtcctgtgttgtccccaaattggaagatgctttcttggaatgagatttgtggtggattctcaatagcgctggtggggactgggggatgtctcctgcggactccctcgccgccggccgggacccgccgcgctgggtccctcgctccccggcccaagcggcgtgtgcgtcttcttcgtggacgccgacgccaccgagtccgagtcctcgggggacgagggggtcaggcgcggcgagccgcgcgtgcggaaggtcatcgacatcagcgtctcgcggccctcccccgcggcggccctcccgccgagccgcgctcgccggcggcggccgcgggccgcg

SEQ ID NO: 9889 - DNA, 881 bp, Triticum aestivum
  Clone ID: PAT_TA_9889
gctctgaagcactcgcattgtgtccaatgaagtccaagaaagaaagagtggtgcttcatagcaaccgagctcagtgttatcttctcctgcagcaacctttggctgccatcagtgatgctacccgtgcgttgtgccttcatagtccgttgaatcgacatgccaaaagtttgtggagaagagctcaagcatatgatatgcttggtttagccaaagagagcctgctggatgcaattctgtttataaatgaatgctctcagtccagtgatcctgatctatccttgaggcaaaacaaggttcctgattacgctgagcgattggtaaagaagcagatgcgtgctgcttggttattcagggaatcatccctaaaacatggtggaatccattgtgagggagatgctagtgatgcatttggtcaagaggccgatgactctgagtgggagacagtgagtgaaagcgatggtgaagatgatgaaaggagagaagcagatgatgaaactgaatggaagagtggtggtcacagggaagatgcgtacgagaaaagctgagaaacaggttttggtgctatctattgttatctagtaagattgctctcattgtgcttgtcgtcggaagcagcaacaacaacagaagcagccgcttgcctgctgccctgcaaaagctaaattaagttgtggaaactatatgagtctgctactgaaagctcataaaaatgtagctttcaaaagtatgtctggtgtcaccgtattgtccgcatggagagcaaggccaaaatttagccgttgccctcgccgtgttctttggtctgtgtgagttgctatgacagactattgagaatgttgtcttgctcttgattggtgttgtaaattaacagaacagtacct

SEQ ID NO: 9890 - DNA, 638 bp, Triticum aestivum
  Clone ID: PAT_TA_9890
gcgccgccacacacacgcccccgcaccgctcctcgccgtcgtttgcccagcgaccgctccggccgcgccggaaaattagatcttttgccccactttacatccccattagataaatcccttccctagcttagcttgcctctcggccgaccatctttttggccgcgcccaaattgcatcgcctccatgactcgagctggcgaggcgcctggacgcgggccttccctgcgccaccacatctccgacccgtctacccatgctcctgttccgtcaagcggcgcggcggcttcggcgtgaggcggctcttcttcgtctgcttgggggaagcggggtggcagcgccccttcactctgtggtcagagttcgtccccgcgtgctgcggctctaggccatcaactggtgccatgatccgcttctgatccccgcttggatggggatttctttctgaagtttattgtcagatgtatgtatgtgtgtgcagatttcctgtaatctttacatctttgtttcccgtcgcttgttgaatcatcacctagatgggtgcgtatatgaattattagttagtgagattaagcgtaaacaagccatgtgggattatcctctagaatttttcttacggttgtactgtaccgactgctcac

SEQ ID NO: 9891 - DNA, 541 bp, Triticum aestivum
  Clone ID: PAT_TA_9891
ttcggcacgaggctgtgatgttgtgctgggagcacccttgctacagtcatgggttaggtttcagcttcacatcttctcaggtttaactattggtttacattgaaactatggcaagtgtcaaatgagtgcatagtgtgcaatttgtctagtaatctaggcgcgcataagtatcaggccatatgttttcttataagcaaactatactgatggttgtaagatgagttaaagtatactagtgctatcgtcattttcatactaaatgttattcatttattagtttgatgttctatatgcttctaatgcgtgatcctttcaatgctaggtgatttgattttcagaagttggaagaggaagacgatgaagcatggtgtttttctatcaatctacctcttgttctggttgtagtctgtagctagttatattgtaatcggtagtagtcagcacatcatttctatgaataccatgtaaagactgtaataggctgattttgcatatcatttcaagaatttagttctgttccaaaaaaaaaaaaaaaaaaaaa

SEQ ID NO: 9892 - DNA, 350 bp, Triticum aestivum
  unsure (1)..(350): unsure at all n locations
  Clone ID: PAT_TA_9892
gcaggnaattcggcacgaggccggccgtcgccgctgcaccatcccccctccggctcctcgctccaccactgccgctcctggaagctggccgacggcggccgcttccggtgagaccaaccaccgtcccgccccgcatattccgatcgtccgtcccagattccgcagaggccattttttttcggggctttccccctttagctttacttgtaaactggagaaggaatttggtgcccggataggggctccgctccgctgacatgtgggccactgtattggcgcctgtcagctgagcatgctgtaaaaaagcttcatgtgacctgtgtatactagcagttcatttaaaaaaaaaa

SEQ ID NO: 9893 - DNA, 694 bp, Triticum aestivum
  Clone ID: PAT_TA_9893
cgcccccccgccccctccctcctcctccctgccggccggcggcggccggccggccgccggcccggccgccctcccctcgctcgccgcccccggccctcgccctccgtccgtcgcgcgccccgccctccccgcccgccgccgcccccccctcccccccccccgtccgctcctcgccggccgctccccggcgcgtccccctccgtccccccccccccggcctcggccccccccgcttgccccccctccccgcccgcctgcccccccctcccccgccctgcgtcggcgtcgccggcgggcccccccatccctccccccccggcgggcgctccccccccctgcgcgtccgccgccccctccctcgtgccccccccttccccgtcctgggggccctccccctcctccgccgcggtgctctcccctccaggcgactgctccccctccatcagcggcgtccgcgccccttccggggcctcgtccctgcccctctccgtcgccctcgcccgtgcatgggcatcaagggaacttgtaccagtctatcaggggagtgcttacggcttccgagagcttgtacctgcttcataccgtagctttcacccttgcaaggttcttcctgcgtctctgacatcaaacaggaattcttccctcatgcttgtaaacattctactcggtgcttggtttggaggatatgtcttgg

SEQ ID NO: 9894 - DNA, 801 bp, Triticum aestivum
  unsure (1)..(801): unsure at all n locations
  Clone ID: PAT_TA_9894
aaaacagcccttgcacacgtccgtctatcttcttcctcctcccccgattccacccaacgagccgccgggaacctcctctcctccagccaccgccggtgccctccaccctctccttctctcctagtctccgcgtccaacctcgaaagcatcccctcctcgcgcccaaaaccctagcccgcgtccacggcaaccaatctctggatccgcatcgcaggatgccgccggatccgggaacagggcatcgcaccctgcagccgccgttcaagtcgagcgcgggggcggcgaatgccggtgctcctctacttcctcgacctccaaggacgcaggccccggattcgtgctcgccttcttcctccaccagccttggtgcccaactccctacaaccgccgtcgccgtcgccgtcgtggactcccaagcaggcgaggagcatgaggaccgagctcgagcgcgaccatgacgcagcgcacaaggtccctgtttcctgcacaagtatacacaacaccttgcttggttggggagcagcaacatcaaggttgttgaacaaacagcaatatcaagacgttgaacaaatagcaacatcagttgctgatagcgtgctgaattactcaccatgaaccgtcctcattctgtaacttctgaatgaattcactcactcacctgatgcattgttctacttcatcttcttgatgcccagngtgtttcagcaccaacgcttggatgaccaacgaggaacaagctatggcggtggctgccgatttgccgcctcaacagggtctcgttcctccctggtttgcacaagc

SEQ ID NO: 9895 - DNA, 628 bp, Triticum aestivum
  Clone ID: PAT_TA_9895
gcccaatatttcccccttctcccgaagcgtccaggcgacatcgagccatcctccaccgttgcgccgccgtgctcaccccacaccgtccggtcgtgctcgcccccgtccagatccaccacgcatggtctatgcagatcgttgctctcctacactgccgcctctccttgccgccagagggacagagaacagggggattgagaccgtggaggaaaggctacaggtgtcggcgccgcccaacaggagcccgtgatggccggtcggctcggacgacagcgccggcatctacatgaccttgatgaagtccgaccccagctccacctctgcactggccatgacaccatgacgccccagctacctagcaacttacagggatgtgaagttaacatacaatgctgaaggagaagatcaaggaaatcaataaggatgccgatttctacagcgatatgtttgccatgatgttggctagctgtagcaaattgtagcttgcgtgcctcggcttgaccgtcaggcagtggttggttagtttagttagcctgttgtagctaattgtagctagctagcctaattctggacaaacatgcggtgctggtgatattatggcatcctgatgtgtatatgtgattactga

SEQ ID NO: 9896 - DNA, 687 bp, Triticum aestivum
  Clone ID: PAT_TA_9896
gaggaattcggcacgaggctctccgcgatggagctgctccggagcaccggctgctatatgccgctgcagatgccgatgcagatgcccggggagtacggcgccgcggggttctcgctcggggagttccgcgcgccggcgccaccgcagtcgcagagcttgctaggcttctcgctggacgcgcacggttcggtgggcggggcttccatggcggggtacggctccggtgccgggatgcaagggatgcaggacaggtcgggcaggttgctgttcgcgttcgaggacttgaagccgacggcaaactctggcgccggtggcggtgagagcggtggtggttctggcgcaggcgtggatggcggcgaccatcagttcgagcaaggcaacaaggagcaacaaggcaacggcacccccgttgggcagcccgacacgccggggttctggaacggcatgatcggcggcggcggcacctggtaacgtggacggcggcgcccatgcatgcatagttcatcgtcggctgtgcgtgcatgcatgcgcttccaagctgcagctggagatagggcacaaaggtttaataagatggtggatatggatgtttgatatctttctttctttctttctttctttctggtgttcttctcttcttcttcttgctcggaattgtgctctagccgttcatttgtgtttggtgat

SEQ ID NO: 9897 - DNA, 623 bp, Triticum aestivum
  unsure (1)..(623): unsure at all n locations
  Clone ID: PAT_TA_9897
gnaattcggcacgagggcgagctgagctgacctgctgcagaccttcgcctgcctgcctgccgcctccttgctacttcctcctcaggtttcgtcccgcctgccctcttcagccggccggccgaacgtacctcgccgccggccgtccctgcgtcgccttagcttagcaaggccatataggccccgctggagagctgaaggaggcctccaaggcattcggaagcgtgcagcttgaacatcagcagcagcagcaggcgaccgaccagaaatgtcgctccaggtcgaggacccgcggagcgcagagacgccggcgccgctcaagcgtcacgactcgctgttcggcgacgcagagaaggtctccgactcgaagcaccatgggtctcaggtgagctggatgcggacgctgagcctggctttccaagagcgtcggcatcatctacggcgacatcgggacgtcgccgctctacgtctactcccagcaccttcccggacggcatcaaggacagggacgatctcctggggcgtcctctcgctcatcctctacaacctcatcatcaatacccatgctcaaagttacgtccttcatccgtggctctacgcccaacgacaancggagaatggnggaa

SEQ ID NO: 9898 - DNA, 1001 bp, Triticum aestivum
  Clone ID: PAT_TA_9898
agaaaccaccaggcaaaaacatatcgccaaccctaaatttcaccggatgggggcccgcgagcatgcgggccggcaccaggggcccgacggctgctggctgctgcctcgacccgaccttggcaaggtcagcaatgccgcaagccgccactcaagagggagaggcgtcggggtccggaccaacccgcgcgctcccacgcagccagaggtccacggctgcagcaaggcccacggcgacgacccggtcgatggccctggtgcgtgcgcggcagtccccgggctcccagtccccactggaaccaaccgtgcgatccaatacaaggaagagaaagagggatccggctgccaaccggaaatcgaagaaacggaagaggaccggggaggaggaggaggtctcatctgcagacagctctccagttcgccagccacatatcccggatcggatgtaccgacttcatgatctgaatacgtccaaagccattcagaaggcacgagaagatgtttcggccaaaagagctcgccatatgggattggctactctgaatgtgcacatgtgcagagcttccatgtgtgttcttgatgacccaaatctggttcctgatcgtgaatctgcaaggacggcagtgcttaacgctggacgctctgttctcggactttcatcctctgttggtggtaagccactagcacgatgctgtggtttctgggttgattgggatgagaagaacaaaattggcactgctttgacaacttcacgtctcatttgtaccaagtctgcatctttggacagttggtcagggcaagaagagtatgatactaatgccgaggtccttgttcacatgcagggtggcaccactgaaaaggccaccctgcagtaccatcagaagcactatgatttggccttcttcagcgttagaatggataggcctgttcatatactatctttcaatgatggtgtgaagcgttctgaccatgtttttgagcttggaagagatgaaagttcgttt

SEQ ID NO: 9899 - DNA, 774 bp, Triticum aestivum
  Clone ID: PAT_TA_9899
cttctcacctatatatggtggaatccaaggtccaggcaagcaattgattcatgaaggtagacttctctgctgatgtcttccattgatcggacatgcatctggctccacttccatccgacaaaggcgtccctctgttcagttacttctgtcaggaagcttctgtaaagagatttggatagggaagagcacaattaaagagcaagaagatggagttggtggtaggtgcctcgaatgctaccatgaggtccctcctgggcaagctggggggccttctagcccaggagtatgctctggtccgtggagtccgccgtgatgttcagtacatcaacgatgagcttacaagcatgcaggccttcctccgtgacctcagcactgccctggatgaccatgacaaccgggatgaaggactggatgaagcagatccgtgacatgggctatgacattgaagattgcattgatgactttgcccaccgcatcccccgtgatcccagcagtgatgttaatgccttctccgtcaggaccaggtcccgtgatcgcccgcccgggtggcctcgtcgcgacattgcgtcccacattgcggccctcaaggtgcgggcccagccgattggcgggccccgtagaagatatggggtgcacaacccaaggaaccgtaagaatggctctggagttagcgctgcaacatacgaggttgctgagcatcagctcacagagcgtcagctcattggtacaaaggagcccgtggggatgacggctgacatgaagaagcttgaggat

SEQ ID NO: 9900 - DNA, 1077 bp, Triticum aestivum
  Clone ID: PAT_TA_9900
catgccagttgagatcgggactgctccctcagctgaacaggttcagcaatttgcggcgcttgtgtcagatggaacgaagaagcccatttaccttcatagcaaggaagggattaataggacatctgcaatggtctccagatggaagcagtatgccactcgtgcagagagactggccaccaaaaagcattcaccaattgtgaatggtaaggcgctgaagaatgatccgacaaatggcccaggttcctcgtcaaatggtagtgaaaatggtgcagtagtgaagtctgatagaactgtggatgctggggaagcacatgatatagacatagaaattacacgtattaatctggaagttactaattcccttcccaatggtcaaagcactgaacaagatgaaatgcatgacagcaggacagaacttctttcagattttaaactggagaccagtccccttaaggcacagtttcctacttgcaatgttttctctagaaaggagatgaccaaattttttagaagcaaaagagtttatccaaaatctgttctgaactctcgaagacgatcgagtagcttgatgatctcaaggagaaaacaaaatctcagagctgaagataatgaggccattgattgtgaagcagcagacatgatggttttgaaaaacgcaaatgggacattacttgacaatgattatatattatcggtttcttcaggtatcactaatggaaaaccctcgaacaatggaacctccacttcttttgaagaaaaggtaagtgaagcttcactcctaactattgatcctaaaacgtctaatgcgagcaatcccaatgggaatgctcagcttggatcacaaaaaccatctgaaaagaatggtggtccttatcttgagagatactcatcagatacaattgatggaagtatttgtgccacaactggtgttgtcagagttcagtcaagaagaaaagctgagatgtttctagtacgtacagatggattctcttgtactagagaaaaagtaacagaatcatctttagcttttactcatcctagcacccagcaacagatgcttatgtggaaatctcctcc

SEQ ID NO: 9901 - DNA, 1124 bp, Triticum aestivum
  unsure (1)..(1124): unsure at all n locations
  Clone ID: PAT_TA_9901
acacacgcaaattgctaatactagagagagagagatcgggagaaggcatggagagggagattggtgcagagtatgagctgaatgagatagatggtggcacgttgcatggctctgtggggagcaggctctccctgttcgccagggagttcaagtggagaagcagcagcagcgccctgaggctccccaacaattgctatggcagcagctttgtcatcgaccccaatggaaggtggtacaggatgtggtcgaacatgatgttcctctggtccatctactccgtcttctacacccccttcgcattctgcttcttccggggcatccccgagcacctgctggacctcgagtgcgtgcagctcatcttcctcgccgacgtcgccgtccacttcttcctcgcctaccgggatcctcacacccaccgggtggtctacgaccagcagaggatcgcgctacgctacatcaagggcagcttcgctctcgacatgctcggatgcttcccctgggacgccgtctacaagtttacagggaggatggaggtggtgaggtacctggtgtggctgcggctgtacagggcgaggaagatccagggcttcttcaagaagatggagaaggacatccgcatcagctacctcttcacgcggatcgcgaagctggccaccgtggagctctactgcacgcacaccgccgcctgcgtcttctactacctcgccaccacgctgcctccggcgcgcgaggggggcacctggatcgggagcctcaccatgggcgaccagagctacatcaacttcaggaaggtcgacctgctcacccgctacatcacctccctctacctcgccatcgtcaccatggccacagtcggttatggtgatgtccatgcggtgaacccaagggagatggtgttcatcgtggggtacgtctccttcagcatgctgctcggcgcctacctcatcgggaacatgacggcgctcatcgtcaaggggtccaggaccgagcgcttccgggacaagatgacagagctcatccggtacatgaacaggaaccggctgagcagcgacataaggtcccaggtgaaggcgcacctgctgctgcagtacgagagcagctacaagagagacaggnatcgtcga

SEQ ID NO: 9902 - DNA, 636 bp, Triticum aestivum
  Clone ID: PAT_TA_9902
tgaagatcctaacaacaataatcgaatgattcatatagaaatcaggtttccctctcaggtggggagggacagatgtggctgccgccccgcgcggccggaagaaggctgccttggttgtactccgggcactgccgcctccatccctgctccatcaggttttctattaaagggaattaaaccatggatattttttcatcacatacatggatttatcgtgcctctgcgccatttggctcaacgggtcatcagacacgatcacaacatcatatatattgagtgactatgaacttcgatacagacaaaaaagaaagatcatgaacaataaaatatatatttgctcaaatttttgttttcaatggcaagcaaataatttgtttacttaggaaatgatgtttcatgtcacacacaccaaagtaagaaacagattccttcctctttacttgcagagatcaacaaattattgcgcttacctgatacaattattttcttttgtttggagcgttccctgtgatcgtcagggatatcctgcagaacaatacggaaatccatcatcggcaaaaatatcgagtagaaatcaagcacgcgtaataggagtgcatatggacgatctgtctactctctggtctatttttaaac

SEQ ID NO: 9903 - DNA, 698 bp, Triticum aestivum
  Clone ID: PAT_TA_9903
ccacgcgtccgcaacacatccatggccggcgcgggtgtggagcggggatgcagcgcgggcagggagcaggaggcagcgcaggcagggagcatggcgtactcgtgggcgagaagcagggaggccgcgcagacagcgagcatggcggacacgcgggctacggcggacgcgcgggcggcgagcatggcggacacgcgggcgacagcggacgcgcgggcggcgagcacggcggacgcgcgggcggcaggcatggcggacgcacgggcggcaagtatggtgcgctgcggtggctcactccaccgttgactgctcagcgcaggcgcgcggcggcttcttccctcgggcgcgcggcggcctcttccctcgagcatggcgcgcggccactacagaggagctcctccctctggcgtcggccgcccgacgctgcactggcgcgcggcggtgctcctctctctctctccaggaacctgcgagcacggccgggcggcggtgcggataccaggctcgggcgagcgtggctgttcggtggcgcggcgagtcaggccgggcgagcggcgcggtgagcacggtgaggcggtggtgggggtgtccctgtggtattctccccggcgagaagaaggccgaccggcggtgaagtacatgtcactgcgatggttggacttgattgcttttcctttttagtttttaggggtttttgtgta

SEQ ID NO: 9904 - DNA, 673 bp, Triticum aestivum
  unsure (1)..(673): unsure at all n locations
  Clone ID: PAT_TA_9904
gcacgagggggaggcctggcacggccgtgaggccaaccaccaccaaaacatcctccgaggaaagaagccgcaagcggcctcgcccggtcagaaaaccaaaagtaaaaggaggggagaccaaaccgccgtcccccgttcgccgtctccgcgccgcgcgaccccttcggcccggccgccctccccgaacccccctccgtctgctgcgccgccgcccgcgaatccgggccatggaggcgctgtggaagcaggcctccaggctcaaggagcaggtcgcccgccagggcgtgtttaagcagtttggggctggtggctatggaaattctgataatgcattcacagacgagtcagaagttaaactacatcagagattggaaaaactttacttatccactcgtgctgccaaacattttcaaagggacgtcgtccggggtgtggagggctacatagtgacaggatctaagcaagtggagatagggaacaaattgtctgatgatagccagaaatatggcattgaaaacacatgcacaagtggtaatactttatccagagctgctacatactatggaaaggcgcgttcactgatagaaaaggaacgcgggaacatgctaaaagcatttggtactcgggggaccacccccccgcccgccccgggcggccgctcgaggatnnaaaa

SEQ ID NO: 9905 - DNA, 1045 bp, Triticum aestivum
  Clone ID: PAT_TA_9905
gcacgaggctcccccttcctcctcctcccccgtcctccgccgccgctgctggctttccttccggcgagcgaggatcgtccctgatccgtccggggctcgccccccgcctcctccgtgcctggaggtgaaataagcaaatattttcctgacgtcaagtttgctacagactggcccttccttggctgaaccggcacacactaccaacatggaaacatacaccacggatgatgcgcttacagccatgggatttggaaaattgcaaggacttgttcttgtttatgcaggcatgggttgggttgcagaagccatggaggtcatgctactgtcatttgttggaccactgattcgagaggaatggaaaatctctgcccaagatgaaagtttacgctcaagtgtagtgtttttgggcatgttaattggagcatgtggttggggatacgtgtctgacaaatatgggcgaaggactggtttactgctttcaactctgtttactactggaatgggtttcctaagtgctttgtctccaaactatttatgtttgatggctcttcgctttctcgttggcgtaggattgggtggcagccatgtgtattcatcttggtttttggagtttgttcctgcgcaaaatcgtggcttttggatgattattttttcctttttttggactattggcacagtcttggaagcttcacttgcatggattgtcgtatcaacattgacttggaggtggttgctagcattgactgccatcccttgctttctcttgctccctttctttggaattacacctgaatcgccacgctatctgtgtgcgcaaaatagaatatctgatgcaacacttgtcctggagagaatcgccgagacaaaccaagcaactcttcctcctggagttctcgtataccctcgagacggtgaagttgatcatagtactcttacctctgaggcagatcatcttcttccactcagagagaaggactgcacagatgatgatgtcataagccccaaatctggtagtgctgctgcattgcgcagtctactgtcacgg

SEQ ID NO: 9906 - DNA, 600 bp, Triticum aestivum
  unsure (1)..(600): unsure at all n locations
  Clone ID: PAT_TA_9906
ncgtgtttaggtgaagttttncnccagcagtcgggcatgtgggatntgaaggaggaggaggatgggtcgggtgtggatancttcttgatcgangagcccaggaggcntgagtagggtcaattcgggtccgacggggaggcggagctgcaagcaaggagtgaaggtttcaacttggaaaggaaggcggaaacaggggaaatgtggcttttggtaagggggagggggcggggaggtagatatttccgcggaagccgaaaatttggaatcgcttcagcgaaaaaactggcgcgcaaagtgtcatcagacacggtcccttattcagaactgtgtacgatatgtgaacatcacaaacgattcagatagcttaacccgtgtgtgatgagtttgaacgtcaaaagttttggttcgaatttccctggttacagtggtcatccacgtcattgcataatttgggtacacaaaggagactacagcacacccacacttcttaatcgagcaagttcagcaattaaacagagctagctgacctaaacattactctaacaaattaaagaccgacgctctaaattaaacaaaacaaagagtactacttcggctggc

SEQ ID NO: 9907 - DNA, 1044 bp, Triticum aestivum
  unsure (1)..(1044): unsure at all n locations
  Clone ID: PAT_TA_9907
ccacgcgtccgaaagtaagtttgtgaagaatggcgaacaactaaaaccaagttactttgcagcactctatatgattatatttttgtatgtacagatgagacacttctcgctgaatcatcccattacaagtttctcaagtcaaaagatctatttgactcacttgggagaagaaaacataactgggtttctacttgtcaggcacgagctttgctccagaatgctatattgtttgtggttgatgatttcgacagtgaggcaagggatgcaagaagaactgatggtcaagtacttatggtatcagatgcaagattcagtatgttgaaagttgtatttggcagttacaccaccacaaccaagccattaaaagagaagctcaagagcaaagaagatgctgagattgttcggtttgaaatgagaggagacatttgggcgaggagaaggatgtgcttgcgggataaccctgacttccacttgctacagtggagaaagacttcaggactcaagcgagcgcaagtgaggcaacaagaggaggcgtcatcgcaggacagcaatagcaacagactccttgaacaagtgcaactgaccgtgaagaaccttgtggaggagctgaaaatcaacactagagcagtgacggagtcaagtcaggcaattgcaaagtcatgccaagatgtggtggaggcctgtaagttgaccgtggccagcaccagcacgggtgccggtgtagtgaactgagcgcggcgagtctaggtgtactagaagatgagtagtggtcgtgcggtttgtaacatgttccatgtagatgaggcctgtaagttgaccgtggccagcaccagcacgggtgccggtgtagtgaactgagcgcggcgagtctaggtgtactagaagatgagtagtggtcgtgcggtttgtaacatgttccatgtagatgagtgccaaggagcaagttctatcctgctaccactagattgtnctcagtnccttgtatttcagccaaatgtttttgtcagattctcagtgccaactattgtgccagcattagaatgt

SEQ ID NO: 9908 - DNA, 568 bp, Triticum aestivum
  Clone ID: PAT_TA_9908
gtagccagccatcaagtacaccgcagtgctgcaccgagcggctctaggctagcggagttgagtgtcgtcagacagccaccaccttccagttccagccatggccacggcgtcggcggcgcggatagtgccggtgctgctggccctcgcggccctcatctgcgcggcggcggaggcgtcgccagcgaaggtgccggcgatgtacgtgttcggggactccacggccgacgtcggcagcaacaactacctgcctggcagcgcggtgccgcgggccaacttcccgcacaacggcgtcgacttccccacctcgcgccccaccggccgcttcagcaatggcttcaacggcatcgacttcttagctctgaacatgggcttcaagcgcagccccccgccgttcctctcggtggccaacagaaccaacaggcagatcgcgcgagggctgctgggagcaaacttcgcctccgcaggatcaggcgttcttgacacgacgggggactccatcgtctcgatgagcaagcaggtcgagcagttcgccactctgcgatgcaacatctctgcgcgcatcggcgaa

SEQ ID NO: 9909 - DNA, 620 bp, Triticum aestivum
  Clone ID: PAT_TA_9909
gtgacgtcagacgtaggaaagaagatggtgccgaacctgaagcagatccagaaagagatcaaagaactgtatttgccttccagctatctttgaaggcggatgaaagagatgtgtatgagttcttctcaagggccgggaaggtccgggatgtacgcttaataatggatcgaaactcacgacgttctaaaggcgttgggtacattgaattttatgatgctatgtcggttccaatggcgattgctcttagaggtcagccgcttcttggtcaaccagtggacgttaagccatcagaggctgaaaagaatcttgttcagtccaatgcttcatcaagtgtagcagcttcaggtggggcaaggaagttgtatgttggaaatcttcactccaatattacagaggagcaattgagactggtctttgaaccatttggactggttgagcttgtccagctgcccgtagacccacttactggattatgtaaagggtttggttttgtgcagtttgcacggctggaagatgcaaaagctgctcagaggttaaatggtcaacttgatattgctggaaaagtaatcaaggcttcagctgtgacggaacaaccgggagtgcaagccagtggggcaact

SEQ ID NO: 9910 - DNA, 576 bp, Triticum aestivum
  Clone ID: PAT_TA_9910
tcaattgaagctgttcctgtacgaagtgaagcagcagcagctgctttctgggatccggagctatctaaagttatactcagcaataaccatcaccaaacttgcccagtatatggaaatggatgaggcaacacttaggtctatccttatgacgtacaagcacaaaatgcatgcagttgacagtaatgggaaaattgtatccagtgcagactttgatttctacattaatgaggatgttattcatgtcgtagagtcgaagtcgaccaagcgccatggtgactactttttgagacagattttaaagtttgaagaaaccattgctgaattggacaaggtacagcttgactgagcatggtagagatcatggaggagagaaacgtcccaggatcctgttttccttttcttttttcctattgtgagaggcacttgtgatgactactgttagcagagcattagttgtgccttctggtacactttttgactcagtgaagcactggcaattcactgtattatctcgtttcttgttcctgtttgctatttgatgagtaatctgtcagttgctaattgagaacttgagat

SEQ ID NO: 9911 - DNA, 716 bp, Triticum aestivum
  unsure (1)..(716): unsure at all n locations
  Clone ID: PAT_TA_9911
aangacaattatccgcacaaacacnacagggaaaataacgaaaaaaaaggaaaaaaaaaaaaaaaaaaaaaaaaaaaaaaaagcggcggggccggggatctctctcgacttcatcaacacaaacaaaaccaaccttcaaacaaccactaccctttcaaaaacaaccatcatcatgtctggctgtggatgcgcttcttctggctcttgcggctgcggctctagctgcacctgcgccggctgccctcacaaataagctatttcttcaacgacttcgatgggaaccctgatgggcgagatgaggcatggggaagctgaatgtccttcagggcctgacgattcagggaaggctgatcagcaatggatccactcgttacttgaccgtatctctattgagtgtagtcagaattgaatgaagacataaattgcagtttgatcataaaaaaaaaaaaaaaaaaggcccctaactcaagaatatgtttgatccagctgtggagacggatcctgattttgatattagatattagagatgatgttcgagaagaatgttctaagtttggccaagtaagacacatttttgtagacaaaaataccgcaggctttgtgtacctgcggttcgatagcataacggccgccatgggtgcacagaaagcacttcaagggagatggtttgcggaaaagatgattactgcaacatttatgtccactcatccagcctg

SEQ ID NO: 9912 - DNA, 1961 bp, Triticum aestivum
  Clone ID: PAT_TA_9912
gcccgcggcaacaaagcgctcccctctgaagcctcctcccacccccctcacgccgccgccgcaaccccgaaaccctaaccaaaccccccagcgccacaccatggcgtccgcctacgaccgggaggacggcctcgcgccgccgcagccgcacggcggcggccccgccgacgcctacgatcccaactacgtgcccgactcggtgaagaccttcgtggtgcacctgtaccgccacatccgcgacaagaacgtctacgagatccaccagatgtacgagggcggcttccagcgcctctccgaccgcctcttccgcgacacgccctggccgtcggccgaggccgtggcgccctactgcgacggcgaccacgtcttcctcctcctctaccgcgagctctggtaccgccacgcctacgcgcgcctctcccccctcaccgccagccaccgctccgagtcctggaacaactactgcgacctcttcagcgtcgtcctccacggcgtcgtcaacatgcagctgcctaaccagtggctgtgggacatggtggacgagttcgtctaccagttccagagcttctgccagtaccgcgccaagctcaagaacaagacggaagacgagctccagcagctaaagcagtttgacaaggcatggaatgtctatggtgttctcaattacctgcaagcactcgtcgagaagtccatgatcgctcagattctggagagggagaaagaggggctggagtcgtttactgccaccgacgggtatgactaccagggtgggagcaatgtgctcaaggtcctgggttactacagcatgattgggcttctcaggatacactgccttcttggtgattaccacactggcctcaagtgcctggcaccgatcaaccttaaccaacagggggtctacaccattgtgattgggagtcacatctcgacaatctatcattccgcatttgcaaaccttatgatgcgcaggtatgttgatgccaccagggggtccaacaaattgctgctgggtgtcacatcgcgtcagccgttccttctgaaatcccctcccttatgacggacacgcatgacaatgctaccgaggaattcaccacaatcctgttgtccatcttaatgtccacgcagtaccatcagaaatccccttagtagcacccggttgtgaggaaaattcagtagatgtatgcgctgctggcagtttgccgatctctgtgcccgcagaacaaactcatagatgaaaatgttagccccccagctggatagtactctaccatcgacaaaatggcaacggctgcagaggtttgatgatgaagcatatgctgcgtttgaatgggctatgttccgtatccatgccccacagctactgacgccttctcctccagttctcgaaccaagccactaacaaactaataaccacggccgcctatcgccttcaatgggaagctgttccgctacgattgggtagaaccttcaggcggacttccgggatccggagctatctaaagttatactcagcaataaccatcagcaaacttgcccagtatatggaaatggatgaggcaacacttaggtcagtcctagtgacccaagcgccatggtgtgtactctttgaggcggaatgggaagattgtatccactgcagactttgagttctacattcatctggactgtgctcggttgagggaatccaagacggccaagcgccatggtgattactttttgtgacagatttttatgtttgaagacaccattgatggattgggcaaggtacgccttgtctgtgcctgctggtgctctttgactcagtgaagcattggcactctgtattatcccgtttctagttcctgtttgctgtttgacgtgtgaaccctccgtttgcgcctgtggtcctccgtgcccctctgggtttatccaattgggtgggcacatttttcggctcacaaaaaaaaaaaaaaaaaaaaaaa

SEQ ID NO: 9913 - DNA, 578 bp, Triticum aestivum
  unsure (1)..(578): unsure at all n locations
  Clone ID: PAT_TA_9913
atcccccgggctgcaggttggggtattgcacttgatcatgatactggatatgttggctctcatgacagcttttgctgtgggaagctgccgcaaattgaggacttcagtgtatgtctatgcactagttggcggcgttgtagtaatcctgctgctcctaattattgtgacaagtgcaattgcaaaatatcggaagccaagagagggaaatgggattaactccccgagacatcctgaacctgtttcaggagcaaacacaccagcacgacctgaagtttgatgctccctttttacaagaaccctattcatctaggaatctatatctctatattatctgcaaacaatttgtgtgtctcctgtcagcatttttcttcatgttttgacctgaacactggtgttgctgcctgttgtagttcttggcaattattttagcatacttgaaatttgagcttgagccttaaaactgcatattgggtacatcatcatgtaatggagctacaagcaggcaatgatgattatcttcattatcgtncatgtaacgagcgagaatttagagctgtatttcgctatgaaaaaaaaaa

SEQ ID NO: 9914 - DNA, 586 bp, Triticum aestivum
  unsure (1)..(586): unsure at all n locations
  Clone ID: PAT_TA_9914
tcntcgtggtcatctccgtcggtggattcgtcccctttaagctcttgaactacctgctgctcctcgtcgtcatctctgncggtggattcgtcccctttaagctttgatctacgtgctgctcttcctcgtcgtcatctccgtcggtggattcgtcccctttaagctctgatntacgtgctgcaggataagtcgattggtctggttgatcggcggttcatttgtattctgtcaaaatttgtccgtgctgtcagtggttatctgctttcttattgttctgggtacatatgcatgcactagatagtctgtttctagatactttccaagtacgttgtgttagggaatgtgagtctgtatgtcacggtgttgtcctcgacctgcacacaagtaaatatttttttttcatgtgtccatgtgttgttacatgtatgcactcttctcactcgcatatgaggagggggtcgtcaagatgaatttcatatgcccgactctgcttaattgagcaggttttctgtgaaatgacttaaatattgaggagcacacaataaattccccaatccaagcaggccctcagtcttaataaacactg

SEQ ID NO: 9915 - DNA, 387 bp, Triticum aestivum
  Clone ID: PAT_TA_9915
cgtccgacaaacgtccctccctgaaacccatagtggtagtgggaactatgcatccgcggtaggtggcgcagctcacgcgcatctgctcttacctatctggtccatatatgcttgtctcgtccgcttggccggccacagttacgtccacgcagttgaagtagcttgtgtgcattcctcagtccgtccgtctctagtgtgccatggcgtcggctctaccacctcaccttcctctccgtcttcttctacctcctcctcaccggcctggtggctgccgatccgtctggagggaagaaggtcggcaagaaggtgatcatgacagtgcggtccccggctgccgactccgtggagaagatttcgatctcgactcgtctaatcggtgaccgtggg

SEQ ID NO: 9916 - DNA, 594 bp, Triticum aestivum
  Clone ID: PAT_TA_9916
cgtccgcggacgcatgggcggacgcgtgggcggacgcgtgggcgcagttgaagtctgcccatggctcggctctaccacctcaccctcctctcagtctccttcttcctgctcctcaccggcctcgtggctgctgatctgtccggagggaagaaggtcgggaagaaggtgatcatgacggtgcggtgcccagctgccgactcgggggagaagatcacgatctcggcgcacctcgtcggcgagggcggggtcggcgacagccacttccatctggacagcgatgactacgagcccatcgttttcgccgtgaaaaaccttgtctcggccctggagaaggtaggagatccgcaggcctctctatccaagatgtagcttcacggtgctcagtgggcattggagatgtagctcctctttacattcgtcttagcgagaatacattaggcgccttttactattttgctgcaggtccttctgcatgcagcagtgcccattcggcgagcgtgtccagtgggcctattatttaggctgtagtaacgtggaagtgtccaagggtccgcatttatggctttctatttctcatgaccctatttggatcct

SEQ ID NO: 9917 - DNA, 939 bp, Triticum aestivum
  Clone ID: PAT_TA_9917
ccgttcccggattgaccgaccgacccacgcgtccgcccacgcgtacgcggacgcgtgggcgcagttgaagtagctcgtgtgcattcctcagtcgcgtccgcccacgcgtccgcccacgcgtccgcgcgtgggtgcagctgttctcctctgctctaacctaaccggtccatatatgcttctcttcttttcttggccggccggccggttgaagtagcaagcagtaggttttgtgcactccgcccgaagtctgcccatggcacggctctaccacctcaccctcctctgggtcttcctcttcctgctcctcaccggcctcgtggctgctgatctgtccagagggaagaaggtcgggaagaaggtgaccatgaccgtgcggtacccggctgaagactcgggggagaagatcacgatctcggcgcacctcgtcggcgagggcggggtcggcgacagccacttccatctcgacagcgacgactacgagcccatcgttttcgccgtgaaaatccttgtctcggcggccctggagaaggtaggagatccgcaggcctctctatccaagatgtagcttcacggtgctcagtggtggttgcatgcccagtcagtgcacattggagatggagatcctctttactttcgtctcagcgagaatgcattaggttccttttactattttgctgtagtaccgtctgcaagtagcattgcccattcggggagcgtatcctatgggctattattaggatgtagcaatgtggaattgtgcatggtgctggagtctaacttcagctatgtctgtgtatcttggtttctgtaatctttcgggttcgaggaacaaaatggttcgttgttcttcacggatgcctctctctctctctctctctctctcgctctctctttctctctctctctctctctctctccaaccatcgtcacaaagcacac

SEQ ID NO: 9918 - DNA, 537 bp, Triticum aestivum
  Clone ID: PAT_TA_9918
cttggatgcagtgatgagatactgactattatagcgatgattcaaacggggaatattttctataggcctagagaaaaacaggctcaagctgatcagaaaagggccaaatttttccagccagagggagatcatcttaccctacttgctgtatatgaggcttggaaagcaaagaacttttcagggccctggtgctttgagaactttgttcagtcaagatcgctaaggagagcacaagatgtcagaaagcagcttctaactatcatggatagatataagttggatgttgtcgctgctgggaagaacttcatgaaaataaggaaagcgatcactgccggcttctttttccatgctgccaggaaagatccccaggaaggatacagaaccttggtggagaaccagccagtgtacattcacccaatcagtgcgctgatccagcgccaaccagattgggtcatttaccacgagcttgtaatgacgaccaaagagtatatgagggaggtgaccgtcgttgacccgaaatggttagtggagttagcg

SEQ ID NO: 9919 - DNA, 918 bp, Triticum aestivum
  Clone ID: PAT_TA_9919
gcatgctcctgagctcaccgtgctcggctacctggagacggcgaaccacgtgctgcagatcggcaacaccatcatcaaggctggggtaacaaaagtggccccaaatgctgtggttccaagtgtcaaggtgctagctttgaaggtggatttcggagtagccgaggaagtgaagaccctgctcagcttcttgagatgctttccccaagtcgagaccctgcacgtcatgtcctcctccaacaagaacgaagaggaagaggaagaggaagaggaagagcaggacggcaaagacgcgggtgatggcagtggcgagcagctcatcagccccaagttctggaaggaggccggcccgatcgggtgcgtggagtcgcaagtgaagaaggtggtgcttgataagttcaccgtgggcgccaacgagctgggattcctcaagttcgtgatggcgagagcgcaggtgctgaagagggtggtgctggtgctggaccccgggatgagccccacggcggcgaaggaggcattgagcaagctggcgtctcaggtgccgtccgccaagtgtgccagtgagaacgtggagttcatggggctcccgcgtccgatggctgcttggagctaccagatcgcgtctgacctctccctgagcgacccgtttccggctgaaggcggtatattggtggagcgtccgtgagcgtcgaagaacactttggatgtttctctgaagaacctattaggagtagctagcttcaagaacttgccagcgcccgtcccttcgtcgtgctgggccccggtggcccatccgctgattcttttggctgtgaatagattgcacatgctgtgatcgagctgtgacctggtttggttgatgtcaccatcatgagacatttatttatgtttgattgatgttgtttccgggtgtgaaagact

SEQ ID NO: 9920 - DNA, 1071 bp, Triticum aestivum
  Clone ID: PAT_TA_9920
cttgagctcccgttgagaagagggaagggcgcaaaccagaagagttgaggaacatcaatggtcttcatgggttactaaatataaaatgtctagaaaatgtttcaggctatgaagaagcccgcaaagctgagttgaataagaaactttatcttaattctctgaatttggaacggagctcagctagtagaaatagctcccctcctgctgatgaagaggtgcttgaaggtctgcggcctcaccatgtcataaaggtacttcatattagaaggtattgtggcgcagaagctcccagttggctgcagtcactgcagcaactgcgttccttgcaccttatcaattgcaggagtttgtgtatccttcctccattgggaaatttgggatcactcagatatttacacatgaaggagctgtgtgcagttgaccagattggacatgagttttatggcaccggtgatgtggcatttccatctctaagtgtccttgaatttgatgatttcccgaagttgcgtcagtgggctggcatagaggacaagaactcatttccatgccttgaaagggtaagtctgatggattgtccagaattgatccaaattcctttgttaccccaagctactcgtgaagttaccatcgaacgtacaaggttgataccatatatgaggcttgcgcccttgtcttcaaattcagaaatgctccagctggatgtttgcgcaagttctgtcgtcctcgatagactactctacagacataatatagagtccattgcagtgttaaacataagtggggctgaacagcttgttgcttctggacaactggggtctcttgtttctctgcaaaggcttgagctctctcagtgtggtcttactgaccaggctttaagaagctttctccaggatctgccttgtttgtcctctttggagattatagaccttcctaacataacatcgcgttcctggtatcgggaacagtcaagttctgcacaaatgctccactgagttgtgcattcgccaactgccaatcgctttgttcctctatcctcattgccggattggttcactaaatatctggggtcga

SEQ ID NO: 9921 - DNA, 962 bp, Triticum aestivum
  Clone ID: PAT_TA_9921
ggcgacgagagtttcctgggcatgttgaactttggtgtctcaacacaagtgccggatagtccagttggagagcaagagtcgcccatgctgccaactcaaaaaacatctacaactgtgaaaggaaaatccaccaaggggaagaattggtctattgaagaggataatctgttggtggcagcatgggtgcacactaatttggatgctttgatagaaacagatcaaacatcaaattcttattggggtaggatttatgattactacagcacgcgcaagaaagtgtcatggccggtgcgtgttcaaaatgcactcaactgtcgttggaccactattaatgaacaagtgagcaagttttgtggatactatcagcaaatacttaatagaaaccaaagcggagtgactattgctcagcagcaagcccaggcacttgttctgtaccagtccaaagatcctaaaaagaggccatttacattaatgcattgttggttagtgttggaaaagcatcctaagtgggagaatcgtgtgatttccaaggggcctcagaaaaagcagaagaagacctcggatgcaagtccaggtacgacttctaatgacgaagacttcgagagatgcactgatgctcttgaaacagagacaagacctgatggtaataagcgggagaaaacccatttacaaaaagctaaagcttctgcttctgatgcttttagtcccaagttatcattagaaaatgtgtgggcacaaaagttaaagaaggctgaggtcaaagttaccaagagagggagatgtcatacaagcaatttgagttagaagagaagatcatgtccatggacactactgttatgattggggctcaacaagaatactacatgaacaagcagaatgagatcgccgctcgccggttcaacacatcgggttgaaccatttgtcaggtctgctagtatttgtcgtgtgactattttcatatc

SEQ ID NO: 9922 - DNA, 777 bp, Triticum aestivum
  Clone ID: PAT_TA_9922
tagctagacgtgcatgactttcatgcgtttatgttttgggcagcagaattaatgaccactcacaaaggactagccatcaaggtgtttttctgcgcatatgtcgttcaagtggaagatggggcactgtgccttttccaactccttccgacctactgatcaagtcaagagaataagagctgtggagattacattttcttgctgaacttttcggtcaatgcctaatatgtgtgcttttcttcctaatggtgtcatgcttcgatttgatttcttacatgaggaagtgaatagcagtgattattgcacatgcttatacattcaaatggattgctaggttaaatggtatagcgttcaaagatcttagttttctgaacggtctaataattattcagtttactaaactgctgaactacttctttgggtctgaatttgctgaattatcaaacggtataagaattattcagtttaataaattgctaaactgcttctttgggtctgaatttgctgaattgtcgaacggcctaagaattattcagtttactaaactgctaaactgcttctttcggtctgaattttctaaattgcttctttgtctctaaattgctaggtaccctataatatattgaagcacggaaactccaagctcttccaggatgtttttgaggaattgcacattactactagcaagattgatgatgatcttatgttgtagtccaataggtattccaatgaaattaagaaagacatccttagaggctggagcacttcatttgtgtgtag

SEQ ID NO: 9923 - DNA, 1130 bp, Triticum aestivum
  unsure (1)..(1130): unsure at all n locations
  Clone ID: PAT_TA_9923
ggaaggaaggcgcctcacactcgccatcagatttggagggagccaagatttcgttctctgcaggatactttcatggagccaattcttccatgtgataacattgagccaattatgcaatattcgactacagtgcgccttaattctactacagccgatgcctcatgcggggaatccgttaaagcaaagaagtgtctttcatatgaacctgctgaatccagcaatccccacaaggaagctgcaaatgaagaaacagaatgtgtcccaaatgaactgacaaaatggcatccagactcctgttgggtgctacaatcaaagtcagcaaagtcaagatgtttgtgaatgcaatgctgatacaccctatgaaaagaacagcacactagtcaatggagaggaatcagggctgccagaagagagattgtatgaatcaaccagtcacagtgcattgcgcaatgaatcgttgactgctgacatagatgcggatattcctatggatgaagagcatgctgccagagatgaagatttcccgctttcaacaagaactagggcagtagcaaagtgccttcatcagctattcttggaccagaagagccagcagcaaagcaatgtccccgtgacgctcggccaggccctcgaaggcagcaagaggaaaaccacagcaagattcttctatgaaactctgatcctcaagagccgcgggttgatagatgtgaatcaggagaagccctatgagaacatcacaatctctgcgactccacaactcgacgcggtgctgcagaatccagtgcccccttcaacttcttagcagcagatgtcagggtaggtagttttaggagaaaatgactcaaagtttcagtttttcgctatatcccgtagcatcatcgcgagaatatgtactggtggcaggccagttgtatatatggatcatttgttcgttcgtatgggtcaggattacatagagaaagnctttaggatcttgctcggttaagttaacgacaggccgagtttcttgctggtcgcatgcgggatgtaagttagctgaggagggggtttattcagattgcagtttcttgccggttgcatgttgaatgctgatggcatctgccaatgagtaaaagagcaggcaaaaaaca

SEQ ID NO: 9924 - DNA, 1034 bp, Triticum aestivum
  Clone ID: PAT_TA_9924
gcgggccgcaaacgaactgtgcccgcgactgcgagcgagcgagcgaaccgaggaggacagcgcaaccgccggatcgatccgtccccccgccgatcgccaccgttccccggagactccgcacgaacccggccgaaggcgccggccatgggctgctcctcctccgtgccagctagaagcaccggagggctgaacaatatcaacggtagctcttctgctgctgattcaaatgacttgcgtgccaagttggtattgctcggagattctggtgttggaaaaagctgcatcgttcttcggtttgtccgcggtcagttcgatccaacttccaaggtaactgttggtgcatcatttttatcacaaacattggcgttggaggattcgacaatagtgaagtttgaaatctgggatactgctggacaagagagatatgctgccttggcacctctttactacagaggagctgctgctgcggttgttgtctatgacataactagtccagaatcattcaagaaagcacaatattgggtgaaggaacttcaaaaacatggcagtcctggtattgtcatggttttggttggtaataaagctgatctacatgaaagtcgtagtgtaccttctcaggaggcacaagagtatgcagagaagaacagcatgttattcatggagacgtcagcaaaaacatctgataatataaatcaagtatttgaggaaatcgcgaagaggttgcccaagccaacggcgtcctgataaataaatagctctcgtgtactatattgagatggagtgacacgcttacaagtctgtaccatgtaatgcatgtaaatgcccgaggttaaactgggcatttgattggaaatcgaggataatgtaaagctagcttatatttcattgtgttaaagtgcaagtattgagcaaataaatggtgttgactgtggatagatctttgtctggtttatgatctggagatgggccatagcccgcctagctgtgaagttgctgcccattactccagtataattttagtgagcagctcagca

SEQ ID NO: 9925 - DNA, 514 bp, Triticum aestivum
  Clone ID: PAT_TA_9925
agaagtcggaaacgggatccaaggggcagaggagtagtgaggttctcgaacactgtggagacgatatgcccatcgaaatcctgagtgaagacagttctagtgatgatggaatgcagcaagcgaagatgatcacgagcctgcacatctacctggtagcaacgtagatggtttggatacattagttgcaaatgacatcgtggcggcgaggtcaaaggagggtggaagaaccaccgtcagccatgtcaggagtgcagcacgcggtggagttgacgctgctccgcacggacatgggactcacaaaggccctgggaccagccgatatcggggagtagcccatgtgggagaattgagcatcgcgagagcgaacctggatacacatttcagtggttcatcaggttagtgcaagcctggatggtcgacagtatttgtagcaaagatgatgttggaaatgttgaaggtgcacataattttccaaaaaatgaataattcggcatggcggggagggtggcagtcc

SEQ ID NO: 9926 - DNA, 822 bp, Triticum aestivum
  Clone ID: PAT_TA_9926
tattacacagcctctgaaagcagcagatccactacattggaaggaccgtgatctcgatccagaaatcatgtactcctccagtggtggcatgccccatgggcgactagcaataggtgatggtgctataaagaaagcagtggtagttgcaaaagctagagagaatgacacaaggccatcaaactccatatcataccattgtttattgaaggaaaatgctctgcgttccgcccgctgcctggctgtttgtcttcggtgcgcacatgttcaggggttttatggcaagctgggatgggaagtacccgaagatcttcttgcctaccaagatgagctgatggatggcggtgatctgatgaatgaaacaccccaagcccaagaggatggtggtactccaatgacagattcttcacatgatgaaaggcatgttgatgctggtactcaaatggatgatcatggttctgctccaacacatgaaaatcatttaggaatgccatagttatagttagtgcttgtattggtaactatgtgcacggacccttttatttgtcaatcgctactactgatggaaatttaggactctagtatgtcttttggtctggctaataactagtgttaagttgagcttttggtaattacgtgaatctggtgaacatggaggtttgtgtattggatatatattgtgagctataaatgggatgtcatcttaaactgggccatgtgacctttgtttgtgcatgaatattaatagttgtaccacaattggctgtgaatttcagtaattcaatattattttgatttattgggttaaaaaaaaaaaaaaaaaaa

SEQ ID NO: 9927 - DNA, 1437 bp, Triticum aestivum
  unsure (1)..(1437): unsure at all n locations
  Clone ID: PAT_TA_9927
gcgcgtccgtttctcgtcccctcccctcccctcccctcccctggcaccgcccgtccggcggtctgctcccgccggtgggctgcccgccgctcgtcgttcgtggctcctcgcgcgtgagggcagcctgccgggtatcgcggccaatacgggcatgtccacgacgcgggggaagctttcgagggcgggcacgcccagggcgccgccccccggcacgcgccgcccgggcagcagcagcagcaggccgacgtgtacctcagggcgctcctcatcctggtcggctttctcgtgatcgggtgcctcatcacattctaggttcgtcaccattgtcatttgtcaccgtcataatatgagcaacgattgtcatgatacttctcacatgttgtgtgcattacgttgcccccccgtaggaaagccccggtctaaatctgagtggtgcgttttgagcgaaagtgttcatagaactcatgtatatatgtgctatttagacgcggtctgaatggggggtgcctgtgtaccgtagtagtttcacactgagtcgtgaatgatttggaaacctctgtttggagtggatgtaccagaccaattatatcatgtgggaatttgtttcgaccgtcaaagtgcggcgggtgttccgcgatttggagttcccaggtgcgtccgcgcccgggcgcccccccgggcggcccgccggccgcggtccccgacagggccacccccacgccctggcctcccgcgggcggtccgcccccgccgccgccccccggcacgcgccccccgcgcgccgcccgcgccgcgccggcggctgccgcaggccgccgcgcaccccgggccgctgctcatcctggttggctttctcgtgatcgcaagcctcatcacattctaggttcgtcggttcccaccattgtcattggtcaccgtctgtcgaaaaaaaacaacgattgtcgtgatacttctcagatgttgtgtgcattaccttggcccccccatacaaagccccggtctaaatccgagtggtgcgttttgagcgaaagtgttcatagaactcctgtatatatgtgctatttagacgcggtcctgtgggggggcgcatgtgtaccgtagtagtttcgcgctgattcgcggatgatttgggaaacctctgtttggagtggatgtaccagaccaattatatatcatgtgtaattttgattcgactgtcccaagggagaccaccgcctcagcgcgctcctccccggccccgcccgcgccttccttccctgcttcaanccagaacgggaagngaacttcctttcgtntccttnaaaanccgggatttncaattcaaaaatcctgnttncccaataaaanctggccctaaagcccaaannccaacttcaaaactgcccgntttaattcgggcctctnggaanattnaagcccggtggccttngaanacgg

SEQ ID NO: 9928 - DNA, 777 bp, Triticum aestivum
  unsure (1)..(777): unsure at all n locations
  Clone ID: PAT_TA_9928
ttggaacttattggatgctgataaatccaagnctctggnataaccaacaaggtgaaggaatcatggtccgatgtccctctaccgggaaataacaatgaatggtttatgaaccaaggaaatatggtaaaaaaggcggttgacagttttccagttcatcatcaagccaattacagaagaagcataggcgaagataagataattcattgcagcagtgagatattctacatacctcgacggtacaccaggtgacttctcctacctcgttaaagttatcggaaacctagacatccatcacaccattggagtccccatgttgttccttgcaatggatgtaccgagcaattttgaacccaaagctttgggaaaacttgcttatcggacaaacttgccatcagataccactttctcggcgatatatactcctgaagcacatgctgtgtaccctatgaaggttgagaatgaaattgattttgtaaaactaatcagagtcatggcttcaggagatccttttcttctggagttggtctgatccaggagactagagtccactaaaattgtataatttgggttgggaaggggaaacaaaactacgatcgttaaagttattgttttgttcctcttcatcctccctttcagttgtaagttcaatttaacaagagacttttaccttatcagtagtctcacacgatcacattaacaccattgtttcctagtatgaaacctttacctattggactgttgcagttcaatgtaaagataacaataagaatgctaaac

SEQ ID NO: 9929 - DNA, 1008 bp, Triticum aestivum
  unsure (1)..(1008): unsure at all n locations
  Clone ID: PAT_TA_9929
cgtccgctgattcaaaaccattcactgcatttcttatatcgcatcagagcataaagtgagctacaagtgatcacaaactttgatcatcatcccatctacagatcaaagttcatctctaaccttatgatgacaaccagtacatgcaactaagcgacccaagtggccaagcctataatgagaagaacaccaccaacactgtgtgtatgccttttccaatgccgcattgacagtaaacaaatactcactactctttagagaaaaatgttacctccgaatcggagaattttacagcacaatatgaggtaatcagctttctgatgacctgagttcttgtagcaccgtcatgacctgctcccggacaagctcgagcctcttgaggtagacctccagctcaagaatctgctgctgcctccacttctcatcaccgggcacccgagggctcagtccggccaccccaagaccaacgccaagaatatcagcacccccgaatcccatgcccaagcccaatcctagtccggtctgccctggaacagcaaccgagctgatgagctccttcagcagcggtgacaggatgctccggacatcagcttcagtggggcaactggctgtcagcggataaggaggcaatggtgctgccggcgctgaaggtggctgtgcaatcaccggcacggaactctcgaacgccgtgatagctggctnnngagccgcatcggtcaacatcggagcgggcgttgcagggaagatgggcgcctcaatctccggcgccgtnnnnnnccttccacgccgcgagcccctgccccgaggggtgtgcgcagacgcgcctccgcccccgccctcctcgaccgcagcaggcggctccgtggcggcggcggcggcggctgctgctgcaaccgccgctgcttctgcggggttgatgtcgtcctcgtccgaggcgtcgccgtcgcgcttgaaggccgggcgccagatgtggcgcgcgacgtcgtagatggcgcccncgcggacgcgtgg

SEQ ID NO: 9930 - DNA, 574 bp, Triticum aestivum
  Clone ID: PAT_TA_9930
ggtttacacctggtttgattcagctgtgcgctttgctctgtttttttgcaatgtctagttctctgtgtaaatttgcctgtgttggatgtctgagccttgttaacatcccccattctgtgtttgtttcagttttattgggttgttgccttcactgcttggttctttccgtagcaaattaagatcagttgaaggcttgccaaagtgtttttttgctaatgctgctacatccatccgttgaatctctcaagactgaaaccatcattttgttgccccctgaaagaatgacaacgaaagaagggcagactggatatgtatatacttgtgattagttgttcgaagaccatggatcagatatcctgctgtttgtttacttgttgtatgatttctgtgctgggttgcccaacgtgttttgtctgttttctgtacattttgctgtgtgcatgaagactatcagaggatccctttgtattttgttcaacatttgtaatggatttgagtgctgtttggctcagcatattgctcctggagctctatttttctgaagcctaaattatttttggaagcaaaaaaaaaa

SEQ ID NO: 9931 - DNA, 286 bp, Triticum aestivum
  Clone ID: PAT_TA_9931
gcagaacaaaggagcatgatgatagactttgtgaaatgctgtttagccttcagaagtaggagccttttgaaaattgcttacaattttctttctgtaaaactagattcactatcctgtaagaatagttgccatactttttgtgctttctgtgcttgcttagtagttattttctcagctgaacctgtatccatggcttgtgttatccaacagcatgcaatctgatattttctgtattcgtctgaatttaaatgatttctggtactggtagattgtattaaaaaaaaaa

SEQ ID NO: 9932 - DNA, 480 bp, Triticum aestivum
  Clone ID: PAT_TA_9932
cgtccgcggacgcgtgggcggacgcgtgggggagcatgccatggcctcggatccgcgccgccgtggccggagaacgtcgcccgccaccggttcttcgaccacaactaccggatcaagttgccccgcctccgatctacccgttcccggccaccccaacctcgcctcgtcattgggcgcgcagagagacggccatggccgcccgattgccgagcgccgccggccaaggtggctgcccgatgcacgagcgccgccggccaaggacccgccggcgtacaaaccccctccacgccatccccatctcgccggagacctgctccaagtctggccgccctccaaacagtactcgctagacacatgacgaaattgacatatgactcttggaggaggacacctagaatcagtcggggaagtagtagtcgttggactcgggcagcaatctaaaatatgataatgatactgatcaacgtttttatttggttg

SEQ ID NO: 9933 - DNA, 743 bp, Triticum aestivum
  unsure (1)..(743): unsure at all n locations
  Clone ID: PAT_TA_9933
gagggaaagcacccgtcggagncggaagcggcgcggcggcggcgggttcatggactctggctccagatccagcggcggcgccggcttcgacgacgacgacggcctcgccgcgcgccgcgaggtctcctcctcgctgcaagagttagctgtcagggtggatgcgaagggcgggagctgcagcggcagcggcacggatcagctgccaaacacaccaaagtcaaagcattctgcaactgagcagcgccgccgtagcaagatcaatgacaggtttcagatacttagggatcttttaccacacactgatcaaaagagagacaaggcaacatttctcttagaggttattgaatatatacgatttttgcaagagaaagcacagaagtacgaggcttcatttccagaatggaaccaagaaaatgcaaagttgctcccatggtcaaacatgtattttcgatcatcctggaaaaatgcacagagtaaagggcaaatcgcagaagatgcctcgcctcacccttcacaattcatcaagaaatggggcctcccctggattcaatatcacaggcaagcttgatgataaccacaccgcggctatctcaggggcaccggatcaggcagaaaccgaccacatggctagtgtgtcctgtagatcggcggcccccaacaatattagataanttccccatccaacacaatggcantcancgggtgatatcncgtaaaatactgtaatacacatnagatgnnag

SEQ ID NO: 9934 - DNA, 483 bp, Triticum aestivum
  Clone ID: PAT_TA_9934
tattttttaccttttaacagcatgtggcagcgtctttttctttttatatagatggacttccctatgaaatatccgactccctaacaatttactctcttcctctgtggaatattacgaatgaggaccaattcaggccatggagtgatgatttccaactttacaagattattccttccatggaatgagattatttacagaattacagaagacctctccttgctcaactagagaaactgaggggttttcccgtggtattgttatttgtcagcacaactcgttctagtgattctaagagaaactagtagcctatcttggtactcacgaccccccaaatgaattatctttagaccctagtttgctcagcctctctttcaggtagaaggtttatggacaagacgttgtcgacagacaatgtattgtttttgtatatgggcaactgcagtcataactttggaatgctctagtaatgcttcttttttcccg

SEQ ID NO: 9935 - DNA, 1857 bp, Triticum aestivum
  Clone ID: PAT_TA_9935
tcccccccggcccccctcattctctccacccgggccaaggggagggtccggctcaacggggcgttggcgatggcggcagcgaccgccgccacgggcttggaggtgccggagctggacctcaagctcacctaccgcggcgtctcttgccaggtcccgtgcgccgaccccggtaccgggtgggagcccccgcatcggcgcccaggcccggtcgtggctatcatcgcggacgccgacgaggacgacgccgacctcgccgtgaacgtcaccgcctcgggcttggactacggccgctggccttggtcgggctgctgtggaagcgcccgggccatgccctcccacgcgtccgcggtggtcgctcacacgtaggcgtcggcgccgccggcgccggccgctggggcctcgccctccccaatctcctcgggtgcgtccatcagccgtggcggtgtctgcctcataggcccttcccacggcgtcggctttcactgtttcccaaatctggaatgttattcttggaagttagtcttatagcatttctacttcaacggaaatgaagccagtggttatgagtctctgggacgtaccctttgttatctctggtgctgtagtcagtgctgatgtattgctcaagaccatatatgtatttggctttggtgttcctttgtttatcgatgctgaccaaggaactggtgggaaatggggcctatggattctccacaaattggtgcttacaggagtttatggcttgattgttttcatgcatcactcgaggtggaaagacaggctacctgcaaaaccagcatattaccagtatgtgtgtgcaatgctggcacttaacggcctatcgctgtttggctgtttcctcattgcatgtggagctggatttggtttatggctgtataacttcactactgtctgttaccacgcgctttaccttccacttctgtatgtgactttcttagcagactttttccaggaggaagatatgcttctagagaacgtatactactccgagatgaaagacgccgggttctttgatgctgactgggattaaacctgcctgcagattccgttccacgctgtatgacttattcgtatgtgaatttgcacggagtagcatcatccaaggtactgaatgaatcttagaacagagatagcgaaggcgccaccatcctcaccggagggaagccctgcagcgacaagggttactacatcgagcccaccatcttcaccgacgtcaccgatgacatgtcgattgcgcaagaggaaatcttcggcccagtcatggctctcatgaaattcaagacggtggacgaggtgattcagaaggccaacagcacccggtatggcctggccgccggcgtggtgaccaagaacatcgacaccatgaacaccgtgtcgcggtccgtcaggtccggggtcgtctgggttaactgctacttcgccttcagaccccgaccccccgttcggcggctgcaagatgagcggctttcggcaaggacatgggcacggatgccctcgaaaagtacctgcacaccaagactgtggtcactccgctctacaacacaccctggctgtgatctggacggacatccgatcacaaacagcacaggcgaaacaaaagtggggaagattgactttttatatgtcatttatacacctgaatgctttcagcttccttgtgcagttgtacttattaccagtggtcaatcttcttcgtggtattaatctttacaagacgggggggccccaaatgttcagtaaagatgctgcagttagactgaagtggcgatactgtcactctttcacccgcacagacttgattaccaataaaagtttcaaaagtccctttcagtcgat

SEQ ID NO: 9936 - DNA, 591 bp, Triticum aestivum
  Clone ID: PAT_TA_9936
ggaaaatgtcgtggcctccgcccgtgggtacacatgatgcatctgatccaagttcgatatacttttggtctgcaagtgaaatcaaggaggctgagcaagccacactactatttgctgcagatgttatttacagtgacgatctcaccgatttgttcttcgacacagtgaggcagctcatgtcacgtggtgccaagaaggtgctgtacttgaccctggagaagagatacaacttcagcctggacgaactagacgtcgtggccaatggttacaagcatttccgaagcttcttcacggttcaagatgtgtctccaggatgtggaggccaggataatgctacactgaaaccaggcctcgtgggggagcagatagaccttgcgagggttcctcagtacatcagggaatatgacagaggcaaggatccgggagatgtggaagctcatgtactgtccagactaaaaatagcatcatcggtttacatcgactgtttatgttcatgctgtgtggaaattatgtgttccccctaggatacacatcttcctgggctgctggataacagcctgcttagaccaaagacaacttaataaaagaaac

SEQ ID NO: 9937 - DNA, 742 bp, Triticum aestivum
  Clone ID: PAT_TA_9937
ggattagcctcctctgcaagtcccttccgccggagccccgcagtcccgcgtcgtcgcctcctctgaatcgtgcgggaggacgaagagcagtgcctcccctgcccgacaccatgaactagcgccgccattcaatttcgcgtccagccctgttctggaccggattctccctctccgccatcaagaacgagcttcccgcaccaggccctgcctcgcggcagatcctcgccttccgcctggaaccgttgcaccgccgcggttccccctcgccctcgacctccatgcctcgccgccccgtctgctcattcttgttgtcgtcgccgccaagaccttgccgcgccggatccgccgcccactgccgggaatcggtccccgacgacctcgcctcgcatccggtggccgtcccgtcgttttgtgtcgccggaagcaccagcaccgccgccccttgacttcctggaatgggcgcatccccaaatcccgctcgctgtgtctgttgacttcatcgccgaccgtgcgggggccacgagagcactaggcccagctcgcccgcgcgaagacccgcaagccctaccgctttgcctgggccgccttctcccctcgctgctcgtcgtgggccgcgcgcctgccggcccagctgcgccttatcccgttctagtccatcaccgagccggcccaagtgccgtcgtgagcagctcagttcaacccaatgcagcccatcctgttttttttcctgctgctccgaatt

SEQ ID NO: 9938 - DNA, 461 bp, Triticum aestivum
  unsure (1)..(461): unsure at all n locations
  Clone ID: PAT_TA_9938
gggggggggcaatgacccgttaattcgtattcgtatatttttttattaaacaattccacaaaactattctatatttaatattgcttgttcattctaaaatcaacttaataattgataattatatatacatatataatataaatatttataatggagaatttatatataaatgtaaactttgctacatggaaacgtacatatatttgaaaacaaatattcatctcataattatccatacatataaaagtaaccaattatgcattagaaaaagttcatgtattcaagaatagtttcatggaatatgttctgtatttctactaaaaggataataaaaaaagaactgaaagagaaaaaaatagaaaaatgaagaagtaaaaagatactccctccgatccataataagtgtcgcaatttttgaactatcaaaagtgtgacacttatnttggattggagatggtatt

SEQ ID NO: 9939 - DNA, 978 bp, Triticum aestivum
  unsure (1)..(978): unsure at all n locations
  Clone ID: PAT_TA_9939
ccacgcgtccgggggatccaggcccgtggctccggccagactcccgaccaccgccggccgtatagcgtccaccgtctctttctctacatcgtagtgccgcaaggatctcgccatcatggcagccacggccaacgcatcctgtctccccgcctctccgcgcctcccggccagcggcgccggcgtccggaacagggggaggctgccaatggccgctgttggctgcactgccggacgcggcggggttcacctgaggagcgcccggcctctcctgtgcacctcctcatccgctgcggcaggagcacggggcagcgggaagatggaggactacaacaccgccatgaagcggatgatgcggaacccatacgagtaccaccacgaccttggtatgaattatgctgtcataagtgatagcttgattgttggctcgcaacctcagaagcctgacgatattgatcacttgaaaaatgaggaaaatgtagcctatattctttgtctacagcaggacaaggatatcgaatactggggcattgattttgaagctgttgtcactaggtgcaaagaacttggcattcagcatatgagaagaccaagcagtagacttcgatccagattcgctgaggaaacagttaccgaaagcagtttccgcactagaatgggctatatcacaaggaaaaagggcgagttnacatccattgcactgtggactttggtaaagcgcctgcggttgcaattcttaatgttctggntcgagaatatggacctaatacggcttttaacaagttaccttcataagaccggtggaccgaataaaaaactattccctttnncacctantgatntaagctnagagggnacccaaataannnaanctttttggnnacccnntcgggggccgggctttcnangggaaantttttttnnaaaaggaaatttaaaaaaaaancnngntcgttcccttcnaanggnttnaaaaaaaan

SEQ ID NO: 9940 - DNA, 877 bp, Triticum aestivum
  unsure (1)..(877): unsure at all n locations
  Clone ID: PAT_TA_9940
gcatcatcgagtggccctcgntctcgaatagagcgaggagagcgaggtgaggctgccgatgcggaggaggtatgtcttcccgggcacggcggtgaagagagtcggcagagcgcagtcggggcgggaggcgttgcacgttccactgggagcgagcgagcagttgaacattcctctgccgttgatgaggagagactggggctcggtgacgaagacgaaggggttggaggagaggcctgtggcctgctcgtagacgctcttgtgccaccagtcgccgaggaggacggtgtgctcctcgtcgtaagagaagggctcgacgaagccgtccggcacggtgactacgatcatgccgttgagccccgccacgcgctgcatcccgtagtgcgcatggtacaggtgaaggtttcgccgggcaggatggggcactgcgtgacgccggcgacgccgtcagcccacggcgtgtcaatctggcggatgccgtgccagtggatggcggtgttctcggtctcgagcttgttatggacggcgacgacgatggtgtcacccctgcgtggcgcggatggtcgggccgggagcctcgccgttgacggtcacagcgagcttctcgaagcagtcgggggactttaactggtacgagatgtcccacgtgtagtggtgcaccttggcctccgccacggccaccagcagccagaagcagaggacggcggcggcagcgagcagtggcctcgccgacggtagcatggtgccaaacacagctgcgtagttaattgcactggcgctggctgtggagtaaagcaagaagaagccacccgctgtgctggactagttcgatcgagcaggtgtggcgtgtgtgggtcgttgttctagcacgcacgcgtta

SEQ ID NO: 9941 - DNA, 632 bp, Triticum aestivum
  Clone ID: PAT_TA_9941
tggtgttttgacataaagttgtgagtcagtgtactggtttgacagattgtattgtcatattcaccctttctttggaaataaagaagaattagtcagttttaggtttgaatgtcaggcaaaaatcaaatgggagaagcgacctgtcagtccagattctaattgttatttggtgttgagattcatatggctgagacataattttaactgggcgccttcagatgtaatctattgcctctgacatgtgatttgctacaaaattatgtctcaactatctatattttacattactactgtaggcttctgaaatgtaaattatgctaggatgtttagctttaactatgatatcctaaatgcgcatgaaaatactactgggattacgactaaaaaaatcatgacatgcgagcaattcttggttgaaatactgtgagcttaaataacatgagctaaactattgtgctatgttcagaattggtactagaaaagataatctaaattgtacattgtgaaagtatattggactcttgcccttttgaaattagtcttctaagtattacttagtaataaatgacatgataacatggttggtttagtttaaagctgtaggcacaggcttgcggtaggggaaaatcatt

SEQ ID NO: 9942 - DNA, 234 bp, Triticum aestivum
  Clone ID: PAT_TA_9942
gcgcacgtcaattcttccttcacagggttcatgactttagtgtttctatcatcaggtggtagaaagttttagaaaaaacttgattgaacccatgtttcatgatcccctatttgtgtgggtagcgttgctacattgggtgtatatcattatttttgtgacaatgatttaaatatttgaccgctagcatacaatttactagcgggtactagtgtgttattgctcttaaaaaaaaaa

SEQ ID NO: 9943 - DNA, 1014 bp, Triticum aestivum
  Clone ID: PAT_TA_9943
ggcacctttcttcactgcataatattgaatcggctgaaatcacaaatctttatgctatcatggatggctataactttctggtgttacgagagcccagctttaagaccttactggcaaacctcaacaatctgagggagttgtaccttgatggagtggacatatctagtagcggagaggagtggagcagtgatctagctaaagctgtcccccgtcttcacgtttttagcatggcgtactgcaaactcaatggtccaatccactcttctctgtcaagtcttagatcccttactgtggtcaacctcaagcttaatggtggaatttctggtgcggttcctgaattcttcacggactttctcaatttaagtgttcttcaactcagttataacaatttcagtggctggtttccttggaaaatctttcaactcaagaatataagagtccttgatgtgtcacacaacgaacgactgtcagggcgtttaccagaatttccaagtagggcttctttggagactttgattctacagtacactaatttctctggtgtcaggctgagctcttttaacaatctcctgtctctgagggagctaggtttttctggaagatcaatttctttggagccaactgatttgttgttcaacaagatcaactccttgcaaattttacttttgctcaattttcaggagagttagcaccatttttctcatggattagaagccttaagaacttgacaagcttgcacctctcggattgctattcctccaagctaacgcccccgatgattggaaacctcaccaagcttgacaagtttggagattacgtactgtggctttgttggacaaataccatcatcaattggcaacctcaacaagttgacttcattgagaatctctgattgtgccttctctgggacaataccatcttcaattggcaatctcaagaaactaagaagattggaaatttcttatactgaattatcatgtccaataacaacagatttggacatctcaacaaatt

SEQ ID NO: 9944 - DNA, 449 bp, Triticum aestivum
  Clone ID: PAT_TA_9944
gaaaactctcgcctcgccttaggttagccgtcggggacgagcagctccggcaagacgcgagttcgcctagccgtggaggaggcggagctagcctctgccccgtccagggtgtgacgccgcctagccgcggaggcaactgagcctcagagcgagacgcgatgcctcggagccgtcgaggccatggagctgcggatccggcgccgtcgaggccgtggagctgcggagccggcgccgtcaacgcccccgagctgccgaggccacgaagccaacgccgtcaaggcttctgcgggccatctgctcggctgcttgcatttggtcttgctgtacgaaatttttcagagtaaaaacagaaaagctctgtatgactgaactagtgttctactctgttgtagttctgctgtaaaagctctgttgttactctagttctgctgaattgatcaaaaaaaaaa

SEQ ID NO: 9945 - DNA, 439 bp, Triticum aestivum
  unsure (1)..(439): unsure at all n locations
  Clone ID: PAT_TA_9945
gcaagtatgaagatgcaggnaggagcagggcttgagctgtgtacattaaccagcaccactactactaccaccaccactactatctacgcaagaatgtgtgtcagtgttcagttcagttagtctaaggctaggtgaacttgggcggccctcgccgctcgccgagcatgtgctcaagcatccgggggcggcgacaagaggcgatcaatcgatcggtcgagtgaaattctttggttcatttgtatgctttgttgtagtttcattgtcttctgcaaagttgtaggcgtgtgttgggcgtccatggtgatggtgtcgcttgtaatgttgggggtggcaacttcaccttttctagcatttccacaagttatgggtcttgtaaattccaagtctcaataaagggaacacaaacttgcctttttgtacagaacaatcaaaaaaaaaa

SEQ ID NO: 9946 - DNA, 1603 bp, Triticum aestivum
  Clone ID: PAT_TA_9946
tttttctttccacgcgttcgctctcgcgtccgcccacgcgtccgcacgaggctgtcttcccggctgcagcaaacttcccccaaatcccctctcctgctcttccccgggacccttccatcccgcctctcgaacctaccgtcaggctttccattggccgtccccgggtctctgtagccgcggggggacgggctagatgcggttgcggccggcaggttggcggagccgcggacgggcgggcgagatccggttgcggcggccatggtgaaggagaccgcctactacgaaaccctgggggatcagcgtcgacgcctccccctccgacatcaagaaagcctactacgtccaggccaggctggtgcacccggacaagaatcccggcaaccccgacgcggcgcgcaaattccaggatctcggagaggcctaccaagtcctaagcgatccagcgaagaaggaggcttatgataagcatggaaaggagggtctttcccaggataacatggttgatcctgctgctgtatttgggatgctttttggaagcgactattttgaagattatgttggtcagcttgctctggcatccaaagcttcagtggaggttgatgaaggtttaagcagtcaagatgccagagcaaaggttcaagagaagataaaagaatttgcaaactgaaagagagaaaaagcttactcagagcctaaaggatcgacttcagccatatgtggatggtagaaaggatgattttgtgcactgggcgaatgcagaagccaagcgtttatcagaagcagcttttggtgaggctatgcttcacactgttggatatatttatgtacggcaagcggcaagagaacttggaaagagtaaattgtatatgggtgtaccattcatagctgagtgggtaagagacaagggtcacaccattaaatcgcaagttcatgctgcttcaggtgctattgctctgatgcagctacaagaaggaatgaaaaaggtggaggagggtgccgataaggaagagcagcttatgaagagttttgaggagaaaaaagaagccatgcttaattctctatggaaaattaatgtggtcgatatcgagtcaactctttcccgagtatgccaagcagttcttaaagatagcactgtctcaaaagatgttctgaagttgcgaggaaaagcgttgaaaaagcttggaacgatattccaaggcgcggaatctctctaccatcgtgagaacagcctacgtgtggagtctccgatgaaagaggatggaacgacagcgtcgcactgaagactgataacatttttaacaatttgtgaattattcggatctctgtgaattattgtctgcttgtaatattgtggcacagcaggtttgctctggacgcacctgtatgtatggtttcgttggtctttctgtaaaaagagtgaatgctgaaacacgacgcatctctgttattgacccggcattctttcttgttggctgttgcttagccagtgtatcacattaacatttcctttttccttttgagaggaatgctccactctcacttagtgctgtcagtcagtttgtgcagattggcccatatagtcgatctgttggtccgctcttac

SEQ ID NO: 9947 - DNA, 829 bp, Triticum aestivum
  unsure (1)..(829): unsure at all n locations
  Clone ID: PAT_TA_9947
ccgcccgtgcgtccacctgccgccaccaccgccgctcctctcgcccatcggcgttgctttcctcctctagtcctccagccactccactcgcccatcggcgttgctttcctcctctagtcctccagccgctccagaaaaatccttactggatcccctgcaccctctcttcttttgaccgcctaccctgatatcagtctctgcactcgattccccacctctgagcgccgccactcccctctatcctcgactcctccgacgtgcgcctcacattcagctccaacgacgggtctctccctcacgttctccttgtactgccaaatattcattgcggagagcgggttcttcaccgccaagttctcagatcactggtccaagaagcagcgggcatcgctctacgactgcgacgatgtggagatagacaagtcggcgtcgtcatctgctcgacacgtggccgatgcggacctgcgttttttccgtcgctgcagcagagccgcaccagaaggcgatttcagagtcaaaaacccattgttgcgtcctaatcttttttgagcaatgctaggcggacgacaaacgatggacgaccagcgcacgacgatgaaatccagccagcgaatctcgtccatagccatgcaacgtccgctggattgctggtcgtgcatagatcggccagagtgtgtcgtgtgtggagcaattccgatctttttttggtccactgcagttttgcagtgtaaagcaccactagatggactaaattactttgtatttgcagtgcaaagcagcactagaggaccaagttactttgtatttgcagcgatnataccattgccgt

SEQ ID NO: 9948 - DNA, 783 bp, Triticum aestivum
  Clone ID: PAT_TA_9948
tacaacatgcaagggaatttgataaggtgtctgaagagctgaaagagaaagatgaacaacttgaagccatggaatctgcaaaccaggcccttattattgtggaacgaaggaccaatgatgaacttgaacaagccaagaaagaacttatacagggcctacaacagatacaagtaactcgatccactattggtgtcaaaagaatgggtgtgcttgatgaaaaagcttttgttgctgcatgcaaaaagaaagagggaaatggtgtttcgaaaaaaaatgcaaagtatgatgtagaggcaacacttgtgttatcaaaatgggaagatgagatcaagcaaccagattggcatcctttcaaagttatcgatgttgatggacagacaaaggaaatagtccgggaagacgatgagaagctgcaagccctgaaagaagagctagggcaggaggcccacgatgttgtggtcaaggcccttcttgagatgaacgaatacaaccccagcggcaggtaccccgtccccgtgctgtggaacttcaaggagaaccggagagcgccgcttgacgaggcagtagcctacattctcaagcagtggaaggcgagcaagaacaagagaacgtacttctcctgagtgagatcgacgtctcctagtcctagctgtagtttctggcctgtggggctgtaaaatcgtatcgtagtaacagtacttgatgcttagtaaattgcgaacgaaataaacacaattgcgacgagggttttagaaaaccattggattttttagagatactaag

SEQ ID NO: 9949 - DNA, 787 bp, Triticum aestivum
  unsure (1)..(787): unsure at all n locations
  Clone ID: PAT_TA_9949
aaaaaaaagttgagnccccttcccgttgttaccccccttacccgtgcanaccctggagctccaccgcggtggcggccgctctagaactagcggatcccccgggctgcaggaagttggctcgagcgatgaccgagccgccacccactggcggtcctcggattgtcctgatcgaccaagctcagagcacgtcatcggctcccaagccctcctgcttcgacaccgcagatggcgcatcaatggccagagcagaggagaagaggaggagatcctttccgtgcagatagcaagaaatgggaggcagatgggcctgccaaggatgggattggggtttgatgcattccttcccctcccaggcaaggtcttcgtcaaggagatttctgggattcaaggtcccctgaccctggccaaggactatgacatggaatgacctgttaatgttgttgacacatcttctcttctttatcgtgtatgctcctgtgtctacgagggagctcttctccacgatgccggtgactagcgcacgcggtctccgtttgatcgtatccccggcaagtaaggttttgctttgtggcctcaagttcagcgtatccttggttttatattgaataaatgcctgtagtctgcactcatttctgtaacatagaagtttatcatgctcctcttcatcttatgctttgtagtgaacttgatacgtatatttagtgtctatgtcaatacctgtggttctgaagtgtatttgagatgtattttccttctggaaaggccacactattccttccaggttttt

SEQ ID NO: 9950 - DNA, 391 bp, Triticum aestivum
  Clone ID: PAT_TA_9950
gctaagactaagttatagtatatgcgtaaactgacaccgaataggatttgtggaccacagtaagactgctctcttagaaaagtttccggtgcaaagttctaaaaaatgagtaatcaacagtaagactgaagagaccgatacctttatcaaggaccattttctttgtattttttaaaacatcatctgaaataacagttacatcatttatgagcatgtttgcaatttcattcaaagggaaaattacaaacaatgtaatagcaattgttgaaaactgtcactgcccctcttgcagattgaccattcctcatggggtcaatgacatccaaattgtcatagttaataaattgattgtaacccgccccgtgggcaagggataaacctaaaaaaaaaa

SEQ ID NO: 9951 - DNA, 1022 bp, Triticum aestivum
  Clone ID: PAT_TA_9951
cgcattcttgatcagcagattatgactagcgcgagtaggtttgaagggcctccagaatcatctgtccaggagatgatagatcatgctcaccagactggccgtctaagccgaattactaccaggatgagagcaaggaggctgcaaagggaagcagaaaatcctacatttgtttcttcttctactccagacggcgggctgccaggaagcagcgcgccggatcctccttaggcgtagtttcaagtccaactttcctcggaaggaattgatttattgcaacgccttacccttgttggccttgcaaatacggaaaggttggcaactgcagtgagcgatcttagaagaatatccaggccaagcctccgagcatcaacttcgtcaaatttgccaaatcatgagccgccagttgatggaattcatgctgctgcagcaccgtctgcagatcaaacttctaattcaagcacaatggctgtgattcaggaggatgctgcttttactgaaagcgtaggagaacctagcaatgcagggtcctcaagaaccctgaggaggaaggggaagaagccacgccttaaggttccttggatgtggatggtggcgaaacacaccggaacaagagaaggcggctgaacttaaagctaagaaaggccgaaccgggttttgcagaaggcttcagcgttgctccagtttttaacggttcgctcttttcaatgggcccattttatccctttgggcacactgtgctgagtctgatcaaaagtcttcctcttccgcttgtttaatagggtactgtttagttgtttgtttgtttagttcctcccatgtttaatttatgctattactttagacatgcataccaaggaaacctgagattgtcatcagatgaattttccttgatcgaaaagcagatgtgtactatatgggatcaacttttagtgtcataaataatgcactgtcatttgagtcttggttgtagatggctgccgtgaacatgtaaaactgagctgatatttagtccaaaaaaaaaa

SEQ ID NO: 9952 - DNA, 619 bp, Triticum aestivum
  unsure (1)..(619): unsure at all n locations
  Clone ID: PAT_TA_9952
gttgacatggctttgagaagaaagatatctgctgtcaggaataagctagaagatctcatacggactgctaagtgctccatggaaggagttgaatttctccacaccagcttgtgcaaggctgagttgggtttgaggcagctagtaccggtcgtaccatgcgatacgcaagaaaatgaggagtcatttattggtagcatcattccaaaggatgtcaccatcctcacacctattgatatcaatgcaaggggcacatgctctagaataaaggggcacagggatggtgtgaggggtggatctggtgacaanaaaagaaggccaggaattcatcaaaaagtcgcacgcaaatgtagcatttgtaagaaagtggtattccatgatgcaaggacatgctctatgaaaaatattacacaanagtagagcacatcaacctccatgagcaagaagtaccaactccaaagatgctcatgtccatgctgccagattacgacgagagagcaagtcttgcttgctgccaaacccgctataactgagtggtctatccactatgctttgcactgagtttgtatcagacttgtagaccatggaccagtcctcgctgagaattgatgagcaantatgt

SEQ ID NO: 9953 - DNA, 1114 bp, Triticum aestivum
  Clone ID: PAT_TA_9953
tcggcacgaggccgtcgccacctccggccgcgactcgaccgccgccgcgcacccactcccgctccccacgatgcggcacctcctcctctcccgtctcctccgccgcgcctcctccccctccccgcccctccgcaacctccaactcatccgtgctctctcctcctcctcccctctcccggcctccgacaccgacctccgcaagtacgccgtccgcgcgctcctcgtcctcggctgcggcgccgccacctactactccttccccttcccgcccgacgcgctccacaagaaggccgtccccttcaagtacgcgcccctccccgacgacctccacaccgtctccaactggagcggcactcacgaggtccacacccgcgtcctcctccagcccgactccatcccggcgctcgaggatgccctcgccaccgcccacagggagcgacgcaggctcaggcccctcggctccgggctgtcccccaatggcctcgggctctcccgggccggcatggtcaaccttgcgctcatggacaaggtgctagacgtcgatgtcaagaagaagaccgtcacggtgcaggctgggatacgtgtcgccgagctcgtcgatgcgctcagagagcatgggctcacattgcagaactttgcgtccattcgagagcagcaggtcggcggcatcattcaggttggtgcccatggtactggtgcgagattgcctccaattgatgagcaggttattagcatgaaactggttactcctgccaaagggacgatagagttatcaacggagaaagatcctgatttgttttatcttgcccgttgtggacttggtggcctaggagtcgttgcagaagttactcttcagtgtgtagaaagacaccaacttgttgagcatactttcgtttctaatgcagatgaaatcaagaaaaaccaccagaaatggctttctgaaaacaaacatatcaaatacttgtggattccatatactgatacagttgtcgttgtccaatgtaatcctccttcaagatggaaaactccaaagttggcatcaaaatatgtaaaggatgaagccctacagcatgttcgtgacctttaccgagagtcattgaagaaatatagaact

SEQ ID NO: 9954 - DNA, 1711 bp, Triticum aestivum
  unsure (1)..(1711): unsure at all n locations
  Clone ID: PAT_TA_9954
acctccgcctgtcgaggcagatggtgctccagatgcgctccgagctgctgtgtgtgataacctgcagctgtacatggagaagtatgaggaagagttcagggcatatttgaaggagtttgttgaggccgtgtgggggctcctcatggcgccgacagtctcgccgtcccgtggtcagcttgctgtgactgcgataaggttcttgacaacagtcgctgagagtgttcaccatgctttgtttgggactcctgatgcaatgaaacagatatgtgacagcgttgttgtgcctaacctgcgactgcgggacgaggatgaggagttgtttgaggggaactgggtggaatatgtcaggcgcgatgcagagggaagtgatacggatacactgaggcgtgctgcgtgccgcttgctgcgtgggctagccgcgaactaccgggaacaggtggctgttcttgtatcagcacaggtccagcagatgttggctgcatatacggctgacagggcaaacaactggcaggagaaggacgctgcgatatatcttgttatcgctcttatgcagaagcctggtgccacaggtggtgggacactggtggttgacatggagacattctctgcatctgtcattgtcccgaacctgcaggcccctgattgggaatctgagccaatgctgaaggcaacagtcctcaggttcttgaaggagttcaaggatcagatacccaaagccaccgcactgcgtccgcttccaagtgtgacaaggttcctgacgcatgagtccaatgttgcccattcctatgctgcgatctttattgagaacctgctgatcaccaaggatgttgtccaggtaccaggggtcaatgtggtgacaagagcttcacgctatgttgctgctgatatcaactcttttgcccagcagattattcagagcctgtccaaggcgttaggttatcctgattcttatgagaacccctatctgatgaagtgcctgatgagagtgcttgggattgcaactatcgctggccaagttgttcatgagataaccgctcgtcttgtgggcattctgatggaagtgtgcaataaccccaagaaccctgactttaatcattacttgtttgaagctctggcagcagtgattggcaaggctggtgaacaagacccagcattggtacctttgtttgaggcaagcctcttcccagtgctccagaggatattagttgaggacatctcaagagttctggccatattcttttcaagatattccgcacagcttgtcaatttgagcccgccacctctctccgcaagaattacatgcagctgtttgggtgtcttgctccagcaatgctactttgggattngaccaccatgtgttccctgccttgggtccgctttgctgcgacatccctttccggaaattcccaaatgactttnaccaagaagntagctgcccaataccttaatgaatcccgtatccnatttcacgcaacaacacggaattctnattccacagctttacacacttangggaagttggttgggcattacaacccacacataatgagaatggangccccttaacccttacaaacnagcaacatgaattgtgaatccctgtggggcangtcctgngnatcaatatggcagtgtctgnattcgtgaacatcacaattctcnaaatntcagttttgtccaccaatttaagtnctaanactnaaatcccaaa

SEQ ID NO: 9955 - DNA, 830 bp, Triticum aestivum
  Clone ID: PAT_TA_9955
tccggcgacgagggtggcggagccaagggccctgctgtctctagcagtggtgccgctggctctgatcgagccgaaatcgccggcggcgcacagggagatgcgtcgggtggtgcgggagagtttccccattcgcagcgagtggggcgacatccaccttcaggtgatcaagcatgcgacctttgcggagagagggcgcttcatcggcgacgagggagcggacgaggtggagctcctattctgggctatccaggaggccaaatcggagatcccagagcaagcggccccgtgggcgtacttccggacagcaaatccatcgcggctcaacatcaggctgccgcgggtggaagcgctttccagcatcccgctggaggagctgccgccgggggtgctgcctcctgctcgtcagtgactcgctaggtgctactgcggcggaacgccattgaagcccctccatggtcaggggcaaaaatggcgaagcattcgctgcatcatggacctggtgggagggctggtgaggcaatggaagattttgtgctccgacactcaggatgtgcttcttcttcgatgtttaaggcttttggatcggcgaagaggggagctgcttagaatagcctgggttatgtgaattttgctgaactatgtgttctctgtttatctgtttgaatgctccagtcttgggcagtttatctgtttcgttttgtaataggagtagttggcttgttcttctgtggcagctacttttggctgttgccgaacgctgtacaatgtccttggtacgctggtttcgcctttgcctttttaataaaagttggggcaggggggaaacccct

SEQ ID NO: 9956 - DNA, 805 bp, Triticum aestivum
  unsure (1)..(805): unsure at all n locations
  Clone ID: PAT_TA_9956
gagatntttgttccgcnaagctcgaaattcaccctcactaaagggaacaaaagctggagctccaccgcggtggcggccgctctagaactagtggatcccccgggctgcaggaattcggcaccaggagtaacgcagcggggcggcggcggtgccggtggcggggacggtgcgcgccctcttccggccctccccctcgtccgcccggtccgccctgccgccggcgcgcgccccctgcgcccccttccgggccctccgcacccacttcctccggcgcccccggcggcccctgcgcccgttcctcccccccctcgtccccttcgtcaccgccgccatcccggccgaccccgccgtctcctccctcgcctacctgggctcgggcgacgcgtacgccgcggtcccggcgggcccgggcgcgccgggcccccgggtcccccgcgggccgcgcgcggacggccccgctcgagggccccccctgcgggctccgcctccgggcgcggccgccggggacgggcgacttcgtggccgccaccttatcggggtcggcggtggcggaggagaagacgacgtggcgggcgtcggggcggtgctgccgcctcacgttcctcgagcggcaccggcggctcgccgtccacgagtacctgccgcacctccgccgcgccgggcaggaggccatgttcggcaaccgggcccgcaggctctactcaaaaaggagggagctcaacttcccattcttggaaggacgaggtggtggagcttacttcgacttcgaacacccccaccaccttttgaaccccctggcccaggc

SEQ ID NO: 9957 - DNA, 502 bp, Triticum aestivum
  unsure (1)..(502): unsure at all n locations
  Clone ID: PAT_TA_9957
gaaaagatggccaccagaagccacgctgctgatcgcctttctattggtgtcgaccagcatgctcgtttccgtggtggcatccagagaagttccgtcgacagatccgatcaatccagcaaactcacttctgggcggaactggtcgcaaattcacaatgacacgtgtggagaagacgcgtgaggtggtcccaggcggaactggtgagggtgtcagggctatttcccaggagaagatcattttcggtgcgcccaataattttgtctggtcgacgcgccttccgccgtgcagagcacgagcatgctaaagaagtccagatgatatcaagagctttgtttcccctgcaccttcgtcccgatgataaaatctgtactaactaaacggctaatcttcgcccggatggcttagataaaatgcacgattctttatcgttgtttccatttaattaacgcgatggatcaagactgaaaataaagggggaaacttgttcagttcanaanaaaaa

SEQ ID NO: 9958 - DNA, 221 bp, Triticum aestivum
  unsure (1)..(221): unsure at all n locations
  Clone ID: PAT_TA_9958
gactatttagagtttgatttcttttagtgaacagnaatgttcttttttttcccatttgttttgcataattagaggttgtaggctttccgcatgtatgtgtctgacagatgagtcgtatgtagatttttgtgtctgtcaacctatttcctgttttgtagtgaacgaatggaagtttcaaatttatattcctccataagttttgaagtcgctgaaaaaaaaaa

SEQ ID NO: 9959 - DNA, 640 bp, Triticum aestivum
  Clone ID: PAT_TA_9959
ccgggggccgccccccccccccgaggagccgcccccgcccccgggggagccgccccccccccccccccggtcgcggcccgcccccgccccctccgccgccgccccctccgcccgcgctgccgctcgccgccgcctccagcccgcagcctgcccaccccgcccccgccgcggcgcccccccctctccccccctccgcccggtccatccctctcccccgcgccgcgcctcgcgccctcccccgcacgacgctcccgccccggtccgtctccaccctctcccggtctggtgcggggggggcgcccgccgtccggccgttcccctccgtcctcctcgccccccccctcgccgcccctccccccgggccgttcctgtgccgagggctgtggtgggtgcgctcgggccctggcggggcatcctctgggccgccacaatccactcctagactgtttcatggtggtcgcgctccgtccggcgtttgccctccgtcatccactccttcctccatggggatcgtgactagaggacgtaattgagcagatggctatattggaatcgaagaggacctaacggggaatctatagaggtgctcatcgggctaggggaggctctgcagcggctgaatcagtcagaggcgatcgcc

SEQ ID NO: 9960 - DNA, 638 bp, Triticum aestivum
  Clone ID: PAT_TA_9960
tcggcacgagggtgggcctctgttgtcagcgaccgtggcttggttccggcccggtcgccccgtcgcgcgcgtcggcgggggaaagatctcatgccaccgcacgtaaaatcctgcccccgccgagggtgtttcggtcttttcgctcccgggggtcgtgcgtggcgtgcggtggtttgctcgtccggctatggggtgggggagggcagcgacccaccctttcgtcctctcattcgtccctctcgtctccctctttctggatctcgttctctctcgtcgccggcgcttctccttctcgattcgacgccgtccttcaggtggtttcccaccctaccttttgggtgaaccatgtcggaaacttatctggggcgatgatgataaaatttggctgacataaacttttcttcgattattcgaggagctgtgggcttaaaaaacccactcccccctcttttcgaaccttttcattctcactgaatattgacggctctctcttggatggtcattctgttgagtgataaccagaggagctcgacttcattggtgggggttgatctggtgaaagaagatggtggagctaggttgtatgatatatcaaaggcgaatccgagccctcataaaagaccaaaataaaaaaaaaa

SEQ ID NO: 9961 - DNA, 305 bp, Triticum aestivum
  unsure (1)..(305): unsure at all n locations
  Clone ID: PAT_TA_9961
tcggcacgaggatgactttgtctgcaagncacatgctcgtagaagatgacaagagtatacaaggcattccgttatctgtatgaatccgccgaaggagcaaaatttggacaggacaggactgaatcctgttgttgttgtgttgttcatgtactcacctcaccgtagggtgtagggtgtcgatatgccgtgctgtagcttgatgtcatctatcttgctgtggagaataacaaagactacggattatgtagccaggcgcaagttctgcacgtacgtcaatgtaaatcgtcagttatgtaaaaaaaaaa

SEQ ID NO: 9962 - DNA, 1197 bp, Triticum aestivum
  Clone ID: PAT_TA_9962
gcacgaggctcctccaggcatacaataaagcccagtgcagctgatcgcagggaaaagagaagaggatgctgacctccatcttgcaaataaaattatgcacaacaaacagtacaacatgagtaaaagtgtagaggatgaatatgaatatggtgatgctcccactaagaaaggcaaaaggaccagagaggcacatcaggagaataggggcactcagagacatattttaactcagaaagagcgctgtttgtattgctttgagaacccatccaggccaaagcatctggttattgctatagggaacttcacttacttgatgctgccacagtttgagcctcttgttcctgggcactgtgtcattcttccattgcagcacgagtcttcaacaagaacagttgataaaaatgtctgggaggagattcgcaacttcaagaagtgcctcctgaagatgtttgcgcagcaggacaaggatgtggttttcatggagactgtcataagcttggtcaagcaacagaggcattgcatgattgaatgcatccctgtcccatgcgaagtttcaaacaaagcgcccatgtacttcaagaaggcaatcgacgaagttgaggaggaatggtcgcagcacgagatgaagaagctgattccaacgagcggtaacctgcggcaggtcatcccggagaacttcgcctacttccatgtggagtttggtctggaccgcgggtttgtccacgtgatagacgacgagagcaagttcggtgctggtttcgggctgaatgtactcagaggggtgctccggttgccccgggggaggacatgcaccgtcgccgggggcacgagtccatggataaccagaagcaagccgtccccggcttcatgaaagactgggagcccttccgacgggacgaaccgcctcgggggggcccggtacctactcacctctgggaccctttgggcgcctcacgccgtccgctccgcctcctgtcgggggacggggttcctcctggcgccggcatgttcccgtgtctttaaatgcttttctggttgaatttaacatttccacaggatatggctgtgaactgtattagttcaaatatatatcctgaagggacgacatcagaggcagcccagaggaatgccatcattgattcagactaaatgaaataaaaagaggtttatattttttttaaaaaaaaaaaaaaaaaa

SEQ ID NO: 9963 - DNA, 553 bp, Triticum aestivum
  unsure (1)..(553): unsure at all n locations
  Clone ID: PAT_TA_9963
caaacgttgggngagggaaaaanttcctgttgtggaccaggcgtccgggactctgccgcagcaggtttccaacaccacagcttggccacactcgtcatcattggctttgaatctgaagactgctttgtgagttatgtcagacatgttatggtgacggcggtgaatctagcagatgtgttcctgtatagtaggttggagtgcggcaactgcgaggagaagcctaacaggtacccctggactaaaaggcagagggtctctctgaagaggaggcttgcagctgggattgagtcgtttgccatatttcactttggtgccaagaggcctggccatgtagcaaaaatggagtacccacagtgctcgctgcttgaggcaaaaaggtcttttacgtgaggcaaaagaggtggttgatttcagagtgctcactgctgtgttagaagtgttgttactttggtcgagagttgtttcagtctttctatatatatcgaccgcaaactgtattatgtctttttaaggtttagtgtattattatgctgtaaaaaaaaaaaaaaaaaaa

SEQ ID NO: 9964 - DNA, 508 bp, Triticum aestivum
  Clone ID: PAT_TA_9964
ttcggcacgaggcacactcacacgtatctcttttttttttaagctcactcacacgtagctcttgaatattctgaaacaaaaacgtagctctcgctgcactcccttttcatgttcttccgtcccctcgctccaccaaaaatccaaaattgcttccactcgagctcaagattcccaacaacacctcaattcccctcttgattccttgccgtgaccttgctcgtcctcacctgcacgcaccgctgcagctcggctcactggtgcggccacggggtgagcctagtttggctcactgtacgcctcctcgatctctcaggccggtcaacagcgacggaggggtagtagggcttgatgagaagctgcgccatggaggatgcgagcttgccgatcttgactgtgtcgtcctcgttagcgtccttggaggggatgtgggcgtggatctcgtctcccggagccagcttggatccacatcgattgtgaggatgctggcggcgttgttttccctcgcatc

SEQ ID NO: 9965 - DNA, 638 bp, Triticum aestivum
  Clone ID: PAT_TA_9965
cgtccgcggacgcgtgggtaaggaggcagttttgttacttgaaagatatctaagacaatgggctgatggttctctacatatcaaggtggctcaagtatttgcagcaacaagtctgctttctgatgcactctcccactatcaatctgcactaaggataaacccgcacaatgaagcagccaagaaaggattggagcgcttggagaagcaaatgaagggagtagacccggatgcgcctgaagatgaggacgagaacgaagctgacgacgtcgatggtgaccaggatgacgccgagctgctttaggaactgtggactcaaaatggcgtcacatatcagtatactggaggtaccatgaatgccgaagctgtcactgaccgaagggggcttgctgtgcggggtgggggttggtggtacttggtaaggtggctggcgtaacaactttgtgtcgatggtttgattgcacgagtgggaatgttgtgccactgccacggggttactctcatgtaactgtgtaggataggaggtgacctgttgttacggaaggaaaccccgtgagtgctttgttaacactgggttccaaaaagtaaatcattcgaatgatcacttagctacccgaccctatttcatagtttggacatgg

SEQ ID NO: 9966 - DNA, 707 bp, Triticum aestivum
  unsure (1)..(707): unsure at all n locations
  Clone ID: PAT_TA_9966
atgctctaaagagagatgaggatgcattggagatgatggagaaagccatattttctgataagaagaatccacttcctaagtatcagaaggctttaattctggtaggacttcaaaaatatcaggaggctctggatgagttggaacagctaagggagattgcacctcatgagagtagtatgtatgcacttatgggcaagatatacaagcaactcaatattctcgacaaggctgtattttgctttggcgttgcccttgatttgaaacctcccgctgccgaccttgctataatcaagtctgcaatggagaaagtacaccttccagatgaactgatggaggatgatgacctgtaagttcactttaaagcacaaactgagaaatggacatttattcagatctatgagtttctgcttgtgcttcggagtcatggcctgaatgtgctttctgagaggaactcagaggttgaaggaagcaagcacatcatgtggaaccagaatttacagcaactatggattctcttggggcattagtgtaccattaaccacccagttttgtagcattagctgtaacctgtacactgacagcacaaacacaacatgtgtagtagtttaggtgtacaagctgagtattggcagcgaggcctgtatcattgtacaattgtacgagtatcaaaagaaatcgtcgagnaaatataaaacgatgccggggca

SEQ ID NO: 9967 - DNA, 1084 bp, Triticum aestivum
  Clone ID: PAT_TA_9967
ccacgcgtccgctgggtttcggcataaggtacggcaagagcaggcccggtccggagttgccgggtcgccccccgcggccggcctgcgggggcccgatcaatgtcgagcaatggagattgtgatcaggaatgtgctaccgacaaccacgcatcgctggtgcaagtggcatgtgctgaagaagtgcaaggagacactgggtccaatgtacacgaaacagagtgacttccgagcagagtttcacaaggttgtcatccacatgttgacaattaacgagttcgaggacgcttggaaaatgctaatagagaaatacagtttacagagtcacacatatatgacccaagtctatgagataagggagaaatgggctaagccttattttcagggggtattttgtgcgaaaatgactagcacggagaggagtgaaagtgccaacagtatgctgaaaacatatgtgctgccagggtgtccaatgcacatgtttgtgaaacactatatgcgtctccagtccgcgagggacgcagaggagagttatgaggaaaagcgtaataaagtggccggagttgtgttcaagtgcaatatgtcaacagagagacatggcagcaaggtgtacacatgtgcaatgatcgagcagctaggtgagctgctctaccaagctaacgcatatcgaattgaagagttggataagggtagattgtacagagccacacacacgcaggctgagatgcgcgagaagtgggcaaggggagtttacgaagtgaagatgctggatgatggtcgtttatttgagtgtgaatgtggtctgtttgaacacatgggcatgccgtgctgccacatgctaaaggttatggatgttcttggttacactgagatcccggagaagttgatattgaagaggtggacaagggatgcaagggatgttcttctgtctcatttgcaagtctaccaaagaggccatgcaagcagtaggataatgacacaccggcacacaagtctatacatgcacgcaatggagttggtccgtctgggcgatgcatccgtagaagcctatgagaaagggatgagaatcattagggatggtattact

SEQ ID NO: 9968 - DNA, 1570 bp, Triticum aestivum
  unsure (1)..(1570): unsure at all n locations
  Clone ID: PAT_TA_9968
gcccggccgcgtcggccccgggtccgtgtctcccctctggggttggggtcgtcgccggctctgctgcacccggccactggtggggcttgcccttgcggtcgagggccgattcccctgacgagcggcgggggctcgtggctcgggtgcctgtcccaggtgccttcgtcggcgcgtccgctagggttccggatagatgcagctattaattcaggaaattcaggtggcccagcttttaatgataggggcatatgtgttggtatagcttttcagtctctcaaacatgaagatgtagagaatataggttatgtgatacccaccccagttatcaagcattttattcaagactatgaaaaatctggagcatatacaggtttccctataattgggatagaatggcagaaaatggaaaatcccgatctccggaaagcaatgggaatgaaacctgatcaaaagggtgttcgtgttaggagagtggaacctactgctcccgagtctggatgtctgcaaccgtcagatattattcttagctttgatggagttgacattgccaatgatggtacagttcctttcaggcatggcgagcgaatcggctttagttaccttgtttctcagaaatataccggtgacaaagcccttatcaaagtcctgcgcaactcaaaagttcatgaatttaaaataaagctagcgacccacaagcggctcattgcagctcatgtcaagggcaggccaccatcatattacattgttgctggctttgtttttgcagctgtctctgttccatatctccgttctgagtatgggaaagactacgaatatgatgcacctgtcaagttgttggtcaagcatttgcattcaatggcggaatcacctgatgaacagctggtggtggtatcacaggtgcttgtggcagatatcaatatcggttatgaagatattgtcaatacgcaggtccttgccgttaatggtcatcctgtgaaaaatttgagggacttagtgacaacagtggaaaattgcaaggatgaattcttgaagtttgatttggagtatgaccagattgttgtcctggagagaaaaaccgccaaggctgctaccgaggacattctgacaacgcactgtataccgtcggccatgtctgatgacctgaaggcctaatggagaacaagatgcagctgtctggtggccccgattggggtcactttttttggttgaacaccagcccggcaccggtagaagcctgagtttatgcatccagaccttccgggcctcctgggtgtgagagagcttcacncaaagaaggctgagggtaagtgggcgtcacatcagcataagctggagcggtgtccagcaggagtcatcatcaaagtgatagtggttaattgataaccatggtttcatttttttcaaaattaaattaaattattgaggagaagagaagctcatatttttgcctcagccccaccggaaagtccaatacaccctcgtcgccagttacaatttatcaatgatataggttaccatctgctccctcgttttcacatttnaaaaaaaaaaaaaaaaaagaaaanaaaaa

SEQ ID NO: 9969 - DNA, 679 bp, Triticum aestivum
  unsure (1)..(679): unsure at all n locations
  Clone ID: PAT_TA_9969
gtatcccgncggggcatccatcgttgaattgtgcccctccaccccctgacccgtcgccgggatgttctgcctcctgtaccggggccctgccggctggagggcccgctggtgctgccccgctggctgctggccctgcccttggccgtccatgcgcgcgccgcgggggaccgccgcagcgcttcttggctggaccggcttcggagcggcgaccggcccctgccggtcaatcgcggagcttggtcgcgcgccagttcccacctgccacccacaccccccgcccgaagacgtcgcttgggagaggtaggcttggcgacggcgatctcgcgcgacgaacggatggggcgccaaaagctgaagtctcacggcaggaggtagagctgggtcctcatcgaaactctgagtggatcgtcgattccactgacaacctccacgcagttgagctatcagggccaaggtgatggtggctgctgctaaattaggtctcgtatgttgtagaagaaagagcatgtgcatgaaccatcctagtgcgatcccccatttgttcatatcagccaatggaaaaaatgttgcggcagccacaatatattttgatgtacttgtaatgatgcccttggaagttggaaccgatattctcctgctgaccaaatgccgcggcaaggaatggatctgaaaaaaaaaa

SEQ ID NO: 9970 - DNA, 760 bp, Triticum aestivum
  Clone ID: PAT_TA_9970
aggacgatcaaacgcagaaagcgttagaagatcgtttccggtttaagactgcagctaaatcatctcagccaaatcataatgtttaggccggccagaaatatctcctgtgtgaacaaaaaggaatatgcaacgcactccccatcctccatatcccaaaatgaacagaaagcgcctggattcaaaacggcaccaaatgataaaactagcagctaagagcatcttctgtcagcttgtgtcggacgacctttgtacaccaagctatactcactggtctttcacttgattaatcggaatgagaatggtcccaggattggcctcatcttcggtccactcgactgatttcttctccagaaacttctcaaccttccttcttctttgtcccatcttgaaagtgccatcgtcaacaccaataataactctcaaattatcaaaagatgggatgttagccaactgcctaagatgaagtctcagaagatttgctacgtttgctgcatcctgtgagcgcagatcaagacataactcatttttggactcttgtttggacttggtgatctcagcagccgatttttcatcagataatcgagccatcctataatagttctttccttctgtcataagatactcggcttctttcttgttaccctccctaaaagcatcaacagccttcccgtagtactgcttcatcatatcccagtgctgctttgcagccttacgatagttctggtaatcatcctcatcacgcacaactggttctttgctg

SEQ ID NO: 9971 - DNA, 824 bp, Triticum aestivum
  Clone ID: PAT_TA_9971
ttcggcacgaggcttatcacagtggaaggaagatggtgtaccttaaccctgtcactggagagagcaaagagcagcatctgcgcgaggaaagaaacgagatgtgggtgaagttcttcgatttcaccctcctgaaaagcatggacgaggatctagcagaggaagcggatgacggcatgcaccccgggaaggaccaatggctgtggccgttaactgggcaagtgttctggccgggcattgccgaccgcgaaagggaagagaaatacattaagaaactggacaagaagctcaagagcaaggtgaagttgctagagaggcagaagttgggttacaaacaaaagccgctgggacaataacagtagtaaaaccggaagaaccaaaagagatatccgaaaatcgatcacgtcagctgcaagatccggtccatcagtgctgatacaccatgttttctctcgcggcaatccgagaagaggcgagcatgtcacattcttgctgcagaagagacgaagcgtgaaggcgccgtggttgtgaatacgcattctttcctccaacccccggatctcccctctccagaggagcttggcgaagttggaggacacgggctggacacagaacagtttttcttcctgctcatacaaaaataggttacatagttccactggttcccattctttatttttgtcttccccgttctgctatggaactggtagtagctgcacgcacggggagcagaattttggtaggacttgtaaccgatcacacgccgttgtacatgtaaattcccaatagagagccacgcacggatgcaagagcaataattaaagcac

SEQ ID NO: 9972 - DNA, 1771 bp, Triticum aestivum
  unsure (1)..(1771): unsure at all n locations
  Clone ID: PAT_TA_9972
gcaacggcaacctgcgcctcgtcaagagtaagcgccgcgcgctctctctctccccgaacactcgcgcggctcggtgttgtgcactgcggacggattcggccgggctggccgcaagtccgtgatcctccgcgaaattggagcgagcttcgatttgtatgaacttagattcgcagggagaaaccccaatttcggcagggcgtccccgattcggagtcccatcccggcacgtgccccccctcccccccccgtgccgccgtcgtgcccgcccgccgccgctccctccgccgcgtctcggaaatggcgaggaaggtggacctgcggggagccaaggacgcgaaaggggacaccgtgctccacttcgccgcgtgcaagggcagcctggagatctgcaggttcctggtggaggactccgggctcgatgtcgattcggcgtcgaaaacaggcgagacgcccatggtctacgccgcgcttgcggggaaggtccaggttatgaggtacctcctcgaccgcggcgccgacccggccgtccgtgacgacaacggctcgacgccgctgcactatgcggcagaggaagggcactgcgaagctgtaaggctgttgctgtccaaaggagtccccgtggaccctgttgatcaccggggcgcgccgttacagttggcggttgcaaaggaccgtgtcgaggttgtgaagcttctgttggagcatggggctgatccaaacaaattggtcaatcatatccttacaccactcctgatggctgtcattaggaactccttgaaatgcatgaagctactgattgaggcgggtgctgatctgaatgctcgtggtaactctggaccaactcctttaacacaagcagttgatgacggttccaccgactttgtcaagttgctcctagaggctggagctgaccctaacattcctagcgagcatggtgcaattccagtcgagctagcagcagttcatggcccgatgtgaccttgttgaagttctatttcctaggacaaaaccaattccatctctgccagattggagcgttgatgggataattagaaccgtgaagtctccgcttatgaatcatcttcaggcctcggtttctgtggaagaaaaaattgcgttttggaagtcacaaggaaaggaagcatttgcaaaggaggactaccttacagcaatgaccttctatggcaaggtacttgacacagatccatctgatgccaccatgtatgccaaccagagcctctgctggctgcgtatgagacatgggaagctagctctggaagacgcgctcaagtgcaggatgatgcggccccgttggtccaaggcctggtatcgtcaaggcgcagccctcagcttcatgaaggactacgagggcgccgctgacgcgttccgggtggcgctgcagctcgaccctaagaatgaagagattaaggaagcgctgaggaaggccgagaaggctgtggaggagccgcagcgcgggtaagataagcaactaccgttgctcgtatgttaggatgtgttgcgctggggaggcagccggtttcaaactctgctcgatcagaggccccgatttcgtcggcagttacaggggcgagacctcgttctttctgacagcattatcttaggtgggtgatgtgttgtgttgtacatatagcctaaatagatagattgattttgtgacgatgatggtgactggccaggcgaaaaatgcatagctagtactaacagtagctgcattctgttattttttcgccccaatnaaatgtanaggtta

SEQ ID NO: 9973 - DNA, 1092 bp, Triticum aestivum
  unsure (1)..(1092): unsure at all n locations
  Clone ID: PAT_TA_9973
gcggagtccaaactcgataaactgcgatgcggatgcttggagatggttgtcctttgtcaatcgatgatcagtctgccataacaagcagttttcgttagtcatctgaaaggggcttactcggactcgaaataagttgcagcttttctgttgtattgggggttccctcacgctggactgggtcccgccttcaccaccagggggcccggttgccggcctcgtcattctcgcgcctgggcgctggggcactcctggccccgccgccctagcgtccgacttttccctgctcggccctctcgtcccttgcccgtgcaatgtcgggggcgcctttcgtaaagcccgtctcacctctctgtgttatttcctattgaaccgactgttttttgttcatttcttatgtattgatactttctagttaaacattcgtttaatatatgtgctgaacattattaaaaaaaacgacaaggagaccgagccaataaaaaatgagcaatacctttcaacctacccaccaaagatgagcattttggaggatgtgatccacaagatgagaaccccggttgtttacttgaacataacaagattgaccgactatagaaaggatgcgcacccctcgatctaccgcaagcaacacctgagtgaggaggagaggaggtcgcctgagagataccaggactgtagccactggtgtctccccggggtaccggattcctggaacgagctggtttacgcccaacttttgatcagtcagcatcagatgctccaacagtaaatgcaagtatgagttttctggatgcttgtatatgaaacaatttcaagggtaatgatcatcaagatgatccacgtagatagtgaagctgccgctggtgagatctctcaataccccctacacacattcttcggttagaggcatctaggacttcatgttgtaaagttcatgcctacgctaatcaggaataaacaatactagtatagatgagatgatacatagatgcttctgtgcttctggctgtgctcaaggatgtcacatgatgcattcgattttgttctgtataagcngaaaatacgaatcgtgtgcgcaaacaaaagagctgt

SEQ ID NO: 9974 - DNA, 656 bp, Triticum aestivum
  Clone ID: PAT_TA_9974
gctctcaaaacctaagcttaaacctcaaattttggcatgctttggagagatcgctcttgctatcggcaagcattttgaggagtaccacctgcaggctgttaggaaaaagctgaaagaagctgctaacccaagatattatgccaatgtttctgatgaggataaggttgattacggtaaccagcttagacagggaatatgcaaggcttactctggcatattgcggggtataaaggaccaaaaatctgggttgaaggtagcagcggatctagttgagttcattgaagctgtctctgaggacgagagcagggatgcaagggtgacatccgctgcagttgatgtgttggatcagtttggtttcatggcggagtcatggaaaaagggactgatttcggaattagggaggtaacatataagaggaggaactcgttctgcttcttttttggcaagttgccacagatgcatggaaggacagcaacatgtgtgtgtcgttggtagtatgatgatgtattttggtggcaattggatggacagccaaactgaactcgtctagtagtcggcgtatgtctatttgctagctgttgtcgttgagcttgcagattatgtatgattaaccaatcctgaattcctgcttgtgattggtagggtgtgctgtcaag

SEQ ID NO: 9975 - DNA, 713 bp, Triticum aestivum
  Clone ID: PAT_TA_9975
tcccccgggctgcaggggaaaacatcagttcaaggtgcaaaacctttgaaaagcactacgaggccattagcaagatgctatctcaaagtggatttgggtgggattgggtcaataacaagctgtcaattgatagtgaagatgtgtggcttaaatatgtcgcggctaacaagaaagtaggattttacaagaacagggtcattaagaattgggatgctatcaccaccatatactcaaaagatcatgcaaatggtgaaggtgctgtcactggtgctgaaactgttgtagaaccaactacggaacccaatgaagcctctcctgaagtgccaaaaaaaaaacaacgacttggtgatgccatcctgtgccttcttggggatatgaaaggctcatttcatgatgctttgaagtcactcgagcctttacctctgccccaagttacacctcctgctgaaatccttgcgacacttgagatgatccctgatctagctcgtggtgacatcttgcgatcttatggtaagttgatccttagcgaacacttgtacaaagcgcttcttgagcttcccatgaacttcaggaaggaatggttgttgatgttgaattagtagaatggctcttgatagataatatgtatgtgtgttgctactcttatttctcctagtttgtgagagacttcgaacttgtcctaaagtttcattgttatgcacaagacttgctat

SEQ ID NO: 9976 - DNA, 447 bp, Triticum aestivum
  Clone ID: PAT_TA_9976
caggtcaatggcggtgaagctggctgtggtcgtcgacagaggcggcggtgctggggcaggctgtagtgcaagggggagcccggcgcagcaggtgatggcgcggcggaggcgagagagaggatgactccatggatttgcttgggtggtaggcaagtctcattcttggctgtttgtcttggaacttggcttcttcttctttggtgtttccttctctccctccatctctgcttacatgggctcgtgactcagatcgggttgctccagtcagtagttgactgtgcgtgtgtctcctgccttgtgcctggagccgtggtgtggtgtgcgtgcgtgtgcagagtcagaagtggcgtaaagaaatgaatgggagaaatgatgtatgtgtgagtgaagagattgataattgatttttcacgtttggaaatggcttcatgagactcaaaaaaaaaa

SEQ ID NO: 9977 - DNA, 640 bp, Triticum aestivum
  Clone ID: PAT_TA_9977
gtttctctttcggtcggcgccaccccctctctccgcttccgtttgtcttcggtggcacggcaaggtagcgacacgacgcgggaaatgccaaccgcaacatgctcatgccttccgtccttgagggatgcattctatcatcactgtccatcaacaagttcaactccgacaatggttcaccaataatgtgggccgctgcaccacgtcagcaacctcgacgccctgacaggccattttccaactgggcctgttgtaaatgacgagatcatgaggatgtaatcaagtaatgttgctcctgaaaatgaagatgtacttcgtcgtgccactaatctcggcaaaagagtagattatggtgcgcctcgtgccatagtggaattgaatcacaaaaaagtctacagattcatcaaaccatgaaggaggttagtttttacctgagccgcaacggcggccgccagggccgcgcggccgccgcgctgctggtggagcggctccgcctccgggctgccccgccaccgccaggccggtcgcccccctccgccgcggggctgcaccccgaccccctcccctgccctcccgcagcctggccccccccgcgccatgcccccgcccggcgctccgagctgtagcaggagctgccggtcca

SEQ ID NO: 9978 - DNA, 846 bp, Triticum aestivum
  unsure (1)..(846): unsure at all n locations
  Clone ID: PAT_TA_9978
ccactcccctgccttctcgatccaaccccaccaagctcctctgctcgacccccctgctccctgccttctcctcgtcgcgcttgggcccgaggccccagccagccgcgccccgccttctcttccacctcgcgtcgccgctccctgcgtcagccccgcatggacgctgtccctctgcacctcgtcttcaaccagcccgccaccacgtcctcgccattgaccgaaccagctagcaagatgagccccatcgcgcctcccctatccttccttccctcctgcctcgtttctcaccttcctttatctctcttttcttggatgcagcgccaccatgggagcctcgcagaagctccgcgcgggtcgcctcctcgccaagtcccaacacggccacccaccagatcctcgcggcctctctgtttcttcagacgaacaggagctccaggagtccatggcgccgcccttgcctcgtctcgttccgggggattcgaacgccaagtccgtgccgccccggatctcctccgtcctccccatcacgcgctgtcgtcgccatcagcgagctcgaaaacgacgcgttgactcccctcgctcgaagccctgcagcatccgtggttggtccagcctcgccaggagccgctcgctcgacgtctctctgcccgcgtcgaaccgtcccctgctcagctcgcctgcagtcgctgccgcgttgtactctgctttgagatcgcgcgagacgatgagtggtcagcaaccgcgttggccggatcggtcagatccagctcggcccgcgatgattccccgtcggcccagtgcgcatcctntcnggcccagcttcagttcggcctgctaggcccgatt

SEQ ID NO: 9979 - DNA, 1288 bp, Triticum aestivum
  Clone ID: PAT_TA_9979
ggtatcctcttcttgttgcgacaattgtctgtgctgcagtctttatagtattcacgcatcttccatctgagtccagcacaagggttttgccatgggtgttctctttgttagtagctttgttcccaatcacctacctgctggaaggacagttaagggccaacagttttgcagttgaggatgaagcagagaagttcaccaacatgttggctatagaaggggccagaatgtcgcttttgggtctctatgctgctatattcatgatcattgcactagaaattaagtttgaactggctttgctgttgcatgataaagccgcagatgttacacatggtgtatctggtggtcggggctctgcatttccacccaaagcaaggctactgcagcaacggagatctcatgctgcaccaactttcaccatcaagagattggcagctgaagcagcttggatgcctgcgatcggcaacttatctacggttttgtgcttcatcatctgccttgttctcaacataacacttactggtggctcgaaccgtgctattttcttcctagcgcccatccttctacttttgaaccaggattcagatattgttgcaggattcggtgacagacagcgttacttccctgtgacaatttctatttctgggtatttgctattggcatcattgtataagatatgggaggaggcttggcctggcactggcagtggaggatgggctcttgatatcgggggctcagtttgggctctatgctgtgaaaaatgttgctcttctcgtgctcacgctacccaatcacatactcttcaatcggttcatgtgggactatgtcaggcagaccgattcgaagctacttctgacactgcctctcaacctgccatcgattataatgacagatgtactttctgtgcgggttttagggctgttgggagctatttattctctagcacagtacctgatatcaaggcggataagaattgctgggatgaaatatatttgaggtaaatcttgtgttccttggcgcaactgctgtcagtcgagtcttcaacttcctgaagcagatccttgtggtagagagaatcagagaaacaatgctcgatggtaatcacttttgtactggatgattgttatactggtttacccttgaggtgttgtactgtagatgttttgcacaggacataaaatgcatcaccatgggtcctttactatgggcttgtagcaagaaagaaaagaattgctgtttttcacttgactaattttaatgcgttttcagtcgaatttttaaaaaaaaaaaa

SEQ ID NO: 9980 - DNA, 377 bp, Triticum aestivum
  unsure (1)..(377): unsure at all n locations
  Clone ID: PAT_TA_9980
ttgtgttttttttttttttaggccaccatataagtaaataaatgatttaaatgcaggcctcctgatccctaccaagcaagacctgtgcctaactggctattccctgtcaagaactctcccgaaatcctctacttatgcaagaaatataaccctcttgtgcctaaaaacagtggaataagcgaatcttcaccgagattgacaatggagcccacgcacattcacattcaagaaaacagtccaagactgagacaccataaaccttgtttcggagcagaagatgaggaggggagacaatctgtcacctggggtgatgttggaggcgangttctcctccccgtccccggaggagaggagagatgggattcctttncggccct

SEQ ID NO: 9981 - DNA, 262 bp, Triticum aestivum
  Clone ID: PAT_TA_9981
gcgggcaagcactttggcagccctctcgcggcggttccgtgcgcggtttcgagcatctgcccctcggtctatggtagcctcctggccggggtgtggaggtccatgcccccgaatgacaagcagggggcatgatgggtcagacagatagatactttagtggttgcggggactccagttgttgggaactatttgggcttgcgagagaaatttttggccctgaaaacaagtcaggagcgggcctgagccttcttccaaaaaaaaa

SEQ ID NO: 9982 - DNA, 666 bp, Triticum aestivum
  unsure (1)..(666): unsure at all n locations
  Clone ID: PAT_TA_9982
ttcggcacgagggttaggacatgtttggcgccggcagcgagacgtcggcgacgacgctgcagtgggcgatggcggagctgatacggaacccgcgggttatgcggaaggcgcaagacgaggtccggcagcaactcgccgggcacgacaaggtgagggaggccgacctggcagatctgcgataccttgggtttgtcatcaaggagacgctgaggatgcacccgccggcgccattgctgctgccgcgtaggtgcgggagcccgtgtcaggttctgggcctggacgtgccggagggggtcatggtgatcgtgaacgcgtgggcgatcggcatggacccggcgcactgggaggcacccgaggagttcgcaccggagcggttcgagcagaacgggagggacttcaagggggcggacttcgagttcgtgccgttcggcggcgggaggaggatatgccccggcatggctttcgggctggcgcacgtggagctcgcgctcgcggcgctgctgttccacttcgactgggagctgccaggcggggcggcggccgaggatctggacatgaccgaggagttttggcgtcacggcacggcttccggtctgacctttgtcgtggtcccccggccccggagtaaacgcacttttngtgatgtgcatcctatatttttttttt

SEQ ID NO: 9983 - DNA, 1096 bp, Triticum aestivum
  Clone ID: PAT_TA_9983
cgtccgcctaaacccagcaccacccagccggagccatgcgccggccgcagcgccgcgctgtagctaagcaaagccgcgccaaggatggcgacgagatccgcctccttgaggcctggatcgacgccggcaagcccctcccgggaaccaagccgcctcccccctccgaggagtcctccgccgccaacgcacgggtaagggcacgagatgtagtggctaaggcggcggctggggactactcggattatggcgcgtccacgcggttcgacgagctaccgctgtcgcagaagaccaaggacgccctgcggaaggcggggtacaaggagatgagcgagatccagcgggccgccctgccccacgcgctctgcgggcacgacgtcctcggcgcggccaagaccgggtccggcaaaaccctcgctcttcgtcatcccagtcatcgagaagctgtatcgggagaaatggagtcaagaggatggtgtgggttgcattattctctctcccactaatgatttagctggtcaaatttgggaagtggtcaggaaggtcgggaagcaccataactttagtggtggtgctatcgttaagcgcacgggtatcgagcaagaaaaagaacgcataaacagtttgaatatcttagtgtgcactcctggacggttagtccagcactttgatgagactccaaacttcgattgctcaaatctccagatattggtgcttgatgaggcggatcaaatacttgataaaaatttcaaatcccaagttgacattatcctttcacaaattcccaaagctagacaaaccttactgttttctgccacacagacgaagtcagttaaggacctcgcaagggttagcctaaagaatcctgaatatattagtgtgcatgagcaggctagcacggctaccccagataaccttgagcagtgtgccatgattgtgcctcttgaacagaaactgaatatgctttggagtttcatcaaaaggcatctaaagtcaaaatactagtcttcttatcaagtgttaagcaagtcaaatttgtgtatgaaattttcaagaactacgtcctggtattcctctaaaatgtatgcatgggcggatg

SEQ ID NO: 9984 - DNA, 749 bp, Triticum aestivum
  Clone ID: PAT_TA_9984
acccacgcgtccgcttcttatcaagtgttaagcaggtcaaatttgtgtatgaaattttcaagaaactacgtcctggtattcctctaaaatgtatgcatgggcggatgaaatacgaagtacagcaggccatagtagcagagttcagcgaaagtacttcggttttgttttcaactgatatatttgctagaggactggatatagggaatgtggattgggtggtacaggttgattgtccagaaagcgtcgcactgtacatccacagagttggtcgcacagctcgttacaacaagaaagggaaatctcttatattcttgtgtccacaggaagaaagaatgctggaaaaattgaaggcaaccgagagtaaaatacctataaatgttcgaaagccaaaagtggaacaactggagcagatatctcagaatgtagcagcagtgcttgttaaatttcccaatctgcagcaactaggtaaaagggcttttgtgacctatctcaagtcagtgtacctccagggagacaaagaggtgttcgatctgagcaggttctctgcggagaattttgctgcatacgcctcttcacttggtcttcctgttacccctaaaatccgcttcgtaagccacaagaagaatgtgtcgaagaaagatatgaaggacattgatgtgaaacagatgaaacacaaagctgaagtcattgaaataaatccacaggtcaatcgtgatatgcttgcagatgatggacctgacgatgatatc

SEQ ID NO: 9985 - DNA, 756 bp, Triticum aestivum
  Clone ID: PAT_TA_9985
cccgggtcgacccacgcgtccggggcaactgagagacggggccaagcactccaacgcaatatagccgatccccattattgccacgcgcccgcgcccgcgcgggatcagcagcagacccaatcccagcgaccgactccccccgactccccacccctccctggatcgatgcgcggggaagcagagccagcagcgcgagcaggcgccgccgacgcgggccacccgcgctcgccggacccgcacgacctctccgacgaccccgactacgccgacgccgcctccgtccccgcctccatccacgcggcgatgcggaccgacatggcggacatagggtccgaggagacggcgaggatggacgtggtgtacgagaaggagcgcgtcaccatccaccccacgcagtacggctccggccggatcagcggcaagctgcgcctctacctgcagctcggctccctcttcctgagttgggagccaaatgagggagttaacagtttctcaaccagttcagtcactgcagaaatagaaaaatatagaagtttgtacaccattcaggccttgcctctaagtgacgtgcgcttcatccgtaggcacaccccaacatttggattggagtacataatcattgttctctcatcaggcttggcttttcctcctttctatttctacaatggcggaattcgtgaattgttcgcaacattgaaacagcatgtctttattatcaggtcggatgatgatcctaatgtatttcttgtcaacgac

SEQ ID NO: 9986 - DNA, 789 bp, Triticum aestivum
  Clone ID: PAT_TA_9986
aggaattccccccgccggccataccgcgtcccctccctctcttcctcccccaacgcgccggccgcctccacctgccataccgcgtcccctccctctcttcctcccccaacgcgccggccgcctccacctgccataccgcgtccccgctgccgccatggcctcttcaggaggcacgcccctccatggtgcgaagcagcaggccaggatctggatgaggaagaggagatccgggcgccccaacggtggatggatcgatgcgaggtgacgacgagctcctccggacgtggggggcagcgaggccggagatccagtcggcgcatgcccatcagggtcgaagctgcagcgctccggtccccaagctgcctccaggctcgcttcctcctccatcctcgggcacggaggcaaggttctccggcggcggcgggaacctccaggcagagagcgacccctcgtcaagtaggggatcgatttgtcctgcagcttctttcccctctataaaggagattttttttcctttgcttgatgtgtttccctcctttcaattgtatgatttttaggatgggccttcctatccataagtttgcctttatactgcatattagttcactcttttgggtagataactaaactcctgcaaccttactaaatcattgaagttgtccttcccaaaaaaaaaaatgctttacaacaacttgactgcctgtgtatttgtgtagttttctgcatattcatacggctctgaatgttgttccgttccttgataaatacatcgctctacagggttgatta

SEQ ID NO: 9987 - DNA, 603 bp, Triticum aestivum
  unsure (1)..(603): unsure at all n locations
  Clone ID: PAT_TA_9987
cgcgtccgaggccgcccctccgccgtcggaagcagcctcctcctcgacgcgccgccgtcggccgcagcctcctcctcgcgccgccgtcgtcggaacgggacgggcaaagcaacgccctcgccgcgactgagaggaggcgccccgccgccgccagagcgtcaacgtcctcctccgccggttattcccgagggagggtataaagtttttcttctgtcaagaggggtgggtgttcgcacatttcctcaagtagagaagaagcagtataaagttgtttggtgataatggaaccaaagcattctgctgaaatgtccaggcatttggacaagcaaaatcatgccctaatggaaacataccgagcaatgtcccatgagttgcataaactacaggttgaaggaggaaacaatcaatgcgcaagttgtatgagctgatgtctgcaagaagaggcttcctccaaaagcacaaaaggaaaaaaggcggcccccgggagcgggcgaagcgagccagggaagcgaagaacaggaaccatagaatgtcaaccgtgaatctgcaatatatgatgttacgtggggatgcaagtttggttgaatagcaaccgatcttnnn

SEQ ID NO: 9988 - DNA, 147 bp, Triticum aestivum
  Clone ID: PAT_TA_9988
gcttatgttgaaaattttgtagctttgaagtacctatagccctgtgttcgttagtgttttcttcttctgaaaaccagtctaattgtaactctggtaatactgatacggtaactctgtattgccatctttcatattttaaaaaaaaaa

SEQ ID NO: 9989 - DNA, 625 bp, Triticum aestivum
  Clone ID: PAT_TA_9989
ggagaacgcaaaaaatcccgcggctcgctcgttccccgcatcgacggcgccggtgccggcgattcacgcctgcgtctcccgccgacccgcctccgtaccaccaccaccagcaccacccacctttcccctgtctacttgaccaatcccgtgttcaacaggcaatctgatctggttccccaaattttgttggttgccctagcctgtttcgtccgacctcagtatccagatccatggcgccctccgatttctccttccacccctccgccctgatgggctcaaacgccgccggatccacctcccggttccccgactgggccctgctctgcgaggagccgcgtctctcggagcgccggaacgagaccaccgccgagtgcgagaccagcgagggccaatccgtggaggtctccttctggctcgtcgacccgcccggcgcctcctacttctccttcaactgccccggcctccacgcctccgccttcgacgactacgcgccgccctccctcgtctgcgccggggccgccttcgtcctcttcagcctcacaatcaggggctccacccaccacttcgtctacaaagccgcccccgcaggggagcagtcactgcaactgctcccggaccctccagt

SEQ ID NO: 9990 - DNA, 668 bp, Triticum aestivum
  unsure (1)..(668): unsure at all n locations
  Clone ID: PAT_TA_9990
gcaacctgctactttacttgatagctagtcatgttctaggtgcactatggtacttgctatctgttgatcgccaaacagcctgctggaaaatgaattgcaggaatggaagtgattgtaatattaggtacctagactgtgatacaccaaatcagacatgggctagtacgactgatctcttcagccgctgcaatgctagcaatgacaccatcaccttcgactatggcatgtttcagcctgctctgtcaaatcaagcgcctgctcagggtttcttgagaaagttcttctattccctttggtggggtttacagaatctaagttgctacggccagactctttctgtgagcacctacattgngtgagacactgtactgtatattcttggcagtactcggtcttgtcttgtttgcgcatttgattgggaaatgtgcagacctacctgcaatctatcactgtgagggttgaggagtgngcgattatagcaaagagatactgaggagtggatgagacatccgcaactttcctgatgaactgcgggaaagagattagacgatttatccagtacaaggggcttgcaactcgaggtgtggatgaagtccctatactgctcgtcctacctgccgcgcgacggcgggccccttggcgccacctttgccgggacctttncccag

SEQ ID NO: 9991 - DNA, 659 bp, Triticum aestivum
  unsure (1)..(659): unsure at all n locations
  Clone ID: PAT_TA_9991
cacgagggcacggcgcgcgcatggcggtaggcaggatgctggagctcctcgtcttcttctccacggccggcagcttgcttctcgacttggcggcggtgttcccctgtatcctggccggcccatactacccgacgtttaggctgcccaaccagttgatgtggtggacttccttctgcggtgccgtcccgtggggtgccgtgctgctgatgttacaggccaactgctggtgtcacggctgggaggccaccaacgtcgacctcctggtcctgagcgccgtggagtgggtcgtcgcgtgttccaccttcggctcggcgtgtgcggccctcgccgtcgaccagctcgccatccagcacagctactgcggcccgagggacgccgtgtgctcaatgtaccttgtggccgccgcgatctcatgcgccgccggggctctcgccgccgcgtcggccttggggatgctctggatcctcgcctcccggttccgcccagttcacgcggcctagtcaggctcagctcacgtagtgacatgccgcgtgctcttgttagagccccagggaagcactagctagtgtcgtggttagagatttagtacgtactccctctgcttgctgatttctttcgaatcagttacgtggcttgtagaatngtgttcaattacaaaa

SEQ ID NO: 9992 - DNA, 813 bp, Triticum aestivum
  Clone ID: PAT_TA_9992
gtcactagttgttcatgcaaatttcgacatgtctttcagggagctgcaccaggtgctgcagaaacgaatgggaaaaatgagcctggcaaaacatctggtccatctgccaatggggttacgtccaacagtgaaagcggaagtgatagtgagagtgaaggaagggatgccaattcttaaaatgattcacattcaaaggagaatgatgtaaatgaaaatgtaggcacttggcttatttatagttttatgatagataaagtggattgcacatttctttgcataagatggagggtacattcggtgatgcaggcagtgctcagaatggcgtatctcattcatcatcgcatggaacatttaataaacccatgccgttggttccagtacaatcaggtgcagtgataggagttgctggtcctgcgacaaacttgaacatagggatggactactggggtgcaactggctcttcacctgttcctgcaatgcgcggcaaagtaccgtctggttcagctcgaggagagcaatgggatgaaagggaactgaagaagcagaagaggaagctgtccaaccgggaatcagcgcgcaggtcccggctgcgcaagcaggctgagtgtgaagagctcgggcagcgcgctgaggctttgaagtcagagaactcgtccctcaggatcgagctcgaccggatcaaaaaggagtacgaggagctcctttcgaagaacacctctctgaaggcgaagctaggggagtccggcggcggcggcggcagcgatgcggtccccgacatgaacgaacggtgcgacaccaacggcggcagccacc

SEQ ID NO: 9993 - DNA, 508 bp, Triticum aestivum
  Clone ID: PAT_TA_9993
caagaggccgcacaaaaccccgcgctctgattctccaaagcggcggcgcggcgggcatggacggtgccggcatggcgacaccgccggaggccaacacgtcgcccgcgcccaacggcggcggctgcggcgggatcagggtcgagaattgctacgtcttcaagagcaggctgcaggagtacgcgcagaaagccggcctcatgacgccggagtaccaaaccctcaaggaggggccttcccatgagccaatcttcaagtccagcgtggtgattaacaacgtcaagtacgactcgctgcccgggttcttcagccgcaaggctgcagagcagtcggccgccgaagttgcgctcatggaaatcggcaagtctgtggcgttaccaaccaatgcaaccatcccggcagtccaagaaactggtctgtgcaagaatcttcttcaggagtatgctcagaagatgaattatgctattccatcttatatttgcaacaaacaaggtccatacatatgcaccgt

SEQ ID NO: 9994 - DNA, 1374 bp, Triticum aestivum
  Clone ID: PAT_TA_9994
cgtccgcggacgcgtggggtacaatcgtgatggtgggagcggccgtggttttgatgaccaccgtggtgggagcggtgctggttatgggggaagaggccaagagaacaaccaaggtgacggtggctatgggcaggctccccctaaaggccctccatcctatggcggtcctccaggtgactatgcaccgcccccaagttcctatggaggcaacaatgtgtacagttcagactctgcagtgccaccccccaacagctatggcggtggtcgaggcccttacccaccaagctatggtgccccacctccgaacccatacagtggcggtgccccaggggggcaaggaggcctgccacctacatatgatggtggttatggtggtcggtctgcgcctgggggtggaggcgcacgtgctcagcacatggtgccaccttacgggacaccaccacccccctatatgatgtatccaccgggaacagtatatgcccacccgactactcctggtgtgcatccatttcattatcctatgcaaacaaatggaaatcttgaacctgctggagctcagggagctgcaccaggtgctgcagaaacaaatgggaaaaatgagcctggcaaaacatctggtccatctgccaatggggttacgtccaacagtgaaagcggaagtgatagtgagagtgaaggaagtgatgccaattctcaaaacgattcacattcaaaggagaatgatgtaaatgaaaatggcagtgctcagaatggcgtatctcattcatcatcgcatggaacatttaataaacccatgccgttggttccagtacaatcaggtgcagtgataggaggagttgctggtcctgcgacaaacttgaacatagggatggactactggggtgcaactggctcttcacctgttcctgcaatgcgcggcaaagcaccgtctggttcagctcgaggagagcaatgggatgaaagggaactgaagaagcagaagaggaagctgtccaaccgggaatccgcgcgaaggtcccggctgcgcaagcaggccgagtgtgaagagctcgggcagcgggctgaggctttgaagtcagagaactcgtccctcaggatcgagctcgaccggatcaaaaaggaatacgaggagctcctttcgaagaacacctctctcaaggccaagctaggggagaccggcggtggcgactcggtccccgacatgaacgaacggggcgacaccaacggcggcagccaccacaaggagccctgactgatgacgcatgcggcctctaccactctacttacatagctcgtgatgattgatgattcttgtaacaaacaaacttggcggccccgatctgccacacacacacacaatcagatgattcttcc

SEQ ID NO: 9995 - DNA, 1417 bp, Triticum aestivum
  Clone ID: PAT_TA_9995
ttctcaaacctgcctcctgatgtgactgttgaggaactgcaagagctttttggaggaattggccaggttggaaggatcaagcaaaaaggtggctacaaagaccagtggccctggaacataaaaatctacactgatgattctgggaaagccaaaggagatgcttgccttgcttatgaagatccttctgctgctcattcagctggtggattctacaacgattatgacatgagaggccgtaaaattagtgttgtgatggctgagaaatcagcacctagagctcctacatctggtcatggaggcggacgcggtggaggcggcggctatggcgcggatagacgcagagatggaggaggccatgggcctaacagaaaccagggtggtggttcgcgttcgcggccgtactgaaaacagtcatataattactaagattgtcatctgcaagaaaccatttatattcatgttctctctggacttgtactcatacaggagatcgtaagaggcagctggataagctccaaatgctgatatgtttgagatgttattacagccggtggatcactgctgtaagctttggattttgctttggagaacaggtagggtgtttttgttgtgtggttgattcgcttgatccaggatagtctgctagcgatgtgtttatgtgaatcttatttacttgaagtaaagcccttctgaatacgaggaaattagcagctcttaacgacatttcctttatctagtccttttgagtttccatctgctaactgaacttcagtggcgtgtcattgctgtctgctctttcagacaatcctgaagctgcagatccagcttcagttcaattggctctgattttcttcaattcatttctttccttgtattgttcttcacggtaaacggcagctgtcatatgacatactacttgagtaatgtttcattgcagctgttatatgacgtacttgagtaatatttcacttccgtaaaccaggagccacccagcagtgcttcactacagcagccaaaggaacccagagtcgagaacggtgaatttgtttctgaaaacaaggaccaaactctgggagatgcatctcgtgaggcaaataggtccaacgaagatgtgccagaaaagtgctcagataattcatctgcttttacaagtgtggaatgatatgtgctgtttgaatcaaatgcaatggccttccagttttacatcttgatttgcaaactagtaaaacctgaatagctggcttcgcattttagaaatataattgcataacagatggacgtacgtggaccaaccaaggtcggttggtggtccatgttggccattagttattaggaaatttgcatgatgatgtatctcatgttgcttatctgatcaatgaactattattaattaatagtcggtgtttttttttgaatt

SEQ ID NO: 9996 - DNA, 787 bp, Triticum aestivum
  Clone ID: PAT_TA_9996
ctattgatgacagccgtgcctacttctccaactacggaaagtgcactgacatcttcgctcccggtctgaacattgtttccacctggatcggcactgacaaggccatcaacaccatctccggtacctccatggcttctcctcacattgctggtcgccgggcctactacgactctctccagcccgctgaggactccgagtatgctctcgcttccatcacccccaagaagctcaaggagaacctcatctccgttgctaccgagaatgccctctccgatatcccctctgacacccccaacctgcttgcctggaacggtggtggctgcagcgactacaagaagattgttgaagctggtagctacaaggtcaacaaggctgctccctcttctcgcgttgaggacatcaagcacgccgttgagcagggggtcgaggttgtctctggcaagctgaccactggcgctaagcagcttggctccaaggccgagaagttctccaagaagatccacgagctcgtcgatgaggagctcgagcagttcatcaaggagcttaacctgtaagatatatcatcttatcatgttttaatggttacgcatttgtttgttgggactaggttggcattggtttatggtttgggtacatgatattgataatggcgcttgttctctttgatgaccagttgtcatcgcgcgccattgcatgggatagttcatgaaagcgggctgtatttaggctttgctcattattacaataaatctcttattctaagcaaaaaaaaaaaaaaaggccccta

SEQ ID NO: 9997 - DNA, 657 bp, Triticum aestivum
  Clone ID: PAT_TA_9997
gccggccgggttgggactagctcgtgatgattgatgatgatgattcttgtaacaaacaaacttggcgaccccgatccgccacacactcacacaatgagatggttcttcttttttgtgccaaaaaagagaatgccctctccgatatcccctctgacacccccaacctgcttgcctggaacggtggtggctgcagcgactacaagaagattgttgaagctggtagctacaaggtcaacaaggctgctccctcttctcgcgttgaggacatcaagcacgccgttgagcaggaggtcgaggttgtctctggcaagctgaccactggcgctaagcagcttggctccaaggccgagaagttctccaagaagatccacgagctcgtcgatgaggagctcgagcagttcatcaaggagcttaacctgtaagatatatcatcttatcatgttttaatggttacgcatttgtttgttgggactaggttggcattggtttatggtttgggtacatgatattgataatggcgcttgttctctttgatgaccagttgtcatcgcgcgccattgcatgggatagttcatgaaagcgggctgtatttaggctttgctcattattacaataaatctcttattctaagaaaaaaaaaaaaaaaaaaggccccta

SEQ ID NO: 9998 - DNA, 1754 bp, Triticum aestivum
  Clone ID: PAT_TA_9998
ggagttcccgcatttgctggtcccggcgaggtccgctcctctgctcgcgtgcgtggcggcgcgcgcggcggcgacgcgtggcgccggggcccgcctctccggcgagctgctcacgccccgagcccgcgccaggtcgggcccactggtggaggtagagctggaagctatagctgccgagagactgggttcgataaggggtgattgggggaggggctcgtcccgccgaaatgcccgcgagcccgatggggtcctccgagcgaagcaagccagccatgcagtccctgtgaaggcaacagaggaaacagcacgctaccagctgtggcaccccatctccagtttaacctggctcgcccagcattcaggcggagccactgcagccactgtgcgagtttatctccccacgacatcctacgggcacgacgagaccatacatataggtatgtcggcacgtagtgcggccttacggcaccctaataaagaagcacaggccgtaacccccaggcaccgtatcagtgcttcggagcggtagcgaaaggaacacagaatcatgatcggtgcaatgctataaaaatacaaggactaaagtatagaaggtgcatatcctgggggaaatggaaccaacgtagatatccaagccaagcgctaagtcagttcgtcggcgcaatgaagtgacgtttaagagttactgcccaaataagagtgcaagggaaatccaatttcacatctagaaagtgcaaacaaaaaaaaacgagatagatggatgctaatataaaagaaataattgaagctgaggtaggtcaacgtggtccaacagaattaagatgatcgtgcagtttctccagaggctattaggtgagatgccctaatgaaggcatcgtgatggagagatgaacaaggggaataacttcttgaaatcaagcagcaaactgccggggaagtatctcgtgagccaactagggccaacgcaaaggtgcaagaagccatgggagctaaggcatccgaagatgcaggtgaggaaggcgatgaaccggtaaaaagtgatgaaatagctaccaaggtcgactgctagaaacgcagagtagtagcatcgcattaaggagttgaagtcagagaaaaaatcgttcaggagcgagttcgaccggatccaaaagtactacgtgcagatggtgctgaataacagcgctctgaaggcaaagtttgtgcagtcaggcggcggcgtcggctgcgatgcggtccccgacatgaacgaacggggcgacaccaacggcggcagccaccagaaggagccctgactgaccgatcgacgacgcatgcggcctctgctactctacttacatagctcgtgatgattgatgatgatgattcttgtaacaaacaaacttggcgaccccgatccgccacacactcacacaatgagatggttcttcttttttgtgcctcttatcgacctgatgacaatggcgacgccgtcgccgccacctgcagactcctgtgcttgtttcgtccctactgtggaaagagagatcatttgtgggcgcgtgcacttctcagttctcaccgccaaaactcaaaaaaaaaagatgcatctcgtgaggcaaataggtccaacgaagatgtgccagaaaagtgctcagataattcatctgctgttacaagtgtggaatgatatgtgctgtttgaatcaaaatgcaatggccttccagttttacatcttgatttgcaaactagtaaaacctgaatagctggctttgcat

SEQ ID NO: 9999 - DNA, 625 bp, Triticum aestivum
  Clone ID: PAT_TA_9999
cgggttgacccagcgttctttatcgtgctgcggccggcaatgttacaaaaatttcgcctgcatttgtgctattcttcaattgttccgaggaagagatggaaaggcgtcttttgggacgcaatgagggtagagttgatgacaacatcgagactatcaggaagagattcaaagtttttgttgaatccagtttgcctgtgattgagtactatgacgcgaaggacaaggttaagaagatcgatgctgcaaaaccaattcctgaggtgtttgaagatgtcaaagccatttttgccccatatgccaaggctacatagaacagtataaaggaccacaaaggtgataaatggaatgatttcatacaaggttttgctcaagtgtgactacatatctgtgattacaaacccttaatatagatcagacttatcagtagacaatttgatttgttgccagcaataagttagatctggtttgtggtgttcctgctagaagtttttatttaccacccattgttggtgtatcccatgtagtatacctgtaccattgtgtaatttacggtaaggacggatcagaaaaaaaaaaaaaaagggcccgcccggttgtattacagaaaattgaacttatcacaaaa

SEQ ID NO: 10000 - DNA, 1486 bp, Triticum aestivum
  unsure (1)..(1486): unsure at all n locations
  Clone ID: PAT_TA_10000
tgttcttccacgcgtgcgcccacgcgtccgcccacgcgttcgcagcacaccaacaccgcagcacgcaccacgcgcccccccaccctgtgatcgctcgccgtggtctcgccgccgcgccgacccctccaccggcattcgattcggagcccagctcgatccggcggcgccgggcccatgggcacgggttgtggatgctcccgcagttgtgactgagaaggaggtggttgctgagaacatgttgggtgacaagaaagtcacagtagtatttgttcttggtggtcctggaagtggaaagggcacacagtgttccaacattgttgaacactttggattcacccatcttagtgctggagatcttttgcgcgcggagattaaatctggctctgagaatggaactatgattgagaacatgataaaggagggaaagattgttccgtcggaggtgaatataaagctcttgcagcaagccatgataaagaatgagaatgataagttcctcatcgacgggtttccaaggaatgaagagaatcgtgctgcgttcgagaatgttacaaaaatttcgcctgcatttgtgctgttcttcaattgttccgaggaagagatggaaagacgtcttttgggacgcaatgagggtagagttgatgacaacatcgagactatcaggaagagattcaaagtttttgttgaatccagtttgcctgtgattgagtactatgacgcgaaggacaaggttaaggagatcgatgctgcaaaaccaattcctgaggtgtttgaagatgtcaaagccatttttgccccatatgccaaggctacatagaacagtataaaggaccacaaaggtgataaatggaatgatttcatacaaggttttgctcaagtgtgactacatatctgtgattacaaacccttaatatagatcagacttatcagtagacaatttgatttgttgccagcaataagttagatctggtttgtggtgtttctgctagaagtttttattgaccacccgttgttggtgtatcccatgtagtgtacctgtaccattgtgtaatttactgcaaggacgaatcagaccttgtgcccatgtgctataaggttgtattacagataattgaacttatcacagagattatattacagacaatttatctaagcacctgttcactcgtttaaacatcgttatgattttttccagttttcgcataagtgtgactacatatctgtgattacaaacccttaatatagatcagacttatcagtagacaatttgatttgttgccagcaataagttagatctggtttgtggtgttcctgctagaagtttttatttaccacccattgttggtgtatcccatgtagtatacctgtaccattgtgtaatttacggtaaggacggatcagaccttgtgcccatgagctatccggttgtattacagaaaattgaacttatcacatgttcactcatatttacattcnttatacactg

SEQ ID NO: 10001 - DNA, 616 bp, Triticum aestivum
  unsure (1)..(616): unsure at all n locations
  Clone ID: PAT_TA_10001
tatttttttcttttttttttttagattaaattatcttgatcctttattttatcttttaacggctgagattaaaagatgcaaacgtaacgtaaaaatatgtacatgtacaagtagtataacatgccacgtacaaatagtgcacataggttccttccaattcgtcaactagcccgcgnagaaaaaaaaatcttttaatcaatgggtcaggggaagcaaaaatagtaggaaacctaaacaaataaggacaacgattggacctaaccagacctcacgtgaggaagttccaaaacaggaaccaagnacatggaaaaaaagacaggtttccgatctgctttcacggtctcggccacctcaacccacgcacctccacccatatataaacaagtacagccggccgcagaagcacacaccaaaattttggatgtcggcaaccaagatggcttgaagacatcacacgcgactcggcaactcagatggcttgaagacatcacacgcaactgggcaactcgacgtttgatacgcaaagccacctccagccgcttcactntacgtccgacgaagtcacgccaaagcacactcaacgcatgacaaagccatgcccagctactccaatcga

SEQ ID NO: 10002 - DNA, 943 bp, Triticum aestivum
  Clone ID: PAT_TA_10002
cggaattcccggggcggcccgcgcgtccgggcggaacaaccggcacccgtaaacccgacgaaagaaaaaaagaaaaaagcggcggcgtcggatcgagcgagcaggaaccctaaatcccaatcggaaccctcaggggatccgtcggcggcggaagtgctagctaggattaggattggagaggctcggcggggatcaggccatggccacggcgcttcgccacgcggcgaggaggttcggaaccagagcggcggcggaggcggaggcggaggctatcattgagcgtagtccgctgtacactagcacacggatcgtcgattccaccacaggccgtgacctcacgcccaatcagaggaaagatgccatcttccgcttggctcaaatccatgcccagaaagaggacctctacaacacaatcgctgcctggcaagctgactacactgctaagggcaatgtagtgacccggaaaaacaaccttttgctcaaacaactctctcagcatgtcaaacctagacccgatgacccccgctggcgctcaagtcagcgggcagtatactttaatgatttcctcaaattcacgggggcagttttgatcggcaaaatggcaggagatgcctttagtcattacaaggcaaaacaagatcatgatggccacaagggatcaagctagcttgctgcatacaagtcaactagttagtacctggtcttgcagagaaccaaatcataagtcatgtctgctagctagcttcttatcacaattgttagaatgttgtgaatgtgcctaccgctgttgtcgtctctgtttaattatgttgcctccctctatcagtgtgtgtcatatctgttttgctgatgagtcagtctcgtcgaattaaataactagctattggtcgctgtatatatatgtgtttcctctttcttggaaccagtgagccttcatgtctgt

SEQ ID NO: 10003 - DNA, 899 bp, Triticum aestivum
  Clone ID: PAT_TA_10003
gccaataccttgctcttcccctacattccggaatgcccattacgcatggcttatcatatgtacaagatcgccccaatattcatgaaggtactagtatccaacaaacaacaagaaaaaaccaacagtcgcaaacaaacacagtccgctgaaacactaagacatctcacagtcctccacaataccagccccctctcgataccatatcacatttcgacctcttcaacatgtccaacgacctaccgtattcaactccctcgccagcccctgtgtcgcctataggccgctaggacgcatactgcgcgaccctcctgctgccgccgctcccccgctgccgcccgtaccgcgtgcccctctggccggcgccgccgctttctgccggggaggccagggtggccagggaaggatagggctggctggataccggggtcacgccggtcgcgacgtctgcgatgatcgggcggacgtggggctggtcctgcaggcacatgatgctgatcaccaccagctggttgagcgccgacggcgggtagctgccgcggagcgctgggtcagccagccggtggaatttcctcttgtcatgcataaatggccttgaccatgttagcaaactctgctctggcttaggcctcgaagcatcatagatcctcctcccggtgatcagctccaacagaagaacaccaaagctgtagatgtcggatttcatggtaagcttgccactcaccacgtaatcaggagcgcagtatccataggtgcccatgaccctggtagacacatgagtcctgtcaccaacgggcccaacttttgccagtccaaaatcggagagcttcgggctgaagtcctcatccagcagaatgttggcagctttcatgtcgcggtaaatgatcggtgggtctgccacc

SEQ ID NO: 10004 - DNA, 632 bp, Triticum aestivum
  Clone ID: PAT_TA_10004
ttagactacttaacacttctacccattttttctttcaaccaacaaaaacaatcagttcttacaaagcagcaaaagaagatcgaaaagagagctctgagttgaggcactggcaggaaaccgctgtgagtgcaattgatgtcgaagcactctacagggcaaaaacctactaacaccaaatacattcaagtttaggaacacatataggcagtcgctagaaagccaacaaaagagaacttaatacctaatgcagcatagtgagacttcttcgtggacgcagaagagctaggtcattgatcttgagtgacaaatattttgagagtgctaacccatgctggcaggttgtcagtgtgcccatggagtttgagcctccgtagcttctctggaggcttgaagtcatcattgctcggcgaacaagggtcagcaatcctctcggtgtccttgtcaaaccatatcgacagagattccagatggccgtggcccgagatgacggcgcagagctctttgtggttcctccggtttatgccagacacgccgagcttgcgcagctgggtaagcttcttgagctccttgagtcctgccacagtggctttgatgacgcccagtgtgtgcaggttggtcagattctcgacccc

SEQ ID NO: 10005 - DNA, 1114 bp, Triticum aestivum
  Clone ID: PAT_TA_10005
gcacctcggacgtttgtttctacctttggcacacttggcccactccttccaccagataaaaatccgcagctccatcctcccttcgtgtgtcctagaaccctacctgccgcacgcggagcgaaggccgactccgccgccctctcctcctccctcccgcgctcgctggcgtccaggaggcccctctcctcccctctccgcggcggcggtcgcgcgaggccccggtccccgcgccgctgccgccccggctcgcggctgcgcgcccgggccaggaagggcgagccccgaggacctctacggcgccgtatcccgtgggcagcagcccctggatctcaccactgggttcgatatcgagtgggtgcaagaggataaaatcacgctcttcacttcccgatgggcttgttcagataggcggtaacatggtgcctcgcccagtcaccgcttccgagaagaggcaacaaaagggaaaaggcaaactacgtcggtttcaggagagctcttacatggatccaaatcaaacgtctttgccttggcagcactgtttaacattgcagctacaaatggcctagacatgggtagaagattatgcatctttggcttctgtcggtctattgaaatgctaagcgatgtggtggaagataccgtcttggagcatggtggcgagattgtcactgcagagaaggcgagtagtgacggccttcaggagaagctgaccatgtcggtggcggttccgttgctgtggggcgtccctccggcatcggagaccctccatgtcgccgtgcggagcggcggaggcatcgtggacaagatctactggcagtgggacctgttctaagagcccagagcccccagacactggttgacaaataatccaccccacccacactgtatatatgatccttaactggcctggctgcacacattgtgtcagcatgcaactgtgttcgtgtccttgtgcgcaaccagcaacaaacttggtgtatacctgtacagacctgattcctctggtgcatataaataaataaaaagggttccggattcacagatcagtgcctccctctcttcgtaggagcgacgccactgcagcagatcgtacctgcccgggcggccgctcgaa

SEQ ID NO: 10006 - DNA, 880 bp, Triticum aestivum
  Clone ID: PAT_TA_10006
agttacagacgcactacgatgagagtgagaacgcgagttcgtggtgataagatacactacgatgtgatgctgctggccatagctctcgtggcagttatcttttgctctctctcctcccggctaaaggtgaaatccacgagagtgacatgaaacaagcctgccctgcgcccgcaacgcagctgacagcaacgcgagagaaacatacaacaagcaatggtaaagcagcaagatttgtgatgttctagatagcgagccaaatgggggctgtcactgtggcggtatttgagtcgtatgtcatgctgctgatgctgatatgggacgacttctatctactcggctgagtgggcatatatatccgaatcctggtagaggattgttactgttccgcctgatactgtgatgatgaacttcttccacgggttaacttgacatgggcgtctcgccagatcttccaaaagggaggatgaggtcgaccatggagtcgtactcctctctgctaacctgagccgagtttaggatcttctgcacaagctttgagtctgagatcactggagcaagagcaggaagccggtgcacagagagtgcatcgagcagaacaagaaccagcagctgccattgccttgatctcagagcaggcagtgcgtcaacaagtgacattgtgtcaatcaagtatcccagagtagtctccaactttgaaactggggtatgcatcctcatgtttgatacaagtaccggcagtgcattagaaatgcaagaagctaaagctcttttaatttcagatgattggctatctttcgaaactcgcttctcaggatactctctccctttagaaatcaacatttcttccacagaactgtcatcaagcatgtatacataggcc

SEQ ID NO: 10007 - DNA, 1117 bp, Triticum aestivum
  Clone ID: PAT_TA_10007
cgaattcgcggccgcgtcgacttttgtttcatgagtagttttctttccagtaattcctcaaacgtatgattgtcatacaaattttgatgccagcagatgctagaaaacacacatgaaacaaaaagatttgctttacatgaagtttcatttgacataaaagataacataacacactactggcaagctatattcctaggattatcaagttgcatcttcaaaacgctgctgcggtcgccttcttgaatgcactacgattcacctacttcaacacactgtgatttccctgtgcacatcagcagggcagatcttgttcagcggatgggaaaacagcttcgaagcaatcgtcttccgcacatcaagcatattttgcttcttaaaatctttcatcctaatgccatcgaaaatttccaagtacaaagttgcaaaaagtccacaatcaaagtgagttgcctattgtgggtagtcaagcagcggccagtcggatttgaaagaagataggtccactgggaacgctggctcctccgtagaaaaggtcgagatgtcgcttaccagattccttgcagcaatatccaactttccattatcccatgagtcaaacaagttaaactccttgtgcaataggttaatgacacaaacaatccagtggccatcgtagacgatggtgaagtaaagtaggtcaaaaacagaaatctgaaaattttggcatgccctcctcagctcttttgcacaaacacttggatcaaatacttctgggtggacagagagttgaagactcattaaaacagagaaagcaaatttcttctgcatatttgaagacgacaattgttcaatgttgaagctttcaatgaataatgacatgacttcactacaaatatgagcacgtggcttcaacgacttctggaagttcgtgtacgtaatgtggaaatcatcaatcctaatgaaaggaggctcaacttcccctctcttcatcttcttcatcttgtacctcttcatgacatagtgctggtacattgcttccgtgttcgaatctgtctttattttcttgtacttcgatccggctgacagtggactccctatcttttcttactcttgagtttgttctcatccttgctcttca

SEQ ID NO: 10008 - DNA, 808 bp, Triticum aestivum
  Clone ID: PAT_TA_10008
cctcgctccgtcgcgatatcgctccctctcgtctagcgtcgctttcttcgagctaaacaatctgcggctgccaccctctggtgcagcccgcctgctgttcccgccacttcccgctcccggttgctcgcccacgctgttgccggatctggctgatgcctgaattggagcatcttcagttaggccttgttcggttacacccctccacaagaggattggaggggatttgagggggttttgacttgtaggggattaaatccacttcaatccctgccaaatccctctcaaccaaacacagccttaggggggcatgtgtcttgcgtgccagtccttggatcctgatccaccagggaaaattgcctgcaactaagtacttcccatgtgcaacagcttcatcgccatccgcatgtcagctaaggaagggattcccaacctacatcttgttccagtgtggccttcgcttatttaattagtgatgaaagaaacacctcccgcgccgaaccctgcatgccccggcctgagcctcctgatgtgtctttccaccaccttcccctcctctgccgtgccttctgcccctgcgctagctccgcggccctccccgctctctcccgctcggagtcgtctcccccgccgcgcccgccggccatcggtgggaggtccctgtcgtctgctcccagcaccatcctgtcattttccttgatatcagcctctggtgtagattcattgtgatcacagtttagagcagcacggagatgagacaacaagggtggaggcaggccatatgttggaggtcctcgtgatctgcacaacc

SEQ ID NO: 10009 - DNA, 751 bp, Triticum aestivum
  unsure (1)..(751): unsure at all n locations
  Clone ID: PAT_TA_10009
ttttttttttttagtaaatgnttcctgctgttctttaaattaaaaggcccgtacttgtttgggcgtcagacgatatataccaaccagatcagctacttcatcgggcttaagcggaaagagaaactatttacagctcgggccccaacatgtacaacgtatcgctgtgtctaaaatgggcgcaggcttcataaaatacagcccccgcccagatctcctacaaaagggacaagaatcccttgggaaaacataagcctctataccgccgatgggaattatgtgcactttccgcatgcagccgccgcccgggccggtacttcagctcgaccggcatcaaggaaaacaagggctaggcttctgctcttttgccccgtgatttcaggcttttctccaaaaatgccagagtctcggcgtatgaagggtcattcttgttcaccggtttacacgagtttatatggtcagtgttctgtagaacgacaagctccccgtatcctgggtatgcagattcgatcgggactatctccgctcggaatgcccaaccaccataaccttccacaattggtgtgacttcgctctcactaaaactaagaacatcgagaagtcctttgctgtagcgctgccgcacaaaatcatttaactcgacaagtcttggagacccacttcttaattcgccaattgaaggagctggacgaaacacataacccatacgccatggcatgtctgcaagtttactacctcggccgcgaccacgcta

SEQ ID NO: 10010 - DNA, 1320 bp, Triticum aestivum
  unsure (1)..(1320): unsure at all n locations
  Clone ID: PAT_TA_10010
gcacccggcccgctccgcctccgcccgctcccccccccccctctccccgccgccccgacggcacccccgcccgagcccccctcgtggcgccaccgcccccatcccccccccccgcaaacctcagaagcccccgtcgtagtccgagcgaggaggattcgcgtctgcgcgtcggcgaagacggtcgaggtaggagcagcgcccatggatcgctaccagagggtcgagaagccgcgggaggaggcgcccatcggcgccaacgagatccgcatcacggcgcagggccgcacccgcaactacatcacctacgccctcgccctgctccaggaagaagctacagatgaaattgttaataaaggctatgggaagggctatcaacaagacagtggccattgtgggagcttctcaatgagaaggattgctggctctccatcaagaataactccatcgaatcaatcaatataactgacacttgggagccgttggaagaaggcctgaatgtactcgagactactcgccatgtttccttgattaccattaccttgtcaaagacagagctggatacttcgtctcctggttaccagctaccgataccagctgatcaggtcaggccaccgacagaatttgaccaggatgcagaggatgtgccaagtggccgtggaagaggccgtggtcgccggggaaggggcaggggaagaggagggttcagcgatggaggggcagactacgatgatgtgaatggagacatcgtgggtccacggggatatcgtggcagagggagaggaaggggtaggcgtgggtcctttgggcctggaaggggttatggtggtgatgggtatggctatgtaaatgaagaagctggtgggtatcatggcatggagcataatgggcctcctgtgcaaggatatgagggtgatggaggaaggggccgtggtcgagggcgaacgcgtggacgtggccgtggacgcggtgggggtcgtggccgtggaccatttcctcaaggacctcctcaagagtagcttggctggcccatcgactgcatgcgacaagtctcatctttgctagattaatggctgttgtatcttttggtggttaggtttatgtttaaagttgatagagtgactcgcagtgtgggggggttgaggctagttatgattttgtagctaggttaattcttccatttgctttcatataccagacctggttatcattccaactgtgcattgtagcatacctgaatgtgtttatcattaaatctagctcagaaaatttgttcaatcgatttatcgacatgactggacattcncgttgctacattgaagn

SEQ ID NO: 10011 - DNA, 588 bp, Triticum aestivum
  Clone ID: PAT_TA_10011
ttttgcttgcttctgccgcggtcctccttggtccgcggctacgctgggggcgcggttcccggtgccatttccaccatactatccctctgcggactccagtgtcctttccgtgccctacctactttcctacgccaccctgctgcgggctggactgcttgccctcgctcgcccccgccctcatgccggctgtatcgcatgtccctgcaacctctcgggcatctgggcagtccccgttgctgccggcctttgcgccgggaccgttgctgctgagctgagcccgtggtgctgccccacttcgccgagccggcagttgagcccctcttttctgccccggcagctgttcccctcaactccgcctcagggtctttcatccttttctccccgtgctggcggttcacgctgccctgcccgcccgttctggggtcacggcccgctgcgccggcgcgcgggttccggtgagcttcaagcgccatagcacacatcgtgcatggttcccaaacaaggtagatgtcaaatcctgtgcaaagatatggtctgtttctttcatgcaagtccctgctgcatgctggatgtgcagattgatcttca

SEQ ID NO: 10012 - DNA, 433 bp, Triticum aestivum
  unsure (1)..(433): unsure at all n locations
  Clone ID: PAT_TA_10012
accattttacaagtggatgataagacattctaaanccaacgaaaggcaggcaatggtgaattataacacaaaacagatggctataccacaggggaccacttgctttcttctaactgccacttgtctgcttcaagtgcttcttagacacattaatcccaagtttgcttttcatcatcccggaatgtagcattgtagtaagaaccatacgcaaatatccaggaaacatactggacggaattttgctcccattcagaataattaacaaggcaaaaggagtgcccaaaaacaatactagcggaagaacttagtccttggtgttgtagatgagcttcttgatgtcactgatctccctgtcaacacaccccgtcgcatagccatcagctccctgctcaaacatctgatcaaccttggcttcaagcctccgaaacctcgg

SEQ ID NO: 10013 - DNA, 1996 bp, Triticum aestivum
  unsure (1)..(1996): unsure at all n locations
  Clone ID: PAT_TA_10013
ccgtgcccacactgatacatccaacccagcccgaagctcccgacaccacctgtcctctcctcgggatccgaaccatcccccaaaccccaccacctcacgatctcctccacccttctgcggtcccgcccatggccgccgccgccgccgccgccgccgcggtaactcctcacgtcgccgcggtcgggactggatcccacaatcaccaccagccgccgcatcgtccgcccgtgtccatctcggccagaccgagggcgcgcctcgtgcccgtcgccgcggcggccgctactccggccaccgacggcgtcgcgccggtgccaccccaccccaggcgctcggttgtaaagcgacacacgatatcagtttttgttggggatgagagtgggatgatcaatcggattgccggggtcttcgcgagaagagggtacaacattgagtcgttggcagttgggctgaacaaggacaaggcgctgttcaccattgtagtgtcaggaacagagaaaatactcacacaggtcgtcgagcagctctacaaacttgttaatgtcatacaggttgatgatttgtcaaaggaaccacaagttgaaagagagctcatgcttataaaactaaacgtagagccagaacagcggctcgaggtgatgggtttggttgacattttcagagccaaagtggttgatctttcagaccatacactaactgttgaggtaactggcgatcctggaaaaattgctgctgtacagaggaacctgagcaaattcgggatcaaagaagttgccagaactggcaagatagctttgcggcgtgagaaaatgggacagacagctcccttttggagattctccgtagcttcctatcctgatcttgaagtaaaaatgccttcaaaatctacactaagcactgcaaagacaaccagtggggattctgaggaatcatcccagggcgatgtttatccagtggaatcttacgaaagcttctcgatgaatcaaattcttgatgctcattggggtgccatgactgacagtgatcctacagggttttgttcacatactttgtcaatccttgtgaatgattcccctggagttcttaatgttgtaacgggtgtctttgcccggaggggctataatattcagagtcttgctgttcgtccggctgaaaaagcgggcacttctcgcatcaccactgtcgttcctggaaatgatgaatctatcgccaagctagtacaacaactttacaagctcatcgatgtttatgaggttcaagaccttacacatttaccatttgcggctagagagttaatgatcataaaggtcgctgggaacacctcagctcgcagggaaatcctggatattgctgaggatgttttcagggccaaaacggttgatgtatcaggccacacaataactcttcagcttactggagaccttgataaaatggttgcactacaaaggttgcttgagccctacggcatctgtgagattgcacgaactggcagggttgcgctgtgccgtgagtcaggagtcgattccaagtacctccgtggctattcccttcctggatagcgtgtcagttggtgagacatcacactcgatcagttcatgggttgccatgattctcctgatctcgggtctcctaaacaccctctgcgatggtgtttcattcctttcggagcatacagcaagaacgccagctgttatagtttacgttcactagatttacactttatcctcaggagtttttggcatatataccacagagaaatgagtttgggatgtttgaatcccatgtgagctcacggaggcagaagaaacccatccatagtttctgcgctgaggttttctggctttgaagttcgttggtcgatgaagactctttttttacgttctgaatacctaaattaagtatttatgcatttcttttacctctaaagtcatctagaattcaggcctgctactttgaagccttcaattagcaccaatcgnaatataattttnccctg

SEQ ID NO: 10014 - DNA, 636 bp, Triticum aestivum
  unsure (1)..(636): unsure at all n locations
  Clone ID: PAT_TA_10014
ttttttttttttttttttgtgggggcaagtgtatattacttgattcagtatgaaaatacattagacatggnatacaaacaaggctctgccatagttcttcacaacatactgcatgcataagttgaaggggtttcctaaaaaaagcggcatgctgtactttgtcactcctaaggggcaagcacgttgttgaagtaggataaccacaatcagcgtccatcaacgggatatcataggcttcaagtacaatttgtacaaagtttgttactttgtctagcttttttgccctaaatcatgggcgctctcaatacatgcacctctgaagaataaaaagcacccatataagcttaaattgcttggccgaggtcggatgtaaaaaacaaacttgttccttgttgttatagaaatacatcgcatgagcttcagttattttatatttgctattttggattgccagagttcatgtttccctccaacctgtttcacaccagcaagtcactgctcacgtacatgttaaaaatgagttcataagctttattgccattgcacctaggctaggctgtactatccccgcaaacaatagtagtgggcatcaggcaacagaatagaaaatgcatataattaatttccctgaaggat

SEQ ID NO: 10015 - DNA, 921 bp, Triticum aestivum
  Clone ID: PAT_TA_10015
gaattcggcacgagccacgcgtccgcccacccgtcagtcccgccgttgtctcctccgcctccgccgcctttgccaagcgcagcccacacgtcgcggcggacgccacttctcccatggatgcggactggacatgggcgtgccgggcgtgggagaagtggaccgcgaagcacgtcggatcttccgttgcagggatgccggtcaaggcggcgctgctgctcaactacgacccgaccggaccatctcgcctcctccccatcgtagcagaggaagagggaacaaaatttactgctgttgatctgcaaccgttcattaacttcttcaggaggaacaatctgcagacggaattcttttctattggaccaaaccaatatttagtcacttcaatccacgagcactggttttgtgctcgttgtgttaacacaacacagccaggaggtgaaggagttatagttatgcagattggagcttacttattagtctctatgtatgatggttctgttggttcggcttcacaggcaatggtggctgttgatcagtttgcatggcacttcaaccggagaacacattaacttcttgtggtgtagactcatgggcttacagtgtagtgtataacctgacatgctgcttaatgttactgttgtattgtgatccgtaggtatgtagtgcaataactaagattctcttaaatgcagttgaattcaatcatataatctttgcatagtaatttaagatcagtttctacgtatccagttgtttgcttacattattgggaatttcgtgtatgaacttcacactagttgagcagtatgtgtaactattataagatttcacaatgataaaatggtgaaactgttatttttttattagaaatggtaaatcaaagcgaccttttgaagttctttagtaggggcgctgtgcttc

SEQ ID NO: 10016 - DNA, 770 bp, Triticum aestivum
  Clone ID: PAT_TA_10016
gaatccccacattcaaaatttccaatgtgatgatgatctgactggacaaatcaagaccatgcatttccttgcttgtttggttgggcaaagaaagacgcaggatttactttcctttatactttcaaaataaagacttgtcctacaaaatgggagggggacataaataaacagaaccatgtccagtgcccatccctctaccttctttctccctactatacccctcctgaccgaggcgacaagaaaccagaacggaggggggaacaaaacagcagcagctacaaccattgtttttcaacaatagaggatccagagacctattatacatgaacgtcgacgacggagcaggcaagcagcaaaaacaagattagtccaactagtacaggtcaaacgaaagaatcaccacacccaaggggccgggccggttcctatcgacgacatcagcggcagtcagcagggcgcaaacagttaccacctactgtggtgcgctgcgcccttcacccttcctttggagaatggcaggcttccgagcccctatgttaatcgtcggcgaagaatggccagcgtcttcttccatcttccaggacaatcggtcgacctggatcctccaattcaacgatcccaagtttcgacttggtgtgggggatgagaggactgagaccctgcgcactttcctaatcttctttcgacgacggtatacctgtacagatgcaactaatcatgttgtagcaaccccggcgcctcgctgtctcatcatctcattaacagcagcc

SEQ ID NO: 10017 - DNA, 1036 bp, Triticum aestivum
  Clone ID: PAT_TA_10017
tttgcgttatctccgttcgctggttttcctgtccgcgttgttttcgcggcctgtgtttgttttcgtctctcttcgcccgcgtgggtgcccggcccccctctcactgtaccttccttgcagagcgtctgacctttcatggctcattgatagcacgttgttacaaatccccgatcatggcgcgttgctcccagggtgtctctgtcccctcaccagtggccctcctcccagagccactagctgctcccacctgcgggcctcctccacttcctccgttgctgctgctgcctgccggcgttctccccttcccctcgtgcgggcacagcatgccgtcccagccgcctcgcccccctgctgtccgcgctggcgcccccgggcgcctcctcgcccttccgtcccccttgcaaccccccctcctgcgcccctgcccgcttaaccagaacgccattcttggacaggacatcgtcggccgtttcaccgtattcactatcagcatcagcatacgtcgtagccctgccattctggggtgctgtatctatttcatcatgaagcccgtcttgaattttatcttcatccatcaacagctctggttgatcagcttcacatgccttcattgtctcctctccaacagatgcaatagcaggagccattggattctcaccatcgcttatagttgattcgtcctctttgatctcttgattgtcacgcacttgtaactcatttcccgcaacaacaccatttctgccttgatcatcatcggcaacaactgcctccgccatttcaactggcgtgtctccctcctctactacttctttattcttcgcattaccccaatctacgtagaccaccaatgtctttttggtttcacctgtctgtaggcttctattaggcccattctgccaatgaaactttcccaaggaatcttggagcaagaacttgaactcaatcaacctgttggcaggcaaatctttctctactgtccagtcgtggccttccaaccaatccatagcgaccgcgttcgcccacgcgtccgcggacg

SEQ ID NO: 10018 - DNA, 980 bp, Triticum aestivum
  Clone ID: PAT_TA_10018
ttctctgtcgctggggcctcggttgcccgggggggctcggcctcgtcagtccaggcggccgttatggcgccggtgcctcgcccggcaggaccgcccggttctcgtcgagggattggatcctccctgggcgggcgctggtcatcaacatctgaggggaaaagaccgtatacattattccaaggtcattctggaccagtttattccggtgcctttagtccatttggagattttctcctgtcatcatccttcagattcaacaattccggcggtggagtaccaagcctgaatgccaatcttgtttgtttcaaaagggcaccattgccccctttggcgtgtgtgggaccatcatgatgtgggatctctctactggtcgctgcgtttcaccactagcgggacacaactcttgtgtgtggtcacttgctttcagctgcgagggagcattgcttgcatctggatcggctgattgcactgttaaactctgggatgttgcgtccagcacaaaggccctgaagatggatgacaccaaggctggttctacgaaccgactgaggctgctgaaagctctccctacaaaatcgactcctgtttataacttgcggttttctcggaggaatcttttgtttgcatctggcgctctctcgctataggctcctaagcttgccatatgctctctagaatacaatttatatcccttagttttgactgtaagtagcaaagtagatgtttaattggctgactcttgttgtggagcttattacattgtccttactgatctcagtctactctatgatcgactaggtagggtttttaaactgtagcctgtgagcattgcgactcattggaaacgtgtgtattgcttgttgtaacattagctaattttaaattatgtaaaaggtagtagtcacaaatagggaacaggaacccggcgctctcgcgggttgtcctccctccacttgccatattctttctaaaaaaacaac

SEQ ID NO: 10019 - DNA, 720 bp, Triticum aestivum
  Clone ID: PAT_TA_10019
atttaaaacagaggggggaagcagaactgagtatatacacataaaagtgttgttatagccctggtattaacaggcgcatgcaagcctgatgagtggcagtcttagagattacatgcaacagggtaacttgtaggtgctcaaaagcaagcgatggcagcattcatcatgtcataaagcacagctagacgcttgtagagtcggtcgccggcgttgacggaggcaagggagatgttgaacttggtccagatgtccctgatggcagccctggtcctctcaatggcgaacagctccgcactgttggcgtcctgaatcctcagttgcgcgaccttcttctcgtaggagcgcaaatgtgttccattttcatatctttggcttgactcattctttggacttctaatgattatacaaattcttggagaagcaagtgtactcgattgaacgtaccctgactttaggctctccttgtgcctctggaagagctggaatggctctgatgaagcttcgcaaatgccgacttgctcgttgccattgttatcctcaacaaattcttggagaatcaagtgtcctcgattgaacgtaccctgactttaggctctccttgtgcctctggaagagctggaatggctcaggcgaagcttcacaaacaccgacttgctcgtcattgtcgttatcctcaacatcccctctcggagcagctggtttaaccttaatttgaggcca

SEQ ID NO: 10020 - DNA, 834 bp, Triticum aestivum
  Clone ID: PAT_TA_10020
tttttttttttttttttttagcacgaacacatacgggcaacttacgggcaatataagtacatcgtcacggcttcctgttatggatttaaatacaaattaacaactccaattggattagaatatgattaggtaggaggcgagacagaaatcttacaaattctgtatcacagttgatccgttaggaggaaagtaagtttacgcactaatgccataccaatctatagcaacgggcgatcaagcaatcctcctactcccgttgtcagtaccagccacggcgccctgcccctggacctgctctaccacatcttgctccgccatgctgctctgctgcttccgcttacctgcagtgaacgccttctgaagcacatctggcaggtcatgaaacctattcatctcagaggttgtaatcgcttccgagggcagccagccctggttcatcatccatcatcttctccagcacatccgaacaacgcgggaagaagcgtttgccaagttcaactgttttggagagcactctcatccgagctaagtacacatccttcattttgaaaggagtttcatttagatcaaaggttgtccgttgtatctccgtaagtggatttgcactagaaccaagggtaaattccaaagtaccattcacttgagcaacttccattgctactcttgcctcggctgggaacaatatcatcgccaaagcaactcggttttcaaggtacaacaactttccatgtaggcagtcaccagccattgcaagagaaaccgatgcttccccaagttctggttcccttctttcagcttgctccaatatcccaatacataatgtatttttaggag

SEQ ID NO: 10021 - DNA, 720 bp, Triticum aestivum
  Clone ID: PAT_TA_10021
tttttttttgtacaatgtgaatggtcaaatgtgacacatcacagataaataaagaagacaaataacacataccacgcaaaagaatacatgaggaccacctgtctgtttctatacaaatgcacaaatgaatgaaacccataattccagcccatccaaacaaatgtccatgtggtacacaagtatgatactactcattgggttaagcatccgataggtgcaccagaccttgcctgcgatatccgatttgcgtagattgttactagccgcaactgtgtgctactaagcccctccagatacggtacaaatgctttccctagcatgatggtgatatccaccaggcagaatacaacagtcttgcgaatatctggactctggttactgaaagcatcaaaaagtgctggtaaaaatgaagggagttgagccaccaattcctcttgtgaaagccgcccaacaagctttgtcaaacagttgatacacatgacaagtgtcttctcatcatcagtaactagcaatggcacaataacagcaaggcggcttatcggctcctctcttgccaacgcgtcgctcaagcactcgtctgcttccttggcatcctctccctcagcatccccgggcttctccaccagcttttcgcggctactctctatggattcttccatttgatctttctgattgcggagcatctcagcaactagcgatagagaaagcttcctgacagaa

SEQ ID NO: 10022 - DNA, 1621 bp, Triticum aestivum
  unsure (1)..(1621): unsure at all n locations
  Clone ID: PAT_TA_10022
gggaggccacgcgtccgcggacgcgtgggaaaccctaaccctagcggggcgacggcgatgcctaatgccttctggggggactaggaggagttccgcgccgaggtttangatcttcttatcaacgaggagtacaagatctggaagaagaacacgcccttcctctacgacctcgtcatcacccacgcgctcgaatgggcctcgctcaccgtgcagtggctccccgaccgcaccgagcccgccggcaaggaccactccgtgcagaagatggtgctcgggacccacacctccgacaacgagcccaactacctcatgctcgcccaggtccagctccccctcgacgacgccgaggccgacgcgcgccactacgacgacgaccacgccgacatcggcggcttcggggccgcatccggcaaggtgcaaatagttcaacagataaatcatgatggagaagtcaatcgagctcgatatatgccccaaaattcatttattattgctaccaagacagtcagtgcagaagtgtatgtctttgattatagcaagcacccatcaaagcctccactagatggtgcgtgcaatcctgatttacggctgaagggacacaactctgaaggatatggcctgtcttggagtatctttaaagagggtcatttgctgagtggatcggatgatgctcaaatctgcttatgggacatcacagcaaatggtaaaaataaaactctcgacgcataccagatttttaagtttcatgatggcgtcgttgaagatgttgcttggcatttgaggcatgaatacttattcggctcagttggtgatgatcatcatctcctaatttgggatatgcgtactcctgcgcctaccaagcctgtacagtctgtggtggcacaccagggtgaggtgaattgcctggctttcaatcctttcaatgaatgggttgttgcaactgtttcaaccgacaagactgtcaaattatttgatcttcggaagattgatacttcgctgcacacttttgactgtcacaaagaggaagtatttcaagttggatggagcccaaagaatgaaactatacttgcatcttgttgtctgggaaggaggctgatggtttgggatctaagcagaattgatcaggagcaaacaccagaggacgcggaggacggccctcctgagctcttgttcattcatggaggccacacaagcaaaatctctgacttctcctggaacccgtgtgaggactgggtgcttgcaagcgttgctgaagacaacatccttcagatatggcagatggcggagaacatctaccatgacgaggatgatcttcccagtgatgagccggcaaaggcttcatgagacccctaatggtaggacaccagaatggaggcaagataataccttagctttgtcgattttaggtaaccttctgtgattgaacatgttgtcttggttggatttgtatgtgcgttgtactcggcacttccagcatagtacataccaattagactacctgtcggttgtagctgatgcatttacctgtttcaccatatcgtgagtcctggggattattatacctttagatgtctaatcaaggctgcaaaatattttttttgaaaaatgatttttgaattgc

SEQ ID NO: 10023 - DNA, 425 bp, Triticum aestivum
  Clone ID: PAT_TA_10023
ggtcgacccctctgtggaggctaacctatatttatgatggcctcggtcctcttcccccaaaacgtaggcaggaagggatcccacagtggccaatttgaaaataggcaagtagtacatcttatcctgacgaaaggtggtcttcgcctgctaagcttctggtcgtgtcgctgtggtgggctcggtgatgacatctatcctaccgtgctggcgatcttggtctcgttgcaccgaaatggaaacctttgccagatgacatccgtcctactgtgcctgtccttgcctccttagcaccaaacaccaaacaggaaactgcctcctctgcgcccgctggagcccacctgccattgttatcacggcttgcgtcactgctagattgagggggagagagttggtgatgagggtagcaagattgccgtcatgatcct

SEQ ID NO: 10024 - DNA, 622 bp, Triticum aestivum
  Clone ID: PAT_TA_10024
cgtccgcggacgcgtgggttggcttgcttcagggtgacacggacaggttcacttcgtaggccggtatgggatatgttcacatcgacgacgttgcacggagccacattctagtgtatgaaacacccgaggcaaggggcagatatctgtgcagttcagtggttctggataacaatgaattggttggcttactcacaaagcagtttccagtattccctattccaaggaggctcaacaacccctacggaaagcaggcgtatcagctaaacacatccaagctccaggggctgggcctcaagttcaaaggagtgcaagagatgttcaacgactgcgtcgagtcgctgaaagctcagggccatttgctggagtgcccgttgtgaaaatagagacaacacgaacaagagccatagccaaacacgtcgcaactatgtctagatcatgtcagttctcgagtcttttttttttctcttcaaagtattcctatgtcgtctctactattaccaaacatcaactgtcactcgcagattatgcgactacacgaaatgtttccatatgctttgcaattgattcaatcagcaatgaaacatttgaaacgttgaatagagctcagttacttttatcatgc

SEQ ID NO: 10025 - DNA, 905 bp, Triticum aestivum
  Clone ID: PAT_TA_10025
ctgttttggttcttctgtgcactatggtggccgagaatattacggcagctctgcacctaagcaagccacggaatacagtgattacaaggtggataagaaggatcctgtcgcagattctcatggcgattggtggcaaggctcgttttactactaagcaagagcttggtgtcctctcccttttcgaacaaggaaatcgaagggggagctgttgaacctaatttcctttatagcagttatataccttacatagtggagaaacattcgctcatcggtggtggcagtatttggacgcatcatcactcctgggcagatgctgtgtgcgcgtgtgtgtgcctttaccttcttattccatagcttgtgctttagctgtgaaatgtaatgaacctacaagtacctagaacttggtgtcaggttgcataaagggtcccgaggccattccgcctaacctgggcagtctggtctctgatgactcctatacatagtaccaaacctgtgctgcttgtaccgtctgatcctctctccagaccagaagcgctggagaagcagagatcatttacattgtactattaaaaatgtactgttggaacttcatatataagtttgggaagtgttcttgtcgctcaaccaagggcaaagtgtgtgtaactggggcctcaggctttctcgcctcttggctcatcaaaaggcttctcgagtgtggatatcatgtgatagggacagtcagagacccagggaatcgaaaaaaagtgggacacctttggaaactgcctggtgcaaatgagaggctccaacttgtgagagctgatttattggaggaagggagctttgacgatgctgtgatggcttgtgagggcgtcttccacatcgcatcgcctgtcctcgggaaatccgactccaattgcaag

SEQ ID NO: 10026 - DNA, 1177 bp, Triticum aestivum
  Clone ID: PAT_TA_10026
cgtccgcccacgccttccggttcgagagggtccgcgcgtcgtggggagagaatggtgagctcaaccaagggcaaagtgtgtgtaactggggcctcaggctttctcgcctcttggctcatcaaaaggcttctcgagtgtggatatcatgtgatagggacagtcagagacccagggaatcgaaaaaaagtgggacacctttggaaactgcctggtgcaaatgagaggctccaacttgtgagagctgatttattggaggaagggagctttgacgatgctgtgatggcttgtgagggcgtcttccacatcgcatcgcctgtcctcgggaaatccgactccaattgcaaggaagcaacacttggtcctgcaattaatggtaccctaaacgtgctaaggtcgtgcaagaagagtccgtttctcaaaagggttgttctcacatcttcatcgtccgcggtgaggattagggacgaaacccagcagccagaactgttgtgggatgaaacaacgtggagctctgtgccactctgcgaaaagctacagctatggtatgccctggcaaaggtatttgcagagaaagcagcattggactttgccaaggagaataacattgaccttgtcaccgatcttccgtcattcgtgattgggcccagtttgtcccatgattactgctgatattggcaacgtccgcggaggcggaggatggtgagctcaaccaagggcaaagtgtgtgtaaccggggcctcaggctttctcgcctcttggctcatcaaaagacttcttgagtgtggatatcatgtgatagggacagtcagagacccagggaatcggaaaaaagttggacacctttggaaattacctggtgcaaatgagaggctccaacttgtgagagctgatttattggaggaagggagctttgatgatgctgtgatggcttgtgagggtgtcttccacattgcatcacctgtcctcgggaaatctgactccaattgcaaggaagcaacacttggtcctgcaattaatggcaccctaaacgtgctaaggtcgtgcaagaagagtccgtttctaaaacgggttgttctcacatcttcatcgtctgcagtgaggattagggacgaaacccagcagccagaactgttgtgggatgaaacaacgtggagctgtgtgccactctgcgaaaagc

SEQ ID NO: 10027 - DNA, 1603 bp, Triticum aestivum
  Clone ID: PAT_TA_10027
cgtccacccaagcgtccgcggatgggaggggggaggtagtcggtcactagcgcttgcctgtactccccgtccccccctccccccgccccccgccacctacggcacacccgccccgtttacgtgccctaatccccggcggcacctccccctctccatccgcccgtccgtccgtccccctagatcgagcccaagaggtcctcccagccgccccagacccagccgcggccgctcgcggcgactaaggagtcgccgcccccgacgccgccgccgccgccgacgccgccgctgacccgccgctcagcagcctgttccacccggcgccgaacggggtaaacacgatttgagcaggagttctattcaaggagttccaaggggcatgaaaaggactgcataaccaaacgggatagctcataaagtcccgggtagtccggcgagcagcttcatcacataatcccacgtttacaactgttggtccgtggtcctatgggccgctctgggccattctgtgcaccaatgtagatatgggtaggccggccgaaggcaatcgaagggatagcaggatttgactgattccaaggtgggtaagtagtcctgttcatcattgtctcatggtgcttggttgcaacgctcgttttcctagtaagcaagagcttggcgtcctctccccttgcgaaccaggaaggcgacgcggaaaaggtgacttcctttatgtcgttggtatacgttacatacgacagattgactcggagacacatgctagtgggagatgcacgcatcaccactcctggacagatgtggagtgcagttgtgtgtgagcatgttcaattgtttggcttcctcactaagcagtttgctgtattccctaatcctaggaggcatagtaacgtctttggaacggagggttatcagctcaacacatccatgctccccggcctgggtatcctggtctacggggtgccatatacgttcaacgacagcgtcgctgccctgaacgtccaatcctatctcctgaccagaccggtgggaaaagagaagcacatctaacttgcactttgccaaacgtatcgcagcaatgtctagatcatgtcagttctcgagtctttttttttcctcttcaaataattcctatgtcgtctcgttactattaccaaacatcaactgtcactcgcagattatgcgactacacgaaatgtttccaaatgctttccaattattcaatcagcaataaacattgacccattttgcggcaaagagcaggacttgtacgccattcttttcaaggggcagaacggcaatgctcaggccagcatgacagatggtaaatcccagtggagtcctgctaggggccgcacaacatataccaaggataacaagtatgactcggttggtacgtcgtcttgttttggttcttctgtgcactatggtggccgagaatattacggcagctctgcacctaagcaagccacggaatacagtgattacaaggtggataagaaggatcctgtcgcagattctcatggcgattggtggcagggctcgttttactactaagcaagagcttggtgtcctctcccttttcgaacaggaaatcgaagggggagct

SEQ ID NO: 10028 - DNA, 1026 bp, Triticum aestivum
  unsure (1)..(1026): unsure at all n locations
  Clone ID: PAT_TA_10028
agtggatcgtccgcctccggaaacctcgccacccccagtctcgctcgagcagaactacaagcttgggttggaaaaggaaaaatctccgatggctccgtccgcttcgcacgccggcgccgcgctcgtgcgcctccctccccgccccgcgccgagctccctgccacagcaaggttttggccgcgccggagcctcgctgctggccgtgcgtgcgaccaaggactcggacgggttcagacgtctggtctctgagaagcccgagtggccggcgccggcgccggcgaagcgggaggggctggatggtttcggccgggaggcgagcaatggggaggaagacgggcaggtgcagggcgagctggctccgtggagcgttctcaaccagctcggcgtcgagttggattctgacagttcatatactgctctagtctatgggtcctccgccattgttgctatttggatatcatcgatagtggtttctgcacttgaatcagtccctgtggttcctcaggtgatggaagtggttggcctcggcttcacggtttggttcacctcgcggtacctgatatttaaggaaaacagggacgagctgatcacgagaatcggctccatcaagaggcaggtgctcgggtctcgtgacgactgatcagttttccagcggtccgttgtagccctagtgaaaaagaggtcgcactgaaaccccggcggtgtttgcggagagataacctggtacccatgcctgatttccctttttcgataaaagaaagttgctctgaataattagtgcagtagtagtacttcatttcaggccttccttcagactgtggctgcctttgaattagctataccgaatcctgtcatttgacgtcgccacgcctctccgtcantcggtccggataaatgtccgggcaaangcgtcttgaacaaaaaanaaaaaaacncnanggggggccggtaccaatcnccnanaagggcctataaccccccaangctcttttaantccgncnggnaaacgggttccacttancctt

SEQ ID NO: 10029 - DNA, 1037 bp, Triticum aestivum
  Clone ID: PAT_TA_10029
cttttgagggcggtgacatttctggtgttctggtgccttgggtgtatgttggcatgtgcttttcatcattctgctggcatgtcgaagatcatcatttatactcgttaaactacttgcattggggtgccccaaagatgtggtatggagttccaggaaaggatgctgtgaatctggagtctgcaatgaggaaacatctacctgacttgtttgaggagcaacctgatttgcttcacaacctggttactcaattttcaccatcgctgctaaaatctgaaggagtacaagcctatcgttgtgttcagcgtgagggtgactttgtcctgacattcccgcgagcgtaccatgctgggttcaattgtggcttcaactgtgcagaagctgttaatgtggcacctattgattggttgccagttggacagaatgctgtagagctttatcgtgaacaagctcggaaaataactgtttcccatgataagttgttgttgggggctgcaagagaagcaatcagagctcagtgggatatcctattcctcaagaggaatactgctgataatttgagatggaaaagtgtatgtggacctgatagcactatatgcaaatcacttaaggcacgaattgagacggagttggcgcaaaggcaaaatctatgttctccatctcaatctaggaaaatggatgctgagtttgattccactgatagggagtgtgctttttgctactatgatttgcatctttctgcttctggctgtccatgctgcccagagaagtatgcttgcctgttacacgcaaagcaactttgctcatgtgactgggacaaaagattcttcctatttcgctatgatgtcaatgagcttaatatcttggctgatgctttggggggcaagttgagtgctgttcacagatggggtgtctctgatcttggcttaagtttgagctcatgtgtcaaaagagaaaaggtccaggattccaagactgttcgcagagcaactgatggcccaagaaggtcctacatgtcacaggcgtcaacagtatccttg

SEQ ID NO: 10030 - DNA, 659 bp, Triticum aestivum
  unsure (1)..(659): unsure at all n locations
  Clone ID: PAT_TA_10030
ctaaagcaccatataagggatcgtttagagaacacatggaactaggtcgatgggacgaataacacgcgagcgctcagactgtcaaaggctagacttccatcatacgtaccgcatttacacgctgttcgtacatacatacacatactctgcagtagaatcagaattaacgggtgccactgactgaaccactacgccaggagatcccccgatcgaacgacgaaattatcacgcggcacgattcgccgtcctccgatccagcggcttctgcagaagaagctgcgccacggagcgatccatggggctcctctcggtctccgcccacacgctcgatgtgctgagcctgtttgcagccgaggagcccacgttctgttccactgcctgatgcctctgctccacgctgtaggccagccggtacagggcgtctctgatgcacgccttggttcccacgtccaactgattcatgccttcctgaagcttctggaacccgagatgcctcaccggcaccggcgccgcttccggaacagacgatggccgagcgttctcacgcaccccgcccgagctcctcctcccattggagccagagtgcatggctgcaccgttcagagcaccgtcgccggcgagcgtcgaggcggtgccactcatcggcacctgangctgct

SEQ ID NO: 10031 - DNA, 884 bp, Triticum aestivum
  Clone ID: PAT_TA_10031
tctgacatttcttgtggttctctgcctggcccggcttcccccagcctctccattactgcggtccccccggccgtaagttctcccccagactactgtgatccatgctcattctcgttgtcacctaatattactagtgaaactctaccttgtccccagcttcattcaccattactacagtcacttggttcgcggcacgcccactcccgtctggtatccacatacgcctgcgcttcaccgccctgccccgcccggtgccccccgtcagaccctcccgcctccccggctgggctcggcggccgtgcacggccggccccgcccgggctaggtgccacgcgtcctcgccctcgagcgccctgcgcctcgttcgccctgccggccattccgccggctctccggcccggcctgcgcctcccccgaagtcccgcgccgcccgtggtcggcgtcccgcgtcttctcctctgcggggccgggtcccggttcgctctgcgtgtcctccggcgtttcctcctgcccatccagcatctgccccaaattctcaagtttgccttgaacaacatcccatataatatcatctactgtgtcgtttgcgagaaggtaatatatgttcaccgaagaaacctgaccaatccggtgggcacgatcctctgcttcgaataatggcacctccgtgtccatgttttccctgccaacttcacgggtctggccgccgtctcttatacatttgactttctttttcaagagatgttggtgaatagcatcaatcatgggttgatggtgtgcaaatattaagaatttgcagtcagcctcaattacagtggccaggtaatcaagcactgctggaattttggcttcagccgaatcattatagatcttcggacgcgtgg

SEQ ID NO: 10032 - DNA, 641 bp, Triticum aestivum
  Clone ID: PAT_TA_10032
gagaactagtctcgagttttttttttttttttttttttttttttttttttttttttcccaagtcaacacccatgattcattcattcttgatacaggagaaaaaacataaaggcagcaaaatactagtggaaaaaacatagtacgactgcatcaccattcaccgctaccactcctcatcgcccaagctctacattgtgactcttgacaccgctaactacaatcctactacatgatggcacagcccttggtgttctcgtcgctgaacatggtctcgacgtcgccggccccggcgccggggtggtaggcggaggagccgccgccgccgccgccgggctgctggtagtagtagctgtatgggttgtagtaggcggtgtaagggctgatctggggagaccggtggtacatcatctgcggctgcgcctgcggctggtgcatcatcatgttgcccctcaggttgttcatcatcgccgcggccgccgccgggttgttgtggtacccctgcatgctcgccatcaggttgccgttctgctgctgctgctgctgctgctggagccctccgtagccggcggcgccataggaggacgggtggctgaagccgccgccgcctgtgtagccctgtatgccaggggcagcaccggccg

SEQ ID NO: 10033 - DNA, 595 bp, Triticum aestivum
  Clone ID: PAT_TA_10033
tttgtgtcaattcacaaatccatttgatagacaagctctctacccgtccggcccccgtgctggtttgttattgtaaaggaagcagcagcaattccttgttccatgctgtgcctcatcatggcttctttcttctttagcatcgctgcatcatttgggccactaaagcccttcttgcccttgtgattgtgagcaagttcttgatgcttcccagatcccaaatggccatacaactcacgcttctactcatttcgtgtagcctttacgtccggtattcctcttcttctttctccacgtcctcctctcttgcattgctggtgctggttatctccacctgcctctccttgctcttctcaaacctcagacaactggtgagaaccagcagccacaaagcttccatggaggtggttgctcatcaggagaagagcactgtgccacaagatgaggtgtccgaggatgcgctggaggattcggctggaagcctgtcggggtcttcagattgccaggtcagcgaagaggggactgatgaagtctcggtgtctgatgacgacgacgatgagagtcttattgagatctcccttgttgatgggtactatgt

SEQ ID NO: 10034 - DNA, 1181 bp, Triticum aestivum
  Clone ID: PAT_TA_10034
ttgcgatttcggatctgtcgggcaacgtcgtccggcggattccagtcaccgggtatgagattgttatggtgaacgagtcgggcgatgccgttcaccggagctcaagcaaggaggagcatgatagcatctgtgttgtgcgcagccggctagacctcgtgtgcttccactggaatgtgtactctaggaccttctgcgtgctgaacccggtcactggagctactctcgacttaccgatgggccactcaaaggaattggagcatgagctggaggtacagggaagaaaatggggctgccatgtcgagtggtgcgcttttgggaaggtctcctctaccagagagtacaaggcgctccgcatctgtagcattcgtgaccggcaggtatgtgaggttatcacctttgatgacaccaaccatggaagctggaggaggaagcaggaccctccgccccgtatctgtaccggtcgccagatgagatgcgtggtcgtcgatggggtggtctacttcttgatggattttcactacacttactttgaaaccggggttataaccattgagcctggtagcatagcttcgttcaacctcgagacggaggagtggggtgttctacgtggtccagaacagctggagaggtttttgcaagagaacaggggatacacttactcaggacttgaacgcgagttatcattggctgagttgaacggctgcttagttgtggttcataatatttatgacatatctatggacttgtggtttttgacagattttgagaaaggtctttgggtcaagaaatacagcttgccttcacatgttgctaggcttttttggtatccttttctcatgttggatgatgggagaattttcttcagtgggatggattgtctggaaggtatattaagtggtggagagcaaggagagggatttctgcaatgttatgatccaaggaatggcacatgtactgatgaactagaactgagagatcccagatcaattggcatttacacaggaagcgtgctgagtttatagcgtagctgtcactgatgaggtgaatgatacatcgtactggctgttcaccttatgttctaagtgtgaacaattagtgagacaatgttctgatgcatgcatctttgaaaaagtacctttgtgcctgccttcaaagtatattatgtaatctccaatacattt

SEQ ID NO: 10035 - DNA, 581 bp, Triticum aestivum
  unsure (1)..(581): unsure at all n locations
  Clone ID: PAT_TA_10035
acgacgcgatgacgacggctacggcaggcggctcggctactcgtccaggcggtccttcggccgcgccaggcgcacgccagggagggggagcatcgacgatgggctgcaggcctgctcgccggccgtccgcccacgcgtccgcttggcgtccacggcgtccgccaaggccaagttccggtccatgagcacgcccaaggagcgcttcgccgtgccatccgacgcatactcggagcagtgcttcgccgaccgcctcatgtcacccatcccgtccatgtcgccgatgccgtccatcgccagcgacatgggcttttgctcgctccagcaggccgccggttgcgcagcgttcgccgcgcgtcaaggggggaccgatgacgccgtcgaggatccgctccaggaggtccccgagccgccacagcttcggctctgaagccgcgctgcaccagatccagatngagcactacacccctattcgctagacacaaacgaacttctttgtaatgtgaccagtgctgccttgtttggcggccttgctctctctctaggtctgaccatggaaaccttctcaaactgaccgtgctgtg

SEQ ID NO: 10036 - DNA, 1414 bp, Triticum aestivum
  unsure (1)..(1414): unsure at all n locations
  Clone ID: PAT_TA_10036
tcgcctcgtcgccgccgaggtcaaggagaggaagatcaaatacacaggcgagctggagaggaaggtgcagacgctgcagacagaggcgaccacgctctcggcacagctcacgcttcttcagagggatacttctggtttaactgttgagaacagagagctcaaactccggttgcagtccatggaagaacaagccaaacttcgagatgctctgaatgatgccctgagagaagaagtgtagcggcttaagatagcggcaggtcaagttccaaacatgaatggaaaccccttcggcggagggctgcatcagcatcagcaacagcagcagcagattccgaactatttctcgcagcagcagatgcactaccaaggtcatcagcatcaccacccccaaaaccactcccagaattcttcaaatggaggccagtcactgagtggtcagagcgactccatggatttcatgtgaggagtctctgggcaacctcggggcgcataccgaccatagttcggtagctgtaaagataactgatgtatactgtatgcacatgaatcattcgtagggtagcctagactgttcccttgtaccgccacgagcgtccgcgccaacaggcagtcggccgcgaggtccaaggagaggaagatcaagtacaccggcgagctggagaggaaggtgcagacgctgcagacagaggcgaccacgctctcgtccgttttttttgtaacccagagggatacctccggtttaactgttgagaacagagagctcaaactccggttgcagtccatggaagaacaagcgaaacttcgagatgctctaaatgatgccctcagagaagaagtccagcggcttaagatagcggcaggtcaagttcccaaccgtccgggaaaccccttcggcggagggctgcagcagcatcagcaacagcagcagcagattccgaactatttctcgcagcagcagatgcactaccaaggtcatcagcatcaccacccccaaaaccactcccagaattcttcgaatggaggccagtcgctgagtggtcagtctctaagcgactccatggatttcatgtgaggagtctctgggcaacctcggggcgcataccgaccacagttcggtagttgtaaagataactgatgtatactgtatgcacatgaatcattcgtagggtagctagatgttctttgtaccattaatcaagaaaattcatccgtgtgtgtcgcagttgatcatctctctttcttttggggttcatgcatgccttagcctgaagtctgaacgaaccatgcttgacatgttgcccggtagttgtcaccctgtaaagggggttataagtgaatggaatggtttctgggttgggaaaaagaaaaaaaaaggggggggcccggntnccaaattncncctaanangggggcc

SEQ ID NO: 10037 - DNA, 771 bp, Triticum aestivum
  Clone ID: PAT_TA_10037
ctattattcatatattcaaataatatgtgtcttcaacaaagatgattacattcaaccaattaagcagttggagttctataccctctttaactgctagattttactacatgtttccaaataaaagttcacaggacccgggaaacataagaatccgagatctcatcctccgctgagatctcggtcagctcggatagcaaagggtatgaatccggaacggcggtgtgttcgtcgtcgcagaagaatggcctggaaggcatttgcaggccatcgaagccaccttccagcatctctatgacctcgctcattgtcggcctgtcatgagacttcatctgaatgcaccataatccaacaatgcacagctttctctccaactcatgcatgtcagcaaccagagatatagcatccgcctcttgtgcagttagtttgtcatacacccatgatgggtaataagactggcttgagttcgcggcatttggatcagcgttccttcttcctccggccatctccagaagcagcatcccgaagctgtaaacatcagacttgcttgatatggtaccaaagctccgagatatcatctcaggagctatgtacccaacagtcccacgtaaggcattagatggcacaaaactcttgtcccttgggtacagcttggcgagtccaaaatcagcaacttttgggactgaaattgttgtcaagaaggatgttgtgtggcttgatgtcgaagtgtaggatctgcatctcgcacccttgatgaagatagttgatccccct

SEQ ID NO: 10038 - DNA, 1533 bp, Triticum aestivum
  unsure (1)..(1533): unsure at all n locations
  Clone ID: PAT_TA_10038
cagaagttcgctgattatgtggccggcatttttgttcctattgtcctccattgtccttactgacattctcgtccgggtttgtatgtgggacgctgggggcatatccaaattcatgggtttcagaaactagcaattgctttgttttctccctcatgttctccatctctgttgtggtaattgcctgtccatgtgctcttggtctggcgacaccaactgctgtaatggtagcgactggagttggcgccaatcatggagtacttgtaaagggtggagatgcactggagagggctcagcatgtcaactatattatatttgataaaactgggacactgacacaaggaaaggccactgtaacaacgacgatagtgttctcaggaatggatgttggtgacttcctcacattggtagcgtctgcggaggcaagcagtgagcatccacttgcaaaagctatcttggattatgcatttcatttccatttctttggcaaactcccctcatcaaatgctgctggaaagaaaagaaaagacgatgcattctctcaatggctcttggaagttgctgatttttctgccttgccaggcaaacgagttcattgtttgatcaatgggaagatgattctggtgggcaaccgtgctttgatatctgaaaatggggttaacattcctgaagaggctgaaagtttcttggtagacatggaattgaacgcaaagacaggcattcttgtagcatatgatggcaacttcattggtttgatgggggtaaccgatcccttgaaaagggaggctgctgtagttatagaaggcctaaaaaagatgggcatttatccagttatggtgacaggggacaattggaggactgcactggcagttgcaaaggagattggaattgaagatgtgagagcagaggtcatgcctgccggaaaagccgacgtaatccgcattttccagaaggatgggagcgtggttgcaatggttggagatgggatcaatgattcccctgccctagcagcagccgacgtcgggatggccatcggtgcagggactgacatcgccatcgaggcagcagactatgtgctggtgcggaataaccttgaagacgtcatcacggcgattgacctctcacggaagacgttcagccgaatccggtggaactacttctttgccatggcgtataacatcgttgccatccctgtggctgccggcgcactcttccccttcactggcttgcaaatgccgccgtggctggctggcgcttgcatggccttctcgtcggttagtgtagtatgttcctcgctgctgctgaggagatataggaaaccaaggcttaccaccgtcttgcagataactgtagagtgattccaacctggaacctaacccgcctgtttttgtgtgtgacatttctacttgaaagaaatggatatggcatctgtttgtaactcagtgatgatacagtttttgacacctgtgcttgtaaatagcacatatatacacagatgcaaattgtttgtaatgcaagattcagttgtcaaaaaan

SEQ ID NO: 10039 - DNA, 1304 bp, Triticum aestivum
  Clone ID: PAT_TA_10039
cgcgtccgcggacgcgtgggaggcaccgtccagatatgggatgcaacacgctgtaaaagaatgagggcgcatggaaagccatcgcatgcgagtaggtgctcttgcatggaactcttcattgctttcttctggcagtcgtgacaagaacatccttcatcatgatctccgtgctccggaggactatgttagcaaactcaccgggcataaatctgaggtctgtgggctcaagtggtcttatgataaccgtcagcttgcatctggtggaaacgacaacaaactttttgtttggaatcaacattcagtacagccagtgctgaagtatactgagcacacagcagctgtgaaagctattgcctggtcacctcatctacacggccttcttgcatctggtggtggaactgcagataggtgcataagattttggaatacgaccacaaatacacacttgagttccatggatacagggagtcaggtctgtaatcttgtgtggtcaaagaatgtgaatgagcttgttagcacacacggatactcccagaatcagataatagtgtggcggtatccaacgatgtcaaagcttgccacgttgacaggacatacattcagagtattatatttagccatctcccctgatggacagacaattgttactggtgctggtgacgagacgctccggttttggaacgtgtttccgtctcccaagtcccagagttctgacagcttaagtagcattggagcgacatcatttgttaggagctacatccggtgactcaacgaaatgtagtttcgtcgagcttgtaagttattgccgcaagtgctgatcgtcatcagcaccattcaattcccacacgacctccttctgtccatctgccgccgaagccagcaccattttagagattgcacggcaggggatgattgactggctggcttgcgcggatccgatcccctctccccgcgctggaagcggcacatatctattgttgtaggagcgaaggcgggagatgttcatgtcagagaagcatgggctatacagccagccacactccctcctccagtttatgttccccattggaactgccctgcgaaccaaactgttccttaacatttactcactcatgaagcccttttgatttcaaacgttatgttgttatgcggcccttttgatttgttaaaaaaacaaaaaaaaaagttggcgtgtcgattaagggctaaaaaaaaaaaaacccaggcggtagctctattcagaacatcatgaaattcagaactggccctcgctggcctgtgacaaggcctgtggaggattccgg

SEQ ID NO: 10040 - DNA, 765 bp, Triticum aestivum
  Clone ID: PAT_TA_10040
gtatgggtatgacactcgtgtttctctggccgtctgtttgttcagcgcaaccacacctttgtagctgagctttggtttagtcagagcgcagggcaagacctacagatatgtacatcctttctacaacttgcgatcttgctcttatagacctcagccactagctattcacaacgctgaatcaaggtacccgtagaaccgtcgacgactgtactggaggaggctgctatagttgcgatcatgtacgctgacaaagagagcctcggtgtcaggactgaacgatatgccggcaatctcaccaaagaagtccagctcctgcttcctgtcgtacccgctcctgacgtcgaagatgtggatgaagtctgcagcttcggccattgccaggaacttgccgtcagatgtatagcggatcgaccttatggctcccatgttgcctcccaggacagcgacagacttggagaggttacgggcgtcccagatcctgcatgtcttgtcttggttcccagtcgcgaatgttcggccgtctgggttccatgccgatgcaaacgaatagtcccaaatgaccactgagctcgtgaatcattttccccgaattagcatcaaccagaacaccgtcagggttgtcccccacaacagcaatgattttaccatcagggctcaagggatgtgtgattcacagcccaatcgaaatgaaaatgattgcacatttgaaacttctccatgtcaaagtctcttagtccacaatcattgtttgatgctagaaaatgc

SEQ ID NO: 10041 - DNA, 740 bp, Triticum aestivum
  unsure (1)..(740): unsure at all n locations
  Clone ID: PAT_TA_10041
tacatttattttgngacaaggaagcatacactaagtaacgttgccaggggatcgaatcttgaagcaggcaaatccattgatagtccagtgcagctgccaccatgtgcagacagcacttcccatatgtgacaacactaaatcgggccgaatcggctcagaaaaactaaggactggatggtcaaaatcaattgctcgtttgaatatgctggggaagcaaaaaaaaaacgtacaactgtaacgatgcaataggtggagttaagtatttgcagccaacaccaacagcactccaattttcattcacggcttatgtacaacgctctgctggttctgaaattcagccactcttgtaactccaacgcagcccaatctacgcctcagggggaaatacgtcctcaaagaagtggttcagatcacctttgcgcggatcgaaggccaacaattttgccattgcatcctggtattgcttgtcctttgccgccaaattatcgcagatcatgcgccttacaggtctcttggaatggatatcctccagaacactagcagctctctgaataacttcactgggaacaccagcaagctgtgcacaatgaagtccaaagctcaagagtgcctgtccaggtacaagtctgtaaaggaatatgatatcttcattgcttgcctgtccatcaggattcagaacactcatggtacagcattttatatgttcagactgtgggaagtagttttcggcgaagatctcc

SEQ ID NO: 10042 - DNA, 1880 bp, Triticum aestivum
  unsure (1)..(1880): unsure at all n locations
  Clone ID: PAT_TA_10042
attagctcacataagtgtaaatatttgccacgacttggcaagtgttcataccagtttgtagttcaccccagcattgaaacaatgttcctactttctgacagtaaaggcgttctgttcatgtaacctgatacacgaactgattttagaagaagtaaaagtggataactggatgttgcacactatctcgtcatttgtccaaattattcaagtaatttgttacatgaacgctgctatacacccgatatattgcggccgatgcatgcacgatcgcagcgccaacagcaaagctgcaggcaggagaggaattgtttttttccttgctgatgctatcgtctgcagattgtgcgagtagtgtcgtgtgtgaagcaatttcgttgttacattctccctatttccgatagtgtaattgcgacatctaatctaaccatgtgagcagaggggggtaggggtaaagaagtgttattgagaaaagacatgttctaactgtatgacgcttctttctgtaagaacttcacatattctttctgaagtggcatcgaatgtcataccagcctattttcttctttggcatgttcactttttctgctcgagacttgtaacagggaacaagataaaacctgatgccaagtggttaaattaggaagtcattgaatatcagatgntgcatatgatatggattcggcacgaggccgccccgacgcgcacgcgcagtcaacgaggcgcagcgcaaccccgcaggactcctcccgcagagcacgcgcgctgtgccgacgcggcccgcctcctccccgccccacgcacgcatccacgccgaagcaaagcgaaaccgcaaaggactcctccggcagagcatgcgcgttgctgcgacgcggcccgcctcctccgctcccgttgccctcctcgccgctctagccctcctcttcctcgtcggctccgcctcgctcgccatcggagccatggccagccacgtcctcggcggcaagagcgagaaccccgacgcggccaacagcctcgagaccgacggcctcgcccgcttcgccgtcgacgagcacaacaagcgcgagaacgcgctgctggagttcgtacgggtcgtggaggccaaggagcagacggtggccggcacgctgcaccacctcacgcttgaggcgcttgaggccgggcggaagaaggtgtacgaggccaaggtctgggtcaagccgtggctcgacttcaaggagctgcaggagttccgccacaccggggatgccacctccttcaccatctccgacctcggcgccaagagagggggacatgagcctggatggcgtgatgtgcctgtgcatgatcctgtagtcaaagatgctgcaagccatgctgtgaaatcaatccagcagaggtcgaattcccttctcccatatgaacttgttgaaatcgttcgtgcaaaggctgaggtggttgaagacttcgcgaagtttgatatcctcatgaaactgaagagagggaccaaggaggagaaaatgaaagccgaggtgcataagaacctcgagggagcttttgtgctgaaccagatgcagccagagcatgacgaatctagcagccagtgaatctgacttgttgagctcacagtaatgtagtttgtactaagaaataaacagtaaacctgtctctacctggatattatgctttctgcaccggcggttgttgaaggaagcacgatggaactatgtgttcttgctagctgaaccttatttggttgctgttaatggtggaatgtgcaaccaatcttgtaactcgagggtaccgttggatgcgatatacactgtcaatttcggttactctgcaatatacactgtcaatttcccctcctctgcggcaaaaaaaaaaaaaaaaaaaaaaaaaaa

SEQ ID NO: 10043 - DNA, 567 bp, Triticum aestivum
  Clone ID: PAT_TA_10043
attctttgctttccattctcgttctatgatatgctcgtgtttcgcgacttccacaaaaaggcgggggttcagcacaaagagtactctgttgatgtcgtaccgaagaaggccgggccttcagcctatcttgcacaacggatcatcagagcaatcactagaaaaacatgacaaagatgcaagaactgatggataggatcttcccttttctgcagggattcgtcggcctcatgtactcataggtttcagtgggtttgctgctcggctgtgagtgccgcactacaagcgccgccctgccgcactaaatctgccgccctgccacactgcgttgtgggggaggatagtgaacgatagcagctgctcattgtagaactagctcaggtagcaggagacgaggctgatgaatccgtacttctccttgtcgctgcatgcaacgcaacagcaagaaatccggaatttggactgcaaggcgacggtggggcgtgcctgcgtgcccccacgtactggactgcaaggcaactgagcttcatgctgctcggccatgacgcactcctgtcactggcggactgc

SEQ ID NO: 10044 - DNA, 824 bp, Triticum aestivum
  Clone ID: PAT_TA_10044
cgtccgcggacgcgtgggctctggagttagccctggaacatacgaagttgctgagcatcagctcacagagcgtcagcttattggtatgaagaagcctgtggggatgacggatgacatgaagaagcttgaggattggctagccaaatctgataaaagttcttatgaggagcgagccgttctttccatagtcggattcggcggcgtgggaaagaccactattgcaatggctttgtaccaaaacgtcagggataaatttgattatcgggcatcagtcaccgtgtctcaaaactatgatgaagatgcagtcctcatgatgattctaaaacaagtcaagccaaaggagagtgatcacgagaaccaacacaacactggcagctctgatgtaaaacagattaaatttgaaattagccacgataaactcgtgaaagaactacaagatcatctggctgaaaaaagtatctcctcttgattgatgacatatggtctgcaaaaacatgggagagtatcagaaagtgcttgccacatgaaaataaaaaaggcagcagagtaatagtgactacaagatttcaagctgttggtgccacatgctcccaaggagtgattgattttgttcatccagtcgaatttctgaatgaagacgagtctaaaaggttatttaagcgaagtgtttctgaatccaaaagcatcaaatatagcgagaaagaactggaccaagtcactgaggagatatgcaagatatgcaggggtctgcctttggccatagttaccatggctggtcttgttgccagcaacccgaacacactcagcaaaaaatgggaagcagt

SEQ ID NO: 10045 - DNA, 1052 bp, Triticum aestivum
  unsure (1)..(1052): unsure at all n locations
  Clone ID: PAT_TA_10045
tttttttttttttttttttttttttttttttgctgaaaccagactggcatttcaatgttgctgtcaaaccttctgttgaatttggttaggtggggacgcttctatcaccgtatcttccctttcgacgagnatacacaaaaggacgactaacaaaataagtgaccggagacaggccccaacttatgaacaaaagtcggtggttatgtactaactttttgcatccctactgtgcactagaatctagcgttaagaacttcgcaaaatgcagttggttacggatggataaaaccagagcatgacaaactcccagcaaaaggaaatcgcatgcggacatttacgctgtcagcgcatgtggggaggcttgactgcaaacgaaatatttccaggagttgctgcgatcgggtgacttccaggagttgctgcaatcgggtgacctccaggagtagcagctgcaaatgggttgcctcccggagttgtagcaaacgggtgacttccaggagttgatgtaaacgggttacgcccaggagttgctgcaaatggattacttcccggagttgcaggtgagcgaatggttggtgaaccctgcaccctctttgccgctggtgattgagtgatatagtccacaagctgttgcttttgattgctgaatgagtccttaacttgctttaacaaatcttcctccctttttatatcctcgacaagcctttccttctcccagttcttcagtttgacttgctcttccacttcagtgatacttccaggtgtgtttgaatccccagagcttaaagctacagtaaatttcacttcaacatctttcctatcaccaaggcagaatgaaccccgtgcccctctcggcacccgccatctagagaaaccgcaccatcatttatgaagggaatagcacgccgtagatcagctgtagtcttataaacttgtaaatgagaaaacaaactgtaaaacaaagtctccctaagaccatggccatggggtgtgagacaactcaagtatgcctggtccataagtatcatatttactgcgaaaccaagaaaacc

SEQ ID NO: 10046 - DNA, 699 bp, Triticum aestivum
  unsure (1)..(699): unsure at all n locations
  Clone ID: PAT_TA_10046
cttttttaccaacttatatacatnatgttgaacttacaaccttttaaattgtgaacttgttgtgttttcacaatgccaaagctagcaaatagtaggagattcacccaacaaaggggctaattacatagagcagctgcagtaatacaatggtaagtggttaccaacacacatacacatgaactgataacaaggtaatgtacaagttcatgtacagtaacactacaagttcacaaagaaaccggaaatatcctcacatattagttttccttccccgatctggaaaatctataatttagattgtcagtccacataggggtcttcttcgggggtgatcctggttgccgaaacagcagcaacaaccatggagggcttagactggactaggccgtactgcagcagcgccagctccacgaaaaaaagaccgagctctccatctccttgtcgctcttcttatcttaggaggacacggccttggcaaatccaatgatgtgttataaactccgaatcttgcatcaccgagcaaaaggaccttcgcggaggaaagttgaagccgacatccatggactgttgctcgcgacaaactcggccatcctaatgccatggggttggactgaggacgacacacatacgatcttgacgatggaggagaccgtggggtgacggcccatgtcgtgccaccatttcttatcggcggtgctg

SEQ ID NO: 10047 - DNA, 1239 bp, Triticum aestivum
  Clone ID: PAT_TA_10047
gcagacccgcccccccccctcccctcaccacctacccttccctctcccacccttcaccacgtcgcgccccccgatccggcggcggccgatccatggacaagtacgagaagctggagaaggtgggggagggcacctacggcaaggtgtacaaggcgcgggtggcggcgacggggcagctggtggcgctcaagaagacccgcctcgagatggacgaggaggggatcccgcccacggcgctgcgcgagatctccctcctccgcctcctctccgcctccctctacgtcgtccgcctcctctccgtcgagcaggtcaccaagccctgcggcaagaccgtcctctacctcgtcttcgagttcctcgacaccgacctcaagcaagttcgtcgacggcttccgcaaggggccctcgcccaggccggtccccacccaggtcgtcaagagtttcttctaccagttgtgcaaaggaactgcccattgccatggccatggcgtccttcaccgggatttaaagccacaaaacttgttgatcgacaaggagaaaggggtactgaaaattgctgatcttgggctaagcagagcttttactgttcccatgaaaagttacacccatgagattgtgacactctggtatagagctcctgaagttttacttggagccacacattactcaactggtgttgacatttggtccatcggttgcatctttgctgaaatggtcagaagacaagctctttttcctggcgactccgagttgcaacagctgcttcacattttcaggttgttggggactcctaatgaagagaagtggcctggagtatgtgctctgagagactggcatgactatccacagtggaagccacaacatttgtcacgtgcagttccaacactggagcctgaaggactcgacctgttagggaaaatgcttcagtttgatccagcgaacaggatctcagctaaagcggcaatggaccatccctacttcgacagcctcgacaagtcccagttctagttgttgctgctgtcttgggagttggtccttcgccatggagcgaggagattggagatttgatttgcttgccatctaggcaacctgatcgatcttgatttatcagctactcggttttgttattgagtgggcaatcgatttgcctgtctttttatatatcattgtatggattcggggtcggaaactaaactgccactcatgatattccctgatgtttccctccggcatgatgct

SEQ ID NO: 10048 - DNA, 683 bp, Triticum aestivum
  Clone ID: PAT_TA_10048
gaattcactagtgattagcgtggtcgcggccgaggtgagagaactagtctcgagttttttttttttttttaaagaaactaacataaacaagctattttaacaatgattcagcacccggtccttcaataacaccacctcctataactatcatgagtgcaaaaaatgtcgcaggcgatgtacatatacagccatagaaaataactgccagtcaacacggagatatatacatatgctgctaactcagaaccggggatcaactaactacgaaggtgcatgatctgggtgaggattcaaaaaatggatgatgccaccatcatatgcctgcattctgattgttgccagccaggatgagagaaatctccaaacctctgctgaaagcctggttgaacagtagccgtgtctggaaggtggagatgaagggaaaccaaggagcagatggctatgggcacaaaaatgatcattcccatgccagcatcatacagacgagccagcgagcgacctaccgtgcgcccgcccgatctcttcacaattggtttccatgccacagcaatcgaaagaattccccatccagtagggacatatgctaggatggaagcaagtacatctaaaacagtgaggggtgtcatcgcaattgccacaaccaaacctgccaaaaccactaacagtgcaatgcttttgaccag

SEQ ID NO: 10049 - DNA, 849 bp, Triticum aestivum
  unsure (1)..(849): unsure at all n locations
  Clone ID: PAT_TA_10049
tggatcctggaaaatgtatttacaaaaacntcaccncaacaatgacgaacaaatgaaactgctctttctacagatgaacacctaccactctaataatacatcaccacctacatctaaatcctcctgaccccaacttatttaactatcactacaaagaatacgtaccatgactccaggttcaaatgaaggaatatttacaacgggttttggacgagaatagctatgaaaaaggctaggcaccgcctatcaattgccacatggagtgatacagcaggtttgcaaaattacttgcgtatgcactcctcgggctgatgatccttaggataaatgaaaacagagtcgacacacaggccgccttttgtatgcgtgcaatcaatctgcatcatagagaacttgagcttggtcaactcatccgaactcgatatgacaaaatcaccgacatggtaaaggatccagtgtcctggtccatctagatggtagtcggatgttgtgtgctggccatctgaagttgagagctgaaaccgtgtcggtttaatgtcccaaccgtagatgagctcagagtcatagacccgccggcccatgcgcttgtgtggccggcccaagtggagccggaagagaaggctatatgaaccagcagggaagcagaaatcaatctccccagccacctccagccaccatatttgctgaaggtaggcaacactatggaatctcgactcatctgtggtaaggtggctccaataccgccgatcatcgataccggtaatcgccaaagcctttgaggagatggacatgcaaagaccacccttgctcttttggatccaaaattccttggtgcccctatcgaagggg

SEQ ID NO: 10050 - DNA, 366 bp, Triticum aestivum
  Clone ID: PAT_TA_10050
atctaccaccctcccgctgaccagaagatggcccaagacccggagacggaccctcagctcttcaagaagctcctgccgttcatcaagaagaacccattcttcaagaagttcccccctgccaaggaggataccaagccatagaggattggtgtgacctgaagtcctttgcctatttcagtatccatggccgtattgatccctgcagttttttttttcttttgagggaaatgttgatccctggtagtctcgacttcttttttgcaggtgtggtagtagtcttgaactgtaagacaataagttttgggggaaccagcacaaccctctaggggtggcttatctcattatatataatggatgtgttacaat

SEQ ID NO: 10051 - DNA, 787 bp, Triticum aestivum
  Clone ID: PAT_TA_10051
gatattgatgtgaaatttctaccaaaggcactccatttagcaagatccttccctttagagggtcataaaacctttcaatcaaatttgctattgtagtttttccaccaccactcggcccaacaagtgcaacctttgaacctggtgctagcttcaatgtgattcccttaagaatcatatgagaaggacgagaaggatatgcaaaccagacatcgtccagctcaacttccccctcattttcgatttttggacatttatccccagtgtttgtcattgaggaaacacgatcaagtagttgaaaaactctacggcttgcccctgatgctttcattacagttgtgtatagtcctgacaaggcagagactgacgagccaactgtaaggctgtataagatgaatgacgtaagagaaccagttgtcatgtaacagaatatccctctataatcctcaaaaataagttttcaagaaagaatatacccggttacaactattagcacaatgtacaatattgtgccgttcacatccgccagggcttgggccttatcctctggccgctgaacatctcttgacacaatatcaattatcttgcctccgtatttgggaacgaggaggttgctgagagaagcgacgagcagcgccatggtcgcgaagacgagcttccccgcgtcatgctttgccaacttgatgacccggcagaagccgacgttggccgcctggacgttgctgccctcctcgaggtcggagaggatcctggacgtctccccgttgttgaggagcgggacgcggttgcc

SEQ ID NO: 10052 - DNA, 572 bp, Triticum aestivum
  Clone ID: PAT_TA_10052
cgcacatggtggagggggcgtccctggtcgtgcggagcgcgcacggcgcgcgcggcttcctgtaccccatcgtcgacccggaggacatcaggcggggcgggaggtgctggtgccgtgcaccaccccgaaggtgaggtgatcaactctgtcatcgtcgcccgtaaggccgtcgacgcgcagctcagtgggccgcagaacggggacgcgcacgcacggggcgcggtgccgctggtgagcccgccatgcagcttctccaccaagatggaggcgggcgcgcttgagaagagcgaggagttggccaccaaagagctggccttttgattccaaaatgtgcgtgctgaatcatctgtcctcaactccgtcattctgtcgcctgcgatcgtggtaaattccctactcgtgtgtgttttgatgtttgtgcctacgagagatatgcgttctgccttctggagttgtggtgttaatttcctactcgtaagtactacttgtatttgtacctggagtaatggtacgtaagagaaataatgtgtgatttaagagtacatgacgaaagaatgaatgtgattgataac

SEQ ID NO: 10053 - DNA, 851 bp, Triticum aestivum
  Clone ID: PAT_TA_10053
aaacctcaaacagcaacatattctcgagagattctgagtggatcattcttatccacgattcagggaagaaactgcttggtgaattcgctggtgccgtgtgatcaaagctcgggagtcggaatggagctggagatggcgagccagcacggtgccttgctgaaggtggggctgttcgtgctggtgcaggcgctggtgtacctcatcctcgcccactcctcctccgtcttctccaccaccaagaccctctgccctcccccggcgcgctcccacagcgcccgccgcatggtcgcgctgctctccgacctgccgctcggcggcgagccctcgccccgcgccggcatcgtggagccgtcgtcgcccgtggccctggccgcccacgcccaccagaaggaggattagttgaccggaccacgatgattcgcggcgcggacaaggatcgagctgggggaggcagctatagagcgagcatatgtctgccgagctagcacctagcagttggtgccttgtaagacaataagtttttgggggaaccaacacaaccctctaggggtggcttatctcattatatataatggatgtgttacaatacgtacataagtacagaagctatacatagtctaacaccctccctcaatcttagtcactttctacctggaggctgggctcggccggcttgtcgccggcctcctcctccagtgacgcgagccactggagcagcgccgcgttgaactgctccggcgcctcgtcgtgcgggcagtgcccggcctgcaggttgacgacgcgtgcagttggcgtagaactcgtggatccgcgccgccttggacgggccgacccacgggtccaggtccccc

SEQ ID NO: 10054 - DNA, 3020 bp, Triticum aestivum
  Clone ID: PAT_TA_10054
acctctgctccccgtccgcaccaaccatcttctcgaaccaacccattccgcaatgggggccctgcctcggggtctactgctcctcggcgtttgcgccgtcctggtggcggccgtgctcgccgatgcatcacctgcgtcgtccatggtcgtcggcttggccaagtgcgccgactgcaccagaaagaacatgaaggctgaggctgctttcgcgggccttcaggtggctgtgaagtgcaagaacgccgacggcgagtacgagaccaaggccgtcggcgcggtggacaagtccggcgcgttcggcgtgcccctcggcgccgacctcctccgcgaggacggcgagctgaagcaggactgcttcgcgcagctccacagcgcgcccgaccacccatgccccgggcaggagccgtccatgatcgtccggcaatccgccgacggcgccgaaaagaagagcttcgtcgccgtccccggcgaggtgcactactcctcccaggagtgcgcgtcggcgttcctctgccacttcttccacaagaagcacctcttccacaagaagtccgccttggtcgtccctcacctcaagaagaaggccatcgtgatcccgcacatccacaagaagccgatcgtgatcccgcacatccacaagaaaccggcgccggtgccggtgccggagtacaagccgccgacgcccaccccggtgtacacgcacccgacgcccgtgccagaatacaagccgcccgaggaattttcgcgggtgtgtgaaatggatggccagcacggggcgctgctgaaggtggggctgttcgtgctttgcacgtctttcggccccaacctccctccactcctccactagcccccagggaaatagggctcccgagaacaagagggcagcccactggcaggtggatgccctgggccgatcccgcggcccccacggcgcccccgctcccccccccccccgccggcgccccgcccggcccccgcccacccacgcggcgccgagcgcgccaccgacccccggcgggcccaccgcgcccggtggccccgagcaggcccggccgggacccacggcggaccggggagggcaggacccgctcctccgcctccgccgcggcggcgggggcgcccgagccccgcactacccgcgccccccccccaccccctcgcgccccctcggccacccccccacctccaccaacaacaccaccccgagcacagccagtacggccccctgggccgccccccgcgcgcgggcgccgcgccccccccccggccgccttcatccccccgccccctcccccgttcactggctccggcccgccgcccgccacctcccctcgacctggtgcgcgccccacgagcccggcgccatgcgcgagaaccccgcccccgcgcggctgtgccctcgagagaccgagcacgccggcccgcgcgcacacccccacggcccgcgcgccgcgccccgccgattcccccacgtagcacgtcgtgccggtgcccgcggctgtggggatgcccgccgaggagaaggcgaaggcgagcgcgccgccgcggcgcacacacgcccggtggggcggccctggtccggcgcgctccgctcgcggggcgcccgcccctaggcccgctccccgtccccgaccacgccgccggcgggggggccggggtgcaggcggtggccgacccccatgctgacgtggtgaagttcgtcatcattgcacaccaatcgaaaggccggccatgaccagctcatgaccccgggcgcgcggtgggcggccagcgtgggcgcggggcggtgcgggtggcccgcccccccgggtcggtccgcgggtgtgagaccggagcccggaacagagggggggaggtgtaccccagacagcgggccttttgattggaacgttccaaggcggcacggttcgtgcatatgtgcgtccttccttcccaacccagcttggttgatcgcctccaaacccgctactttttttttttcactactaatcaaggacaatctcttgacctttcactttcaaaaggatgcttcgtctgtaccaggaataccaactgccatgactcaccccagtcaacaggcgctcgatgacaggtgccaggaacacgagccaaaccgcacgccagatgtaaaacgcacccggacaccgaatcttgccaccgtccttgctgaccagcaagatggtgcaagaccctggagacggaccctcagctcttcaagaagctcctgccgttcatcaagaagaacccattcttcaagaagttcccccctgccaaggaggataccaagccatagaggattggtgcgacctgaagtcctttgcctatttcagtatccatggccgtgttgattcctgcagtttcttttttcttttaagggaaatgttgatccccggtaatctcgaacttttttttgcaggtgtggtagtagtcttgaacttgctacaaataaacctatgttgaaatgagttatatatatattggcccagttggattaactcatgaggctcatgagcaaaggctcttactgtgcgaatggcaccaaaggattcgtgcaggttcggtgagatggtggcggaggtgacccagaagagagaggagttcgccaacgccgaagtggccttttgatcgatcgttgcgaaggaacaataatgtgtgataattttcgaacctagctgattgatcgcctgcaaccacacgtgttatttttcctactgctaatgcatttcaagtcatgtgttgtttgtacccaataatgtaagtctggtgtttacacgcgatacgccttgtatacaccttgtatgtgcaagtgttgggaatgatacttttgctattatctctgtttatttctatttcacgctttagacattcagacactgttcataacagtacaaagcaagctgtcccaaacgtcttataaaaacaaacggagggagtcccgaataatgtaagtgtggtgtttccacgcgcctttcttgtacacctttgtacgtataagtgtaaaaaaataataattttagttc

SEQ ID NO: 10055 - DNA, 1054 bp, Triticum aestivum
  Clone ID: PAT_TA_10055
gaattcggcacgagctcatcctccccatcccaaaaccctcggaaagcaaaggcggcggcgcgacatggcagaggtcgaagctgcgctcccggtggcggcgacagagaccccggaggtcgcggccgagagcgacgccggtgcggccgaggcgaaggggccgcacaagctgcagcggcagtggaccttctggtacgacatccagaccaagcccaagcccggcgccgcctggggcacctcgctcaaaaagggctacaccttcgacaccgtcgaagagttctggtgcttgtatgatcagattttccgtccgagtaagctggtaggaagtgctgattttcatttattcaaggctggggtagaaccaaagtgggaagatccagagtgtgcaaatgggggcaaatggactgtgatatctagcaggaaggccaatcttgataccatgtggcttgaaacgtgtatggctctgattggagagcagttcgatgagagccaggaaatttgtggtgttgtcgctagtgttcgccagagacaggataagctttcattatggactaagactgccagtaacgaagctgttcaggtggacattggcaagaaatggaaggaggttattgactacaatgataagatggtctacagcttccacgatgactcgagaagtcagaaaccaagcagaggtggacgatacaccgtgtaaggctgcacgcatgatgaagaccgcagctcagaaagtggccttgtagtgtttgaccgagattcgaaccgcctcagctaatgttgtttgaggcaattttccaatctattattatgtcgttttgctctctgatagcttgtggtatacagagatgttgtatgcactcatttttcctcgcaatatcccttgattacaacaacccagaggaggaactccatctcgtgtgggaagtgggatgcatcatcactgttttaagtatatgtttgcctttgtgcaagacttggtattggctgtttagtccacttttgtgggctttgaaaagctaaaaaaaaaaaaaaaaaaaatttaaaaaatcttctcgag

SEQ ID NO: 10056 - DNA, 1090 bp, Triticum aestivum
  Clone ID: PAT_TA_10056
ccccgccggctctcggcacgagctcatcctccccatcccaaaaccctcgaaaagcaaaggcggcggcgcgacatggcagaggtcgaagctgcgctcccggtggcggcgacagagaccccggaggtcgcggccgagggcgacgcgggtgcggccgaggcgaaggggccgcacaagctgcagcggcagtggaccttctggtacgacatccagaccaagcccaagcccggcgccgcctggggcacctcgctcaaaaagcgctacacctgccacaccgtccaagaggtctggtgcttgtaagatcatatattccgtccgagtaagctggtatcaggtgctgattttcatttatttaaggctggggtagaatcatagtgggaacatccatagtgcgcaaatggaggcaaatagaccgagatttctaacatgaagaccaatctagtgaccatgtggcttgaaacgtgtatggctctaattggagagcagttcgatgaaagcctgaaacgtgtgtggtgttgttgctagtgtccgtctgaggaaggataagctttcattatggactaagactgccagtaacgaagctgttcaggtggacattggcaagaaatggaaggaggttattgactacaatgataagatggtctacagcttccacgatgactcaagaagtcagaaaccaagcagaggtggacgatacacggtctaaggctgcacacatgatgaagaccgcagcttggaaaagtggccgtgtagtgttttaccgagattcgaaccgcctcagctaatgttgtttgaggcaattttccaatctactatgtcgttttgctctctgattgcttgtggtatgcagagatgtcgtatgcactcaattttcctcgcaatatcccttgattttaacaacccagaaggaggaaccccacctcgtgttgggaagtgggatgcatcatcactgttttaagcatatatttgcctttgtgcaagacttaggtattggctgtttagtccacatttgtgggctccgaaaagctggcaggaaaaaaaaatgaattttgcggttcgaagttgaaaaaaaaaaaaaaaaaaaaaactcgag

SEQ ID NO: 10057 - DNA, 1135 bp, Triticum aestivum
  Clone ID: PAT_TA_10057
gccatgcgtccgcggacgcgggcgagcagcatcgcaatcgccaaaatgcaggcgctcctactcccatcgcggctgccgccgccgctgctccggcagcgggggcttccccgctgttgcgtctctcgccagccatcccctcaacggagctaccctccctaccgggcgcctctgcttcgggggcggcgaagccgctccgcggcgcctcactgtggcggcggcggcgtcctcgtcttcgtcgggccctctctacccgacgcctccccccaccgagcagacaattgagcgcgccaagctcgagcaggttatcaagaggctagagaaaacagctaggtatttcaagaatttgggtaccctagggttctggtcccagttggtgtgcacgtttgtttctgctggaattttgtcattctccacaggttgttactgggaaaggttacatcaccctttacattctacacaactgctgctggcgttgctgcagcttttatttcagtcttctggtcattttggctacattccgtctttctgaaagacttcggaaaacagcaagtgcacccgcaaaggctcctccacgggctgatgtgagttaaaagtactgaaaaatggcattgtgctcaatattcttgggatggggtcagctgttctcggtgtgtaggcacttgttggtcctttggataccaaaagcccttactacctccgcagtcccctacccttacaacctctgtacgtcccaaattcctgttttggttctgcctgtattacggccttcttgcggcactcgaacgccatactgtcttctttcctaggtgtggcgacttccctgcgagctgctcagttccgtggcaatcgcccggaccgagcctgccccggcatgaccccacggccgaacctctcacgagctgcgcgattcccccaagatgtgctggattcctttatttcgcacttgtcttcctttctccctgactgcctaggaattgcatctcgtgtgcgctgggattatgtccttgacatttcggcttaaatgagcaggttccgtgtgggcccccttaaaaaaaacaatgcacgaccgcatttggtccgtccctgtccgtttaaaaaaaaaaaaaaaaaaaaaaaaactggagactagttctct

SEQ ID NO: 10058 - DNA, 1238 bp, Triticum aestivum
  Clone ID: PAT_TA_10058
tcgtataagagccttatttggtaattattcctgacatatgtttcattgccccgcaaaagaaacatatgtttcacagttttcactcaacagtcacataacacctccatttcacatttccactacacgaaagaaaagcaaattaccagtgttacctccgtcccaaattaacatgtctacatattttcgtgtctctagacaaatctagaacaaataatttaggacggagagagtcgtatttgtttttcaataataataataaagttgttaaaaaggctctttgcaatccttgatgccttgaacgattcagtcgtttgtcgaaatcttcagactatccagcaagtcaatgattgctgccgccgaggatccaccgatctccagtgcattggcagcaatctcttgcgccttcgtcatcctctgcctgatctcgttcccttgctcggactccatgaccagtctcaccttcgcctctacctcctccgctttcaccatcgcctcgtcgtagccgttcaaggccaccccaagtttcatctcctccacgacgaacaccttgttcatcctctgctccgcgtacatcggccagcacagcatcggcacccccgccatgaccgcctccagcgtggagttccacccgcagtgcgtcacaaacgctccagtcgccgggtgccggagcacctccacctgcggcgcccaggacgacagcaccattccgcgtccccgtgttctgtccaagaatccatccggcagcagcgcatccaccgccgcgtcaccccgcccctcgaaccgcttcgtcgagtcggcttccggcgcgacaggcgcgcgcacggcccagaggaacgcgtgaccgctcttctccagccccacggctatctcatttagctgctccgccggcaccgagctcgcgctcccgaagcagacgaacaccacgctccccgccggctgcttgtccagccacacaaggcattcgtgattcgcgttgctccctctctcctcgccgaccaatgggccgacgcagaacagtttcggcagtgactcgccggggcggggaattccctcctttatcgccttcacggcgcggggctccagccactcgaacgtgttcgacagaatgcccttcgctctgggaagctgcttgaagagaccaagagtggtactgtactgcctgttgtcacgatcgagcaggacctccggcaagtcggacgccggaatgggtaactccagggaagcctcgtccgaattcc

SEQ ID NO: 10059 - DNA, 542 bp, Triticum aestivum
  Clone ID: PAT_TA_10059
ctatcttgtaagttaaaataatacatcatctttctaacactttggtttgtacaactgttgacactaacttggcaacgattactttgacatcacacagccttgggtgttcttatatgacgtgacacttcttccttcgcatgtgtattatacataaaatgttttgctgacacgatgatttcgtgttgggcagacaaaaccagtgggctaccttgatggcatagatgaggtgtggaatccaattgttggacagcctggtggcttataggttaatccatgtaagcatctatgagcgtcatatgtcagcaaactcatgaagattaatgtaagtgattcgtattcggattgaaatcactgtattgacaaactgctctgacttgaaaaacagagccctcaactctagttcatgcacatggcaatggcaacccagcggtcgaaagaaatgatgagaaagacgacattgattgggatgatcttgagaacaaaagcccaccacttgcaatgcaggaacagattgatggtgacaatctgttagcgaggaacct

SEQ ID NO: 10060 - DNA, 629 bp, Triticum aestivum
  Clone ID: PAT_TA_10060
ggttctctccaacaatcgtttggtccatgctcgatcaaacaactcgttgggtcttctacgtgggctaacacctctgaccttgttctaccatgggagattctttcttcctttgtccctccaggtccgttgctatgctgcctgtcctcgcctggtccgttgcgatgccccccgtctttgcctgggtcgttttcatttccgccccttactgcagcccccttctcatttgtccccccggccggaccccgcttctcccgctgccggggtcgccgtagctggcgcgctcttgcgcctcccccacgccttcccctcattgaagtgctcttctgcgcctcctccgcccgctcgagcgccggctctgccgctgccgggggccgccgcatggacgtgctcctgcctccacctcacgccagcggcacttggaggtctcggccctgccgccctcggcgccctgctccccccgccccgtgtccacctgtaggcgccgcttggcctgtctctgctccacagagttgtctgttgtgtatatgcaatttctcactttctaaagaaggtgctttttcagcagtttgactgttcagttgtggacatgcatcacatcttcactttgaatctaactgtctgtttgccat

SEQ ID NO: 10061 - DNA, 530 bp, Triticum aestivum
  unsure (1)..(530): unsure at all n locations
  Clone ID: PAT_TA_10061
cgtccgcaagctcgtcatcaaggatagacattgaggccggtacatggcaagaatcatattcttccccaaggctgcgtgacaggatacggactgggcagcagcacctgggatacgcgatacggcagctcgactccatcttctcggctggacacaacttcctgcggaaaaacccgaaggcgcaggtcggggctgcagtgtacctggtctgcctccacatatgggtcatgtacatactgtcgtcgcatcctgttgtcccggacacccgccccggcgccactttctctctggagtcgatcaacaagactagcatttaaacatccatgtgtgtctctctctgtatttttgtttccttgtgtacatcatagatatatacgtagcctattgtttgtgcactgtgcagcgagacacaagacacattaccgacttgttgacatatcacagatgactttactagttttgtgctcggtaggcgaagtgacntgatggatggttataccaactcaaatatgaacaacctgaatagcaattct

SEQ ID NO: 10062 - DNA, 709 bp, Triticum aestivum
  unsure (1)..(709): unsure at all n locations
  Clone ID: PAT_TA_10062
cataatatttcatacaacagccaagcaaagtacattacaatcatacatagtatagatcttgtattcagctataaaatacaactaaatatacacataactagctccagtgagctaaaatgcattgctgggtatggtttttcttcgggattcttcttcctagagctcctgtgcacccaacttttgaagaatgaaggcccgcatcgaggttcttgtcaagggtgcgggtgaactggtggagcgtcgggggcaccttgaagcgctgcttgaggatgcggcactggcgctggatgcgcatgaccttgggccacttgacaaaccggtggaggtccttcttgggtggcagggcgccaccgatgccgaactgcttcggcctcttctcaaacaacgggttcaccaccttgtcctgctgccacccgcccgcgcctccctgtcacctcccacgccccagctcccggggctccctggtccgtgccatttctgccatttattaattacacatgcaacacttataataccaatatagtcaattcccacgagctaatttattaatataacattgncatagatctagcatgaaagagtcaaaacttgtctcacatatcacangtacacttacagcaagcgtaaatgcaaaaggcaatcttccgatgtggcataaattgtacaagtnngaagcaggntcaatagagctcatgcagncctatgtgac

SEQ ID NO: 10063 - DNA, 696 bp, Triticum aestivum
  Clone ID: PAT_TA_10063
ggttgaagccctgatatcattttcattttccatttcccccatgaaagagttcttctattttccacggtgatatgagttatactttctccaaaagcccacgtgctatggaaaccaacacaagcctagtccaaaagcaccgctacaaatgttagctgaacgggcaattttgcctccgcggcagacgcacattgtcaatgtaaattggggcgataacgacggcacaagcatgaacaaaccgcagaaagccctactagcgtggtcgcggccgaggtaccatgatgatccaggaaactaagggaaactaccgctaccgcctgttcctaagttggtctctggtctatggttgcttgaggcgcccctcgccatcagcaaccacgtctgctgaggtggagctgcgggttactgagctaagttgaaatggttggcaaagaagttctgcctctggttgccgcgcattgagaggaacctccagcagcaagtcttgatcagaattatccatgtaccgcggagggccccccctcgatattttatctgggggtaacatgagtaagttaaatggtgctcctccagatttgggcaaaaatgaacctttgaactgaggagccatagccacagatttgcaaacttttttggcaatcctcatggttccttctgggcagctttgcaactggctttcatgaggccttttgagaggct

SEQ ID NO: 10064 - DNA, 407 bp, Triticum aestivum
  Clone ID: PAT_TA_10064
agcgagcgacccaggccgagatcgggaaaattccccatctcccccctcccatcgcctcccctccgccgccgtccgtggatcccgtcgccgacgggccggacccgccgggctccgcggccaccgtcctcgacaccctgggcgaggaggtgctggcggtcatgtccccggtctccatctgcatggccctcgtcgtcctcctcatcacgctcctcgcgccgccctcctcctccccctccgcgcccccgcccgtcaccgccgccacgctcgtctacctcgagtccccctccgactccccggcccagaagctcggaggcgcgcttctcgacgccgccgtcttcgtcgcgctcgtcgccgtcgtcaccttcatactcgtcgcgctctactactaccggttgcaccggctttcc

SEQ ID NO: 10065 - DNA, 770 bp, Triticum aestivum
  Clone ID: PAT_TA_10065
gaccagacgagcagagcccagctagggtttcgagatttcccgtcgccagaatcgaccgccacctcgtctccgcgagcacccgccggcgccatccctcgccctcgacgtcttgcgccccggcgaccctcccggatctcggccccctcctcctcctcgagcaccaccgctgtcgatctctactcgcgccgcccgcagatctgattccggggtccccggctctcccatccaggatcagggccatactcgtcggccaccatgcaggccagcgacaggttcaacatcaattctcaacttgagcatctccaggccaaatatgtcggaacagggcatgctgacctgaccagatttgaatgggctgtaaatatccaaagagacagctatgcatcctacattggacactatccaatgctggcatatttttccattgctgagaatgaatctattggaagggagcgttacgaatttatgcagaaaatgctgcttccctgtggcctccctcctgaaagagacgaagactgaggagctggtgctatagtgctacctccacagcaacttgtgtccagatgctgtgcgttaccaaagtctcaaggcctgtctggactagcgacatgagcactctctgtgattgtgtttgaacatcacgaacatctttgtctagtttaatttctggacggccttggccatcttgcctcataaaggggtaatgtaccgtgatgtcgtatctgcgtcttactatatatgtgaacggtataatcgaattgcagcagcgc

SEQ ID NO: 10066 - DNA, 1278 bp, Triticum aestivum
  Clone ID: PAT_TA_10066
gtccccctgcggggctggcaggtcctccccaggctagagagacacccctcctcggcgagcaaccccccccggcctccgccgccacccgccggccacctccccgcccccttcccgctgcgccgcccgccgcctgcccccggcctccccgccccctccgcgccaccgccccctcccgcgcctccccgagcacccgctgctggcttcccgcccccccgacctcgtgcgcgcggcccaccttcccggagctccgccgggtccctgcccccgccagcccgcgatccaccgctcccgctcccccctcgcgccgccagcagatctgattcaggcgtacccagctatatatgccgggttcataggtcgtactcgggaccccaatatgcaggctagcgacatattcaacatgaattccaaacttgagcatcttcgagcaaagtatgtcgttgcaaggtatgcggaccttgttcagatttaaaatgcctgtgaataggcaaatagccagctaagcaagagaatattggccactacccgatgttgctatatttttcccactgctacaagaatgaatcttattggaatggtatctttacgaatttacttagaaaacgctgcttccctgtggccttccttctagagagttaggacgactgagcagttgctaccttagtgctacttcctacagcaactggcacccttcgtgttcagatgatgtctgttacccaagtccaaatttgaagacactttgtgtggatggtgtttgaacatcctaaagatgtttagcatatatgaccccgtttttacatttatcgcaatccatggatacttgtacttgtttatcttgaaagtcctcgttccagctgtactaatgtatggccgcaaaaataaagggaagcgtattaggaaaagagtggaatacttatcttcctattcttgaaatgaaggataagcattgttctccaaagaaaaatgtatatcatacttgcttaacattacatttgtatgaagttaaggcatacaaccaagtaatctatcagtatgtatttatattattgaattgaataaaaaaaactcataggtcccaaagaagtaaatcaaaatctagagactccttaactatatcaatacatagccccctgttcttgcttgtagccccctccatctctatggaccctgacccgttcagattggtttggttatcccccccccatcccgtttaaattatggacccaggtggctttttttttcatgaatgggtaaatgtaatgtgatgtcgaatcggcc

SEQ ID NO: 10067 - DNA, 791 bp, Triticum aestivum
  unsure (1)..(791): unsure at all n locations
  Clone ID: PAT_TA_10067
ggctgctcgtagcgtgggctgtgggtaggcgaggcgaggcgagggggttcggccgtcggtgatggagagtaaggagagcggggagaggatggagaaggtggaggtgggcgacggcgggaagaagccggaggaggggaccaagcaggcggcggcgccggtgtgcgccaagaagccggcgggcgacgacgccgccatcctggagaccaccaagcactacttcaagcagctcgcggacacccgcgccgacacgcactgggactgcatccagaaccggttccgcgccgccggcgactacatctccaacaagaccggctcgctgtttggcaggcagaaggtggagcctgaggccaaggaggagaccccgggggcgaagccagaaggagcaccggcggcagctgagactcagtgaaggcttgtcctgagctcgtgatcgtcttccatgaaccaacctgaagcttcattcactgagagttgcgaggtcttatcagcctggagtttttcttttcgctttgtccttgtgttcgactagttggggcatggtttgcctgagcgatttcgcattgtaagagacccgttctagttgtggatcttaatccgccggttggtgccgccgtcaattgcggtccgttttggtgacatctgtttgtcctatcacctatgcttcattttgtcgaatggaatggaagatcatatgatcatgccgcccccnnaaattaantnannnnntttatattaattaaaattttaattaaatatttaattataattatataaattttataaatanttgg

SEQ ID NO: 10068 - DNA, 1285 bp, Triticum aestivum
  Clone ID: PAT_TA_10068
cgtccgctcaaacacgcgcgcctccacctcctcccatgagaggcgcgccatcctctccatggcctcctcctccctcctgcccccgcccaccttcgccaacaagcaccatgcgctgctccacccgcacggtgccaggcaccggctgatcaggtgcggtgccgcgcccaccgacggcggcgcgggggacgagctcctcaccggcgcgctgaacctgggcaggcccgacccggtggtggcgaccgtggtcagcgacacgggcaccgatggctggggtgaccttttcaccgagctcaagaggtcgctgcaagcggactcgtccgaccccgccgccagccaggcgacatccatggcggaccgggccttcccggcgaacccggagcggctcatgttcgggcgcgcgctgcggggcgtggccgcgctcacccgcgccgccctggtggtgaagcaggtgatgcggcagctcgtcacctcgctccgccgcatccacgacaccggcatcgtccaccgcgacatcaagccctccaacctcgtggtcacccgccggggccaggtcaagctcatcgacttcggcgccgccaccgacctgcgcattggcaagaactacgtgcccgaccgcaccctgctcgacccggactactgcccgcccgagctctacgtgctccccgaggagacccccacgccgcccgccgagcccatcgccgccatcctctccccgatcctctggcagctcaacagccccgacctcttcgacatgtactcagccgggatcgtgctcatgcagatggccacgccggcgctcaggtcgccctcgggcctcaagaacttcaactccgagctcaaggccgccggctacgacctcaacaggtggcgggagaccacgcgccggagacccgacctgcagatcctggacctcgactccggcagaggctgggacctggccaccaagctcatcgcgcagcgggagaagggacggctctccgccgccgccgcgctccggcacccctatttcctgctcggcggagatcgggccgccgccgtcctgtcaaagctgcagctcaccaaatagtaattgatatgtctggctacatagaacaagcgatcaaacccctgcatatagtttctatatagatgtccatcccataaattctgtcctgagtcctgacatgagtgagacgcaagatcaccaatggcattggcaattttgttgtacagtcatgattcatgagatctcaaggcatctggctggtgtcaatcaatcagtacatcgtttttccccgagttcccc

SEQ ID NO: 10069 - DNA, 1594 bp, Triticum aestivum
  Clone ID: PAT_TA_10069
cccacgcgtccggtcctcgcgaaccctgcccaaccactcgtcgcctccccttcctccccgagaacacgcggggccgcctccttctgcccgatccagatcgacacgcaagctctctcacctagctagcatcgccccctcctcccccgtcctcccccagccctagccatcctcccttccgccaccaccggctgctccggctactccaccgccgcctctgacgccatggcggatgccgacagcaacagcaacccgctgctcgccgacttcgacttcccgtccttcgaccgcgtcgagcccgcgcacgtctgccgcgggatccgcgcgctcctcacccgcctagtgttagggttctgctactcttctgcgcgaaaagccacccaagttctatatacgcccctcgatcgcgctgctcatcagctcatacatagcagacctgccgaccaaaaaccttctctcatcattttaaatcctcgcgtcgttgactcttgtgcatgatggcggagaccgaggcagcatctgcggccgcggcggcggcggcgggcacggcggaggaggggagcagcacctagacggtggtgctggtccgcgtgcacgagagcgaccacagccgccgcccgctcgcgggggccgagcgcgccgcggctgccgcgcgctggggtgggccgcccgtcgcgtcgtcgcgcccggccaaggcggccgtgccctctgtcgtcaccctggcaagcccccgcgccgccgggggtcatccttccggtacgcgcacactagcctgcctgcgtggggcgaggcgagcgtcgtccgggcgcggaggatgggcgtaggaggaagagggtggtgctggtggccgtggacgacagcgaccacagctaccgcgcgctcgagtgggccgtgcggcacgtgccggcgacggccggcgtacggcggccgcggccgagctcgtcgtcgtccacgccaagccgcccgcgtcctccgtccgtcaccttcggcagccctggccgccgccggggacgtggtgagggtggtggatgcgggacctgcggaaagagggccgaggacgtcgttgacagggcgcgacgcctctgcgtcgccaactcggtgcatggtctgatagaggtgatggaaggagaggcgaggtacgtgctctgcgacgccgtcgacaagcaccacgccgatctgctcgtcgtcggcagccatggctacggtgcaatcaagagggcatttctcgggagcgtgagcgactactgcgcccaccatgcgcactgctccgtcatgatagtcaagcagcccaagaccaagaaatgatcgcgtcattgtggcgccgatcctgttgtatctcttgtaaaatccgtagttttgtgtgcgtgcaagtgatgtcaaacaaatagtactatgtaaacagtgtcgcgaaaactgaaccaatacctcaaatccaagttgtatttcaacattaaaaaaaaaaaaaaatagcgcagtccaccctcacaaatcacctttgtggcctataacttctaatacgacctatcgccccaacggtcttcctctctaccgctactccctccactatcccgttcccccgtcattcgtaagcaaagcc

SEQ ID NO: 10070 - DNA, 612 bp, Triticum aestivum
  Clone ID: PAT_TA_10070
gagctttacatcctttcacaccctgttacactttctacgttccgttgctccgctcccacacccctcggctcgccctgtttctcgacccatcctgcccatgcttccgtgcctgaacctggacccggttcggggcggttccgacgggactagccctgccgccgacgcgtgcgcccgctcgcggtcctgggcccgggaggccgcccacgaagccaatcgggggccctccaccctgagcaacaacctggcggatcaaaaatatgtctgtgccacatcaaaaagttctgcgccttgtgattcaacgcgatagctcacggtcgccacgttgttttctttacagacatgatgccctccttgtccttcctgaaggtcatcacgatctcccagtgcagcgacttcaggatcgcctccaacgggtcgagaatctcgagtttctcccggatgatggcccagcctccgggtctcaggatccggtccatctcgaccaagatcgagacaggttccttgcatctgttcttcaagcgtgagaacaaatggtcggcgtgatgaacaccgtccggcccgcgctcgaagattacaggtagggtgtctggggcatgcacggggacaacattc

SEQ ID NO: 10071 - DNA, 839 bp, Triticum aestivum
  unsure (1)..(839): unsure at all n locations
  Clone ID: PAT_TA_10071
cattagttcntacatatagatcaacaaagtccaccgcccgcccgcgctggtaccatccacaaaaggaccttccaactacaacaatactagcaaaatacgccggcttgcaactaccaccagatgttagttctcattcctaaaccatactggatacacaagtccacaaaagagcgtatgaagaccacctacagtctgatgttatcatgttgtttgagcaatcagtttccgccatggttggctgctgcgtcaacgatctgatcaccgacattcccagtggtgtcgttctcctcgctcgactccatgacatcattgttgccatcaactgcttgtgagccggcttgagacgagttatttgtcccttctggttgcgaaacagctccatggcttagtatatgtagtatatgcgctggcaactcttttcctatctccttgaaaagtgcagttatgagctgcccatgcatatctactttctgctgtagcatctccttagcacccctgagttctgcattttcttcattagcacgcctgagttgttccttctctcgaagtgtgagcgaaattggtgcactggcattccttttcctagctgctgatttaatatcttctttcttaacaaccccatcgcctattgacacacgaccatgaggaatgccacctgatgcttcatacaacagctcaccgtccaactctcttccctcccaattatctggatacttctctttgaccaatgtagtatagtcatcaatgcgtttttgtgccttctggctcatgattgcaccattgctaatgattgcaccattgttgccgctgctactcacacctcggccgcgaccacgcta

SEQ ID NO: 10072 - DNA, 696 bp, Triticum aestivum
  Clone ID: PAT_TA_10072
ccccgcgcccgcccgcggccccggtccccttcccccgctggcggccccggccaactgctccaggcgcgcgttgatatagctatgtactcactgccccgcgctaaggccagggtcgacagggccaagcgccgcctcgctgaccccgacgaggaccccgaggcagaggccgcccttgttgtcaagcaggcgggggacttcgtgcttgagtgcagcgagattggagatgaccgcccgctcaccggctgctccttctcccgcgatgcctcaatgctcgccacaagctcctggagcgggatcctcaaagtatggagcatgccacagataactaaaattgcaaccctgaaaggtcatacagaacgtgcaactgatgttgccttctctccagttccgaactccttagcgacagcctcagctgataaaactgccaaattatggaacagtgatgggtcactcctaatgtcttttgatggccacctggatcgtcttgctcgcgttgcttttcatccatctggaaagtacccttggtacagctagctttgacaagacctggagattgtgggacatcaatactggaactgaacttctactccaagagggacatagcaggaagtgtatatggtgttagctttcatccagatggttctttagctgcatcttgtgggcttgatgcgaatgctcgagtttgggatctaaggt

SEQ ID NO: 10073 - DNA, 666 bp, Triticum aestivum
  unsure (1)..(666): unsure at all n locations
  Clone ID: PAT_TA_10073
gaacccaccccttcgcgcgcagacgcggcggaagatcgaatcggccgcgcacggcgatggcgacgactccaccgccgccgccgcttcctctcctcctccttcccctcctcctgctcgcggccttctccgccgccgaggagtttccgcgcgacgggaaggtgatagacctggacgacagcaacttcgaggcggccctcagctccatcgatttcctcttcgtcgacttctacgcgccatggtgcggccactgcaagcgcctcgcccccgagttagatgaagctgcaccggtgttggtgggattgagtgagcccatcatggttgccaaagtaaatgccgacaagtacaggaagcttggatcaaaatatggagtggatgggttccctactctaatgctctttatacatggggtccctattgaatacactggttcaaggaaagctgacttgcttgtccgcaatcttaagaagtttgttgcgcctgatgtttctactcttgagtcggattctgcaatcaagagctttgttgagaatgccggcacaagctttccgatgttcatcggttttggngtcaacgagtcattgattgctgaatatggaggaaaatacaagaaaagagcatgggttgccgtcgcaaaagatttttctgaggactggatggcgacatatg

SEQ ID NO: 10074 - DNA, 1724 bp, Triticum aestivum
  Clone ID: PAT_TA_10074
ccacccccccccttcccgggccgacgctcgatccgatcgcacgcgccgggcactgcctcggcgccgcctcccccgccccctccccttcctctcctcctccttcccgccctcccccccgccgaggtcgtctccgcccgacgggtaaggtgataggcgtggcaggaaggcgacgaagacggccaactgcagctccgacgcggccctcttcatcgacttttacccgccaggccactgccacggcaagtgcgtcgccctcgcctcacgcgtcgcttccacgctgttggcagcatgaactcgtgatagcgtgattgggtgatggtagctctgctccgtaccgaaatgtagactactagcggagactagaatcaacctatacggttgcttgctttattactgtttttcccattaaacacaggggatcaaccaaatgtactgtctcggggcttgcttttccgccttttcacgaatcttatgcctctagttgcgagtgttgtttcgtcgcttgtggcgttcttcagcattccggcacaagctttcagatgctccacgttctctgtccgcttttctttcagttattgagggattgggaaatatcgaccatataaaaataggagcacatcctcaagaagacgatcgtgtggatttgttcgtcgcaaatcaatttctctggttagacggggtttcgcaacctgctgaactttattacgaccgaactgatacatgtattaataatgtgcgaattgtgctcgagccgaatctatggcccatttgaaggacgtttcttggacccttctgcaccgcgacccctgctgcctttgactgtccccatcaacaccgagacactgaaattgctggatgatgatgacagaaaagttgtcctcgcaattttggaggatgactcggatgtaaattctacccacctggtaaaagttttgaggtctgctgctcatgcgaaccgtgatttggtgtttggatatgttggagtcaaacaatgggaggagtttgtggagacttttgatgtttccaagagctcacaattgccaaagctgctagtgtgggacagaaatgaagagtatcgactagtggagggttcagaaaagttagaagaaggcgaccaatcatcccaattaagccaattcctcgagggatatagagcagggagaacaataaagaagaaagtcagtgggccttccttcatgggtttcatgcactctcttgtcagcatgaactcgttatacattctcatgtttgttgttgctcttctcggtgtcatgatgtactttgctggccaagatgatactcctcagccaagacgggttcatgacgagtgatagcttcttgcatgaaaagaaggttatcaacaaggagttctagcccggaggtcgtattgccacctttgaactgttgttagccctgaagaggtcaggttttagtggttgcttgtgatgttcgccgtttctctgtcagcaatcatcaggtcctgcattttctctgcccccgtttctgtttgttggttagagcttagcaactagcccccatgtaaagctagaaacacttcctaattttgccacttgtgtggacatgtttttatttattttattgcaagggttatatggtgtatcatactctgccaaacttttgtacaactccgggcggacaagtattaataatgtgtgaattgtgaaaaaaaaaaaaaataaaaaaaaaaaaaaaaaaggccccta

SEQ ID NO: 10075 - DNA, 356 bp, Triticum aestivum
  unsure (1)..(356): unsure at all n locations
  Clone ID: PAT_TA_10075
tttttttttttttttggcaattccaacgatcaattcattcataagctactaattttacatgttcggatgtgatcttgcccttgtacaaacatgttgttgcagcaaagnagatatagaattcctatatattacagtacagacaaaacccaatctgtttgatcatctgatccaagaggcatctgcctgatcatctcatcgagatcgatcgatccaagaacaaaatactgacagcatcaacaggacttactactttaccggcgcacgcacgcacgcatcatggaaggattgctactatcggtggcatgggcatggcgtcacaggctgaggaagcctctgccctggcgcgccggcgccgg

SEQ ID NO: 10076 - DNA, 530 bp, Triticum aestivum
  Clone ID: PAT_TA_10076
tttttttactgaatatttctttacattaaaagcaatttaaaaagatagttatgctcctcgcttacactgaggcctacgcattttattctgagattcatgtctcctacacatacataaactcatagatagggacttctcactcgtccgaattatcttcctgtggtgattattacacagtaatatataggcctaattttgtcttcagtgttcagtggtaagcactaagcagcactgaatttgttggatggttttcagaaactcatgatgttttcctgctgcagcatacagtaattcatcgctgcggtaatcctgtcgagtgggctcatctatcttcataccccagtcttacactcatcagtttatacacattacttggcaactctttcgggggcacacgtcatctgacaacccttcatttgatgggttatatccgatgataacatttgcagagaacaactgggaacccacaattgggaagtggatctgctgctcttgaaagatgatatacctcttacaattttacaccttct

SEQ ID NO: 10077 - DNA, 628 bp, Triticum aestivum
  Clone ID: PAT_TA_10077
cccagcgtccgcccacgcgtccgataatatggagtcaagatccaccttacacaaagttggtactgatatggtatctgaatcagaagatcgtccgcgagaggaagaaatcattaaatcaagtatatctgttggaaccagcagatcaaaaatatcttttgaaagtgctgaaaaacatactacactgccttctggggatgcttctgaaactgaaaatgtatccactgatatgcttctaagaagtttagggaagcgcaaggttttaaaaggaccaaggtctagtgatgatttcccttataaaaagccaaggatgcttgcttcagatattccttttgcaagccatatattaaataagcattctacttcggagattggtgacacaagaccagatatcagagaatttggaggcaatcaactagatgaccccaataagaaaacttctaataaagatagttgcggtggaagcccaactagtactactgaggatgcagcaagaaatactaataaagaatcttcagcaaataatttgttcagttccagcagggagcacactctttctcattggagtaccctagagaggggattatatctgaagggaatagagatatttgggaaaaaaagctggctaata

SEQ ID NO: 10078 - DNA, 1055 bp, Triticum aestivum
  unsure (1)..(1055): unsure at all n locations
  Clone ID: PAT_TA_10078
agattgattggttcggtctttgtccggtgggatttgcctcaatcttacaaaattgctgactagttgagtcagattaattggttcggtccttttcccatggattggcctgcctagcctatttttactagaagtaatcaaatgagtgaaccttacaatttgtcccacccaaatcactgattacattctacatgaattaaatatgaaacaaggcacaaccaatttgagtagtagaaatcacgagccccgcacgggatttagggcagaagatggtgtcctagttaaaaaagcattgcgcgccgccgcaagccaaccgtgcgacgatactcaccaatgtgattgatgacccatgccaggaagtctngatgaatatgaggattaggtggtacacccgaaaaatcatgcagcagtccgagcagatagcatgactggcttgtgcttcatcaggcgcctgtctcgcctttgtaagtgcgtgcaggaggtccagatatgtacatgtcatcacgcaaccaccatcaggtatcatcaggcagagctgaacattgtgctctttgggaatttttatcccgcacttccctgctctcctgagtgcagcgccatcaccttgtcaatatggctgaggaagctcctacagcgagggctttgactcatcctctgaccccctctgtgcaggtgtttgtctgcagggggcaaactgaagggaaccgcagactggtgtcacaaaagcagaccagggtaccgttctgatcttcagactgtctgcagaatcgcacaatcctagggacagccgctcctggtggaggcgcttgatttctctgaactttttttaaatggtgccagtgaaatcaatattccaaaagctggtggcagaatttgtgagaagatagctgcaacttatgttgcctcctggcggaacatatattgtttagcaggactggacccccatagtttcaggaagcttccgctttaatccacgaatgcagaaagaatctcacggtagaagaattacatttcccgcaccctgtagaagagctacaccattagctaatataggtgct

SEQ ID NO: 10079 - DNA, 1070 bp, Triticum aestivum
  Clone ID: PAT_TA_10079
gctgcaatggaggccacgagagcataaccgtccgctccagtgcaacttgatggactgaactgaaggtaagaggaggatgattggaagtgcacttcctcgccaagttcctgatattcactcgtgggacggagatgaggagcaggtcctgtgcacaatctatgccaataattgtagctgcgccatactgcctttcactatgtctcctttgcccaggttcactgaaactagcctcatagtgatcgcaaagtacatctgtatagaaatacgtattggcgtcgcgaacggaaatgggctttgaaactgtgaagacatgctcaatgagatgggcacttgataggatggtgatttcatcttctgtaactcccacaacagagccagtgccacattgtccctgtttcagcacctcttctcttttcttcactggaacagttttcaccgcagccataagattttccaaatcctctttgtagttcaagttgggaaagacattcacaaaaaagatggaatcttttatctgctcaacgatccacttctccaaatgagccgagaaggcattgggtgcagcagccatcgcctcgtatcagacaaccacaactgcctccgtgctgactaagaaaggaggtgacagtgatcgtaaacgcgaagattgtaggagatgggattacagaaggtagatggcgatgagcaacaactgcaccccttggcagccaatcgcttgttcctgttgcgcagccaggagcaggggccctggtcgtcgccaccaccctggtcgctactgcaatccacaccgtggcaaaaacgcaagaaggcgtcggcccctctcgtttctccctcgattgctcgcagtgccacctccgccaaacccttgacgcggagcaggggctgcacgccggtaccgcgccgcctccttgtacgctcttcagtcgccgctcttgtgcacggtgcggggccgccgctccggtgtccacgggcacgccgcgccccgcagccgctaccgagtgcacgggcccgccgcgccccccggccgcccccgtcccgggttcggtgtctcgcactcgccggacgcgtgg

SEQ ID NO: 10080 - DNA, 706 bp, Triticum aestivum
  unsure (1)..(706): unsure at all n locations
  Clone ID: PAT_TA_10080
aaaagtttcntnccccatgcacagtgtttgcatgacatccagtaggcctctaagctatagagcctactttcttactgagaaactggcctgctcattcatcaggaataatccccagaacaacactctagtggtgtttactaatggagctcatatagttgccacttccgatgtcgactaaaattagtaatggcatcagagctgcacgagctaatgaatgctaactaaatcagtagtaataccctagtagagcattgtccagttttttaacccgatagtactgacatgatgaacttgcttccctgaagtagcgtcgggcatctgcagaccattcaccgatcaccacgtacgcttgcacttgctgcaacgatggttgcccttcgccatcgcagagccgcagaggtagcagaagtggtggccgcacctgcagaccctgggcacccagccctcctccccctcgacgtgcatcttgcccttggcgcaccgccgcccctgcctctcctgcccgaccctccgcgcccccgcggcctcccgcccccccgcctccctcccgcgccgcgggcacccggcgctggccgcgccccccccgcctccgctcctgcccctccgccctcagcagccgggccgcccgcccgcccccgtccttgccgagccgctggaactcggcgcagtcgacgccgtcgtgccacggcaccttgcaccctcgtgc

SEQ ID NO: 10081 - DNA, 704 bp, Triticum aestivum
  Clone ID: PAT_TA_10081
tttttttttttttttttttatcaacatttcctttattgttatttccaccagctctttacagtaatgaagtatgatgtccaaacaatcatatcacaggatttaggtacatcggtaaccaaggggcagttgtagaggggctcccgtttgtacggaacaagattcttctcaattctgagcagcaccaattgaagttgtaacaatcaattccctctaccagtccttttggaaagaagaaataataggctatgcacagagactaccgtatcaggactcaggagctgcagctacctacaacgcagcacaccgtgaacttgcactggcaacaaaattggccagcgccgcagaaggttaccagtaatttctgcgacagccggccccttccttgtttcacgtgttatggtttgaaacatatccatcctgcacatggttaaatcgtcaattcttcactgcccagcggcggccccttatctcgtagccatcaggcgtcttatcaccacctccccaactatccgcggtagcaactgtgctgacaactctacgttgctttttgcccttcaagaccccgctgtcacttgtgctcccgcttaatagcggatcatcgatgccacgaaccggtctctctggcgatgctgcactcacccagttgtcatcctgggtgttctatacttgtctttctttttcagcagtttatcaaaccgcttctc

SEQ ID NO: 10082 - DNA, 1131 bp, Triticum aestivum
  unsure (1)..(1131): unsure at all n locations
  Clone ID: PAT_TA_10082
gaatcngggggctcccgttccgcccgttgccatgataatatagagcttgtgtccggagcatttctaattgatagtggtcaattacatcatatactccctccgtccgaaaaagcttgtcccaacacggatgcatcaaaggcatatttctgtgtaatcaaaagatggatgaaagtttttcatgttgttcacaagtcccttggcttcactcgtccaatggtcattggtgtgggtgttgtatgaaacaatgccccttgcatctgtttgtccatgcacccttttcggaagaaaacctgatccaagtcgtcaaggtactggcgaatgaaatcattggggtattggaaaaaaagtggtattctcagcaaaaagcattcctcgaagtgagatatatttggtcaactacttgcaagattccaccttataccttctcttatacgtcctttcaatttatttgcttcggatcctggcgtttaccgcctctgctatggcagctgcccacaacgctgatccgccccgagtgttattcccctgcatccccggccgctttcaccctcccccgggttgccctgaacaccttatcaacgattataccgcttcaagaaaatatcggtgacgctccccttcaaatgttgcttggtagtcgctttcttttagaatttccttcattgaccagcttatcccttgtacatgaccttgcgcttcgccggtcctgcagaataacagcgtgcaatgaatgaataggaagattgatcttagatcactaagttgcgtgtttccatggagcagccgctgcttccctttgagccaccatagccactgtttgcacatgtgcaggttgcctctgtcaacaactcttattatccgcaccttcctagttctgggaagaaacagcaacttccatttccaaaagaaagatatatacgtctgaagctgctgataatggaagctgactatcaataatggtgtcagattgctcttgctttcattctactgatgtcctctatagtacctcgaccaccgagcaagtttggaaatggccaatatttgtttttcttgtgaaacattctttgagatccccacattctaatttccacgaatcattcaggnatctccgaccctcgtgccgaattcctc

SEQ ID NO: 10083 - DNA, 657 bp, Triticum aestivum
  unsure (1)..(657): unsure at all n locations
  Clone ID: PAT_TA_10083
cgtccgctcgaaactgcccccaatccaactccagcgcctcccagccctcgccgccatggcgaccaccgacgaccccaccgccaccggcgaggtccggcgcctcctcgagcatctcgactcccagcagcaactcctagccacctgccacgaagcctggtcgcgcacgctcgcgcacttcgcctcgctcgatcaggacgtcgcctcccgctccgcctccgtggacgaagccctggccgccgccgacgcgtccacctccgaatccctcgcggcgctcgaggcacgcgaggcctccgtgcccgtgcgcctcaccgaggcctccgacgcgctctcggccgccctcgccgaggccgaggccgaatccgccgcgccgccgcccgccgacatccatggcgccctcaagtggatatgccgccgcatggacgctgccgcgctctggcgctttatggccgcgcgccgcaaggagctcgccaccgttcgtaannagatcgcccccaccgtagcagcgtccgtggacccaccccgcctcgtcctcgatgtgctcagcgatttcctggaggccggtgaaagcgccggtgaagaccagtgctgggtgctcggcatgctgctgcgctcgttgtttggttcnnnnnggcggaagccgccgganataggagntac

SEQ ID NO: 10084 - DNA, 1240 bp, Triticum aestivum
  Clone ID: PAT_TA_10084
cgcgggccgttcgccacgcgggccaggccggatctgctttccttttcctccccctccccgtctccctccgacccccggcgcgaaaccctagtgcccgagaggcccttgttttcttctcctcttccccccgccccccaccgaccccgtggcgagcccctaggcaggccccaagttcgggttcccggaggccgcggacctccgcctcgaggccggccgctcggccgccgtcttccccggggtgaaggaggacgtggaggtgcgccggggcttccttcgccagaactacctcctcctttcgcgccaagctcgccatgaccgccgccgtcgccgggttcgttcgtcaagggtccccgccgctccccgtaagttgttcgctcccctgcaacgctggccctggaccctctcacaccttctcctcccgctctgcccctcatcgtgctctgcccccctcgccactagaaccaccacgaccccgtcatcctgaccctgccctcttgcaacgtcgtcttcatactcctccggtggggcttaacttgcgccttcaccagcgggaaaatcaacttgggagctgtgattttcacagcagtggggttgttcagcttttggacctcctattggtgctgggggtgtagagactttccttgcatcttcctgcccccgttcgtgtttggtgctctcatggtattgctgggtgttctcacttacccatcatcttcttctcactagggcaagatctccacacatgatatatggggccgtggggccgcatcaacttactgtggctacatcatcttcggacacggacaacatcataaagcgccacacgtatgatgagtacatatggggactcccgtgtccctctatcgcgacatccaccacctgcctgctgaatctggatgcaattcctgcgggcggctgatagctagagctcacctttgcccgccatcaccttgagttaaaggccactagcttgtgcatattcagcaatattcatgaatgcccgcaggatacctgtaggcatgtacaatcgattttgcgtaaattctgccgtcctagactccatcacatgtcttgtttcctagcttcctggagtatgcaatgtgtgattgaaccaagctgcacgatgaaaatatactcactggtgctttgtgattgcaaggcacgtgaatttaattccctgctacgaaatgatccattttaaaaaaaaaaaaagccggaggggggcacgaatgcaaaaaaa

SEQ ID NO: 10085 - DNA, 1259 bp, Triticum aestivum
  unsure (1)..(1259): unsure at all n locations
  Clone ID: PAT_TA_10085
cgtccgcctcggcctatctacccgtgtccgtccctgactgtatagcctgtaggtggttgatctggaaaccggctcttgatcggacggacggtgtangtccacaccttgctcccgagtccctgaccaatatatgcctcccagcggccccagtctccccctaccgtggccgactcccgactcaggcggtcgccgaatcctcttcgccggcgccgtcgaagaagcgcccgagattcctttccagccgcgccgcggcgcgccgcccaccactgccctagcgtggagtggagcggacaggagacccgtccaggcaaatattgtccagatgagttcgaagaaggttccgttcaatcggcataaggagaacgaggaggcaaggaagaagagggaggaagatgaagcggcgcgtgtgtacgcggagtttgtcaagtcattcgagggtgaaagcgcatctgggtcaaagtttgtccgagggggtgttatcgaccccaatgccaagctgagagctgattctgaaggtggaaattccaaagatagggggtctgttccaaagaagggcagtaggtatgttccatcttttgtgccaccctcatttgggagagaaccagagaaaaagaaggaagatgagcggccaaaggaaaaggaaaaaggaaagccacgggcaatagacactgtcatggtgcggctcgagctggagaaagagcttcgagaaaggcgtaatcaagaacgtgccagtcgacatggtgacacctccatgccctctagccgttttgatgaactaccagatgaatttgatcccactgggagactgccaggatcatttgatgacggggatccgcaaaccacaaacttatatgttggcaatctctctcctcaggtggatgagaattttcttctgcggacatttggtcggtttggacctatcgctagcgtcaagatcatgtggcctcgaacagaagaagaacgcagaaggcaaaggcattgtggctttgttgcattcatgaatagagcagaaggacaggcagccaaggatgaaatgcaaggtgttgttgtgtacgactatgagctgaagattgggtggggcaaatctgttgctcttccatcacaagcactgcctgctcctcctccaggacatatggcaatcagaaacaaggagggtggtactgtaatcatatctggtcctggaggtccacctgttgcatcggttgcacaacaaacctcagagctggtccttactccaaatgttcctgatatagtagttg

SEQ ID NO: 10086 - DNA, 643 bp, Triticum aestivum
  Clone ID: PAT_TA_10086
ctctttcgttgctcggttaatatcgtagtacgtactgtttacatgaaaatgaccgacttctcttgacaagcacactggttgatgctcgctttatcatctctacggcaggaacgaatgcgtgcctactgtacagtgtcggcccctccccctacagtacaaatcacactatttctggagggttatttacctcatctccctaccgctactacatcctacagggtgccacgccgcagcctcctcagctgtctgaggcgggtccgggcgcgctcgaggctggcttcgtgctgcgacaggccatgccagggctcctccgcctcgctcctcccgctcggcgctcccagccttgccaactgtcggcggagggacgccacgttcacgatgggcacggtggtcggacgcccgtgagcgcactggaagcacaaggacgtcgctttgagctcttcaatgatcagagagcactcggacggtagcaagggatcgccaaacatgattgcccctctgcaagctttgtaattaagaatacggagaactgctgcggggatagacgaggacccgtcactctcatcaagctgctgaataaaagtccgtaagatctttttcctgtcaaatcaacacccaaaatacagggaacagcagcaagagt

SEQ ID NO: 10087 - DNA, 435 bp, Triticum aestivum
  Clone ID: PAT_TA_10087
cgtcgggtcgcttcccgctgccggcgtcggcgtcgccgtcggtcgcgtctccggccgcagccgcaggccccgccgcctccgacctcctctccggcgagctcggcgactccctcgacgcggaatccgacgctcctcccgcttccgcacgcccgcaggtgcagagatacctcgtcattggtgtccacaatgtcgcggacaacttgcaactgccccaagtgtttccaaggcacttgtgactgtttaataaggaatgcgttatgctgttcgggatgcaactgcggtggtgactgccagaaagacttatctcttggaacaatcaacccggctgctgcccaaggtaccaccccaacgcttgcctctggctcttctgctgcccaagatacttctcaaacacaaccgcttgcaccgagctcttctactgcccaaggtatactc

SEQ ID NO: 10088 - DNA, 1814 bp, Triticum aestivum
  Clone ID: PAT_TA_10088
tcgacccgccggctcgctcgcacgcacaccgtcgcacggacacgcaccaccgaccgaccccggcgggccgattcgctctccctcgcctcgcctggtcatggagaaggcgctcgtcgagcggctcgaggctgaggtggctcgcctcgaggccgtcacctcgtccgggggatgggcagcgcgcgacctcgggggcgcctgctcgaggtcggattcggcgagccggccctaggacgacttcttcgccgaggcctcaaggcggttgtagccgcggtcgagggttgactaggggggccgcttctcggggcgacgcccgtgctcacggacggctacgacctcgccgacgaccccgtcggctgtcccaataaccttgcacaaacagtcactggggccatccctcacttcggctacatgccgcgaaatgaatttattggttccgagcgccgagtctgatggcgacggggtggcgcatccattgcccgcagcaagaacctcgatcactacctcgatgccctggccggcactacagccctagggaaagccggcgccttgagtatcccgacggcacatgttgatgtaatgtggcaggtggccgagttctataataacaagtgttcttgttgagtacaagaacaaagacgctgaccacgttgagtgggctaaagctttgaaggagctctacatgcctggcttgagggattatattaagaaatattatcctcttgggcctgtgtggggtcctgctggatgtgcaccaccaaaggctgctgctccaacatcaaaagccccagcggctaagggtcctcctccacctgctgcaccatcagctcctctttttagcacagacaaatctccaaaatcttcgcagcctaagcaaggaatgtcagctgtgtttcaagagatcggtgggggcaaagatgtgacttcagggctgcgaaaggttactgatgacatgaaggctaaaaaccgtgctgatagaagtggtgttgtgaccagtagtgctgctgcccctgctcctgcgaagacttctcgtgcaggaacctttgcctccaagactggaacaccaaaactggagcttcagatgggtcgcaaatgggtggtcgaaaatcaagttggtagaaaggaccttgctattgatgagtgtgattctaaacagtctatctatatttatggatgcaaggattccgtccttcaagtaaatggtaaagtaaacaatatcaccgtcgacaaatgcaccaaatttggaattgttttcaaggatgtcgtagcagcttttgaggttgtcaactgcaacggcgttgaggtgcaatgtcagggcaccgcaccgacaatatcaatcgacaacacagctgggtgtcagttatacttgaacaaagagtcactgggcgcttccattacttcggctaaatccagtgaaatgaatgtattggttcctagcgacgagactgatggcgactgggtggagcatcctttgccgcagcagtacatccattttttccaggacgggcagttcaccacatccccagtttctcattccggcgcataaataaatccgatgatatcttctttttttgtgtgtggctgttcgtttgttcgatgctgcctttgccttgtttttttttctaagatggtggtatgctgagagttgttgtagctcttgttcggttgttgacttcttctgaagccgtaggttctgcctgcagattgttgtttctcttgccattcatttgaccagtgtgtagggcctggcctgtatgttttccttgcacttgcttggtattctttgttatttgtacccccccgggccgccgcccgaa

SEQ ID NO: 10089 - DNA, 839 bp, Triticum aestivum
  unsure (1)..(839): unsure at all n locations
  Clone ID: PAT_TA_10089
nggtgtttttttttttttttagtgtaacagccccaagaaattaaataccaagtaagcagtctgtttacatctggctgcagcctgcagccttaattggtacagaataaagcatgcatataataagttaacaacacacgcacacacgcctcacattacgtagtagtttgggcagttacactggatttccgctacattcgctaatctcacgatctctagcgtggctatcttacacgccctcgtttgggccaacaaatatatgtacaaatgaaagaatattgtacaagtcagcccccaagaaggcccaccggcagcggtcagtgactcgggcattgcaactggctgagccttgcgttgagagcttcaatgtatgagcgcagtcggtgtcggtcagatctagtcagggacaaaggcgggttgagggcgagcgatggtgcctcgatcaggagaaaacgcagcaagcatattgcctttgtataccgcgacatggccactgctgctttccccatcatctcgacaacaccaccatgccttccatattctagtgcatattgaaatattaattcaaccgcgtcgggcatcgctgtagcatcaggtatctgccctacagtgcttgcaagttcttcagcatgttcaacttcagtgagaaactgcctctcaatctgtgtgcattcttcatcagccatttgagagtttgcaagcaaatggggagcgtcagtatcaagccccttcatagtgatatcatgcgagggactctctctggcagctgaagccgcataggaattgcatatgtgaattgcttgcttccaggtcgcaagaataattagctggatcgagaatgc

SEQ ID NO: 10090 - DNA, 1141 bp, Triticum aestivum
  Clone ID: PAT_TA_10090
aaccccggcgcttccctgtgagctcgtgcgtctcgcagtcgtcgtgtggtagtcgcttcgcccgccttgcttcccccggctggactccttcctccgcgtccgcctccccagatccggtccctatggcgaggaatccgggctgcgccgtctacataggtaacttggatgaaaaggtctcggagagggttttgtatgagattcttattcaggtaggtcgtgtagtagacttgcacataccccgtgacaaggaaactagtcgacccaaaggttttgcttttgctgagtatgaaacagaggagattgcccagtatgctgttaggctgttttctggccttgttcggcttcacaatagaacacttaaatttgcgatctctgggcaagacaaggcctcttcaaatgtcaatgttcctgtaacacctaaaatgaaccctataccactatcaaatccacctcaaccaatgagatttggtgatactcctgtgtcacaacatagagtgataaacggtaggattgcaggccatggtgtttctccaaatcattcttatgatttccattcccaagcatcaagtggggtagcaagtagaggattaaacgatggtacatatgagtatagtagacgtgtatttggttctgttatgaatgatgttagccgtcgagctgaccagacaaccagttccatacccgtcctactagcatactaagctccaatgaatgaaacatcggccagtgcagccattgttgtctcagcccttccgtagtgtcatctgggtacttgccattacatgcatgtaaatatggctgatggtagtgcatgtgcgtatctgtctggttgttctgttgttttcttcatcgtagggaggcctgtcactgatggttaggttccatgccttatcttcctgataggatattgcctccactaatgtcgctgtagtacttctcctagtcatagggatggggttgcagtattctcagttcaaaaaatgtgaactattatgttatttgttgtttctcatgtcagttggatctgtattatgttgggacctaaaaaggtaaagaaacccaagaaatctgccatggacccttcaacttttctataattgttggttcgataaaaaaaaaaaaaaaaaagccccttatgaaa

SEQ ID NO: 10091 - DNA, 1355 bp, Triticum aestivum
  Clone ID: PAT_TA_10091
gggcacgaggcagcgagagagagagagacagagagagagagggcgaggaggaggcgcgggggagcaggcgagcagagcagagatggaggcgttcaggaagcaggcgagcaagttcaaggagcaggtcgccaagcagcagcaggctgtgataaaacaattcagcactactggttacgagcgttcagattctgttgtcattgatgaagttgaattacagcaacatcaaaggcttgagaaattgtacagttctactcgttctggaagggatttccaaaaggacatagttcgagcagctgaaggcttggtgtctattggaagcaagcatattgaagtgggaacaaaattttctgaggattgctatagatatggaggtgaaaataatgctgatggtgaagctcttacaaaagccgcatcactgtatggaggtgctttgagaaatgttgaaaaagagtatgaagatttcaatagaactttatgttctcagatcatagatccattgaaggcgatggctgtgtgcgctcccctggaagaagctcgcggttttgcacaacgttatagccggatgagacatgaagctgagatactctctgctgaaattgctagaaggaaggcacgggtaagagaatctccagttgctgagcacactacaaaacttgagcaatctgaaggtaaaatgatagagcacaaagcaagcatggctgtgttgggaaaagaggctgttgctgcacttggtgctgttgaatctcagcaaaagagggtaactcttcagcgcctggttggcatggtagaagcagagaagttgttctatttgaggttagctgccatacttgatgatgttgaagctgagatgtcatctgagaagcaaaagagagagtctgcacctccttcccgtaagcgtgccgagatggcccagtacttcatcgccgaggcagtgcataacttcaatggtaccacagagaaggaactgagcttaattgttggtgattatgttgttgttcgtcagattgctccaaacggttgggcggaaggggaatgcagagcgaaggcagggtggtttccggctgcctatgtcgagaggcgcgagaatatccccccgaataaagtcttcccgcaggcatagtttggcgccttagtttctaatgcttctagctgtcatgtagattcgtgctgctttctgtgcaataacttggttatttgtttgttgtatatcatcttgcacctcccacgagtggttcagaacatgccagttgcaatgtgagctgcttccttcccagtgtaaattattttgctagtatgctactgtactttattgattggttttgcttcaaaaaaaagtcgacgcggccgcgaattcg

SEQ ID NO: 10092 - DNA, 751 bp, Triticum aestivum
  Clone ID: PAT_TA_10092
ttttttttttttttttttttttggcgaaatcggaaccaaacattcagcaaaactagggcacccctcaggggagggggacctcctgcatcctctacagctagcacttgcagagcaacggagcccatccacaaagatcactacacatggcatgtagtagcattcagcaaaaactagggcactcgatcgggaaggagatgtagagcagcaaaatcctctacagccagcacttgctgagcaaagaggcgacatcaggtacattgacaccaattaagttccttcttaacacatgcggcgggcgacgactgacgctaaacagttcagctcagtgtgaaagtcacttaccattagacattcctagctgtggggagcagcagcccctcccttcccttcaggggtgatagatgtcgttgacgaccgatcaagtgaagcgaaccccggcactgcatactagcaatgagaagagcgcactcggaagatgtcagataacaacaacatacactgaagcaaggaaagctggagctacttctggaaagagggcctgcccatcttcttcctcttgcggatatccaagaccatttgcccggctggcgcatttgcctggaaaggatcagagcacatgtcgctccaatatccaaaaatacactgcggggtgaccagctcagatgttgcagcactgattgccttggagaggccaaaggaatcataaactggaacgtaagccttcaggatgtgtagcatcgtgccttctctc

SEQ ID NO: 10093 - DNA, 1106 bp, Triticum aestivum
  unsure (1)..(1106): unsure at all n locations
  Clone ID: PAT_TA_10093
cgtccgcccacgcgtncgcggacgcgtggggtgattccggnggctctgttggaggatcagctttggttcagaggcaggttttgggcataccgcagcacaagcagaggcatatctcagtcgatgctactgcagttgatgatgccctgaagctttcttcagtaactgattcagcgtgctgctgttctctaaggtcgttgagtgctgagaacaggcaatataattaggcttttaacgagaagttggaggagataaaaactttcaggaagtgtttaggcgagttccatgccgaaaataatgttatgtgagcagagagtgcaggcttgtgctcttctgttgaagagcttgagcatgagagattgaatcaacacataagtcatgagagcatatctttanacgaggagaggcgactgggcaaagaaattaagacccttgaaaaaaccagagcgagggggcagttccaaggctgctaagcaagctaaaatgcaagatataggggggtgagagagatgccatacaggatcaggtgaacatcatcatacatggagtaaaggagggagaagcagccatgtctaagattaaggtcctggacgatgaggcgatgggcgtggagagctgctacaagctcgcgcaggcggcatacgtcaacctcgcgctgcacacactcaagcacctggcgctcgtcgtcaatgggctcctcgtccatgattagctggacaacatgaacctcgaggaggttgtgaaggggaacatctgtgacgccgttctttaggtctttgggagtttgctagcagtcctggtcagacttggaccagggactagcgtcctggatgccttggcatgctcggctccaccggtgttgcaagcccagttcatttcaggatcatcaagcttcccgtgtacatctaccacccaagtcatgtgaacgagccgatgaagatactcaacattatttgcttcagctacttccttcgtaactacaagatacttaagatggaggcctgctcgtggatgctccactggtttactgcagtttcaagggcttagggagcgcctccttgttgacaacctcttccttgccaagcttgtcatggagtggcgtcgtcgag

SEQ ID NO: 10094 - DNA, 2438 bp, Triticum aestivum
  Clone ID: PAT_TA_10094
cgtgcgcggacgcgtgggcggacgcgtgggcctaaggaggttgatgtagcaaacttaaaacccatcacgcgacaggaggaaatcgagatgaaaacaccccattccccacccctcccaaatcccatccagatttggccgctccaccgccgctgccccgccgccagatcggagcggggccccggtccgatcccgctccgccctccccagggacatgggaatggaggtcgtcggagctgaagctgcaccagcacaggttaaagtagctgatgaggaagtgaccctttttcaaaacaaggaaagccaagcaactgcaaaaggagcgggaggaagcagctgtttttggattcaaggcaatggccaaagctgcggcaaatgacatggcacctcccaaaggacgcgacggaggaagtggcctgaaccgaagcaaacttataccttctactgtgtctagatccgctcatttgaggaccctaagctgagagggacaactcgagcaggctgagaaggccgcccaaaataagctccgcgctcggtcgaagagtattgatgctataaaagctaacgagcctgagcgagcagctgttctcgtaaaggaaaagtaatggaggtctgagcaccggcaggcctagtgtgctattaattgaaggccattgaagaagaagagatccagagattgtctgttctgtctgctgggaagagaacaataaaaagtcgaggggattgttcgttgctcctgttattgtcgtcggggacctgataaaagattgcaggaaatgttggatgaccgacttaatcatggagagtatatctctagcttgagtagcaatggctgaacaaagaatttaagaccctgagaaaaataccagaccgaaggtcagttccaatgctgctaaacgagctaaaatgcaagatacagtggttgaaagagatgccatacaggatcaggtgaaactcatcggggatggtatagatggagtaaagaaggagcgacaagcagtcaggtctaagattaaggtcctggacgatgagatgagggttgttgatggcgagattgctttgcttcaagaagatttaaatgcagctaccgccagaaaggataaagcgtacgagtcattgaccgaattgagaaaagcgcgtgatcttgccaatgcatccttccatcaaaaccgcatagttctgaacagagccagggattattcttctaggaatgaggtggaagaattgcaagagctccacaagactgaggttgagaagttcatgacacaatggtgcagcagcaagacctttagagaggactatgagaagaggatcctcacttccctcaatggacggcagctgacccgagatggccggatgaggaatcctgatgagaagcccatatttatcgaaacacagcagccagcagcacctgtgcaacaggagcctatcccatcaaaagcgcctttgaaacaagcaaaggaagctggtgctcctcaagtcgtcgctcccaaagaagagccccttgcaaaagcatctgccaagtcagctaaggtaaaagctgctgtggatgctgatgatgatgcctatgaggctgagcctccaaaggagaagcccaagcctaaagaggttgatgtagcaaagttgaaagagatcaagagacaggaggaaatcgagaagaatagacttgctttggaaaggaagaagaagcaggctgagaagcaagcggcgaaggctgcagcccgagcacaaaaggaagctgagaagaagcttaagaaagaggagaagaaaaccaagaagaaaactgaggcagatacggacgagccaactgactcagacaccaagtctgatgaagcagcagaaacccaagcagaggatgagttcactccagtttctgtggtaaacaaagaacagaagcagaacacacggaccaggaatgtagtcaccaagaccaaggccccgctgccaaaggcgatcctgaagaggaagaaagcccagtcgtaccggtcatgggccaccccagccgtgatgatatccgccgtcaccgtgctcgtcgccctgcttgcggcgctgggctactaccagtactaccgcccggcgagcaccagcaactgatggaaggaaaaggaggcctgtgcacccgccgccctcgagtatgaatcttactagaccaattttgcaggtgagagcaacagagtgcgtggtctgcctagacctgaatgaactgaaaagtctggagaagctattcgtttctgttctgtttgttgggtggagtcggataaaaagttgcagttaattttggttggcacagttaatttcgtccgggacttgagagtctatatactgccagtgaactcagttgtactttaaagtggagaatagattgcgatctgaaataagtatgcatgtaaacgtgctgtttgtgtatgtgtatgcatagaatggaggcgtctcagttggtc

SEQ ID NO: 10095 - DNA, 685 bp, Triticum aestivum
  Clone ID: PAT_TA_10095
cggacgcgtgggcggacgcgtgggcggacgtgggggaaaaaaaggcctccgcaaaccctaacctcacgggcggcggcggcggcggcagagatggaccccgactcagtggcgaaggcgttcgtcgagcactactaccgcacgttcgacaccaaccgggcggcgctggtggggctgtaccaggagggctccatgctctccttcgagggcgagaagttccagggagccgccgccatcgccaccaagctcacctccctccccttcaccaagtgcgcccacaccgtcgtcactgtcgactgccagcccgccggccccacgggcggcatgctcgtcttcgtctccggatccctccaagtcgacggcgagcaccacatcaagttctcccagatgttccacttgatgccaatcggaccagggaacttctatgtgcacaacgacatgttccgcctgaactacggctaagaatcttaccaaaggtcgtgcttccccatggaagacagaatgttctgcaaaacaaacaattcggttgtggtttttgtgtttgatggtgaaaaactttgtggtgctttcatgccaacagcttatgaaatccactgaggatgaaacataacaaaacaccctgtactatgggtctgcgtctgaaattgtatcgtggttattcttgtatcaatgttatgtgggaggtcat

SEQ ID NO: 10096 - DNA, 749 bp, Triticum aestivum
  Clone ID: PAT_TA_10096
ctggggcgttttccgggccgcaacaaaagcatttcgcacagcctaacctcaccggcggcggcggcggcagcagatggaccccgactcagtggcgaaggcgttcgtcgagcaccactactgcacgaccgacaccaacgggggggcgcaggtggggggctatcatgggggggtaccaggactccttcgagggcgacaagttccagggagccgccgccatcgccaccaagctcacctccctccccctcgttcaccaccgtccccttcccccaagtgcgcccaacaccctcgccacgccggacccccagcccgccggccccgactggcggcctgctcgccctccgtctccggcgtgcctcccaactagatcggcgtagcaccgcaatttaagctctccgcagctgggccacttgaatgcctaatcgcaccacgggaagttctacctgcacaacggacatgttccgcctgaactgcggctgaagtaccctaccaaaacggaagtgcttcgcaatggaaacaaagcgaatgttgtgttgaaattaaacagtaaaggttgtggtgttttgtgtttgacagcttaaaagtttgtggtgcttacataacaacagacatatgaaattcactggggattaaacataacaaaacaccctgtactttggacttggcgtctgaaattgtagtgtggttattctaatatcaatgttatgtggaggtcaagggaaaaacttagcagttcagttctttttttaaaa

SEQ ID NO: 10097 - DNA, 799 bp, Triticum aestivum
  unsure (1)..(799): unsure at all n locations
  Clone ID: PAT_TA_10097
ttattctttagttctctcncatgaagaggatgaccacagcctatcaggatacagctaggatgaatcaccatctagaaatttgccagcatagaaacaaatgaatctctgcatagcagaagcaaaacgagcctcttctgaagataaaacacaacaggaggaactcagttccaccccccaacaagattgctccataatgaaaagctggtcatcgactctagctagaaaagatcagatcacaaaatggtagaagctttcgtctttagccgtgacgctcgtgatctcactcaagcatcggacttagctgatctcaccttcatccttgagcaagaagccgctccacagcagcgaggtctcctccttcgagcaggccgtggtgacgatggtcacgttgaaccccccaatggtctcgaagatctcgaagtggtcctctatctcgggggagaactcgcagaactccgtggccatgaagaacttgacgcagttgccctgctcgatcgccaccttggaatccagcatcgacatcaccgtcaggaccctgaccaggaagttgtacatcccgtgccctcggatgatgctctgcctcagggacacggcgtccttctgggaccccaggtatgcgttggtcgccttccctttcagatgggcgggcagctccgcctgtatgcacctctggccgcacagaatctccatggccagtttcccaaactggattttggcaccggtggtagactttgatttctcataaggtgccggcggagtcctataagcaacatccgccgatccctggtcggcatcgttt

SEQ ID NO: 10098 - DNA, 1769 bp, Triticum aestivum
  Clone ID: PAT_TA_10098
ctgctcttcccctgagacggacggcacacggcccgttccttccctggacacgaaccggccgccgggggaggagagtctgcccgagtcctcgggccagctcccgccggccggcgccagcttccgcatcctcatgatccccagcctcggcggggagtagtcctgcaaggcggccggggacatcgccaagctcgcccagagctccctcctcaagaaccccaaggagcggcccaccactgagcgagatagtcgaggtgcccaggcgtcccgtgcagaccggaggcggcctctcgtgccagtggcacaaggcacccatcgccggcaacggggaagagggtcaaccgtggcgcccccgtcgtaggaggtgactggatgtgctgtcaaggagagttccttgtccctccttttaggcgaggtttgcgtatggtatagctatgcgaacatgagtttagatgatatgggttgttggattcttgatagtgttttcttttcccccttctttggaggcgcaccggacgcatcgacgtcgccgtctggcgcctcaacacgcgcggcctccagggacataagcagtggttggcagaagtacagttccttggagttcttgagcacccaaatcttgtgaagcttctcggatattgtgccgttgatggtgaaaggggagcccaaagattactggtctatgagtacatgcccaacaagagcctggaagatcacttgttcagccgaatccatcctgctctctcgtggaacagaaggcttcagattatcttgggtgccgcagaaggattggcttacctgcatgaagggctggaacttcaggtgatctaccgggacttcaaagcctcgaacgtgctgctggacaaggacttccaagcaaagctatcagacttcgggcttgcgagggaggggccaacagaagggaacactcatgtctcaactgcggctgtggggacgcacgggtacgcggcgccggaatacatcgagaaggggcacctgacggcgaagagcgacgtgtggggcttcggggtggtgctgtacgagctcctgacggggcggcggtcgctggacaggaaccggccgcagggggagcagaagctgatcgagtgggtggtccagttcccgccggacagccgcaacttccgcatgatcatggaccccaagctccgcggcgagtactcctccaaggcggcccgggagatcgccaagctcgcccagagctgcctcctcaagaaccccaaggagcggcccgccatgagcgagatcgtcgaggtgctcaggcgagccgtgcagaccgagcaagcctatgtggacaaggcacccgtcgccggcaacgggaagagggtcaacgtggcgccgccgtcgaggaggtgactgatatatgttgtcgaggagaattccttgtccctcctcctaggcgaggtttgcgtatagctatgcgaacacgagtttagatgatttgagttgacgcggattgttgatagtgttttcttttccctcttctttggaggctcatttgggtgaagaatccgttactgtggaatgcaaattaaccagccaatacttaagtaggagtagaaacccttgcctgctggaggattccctgctcatatagttcaatagttggatatccccctctgaaggtagagaaacttttccaacacgcgcgcaaagcacggcgcgttaaaataacctttacaacaccgaaatagcaacaccgatatatctcaccttgggttttgtaaagtatcgtaagcaaagggaacatcaca

SEQ ID NO: 10099 - DNA, 744 bp, Triticum aestivum
  unsure (1)..(744): unsure at all n locations
  Clone ID: PAT_TA_10099
ccaaatttggatactctgaataggcctaaatgtgtgacataacaaaacttcacagatnagagttacgccttcttcatcacaagaagaggcaaactcatatgactcggagaccacaggcttgttattttaatttagaacgtgacatcaaacatcaggcaacaataaaatggatgaattttctgcattttgaaaaaaaaggcaggttggggcaatgacattctgtcagctatgagagaataccaccttgcttttttgtacgaagttccaagtaatactgtatcgatcctcagcccaacatctcaggaggctggtactttaccggaagcaattttacgtgctcccttaatttccctttccttgagaagagagatactattaacgaaatcgttgaagcttcaactgacagctgtttagcatcaagtttagcgagataagtcacagcctttacaacttcaccattcttcagaaataccctgaccacttgatttagcagcctggagtcaggagcacagccagccttctccattgctaaaaacatatcatcagcatctgccagcaacccttcttttatgaaattcgtcatcattaaactgtaagtcacaacagaaggcaccaacccaatggctgatatagtagcaaacaaatccttggcctcttcaattctcctagttttaaacattgcagaaatcatggtactgaatgttatgacatcaatcttcacgttcgttgcacgtaatttcttga

SEQ ID NO: 10100 - DNA, 2152 bp, Triticum aestivum
  unsure (1)..(2152): unsure at all n locations
  Clone ID: PAT_TA_10100
ttcgtcctcgacttcgcgtccgtgcttgacgaagtctcctctttctttttcctccacctctatcgctcctccttcccccggactccacctcaaccccctctccgtcgcgtcgccgcggagccctaggacggcgccgccgcgctaccgccatggcgcagccgtcgcaggaggcgatcgaaactttcatcagcatcaccggcgccgacgaggccgtcgctgcccgcaagctcgaggagcatagcggtgacctaaatgaagcggttaatgcatacttcaatgaaggagatagatccaccaccagaatcaatcagaatcctatacctgacagtcatgacgatattatggatctggacgaaccatttgatcctatgtttacccgatctatgggcaacccttttggtattttggacccaagttttgttgagagagccgctgctggtttctttggtcagggacctcaggttacacatcccagggatgtgcggcagatacctattgaagttaaagacactgataatcctcaaattggaagttctggtcagggtcctgttattgaagatgttactggacgtgagtctttatatggtctggaggttcatgggactgttgtcattgatgaggatgatgatgacttgccatctacccatgctcctgttatcccaagaaatactccaagcacatacagttctgcaccaagtgctcctccattggtggatgttagtgactataacaatgacatagaagaggagatgatccgtgcagcaattgaagcgtcaaaaagggatgcggaaggacttacaaatgtagcagagcgagagagagttctacttcaagagggaatgcatgcagttgataattcttctgatttatctgataaggaggacattgaaggagcaagtgaggcagttgaaaggcaagtactaaccacagggcaagctggaacttctaggcaattggttgatgaagagaacttccaagacgatattgaagatgttgacgaagaacctttagttagacaacgttccaggcgtgttctatctggaactgccgggccaacagaagcagtgcaaagggctgagagtcctccctcaggccctcagcctcatggtactgaaaatgctcaccagcataatggagctttcccctcagagtggggaggcatttcttctgaagagcacgacgaagctgttatgcttgaggctgctatgtttggtgggattcctgaacacacagaatatccatttcccctcccatctcatgggatctcaactggctatccccgtatagcacatcctccatcaccaacattaactgcacagaggttgttaagggagcagcaggatgatgagtatcttgcagccctccaagctgatagagaaaaagagttgaaggctgtggaggatgctgagctccgtagattagaagaagttgctgcaagggaagctgctattgaaatggaaaagcaaaagaacgaggaaaagctgagaaaacaacttgaggaagaggagttggagtccatgcttgcagccaagcgagcatcattaccaaaggagccactgccaaatcctgaaggagccgtcacagttgtagttcgcatgcctgatggcagtcgccagggaaggcgcttttcgaaatctgatcagctccaggacctttttgatttcattgacatcagcaagtcattcatgccaggaacctattgactggtgaggtcttaccccaggcgtgcattcaccgacgaggagtgtcagatgtcgttgagtgatgtgggcctcaccagcaaacaggaggccttgtttctagaacaaatttcaggatagtgtgaaggatttagtaatggatggcatccaactggggattcatattttttacttctatctgtcatatgttgatgaaaagttagcaaggtttctcgtgaacctccgcgtcgagaaaggtctcattatcctcttttgttttatgatccgatgttagtaagttccattgtgtactcggtgccgcaatcccactttaggcatgcagtcaggatgtatatacagtgctcttttgttatctaaactaatggattgcatgctaagtttttggaattagcagacatcaaaaataaaaaaaagggcgggggcccaggttaccaaantcnccccncaanggg

SEQ ID NO: 10101 - DNA, 565 bp, Triticum aestivum
  Clone ID: PAT_TA_10101
gccgctccggcatcgagatccactacaagaggctcatcgaggaggacccctgcaacggcctcttcctcaggaactacgcgcagttcctctaccaggtgaaaggggatcggcgtagggcggaggagtactactcccgcgcgatcctggcggaccccaacgaccgcgagctgctgtcggagtacgccaggctggtgtgggaggtgcacggcgacgaggagcgcgcctccagctacttccaccgggcggccagggccgacccgcacaacagccacgtcctcgccgcgcaggccgccttcctgtgggacaccgacgatggcgccgggcccgaggacgacgatgccacgagctacgccgggttcctggccgctcacccgtccatggcttccgccacgagctgaacggagcctcgccgctgtccctctctgaagctgacgttgatcggagctcgtcgcttcagaccttcagtagcagactacgtgtagtagattcccaataattgtactgcctgctctagtgaacaagtagatctcgcaaaaaaaaaaaaaaaaaaactctagggggggcc

SEQ ID NO: 10102 - DNA, 831 bp, Triticum aestivum
  Clone ID: PAT_TA_10102
aaaaaagacatgaggtgcctatggtaacagtattagaaaaacttcgagaaatcttacagctcaatgtaccaaactggtgcatacatcacaacttgttgaatctaacgagcaaaattttcaaaattatacagtacaggtacagtaccagcattttccaagccagctcaatatactttttgtgcaaataaactgcggtacatcacagtatgttgctcatgaagatgtatgagaaataacttctgagaaaatggtatgtctgtccacaagacgcctattgagggggagcatcaggatccaaccttttctggattgcagctgcggcctcgaaattgcccaacttgtactgtaacatcatttcctcgcgtagaagggactgctgcttcatcgcttgagccattccagtttgcatggagcgttttagagctgtcacttcttcctcctttcggcgttcacgttcttgcaacagttctaaccgtcgcacttcctcatcattaaatactgtacggactgctaccgaacccgcattctttaaaccattccttttctctttctccatcatccgttgatggtaagcatccaagtcataatatttttttgatggaaacgtagctgtgttgtggtcttccatgaattccttgaacatttgtttttcttcccaattagccagtgcctccaaattaacctgcttgacttctaataaccatgcggtgaactctggtcgcttgttccacatatcgacctcacggccgcggccatacttgccccacgagttggtcactgcagccttcttccccaaatccttcttctcatccttccgcttcttcttcttct

SEQ ID NO: 10103 - DNA, 803 bp, Triticum aestivum
  unsure (1)..(803): unsure at all n locations
  Clone ID: PAT_TA_10103
gggggctataccgtccaaagnaaaataaaccaaattttactgcccagcaaaacctacttacacctgtccaatatcaggtttctgcacacacaaactcaactcttctccacaatggtctgaacaaaaccacacgtcaacaaaagaacatcgaactgctgacacgaggatgcagccgtggcagttctgggactacttctgttgaactatcatcaaactcctcaaatttcatgaactggctcatctgcgctgctgcaaggtgagcgtaacagataggtgccaccacagatatagcagtggtgctcctctgattcacataggaaagcgaaagaacaagcttctggagatcatctggtgagaacccaatctgatcaagcaagacatgataatgggtgggccttgaggtacctataggtcccgcatgagcacacatgtagaaatcatactgtttcggatgaacaatgcccgagtccactacagttccaggtggaacattatctggtgcatcagcttggaacagtttcgtgtggtgattcttttgagcaatgataactgtaatcttcggaagtgccccctgatccatattcttgtaagcctgcatcatcaaaattctgtaaagtaacatttccagaaaacagagatttccatgccaagtgccaacgacaacctttataatctgatcaacctcaagatccagtacttggctaaactgagactcactcacaccatccctgaaaatgattatatgtgctggctttctttgttgactggttttgtagaagtctagcagaagttcccttattatc

SEQ ID NO: 10104 - DNA, 781 bp, Triticum aestivum
  Clone ID: PAT_TA_10104
tttttttttttttttttttttttttttttttttttttcccaatttgtcgggctaaaaggtaaatttagttaatatgtacagaaagatgttgttctctcttgaccactatgtatcatttttacagcagggcccgggactatgataatccacaagtgcctgaggccgtcgtccatcgtcataaaaacaaattcaacttttacacatcgcctgaactggcatattatcctcaaccaatgaaggcatccttttgatgggaggtgtatacatctcctctagtatgggattcagggatatcaattatcgttgttaccagcatcttctttgtgaaagtttccgttagtgttttctgagctaggcgacggctgcattgagttgcctggattctgtagcagttgggaaaaactccgccataatcttgaaggcagaattggagcaatttcctgctgctcttcagatggcacttcgtacacaccagctgatcccggactcaactcagagaaccttacagctccaagaagtctctcggggagctctgattcagcttgactctcaataacaaatgctaaatctatagtcagtgtcgccacgtaaccaaatgccagatgaacaattgcatttgcaactatggaagacccaatatccacatcaacttcgatgaagtttgatccctcgacatacttgcacgaaagtgctctgccaagtatgcagatggcttgttcacccacagcttttcggacaatccagggccccttaactatgtttgctatcagtttaagcctgg

SEQ ID NO: 10105 - DNA, 1186 bp, Triticum aestivum
  Clone ID: PAT_TA_10105
gttgacaaccgaaagggatagaaacttcattaattatattcatgatgcatggctgaatacttgtctacatcacacctccacaaaaatggaagagtaagtattccaaaagtacgacgtatacgttacatgacaattgacatatatatcagctattcaaaatccaatgaattttcccggaagaacttagctaacttgactatccattctttaatcaatagccacaaagcaacatatttcataaccacaggaagcaggagccgacatcctcagccagagttgggtgtacttgcgggcgacctcaccgtcaccagcccatctgcaggtatgctagctccacctcttctcttctttgttgcaaatgcaaaaaggggagcctctgttgggcgagggccccccccgcgtggcgtccttgtccgtcttggcacatcggctaaaaaaatgtccgattgtttggatagagttgtcttcacaaggagtcttgccgattagaccttccacctcttatttaatgacattcttcatgtgcagtccaatggattgtgggtgaatatacttataagctaacatgtctacctcagacataattctttctctgtatcatcatcagggtcaggttaaaatagataaagtaaaaaagttcttgcatagaccgaggtaggcactccttcaggccacattagttttgaggactgcaaactgcaaatcgcttgcatgcagctctaatcttggttgcattttgagggccaattctaacggtatcaggttgtcagcacctgcaacatcccaagggatcgaaataccaatttctgtaaatcatgccacaccattaaacatcaatgttaaatttacatatcagtaccgtcagtaacgaagacattaatgaaaacagaatgtgccctatctaataaaagtaagaagatcaaagtagatccacattctccctgcggtatggcctatctaacagaagtacaaagagcaaaacaaatctgtgttctccctgtattccatgatgtgtgttttaccttgtaagccaccagaaaaatatgcaggcgaccgtgaaagtaaccctatgcttgacaataaaaattccaagtttcgaacaggatatgaagcaagaaccccaaacctgaattcatatagggttggccactcatacgaagaacaaatacaataatattgagtctgg

SEQ ID NO: 10106 - DNA, 781 bp, Triticum aestivum
  Clone ID: PAT_TA_10106
tttccactaggactacagtgtcctcctcctctgggattcagtgcccttccgttgcaacatgcaaaagctgacgcagaacaaacacttgctacatccgaatgaagtcccggagaccggatggagaacaaacacccagttgacaatgctcgcgtccgctgctcaacgatccgccaaagcatcactcatatgcatggaggaaaatatctatctcagctctgagggaaaagccacgccgctagcattttgacgtccttgcatcctactgtcggcagtggtatgaagaaacaatgtccatcccgcatgtcatatactgcacatgaacttggcgcatccttccagaaccagtcacagctgccatcgtccaggaagtagatgcaatcccccttcagcttgtactgagacacgtcaacagattgggatgaactttggctgacgaacaatgtctggtcatccccaacactgctcaccttcacccaactttgagactggaagtctgactgacacacctcaaattcaatccctactggcttgataccaccaatcgtatcattatcacattcaccaaatattgttctctgtaccagcagtagtgcaccatgagattcaactagatacgactcgaaataagagatgccaccttggatcaactttaagacacagggggcaccatcaagtagacgctcgatccgaggtacccttaacttgccattatcattgtcctctctgacattgattgccaaaaggtcgttgaactcatcaatgacatacagcataccttcat

SEQ ID NO: 10107 - DNA, 626 bp, Triticum aestivum
  Clone ID: PAT_TA_10107
cgtccgggagcatttgacacggagcgaggagcgagtcccttcgagagagccccttgagagtcgcctgtagcttccctgatcccgcccgatccccaatctccgacgacggcgatgccggccggacgagagacgggagaggtgtgtggagctctgtaaatagcaggtctaggattagatcgagtcttgcccaagtggcgtctggcgcctggtggctagcgtcggcgtttttgatggttgtggtggcgaggtgctgcgtgcaaccggagaaaatgacggcggcgactccttcaataagctcgttgtgtttcctgttaaggtggaggcccggctgctcttccctttcttttcaggccatcgtggtggtggatggaggaagaaggagaggcggcgagctggactatgcagtttgggaaggagctcatcctcaatggtgtttgagacgaggcaacggcgcccgcttcggctgtcggcagccggtcctcaccatctcgccattgaatatgctggccgaagggcggccctttctcttcctcccggcctggtgcctagatgggaggcagctcatctctgaatcggagtctaaggcttcttgttctgcggtgttgtgctatgggagaagcagctgc

SEQ ID NO: 10108 - DNA, 1045 bp, Triticum aestivum
  Clone ID: PAT_TA_10108
gggtacgacccccacgcggacccagcgtccgccgaaccaaagcaggagcgagtcccttctagagagccccttgagagtcgcctgtagcttccccgatcccgcccgatccccaatctccgacgacggcgatgccggccggacgagagatgggagaggtgtgtggagatctgtaaatagcaggtctaggattagatcgagtcttgcccaagtggtgtctggcgctatgccgtggtggagcgcgccgccggcgcacgcgagctgcgcctggtggctagcgtcggcgtttctgatggttgcggtggcgaggtgctgcgtgcaaccggaggaaatgacggcggcgactccttcaataagctcgttgtgtttcctgttaaggtggaggcccggctgctcttccctttcttttcaagccatcgtggtggtggatggaggaagaaggagaggcggcgagctggactttgcagtttgggaaggagctcatcctcaatgggtttgagacgaggcaacggcgcccgcttcggctgtcggcagccggtcctcaccgtctcgccattgaatatgctggccgaagggcggccctttctcttcctcccggcctggtgcctagatgggaggcagttcatctccgaatcggagtctaaggcttcttcttctgcggtgttgtgctatgggagaagcagctgcggaggtcccgacgtaccaagtgctaacgtccccggcgacgacgggattggatccggttgggagatgatttggacccgattgcatttcttgtttcctgttcggggtcctccatgcaaaaaacagggactggtctgtaattttctttcctttgtgtgtcctgttgtaaactacggtgtgctagtgctaccgatctatggttaatgcagtttctgggtcgcgtgacccatcttttgttcaaaaaaaaaaaactacaactagatcgcgagtggtgggcacaaaaacttggagaaaacgtaaccacggcacgtgcagcctgtgatgcgtattataagaggagttcaaaaaaaaaaaaaaaaaaaaa

SEQ ID NO: 10109 - DNA, 1761 bp, Triticum aestivum
  Clone ID: PAT_TA_10109
agcaaaacgatccgactcctcgccgagggacggagggaacatagataacagaccaacgaagccagagagatacaaggaagccaggccaacgagatacgcgcgagcgcgaggaggaggaggagccaaggcgagttagttgtgccgtcaggggcgtgcggcggccggcggagcgcggccggaatgggcgtctacgagctcgtccggagcgaggacgccgcgggccccgcgctggatctggaggccggccgctgcggccccgcgccgccggccaaggcgtctccgccggcgccgcggcagcagcggctcgtctcgctcgacgtcttccggggaatcaccgtgctgcttatgatcatcgtggacgacgctggatcgtttcttccggcaatgaaccactctccttgggaaggtgtaaccatagctgatttcgtcatgccttttttccttttcatcgttggggttgctctagctctggcgtacaagagcgtccgcggacgcgtgggtgcaactcgaaaggcaacacttcttgcactgaagctcttctgtgttggtcttgttctacaaggtggattttttcatggagttcgtagccttacttttggggttgatattacacaaatacgtttgatgggtatactgcagagaatcgcaatagcttatctgtcacagcactctgtcagatttggctcaagggagatgatgatgtagattctggacttgatttgatcaagagatacagatatcaactactcgcaggcttactcatcacaatcacctacatggttctcttgtatggtacctacgttcctgactgggagtatcggatatcaggtcctggttccacagagaaaacgttcactgtcaaatgtggtgtacgaggtgactctgggccaggctgcaacgcggttggcatgattgaccgcaaaatcctaggcatccagcatctctacggtcgaccggtttatgcgcgatcccagcaatgcagcattgattcaccgcaaaatgggccactccctcctgatgcaccctcatggtgccaggccccttttgatcctgaagggcttctcagttctgtgatggccatcgtcacctgcttgatcggtctccaatacgggcacataattgtacattttcagaaacacagggaaagaatcatgcactggcttgtcccttccttcggcatgctcgtcctggccttcgcaatggacttcttcggaatgcatatgaataagccattgtacaccgtaagttacactctgtgcaccgctggtgctgcggggctcctcttcgcggggatctacacactggtcgacctctacgggtaccgtcgcccgactatcgccatggagtggatggggatgcatgccctgatgatatttgtcctgattgcgtgcaacattctacccatcttcattcatggcttctactggggggagcccaataacaaccttttgaagttcattgggattagggcatgatctgtatatggtggatcgagctatagggagacacgggagacacatatagagatatttaggaccctatttgcacagagatttcgagagatgagtgcaggcctagttttgcaatatggtcatagcttcatcaccatcctgtgtaactgcctgttcgacacggccaggaacagttgctgtttcacaggttgttttctctgagtgctctatgtatatggcaaaagaagctttgtgtatagatgacaacaatgcgattcaagagaaatataaagtacatagatttattatc

SEQ ID NO: 10110 - DNA, 765 bp, Triticum aestivum
  unsure (1)..(765): unsure at all n locations
  Clone ID: PAT_TA_10110
aattgatcgctttttagtaataagaaacttaatattgtgatntcaggcttactcatgtcagctctagacagcaggttgcagactgcttgacaaagcgactgggagcaaatgactataacttgcatgtgacaagatggaattgatctatatctaccatccatcttgtcatcttgagaggaagtgttaaaccggtatggaccctgcccatctgtcttaggcccataggggggcccaacccatgagctggtcgttctctcctcccaggcacagcaaaacacacacacacaacacggtacgcatctctcacgtacaacatggaaccatttctctaaattcttgaacagtccttgcatgaaggcaacactagaagctccgttttgattaggcagccttatctgaagaacaaatgaaggtcaagccaagacccatcacccagaaatcatgacaattcataaatcacaagaaatagtttatgtcatattcctcagttattgctctctccgatattttcctctgtatcagtgtggtgatgtgtccagcgccctgaaattgcttcaccgcccaagatacatccctccaggtttttgtttctatgtcctcccatagtaaaggtgcttgaactgtccccacgtgctggataagccttaagctacttgtaacaaaggcttcttcccaaagttcatgcttggaccatgacggtgagacctcacgtactgggatcccaagatcatggcactcctcaatgactatctggcgcataattcc

SEQ ID NO: 10111 - DNA, 1791 bp, Triticum aestivum
  Clone ID: PAT_TA_10111
gcacgacgcggcccccggccgccccaggagcggccgcagccgcaggaaccaccagccagacgccggcggcatggctcggagcggcagccgcagcggcgccagcccgtgcgacctggacaaggagttcgccccccagatcgcccagctcctcgccgccccttctccccagtccgcccaggaatactatgaggagctcatacagtccaagaaacatgacggcataagagtcaactacaaaggcgatcatgggaaaggtgtttgtgcaaacaaggattttgctgaaggagaccttattctgaaggatcaaatattggttggtgcacaacacagtcttaacaagattgactgcgtcgtgtgtagttattgcttccgcttcattggttctgtagagttccagattggacatagactgtattttcaaagcattgcttcaagcattggctgcagcagtgagaggcactgtcatggaagtgatgtgggatcaagcacttgctcttctggtgtaacaaaggaaaagagtagtactttgccagaagaggtcatagaatcacttataactggcgatgtgtcactgcctttctcagaccacttccctttaccagaaattgttgcttgtcaaggatgcgaggaaagaacgctactgcagccaatcatgtgcagattctgactgggaatcctaccactctttgctctgtgctggccccaacactgaaccaccccgaagatctgctctcacaaatttgtagagcatgctaatgaaaccaatgatattttcttggttgccgccaaggctatcactttcaccatgttgaggtacaagaaactcaaaagacagaacgacttccaaaacaaatcacctgaatcaaacttttctttgcttatggaagcctggaaaccactttccatgggcttcaaaaagagatggtgggattatgttgctttgcctgaggatgttgatgcttccgatgaagattcatttaggcaggaaataagggatctagcatttacgtcactacagcttctcaaggatgcgatcttcgatgctgaatgtgcaccattgttttcccttgaggtgtatggccatataattggcatgtttgagctgaacaatcttgatttggtcgttgcatcgcctgttgaagactatttcatacacattgatgatcttccagatgataagaaggaggaagctgagaaggccacagcgccattgctagatgctttagatgatgactatgcagttccttgtgatgggacggcgttctttcctcttcaaagctgtatgaatcactcgtgctgtccaaatgctaaagcatttaaaagggatgaggataatgacggtcatgccgtgataatcgctctggggcctatcagcaagggcgaagagatcaccatctcctacatcgacgaggatcttccgtacgaggagcggcaggcggagctcgcggactacgggttcacatgtacctgctccaagtgccaggaggagaagcccaactgagcagcaaggcgggctggacttgctgcaaattttggtcgttgttagtcgtcggcgggcattgtgcttgtagtttatgctactgggtacttttgacaagttcaaactgtaagggtaagattatgcagaaaggatgagggtgatgtaacctgatttaagtgggtgccgctgggttaattaggctttgtccatgtcaaaacttctatcgaaattgtcagaatgtataacctagtcggtgcaaatccgctaatgaattacccgaaaaaaaaaaaaaaaaaagggcgagaccctaa

SEQ ID NO: 10112 - DNA, 733 bp, Triticum aestivum
  Clone ID: PAT_TA_10112
aaaatataaaatgaattaaggattcacgtttacgccacccacaccaaggacacggcggctaggggtttaccccaagtaataggaagatgagctctagggctctccggtatatctgtggttttatacccattacaaccagtgaagagtaactttttttttcatcatagtgaaaggtaacttcgatcaatgctgaagtaaatcaggtgaacaagcagacagtagaaggtcaattcaaatagcgacagctccagtcttcagaaccgttggatgcgccatgaagggtggtggtgtgtcgccactcaggggggaagcggtaaatggccgttagatgaagatccgacggtcgacgatgagcccggatggtttggcgccagcccctgggtgttgaattcttcagttaacaacatgacaagtatcgatttcttcggaagatgatgcagcctgcaggctacgcttcttcttcttcttcttcttcctcctcagcgtggcttcagatattccttggcagacgatttttactgggagcctctgcaatcatagagtgttcctttcggtgccccaaactgttcagcggcatctttaccttctcacacctttcccagtgataggctgatagcccaagacagtactattctcatactttggccaacaccttttccatggccacatgaggttaccgatgagatgatctacaaacccaaagtccttatcagtggaatgtagactgaattga

SEQ ID NO: 10113 - DNA, 1080 bp, Triticum aestivum
  Clone ID: PAT_TA_10113
tcgcgtccgcccacgcgtgcgcggacgcgtgggtggatgaactgcactgaaaggatgaggaaacatggcgcacagttgagaaggtacaagagttggcaaaagccgaactggccgcagctcttgcaaaggagaaagcatcccagatcgaacagattgctgaagcagatctcaatatagatgctttgtgtatggcattctatgcgcgatctgaagaagctcggcagagtcattctgttcataagcttgctctaggcactcttgctttggaagaagctctatccagcggctcgccaatccggacagaggtcgatcaattgcgtaaatctcttgaaggtattgataaagattcactgttagaattggctctttcatcgcttccagaagatgttctcaagtatggatcagatacccggatggagttaaaacagaagtttaattccttgaaggcaacaatcagacatttcggtcttataccatcaggtggtggtggtatacttacgcatgctgtcgctcatgttgcttctaacatcaaggtcgaagaggacccatctggagatggtgttgagtctctcataagcagagtggaagacttgattgtaggaggagatttgactgcagcaaccgaagccctgacaggagggttgcaggggaccgcagcggaggaagcagctgccgagtgggtgaagcaggcaaggaaacgcgcgattgcagagcagacgctcaccctgcttcactcgtacgcttcttcgatcacattttcgtgatctcgatcattgatggatcttttgttctttcttctatttggcaagatttacatgccagcgctgcagattttacgatactcacatgtttctctataccatgtcgcaaatgcatggtccttgtaaacagagataataaattttgccgtgtagccacttggtattgtgatactccagtcgccagacaagtttggatagatatgtcaaacctttttttttcttttctttttgctgaaaatgcgatgttcgtggtctagctgctgctatgccaatgtaaggccgcagggaggggaacaattttatcagtcagagtgctctt

SEQ ID NO: 10114 - DNA, 719 bp, Triticum aestivum
  Clone ID: PAT_TA_10114
catatcgacaggttccaccattcgacaagaacgaacgcctgcatacatattcgaacaacaatagaccccaaccgacccccacggtcacatatagagagtccacataccgcaccacatcccaacccacctacgagaccaccatagccacagccaccttcagacgcgtccccctgtgccattcgcccatgcagatgaagactgactatccacccgccttccaggggaccgttcgggcctctgtctgtaccccccccccacatctccttcgccagctcacctcgcagttgctcgatttgtcccttttcatccccaaaacgatcaccacaggtcccttcaaacctgccatcaccatcattcccatgttgtcgggacggttcgggtcacaggcgccacccccctcatatatttcgtccagagcagcacgttggagtcgtcgtaccccccctctaacactgacacaactatgggatcgccctcctccacaaggcccggtcgcagactgccgacattctgcgcctcgtcccgccccaggtccgcctcaacccaagcaaatacctaatctggcccgcttttgccgagcaattgtgccagagtgacaatcacaccagacaggccccgctgccctcctctctgtgcgccttgtaactttcaaggtctctttcttcttctcatccaactcttctatcactttcttgatttttgacttgtcattctgaaga

SEQ ID NO: 10115 - DNA, 1024 bp, Triticum aestivum
  unsure (1)..(1024): unsure at all n locations
  Clone ID: PAT_TA_10115
tcctctcaactgattcttattctttaatacagtaattccataacacctcatatatatatagtattccaccagccaaggggtagtaaactgatctgcctgcctttatactggcaatgaatttgtacaaatggaaattgggtatcaagaatgaaattctacgagatggggctattgagctgatggatcgccatgttgtacaacaacagagctctaacttttctttgacgtagtataacgtattgcaattgctatgcttgcaagaatgtcgtctgactccaacaacttgtgcagccatctactgtaattcgcctactggcgcctcgttcagccataggtaatggatgaactcgtacagctttgcactcacactcaccttgtaaggtgtcggatttagccgtctgatgtgatccggtcgaagtttttcgagctgttgcatacagcggcttctgatcttcagcagcgggggcagctctgctctaggtttatctgaactcccaggccagtagcaatgtagcagctcctcaacatgctgggggacaacataagccctcttggattcaaggaacgggtggcggcaaagaattcgctctcctgcctttggtgatggttcactttcacgtatcatgatgtctaccaacggatagccttcttttccatacaatctgaaacaccgctttttgcatggaatagagacttttgccacatcctcggaaagtttgatacgaggtctactattgatctcaactagcttaaagacacatccaagagcagcttgggaataacacgttacaagataagttccgattccaaaggcatcaacttcatgaccctgcttgttcagagcatcaattgtttcctcattcaggtcattactagcagtaatgatcatcttcccaaaaccaggtatattgaattccttttctattgcatgaaaaacctttcgagtttcaatagacagataggctagatcaccagagtcnaatnngataccagatgccttgtacctgcccgggcggccgctcga

SEQ ID NO: 10116 - DNA, 1168 bp, Triticum aestivum
  unsure (1)..(1168): unsure at all n locations
  Clone ID: PAT_TA_10116
ttttttttttttgcaggtttgaagntatgcctcactcacattcctgggtataaatggtccagtgcatcaccatcccaatcacaatggtaccggaagatcaaagctacgctaacaagaattcaacgatgcggctgcgacgtccgcatccaccgaaattagaagaagaaaacgatcgaaaaaggttcctacatggatgaacactgacggcaggcatcaaatacccctctaagctgccaggctgttgatgctgtcatggccgggccatcttccgcaaagaaaaagaaaaaacacctatgaggatgacacgcagaggtgaacaagtgcaaggagaagcaccaggaggtagttgcttcggacccgccgcggcttccacgagtaggccgagtcgacctcgatcatgatcccgaacctgcatgtcccggtgctggggtcctggccggtggtcgtcgcgtagcccgagaagccgcaggccacgtcgtcttggtcgttcttctggtagaaactgttgtaggcgtacgagatgttgctccgggtgtccagcatcccgcaggaagtcctatagccaaggctggtgcagtccgccctggcgcacgcgtagctcaccgtgtctggaagctttgggtcgtcgaggctgacagtgggcttcagcacacaccatttcttgtcaaggtacttgacgccgcttgctcttttaatctgtgaatttggcacaccgaagttcagctgatactttgggatgccatcgtatgtgtagatcccccagtggcgctcgaaattccctggctgtatgctcttatcatcctcatcgatcagactgaataagtaagcgtcgatcggtccaggcctcatcggggtcccttgcccagtggcgatatgcgtcatgaagccttggttgaagcgctgggcgagctgagcatttgcgttcatgtcaccgtcagttggccagcctatctccccaataacgatcggcagattcccatatccattcttcttcagggcccagatgagcgtgtcgtggtttgcgtcaaacatgtttgtgtatgttgcagagccatcaacaacgggctgtgagcgcccgtcaaagaaggcatactcagcagggaagtttggatcaatgtagaggctgatgaaagggtagatgttgacagtgaaaacctcgtgccgaatc

SEQ ID NO: 10117 - DNA, 2525 bp, Triticum aestivum
  Clone ID: PAT_TA_10117
ccacgcgtccgatcagcacctccgcccccccccctccaccctcggccctcgctcccattgccttccctcaaatctgcgccggcactaccgctcccgtcccgctccccgcactcgccaccgcacgccgccaccggaaccttgccgcaccgccccctccccttcgagatcggcgccgttactgctgtttggcggcggaatctgagggatcgacagcggcgggggcgcgggccatggggctcaatcgctgacgatgcctgtgctgcgtagtgcggctcggagggcccgtgaggcgcaggagaatccggcggcggcggcggcggcggaggcaccggttgtgccacccgcgccggggcggccaatggcagtgccctggcagggggcgcgaagcgtccacgaggccgccggcgctcctgaagagtgggcggcggcggaggagatcgcgcccgcggagggctcgggcgaacgcgccggtgaggaaccgatggatgaccaggacagcgccgacaaacaggccggcgaggatgcctctccaatccctgagacgctcctggtggccctggccccctggtaccctggtgagggggtccttgggaaaggaggatttggtcaagtatacgttggccgccgcatttcagctaatgctccaggcgcagttgaggtggcgttaaagtttgagcataagaacgtcagaggatgtaaccatgggcctccttatgagtggcaggtttatgatatcctcggtggcattcatggggttcctcgagtccactacaaaggccgccaaggggattacttcattatggttatggatatgctaggtctcagtctgtgggatgcatgtagtaataattcccacacaatgtcagttgagatggttgcttgcattgctatcgaagctatctccatacttgagaaagtgcactcaaaaggatatgtccacggggatgtgaaacccgagaatttcttgctaggacctcctggaactcctgaagagaaaaaactgtttcttgtcgaccttggcttacccaccaagtggaaggatagatcgacaggccatcatgttgagtatgatcagcgacctgatattttcaggggaacagttcgttatgctagtgttcatgcacatctggggaggataggcagcaggagggatgatttagaatctctggcttatacactagtctttcttctacggggacgtctaccttggcaaggctaccatggtgaaaacaagggttttcttgtttacaaaaagaaaatgtgcacctctccagaatctcgtccgagcttctgccctcagccctttaaggagtttgtagaatatgtggtcaacttgaagtttgatgaagaacccaactatgccaagtgtatctccctttttgatagtatagtgggcccaaatccggacatcaggccaatcaacacagacggtgctcagaagcttatacaccaagttggccaaaagagagggcgcatatcgttggaaggagagacagatgagcaaccaaagaagaaggtcaggatgggaatgcctgcaacacagtggataagtgtttataatgcaaggcggcctatgaaacaaaggtatcactacaatgttgcagattcaaggcttgtacaacacattgacaaagggaatgaagatgggctgtttattagttgcatatcatcttgtgcaaatctgtgggcactaatcatggatgctggcactgggttctcttctcaagtttatgaactttcaccacatttccttcacaaagaatggataatggaccaatgggataggaactactatataactgcacttgctggagcaaacaatgggagttccctggtagtgatgtctaaaggaacactgtatactcagcagtcctacaaagtaagtgatacctttcccttcaagtggataaacaagaaatggcgtgatggtttctatgtgacttccatggcaactgctggaaataaatgggcgattgttatgtcccgcaatgcagggttttcggaacaggttgttgagctggacttcttgtaccctagtgagggagtccataagaggtgggatagtggttaccggataacagcagttgctgcgacttgggatcagactgcattgatcttaagtgtaccaagaaggaagcctaccgatgaaactcaagagacgctgagaacatctgctttccccagtcagcatgtgaaggagaaatggtccaagaatctctaccttgcttcagtatgttatgggcgtaccgtatcgtagaaatcttttgccatgagggctgaagtgcgagttagcctcatctttttgatccagctcagtggtagttttgtgtttgtgggcaagttctgaatgcggcctagcgtgttcttgtgaagatgtttctgcctgtcgctgttaattatagaaaatagtgtacagtagtaaatgttttgtagtcgtgttaatctttgtgtagcagacgactcttgactgtagtgtaaggtgatacttagatgtttaaacacctgacttacatgttttgtgcttc

SEQ ID NO: 10118 - DNA, 1577 bp, Triticum aestivum
  unsure (1)..(1577): unsure at all n locations
  Clone ID: PAT_TA_10118
cgccttcgccgccggcgggatcggctcccgggacctcggccccaggacgcgggtctacgccgtgcgcgggcgcgcgcgcctcggcgacgccgcccgggagggcgccggggtcgaggacatgggcaaggtcggggagtcgctctttgggccctatgagtgggagagattcgatctgctggtgctgccgcccagtttcccctacggcggcatggagaaccccaggatggtgttcctcacgcccactgtcatcaaaggggacgccgcaggggcgcacgtggtggcccatgagctcgcgcatagttggactggaaacctcatcaccaacaaaaccaacgaggacttctggctaaatgagggtttcacaacatatgctgagaggaggattgtcgaggtggttcaaggtgaggagcgggcggccttaaacagcggaattggatggagagggttgaacagaatgatggagaggtttaaggataacatggagtttaccaaactgaagccgaagatggctgggattgatcctgatgatgtttactcagaagtgccctatgagaaaggcttccagttcctttggcgcatcgaacgccagattggccgacctgcattcgatgaattcctcaagaagtatattgccaacttcaagttccaatcgatagatacagagacatttcttgaattcctgagagccaatgtacctgggattgaaaatcaagttgaccttcatgagtggatcaacggtactggtctccctccggatgccatggagccagaatcagctacctataagaagatttgtgtcttagctgcagagtttaagtctggaaaaattccaagtgaagaggaggtggcagactggagtggacaagaatgggagctttacttggaaaatttacccacagatgttgaagcatcacaggttactgctcttgatgaacggtacaagctgtcagaaagccgcgactacgaggtcaaagtcgcattcctccagctagcgatccccacgggctgcaggtgttacttcaacgaggtggagaaatgcttgaagcaggtggggaggatgaagtacctgcgcccgctctacagctcgctggctcggtgctcaggggaggaagagaagatgctggccaagaggatcttctcggaggcccaagagttctaccacccgatagcccgcggcgtcgcggagagcatccttttgaagcatggctagttgagttgaagccacattttaccgagcctgaactagagagaacatctttgatgcctattgactgtttgctcgctcatttcttccgcataaatttatctctcctggagctgaccttggatgaaactctgaacttccttccgtgatgtgttatgtgagactgcatgtgcgtaatttattctgaccctgtaaggaacttgaaactctgcctccctgataacaatatcctgtggtgatactgccattggtctccatcgtcgccgcctcctctcgactccaaanaaaaaaaacncggggggggcccggtacccattcncctataggngtcctatacgccgcnaatggcgtctttaaaantcgnacggaaacc

SEQ ID NO: 10119 - DNA, 769 bp, Triticum aestivum
  Clone ID: PAT_TA_10119
tttttttttttttttttttttttttttttttttttttccagcaacatcaaacatttttatgtactgcacagaaactatgttctgcttacaaacagtgaaattagaacaagacatagctgtacaaattgcccaagtactttttccaacacttcacctacccgtaatccacacttataagtcgctgatgttcaccatttcatgactaatttgtacaaataagtgcactcacatctgtactctaacgaagaatatcatagctgtatgcaagtactcttaccccgatttttagaggctcagagccagaaactcataatgtattattcggatcagaacttgccgattgaaatctccagcagaccaacacctgcggccagctctaccgtcttgagtcaacgcttgtttcttcttcatagatccgcgggtcttcactcaaggctgcggccgtcgcttcatccacttcccgcagagagcccaccgtcccgaaagccagcagatccatcggcgctacacttccatccgcctcctcactcaaaggggatctttgtattggttgcatcacgaactccatgagccagatctcgggatgctccttcgcacgccggcagagatccttgggatgttgaccttggcttgtggccgggtgtgggggggagggggaactgtttttcctgttccacggatcaggacggcggcggccggcgggcgtcccgagccacggatcaactccgacggggtaacggtggccgtcattccgccatttcctggccca

SEQ ID NO: 10120 - DNA, 1746 bp, Triticum aestivum
  Clone ID: PAT_TA_10120
ctttttttttttttgttgagtacaacacacagccgactcctatagctcacacatatccacatggttcgagaactttagacgttgatactcacccgagcagaccaccatattccgaatcaacataacacctcctgctacacttcctcgcaacccctgcagagaacttacaccaaagatggcttcgtcccaacgtgtcgtgtcagtagaggtcgctgacgctgggactcgtcgagagttctaggctctgccgtgttggactatcccgcaatttctcctcgactggccgcagtagcccaattttagtcacgatcgccaggcacccccaggctgatatggtgcggtgttcataaaatccactgcgactgtggggcaacagcacaatctatggggggagtccaaccttttgttgcggcccaccgctttcccaaatacggccagctcatccatggtccttatatatccttctgttattctattaagttctaatatgcagcctagtcccccataatatacctctcctcctattcagactctgttacttcctctattttcttgtgtatcagcttggagatacttcagtgaatgtacaaaacactccattttgcgttctctgtaaatacttacaaaagtgcatggtgtgcgtaaatgatttttacttaggctcatgaattgctccttcttatagctagcagttacgtatatgccaccacaacgagctcatttcacaccaaagacgtcggtccccgatagtcctaaataacaaaacaagtgccagtacacttcgaaacaagctatgtacaaaacttagaaaggagttgtgccgttcccaagaggttctgtcagaagtggacccggaggctaggagtgccgagggaggggcggccatttgctgcttcttgacctgatcgatggatatatacaatgccgagcgcaacgacatacaggcagctaagccctgagtcaaccgcgaggggcggccatttgctgcttcttgacccgatctccaggcttcaccatgctgatatcgtgaggtgttataaatacccattgtgacccttgtgcaacagcaaaatctacaagggtgtccaagcttattttgcggctcaccgcatccatgaatacatcaaactcatccatggccctaaaaggtgcttctgtcatgccatgaagagctaaagtgaagcaaagtgttgaaaaagatcgctcccctcctgacagtcctctagtgtctctgacggtatcacgggatgcatcttgaggcatcgtcagctcaacagacaaaactttactcttgtaatctacgttgatgaacccactgatacctttctttcccaggtgctcattaaacagccatgtcaattgtcgcttcaaaaggccagcattcctctgggaacttcttccatcgcaagtccaatgctttttgacacgaatttaatttcaccctaaaacctgcatacagctgttgctttcttaagattttccgttcctttttgtcatgcaatgccctcagatcatctatggactcagcatatcttctgctttcttgatcaaatctctgtttcagtcctatttatcttagcacttaattgctcaggggtggatccagcaacatgactcagagcttccatgtcactctcagagcaaataatcgaagccttcttgaagtactcctgctgacgctgctgaagatctgcatactctgcttcagccgttttaatatcaggtaaaactttagttgtcatgaca

SEQ ID NO: 10121 - DNA, 1512 bp, Triticum aestivum
  Clone ID: PAT_TA_10121
gaattcccggcgcgccccgcctcttctccgcagatcaaacgccaaaaccctaggccgctccatctccgacgccggcgacaacccccaacccctgcggctgtccgcggtagccgagtgcggaggtagccatggacagcgccctcgcaagcgcggcggcgatcgccgaccagcgccagaagatcgagcagtaccgccacatcctcgcctccgtcatctcgtcttccccgccggacatcccccaggccaagcgcttcctcaaccacatggtgtcggatgaggtgccgctcgtggtgtcgcggcagctgctgcagacgttcgcgcaggagctggggaagctggagccggactctcagaaggaggtcgcccactacgcgctcacgcagatccagcctcgtgtggtctccttcgaggagcaggtggtggtgatcagagagaagcttgcagaactgtatgaatctgaacaacaatggtcgagagcagcgcaaatgcttagtggcattgacttggactcaggaatcaggatgcttgatgacacaaacaaattatccaagtgcgtccagattgcgcgactctatttggaggatgatgatgcagtgaatgctgaagcttttatcaacaaagcctcgtttttggtcacaaacagcaaccaggaagttctgaacttacagtacctgcccgggcggccgcgaattttagatctaaaacgtaaattcttggaagctgcacgtcgatactatggtatctctcagattgagcaacgccaaattggggatgaagagattgatgaaaatgctctggagcaagctcttagtgctgctgtaacatgcacaatattggctggtgctggcccacaacgctctcgtgttcttgctacattgtacaaggatgaaagatgctcgaagctcaagatatatccaatactgcagaaggtttttcttgaaaggattttgaggaaaccagaaattgatgcatttgcagaggagctgaagccgcatcaaaaagcccttctgccagacaagtctactgtgcttgaccgggcgatgattgagcataatctccttagtgccagtaaactttacaccaatatcagctttgaggagcttggaacattgttgggcattgaccctagaaaggctgagaagatagcatgtcgaatgatctgtgaagatagaatgcggggttcaattgatcaggttgaagctgtgatacactttgaggatgacaccgaagggctacagcagtgggaccaacagattgctggattgtgccaagcgctgaacgacatccttgacagcatgtcgagcaaggggatcgctatacctgtctgagggagtctgttcacccagttgtttcgatggtgtctgtgatttaactcgggtcaagtcgctggattaacatttttgtacagatgttttgccgttgactgatacttccggaaccgattctgctatgcgatcatctcatgtgaaatttgcgtgggaaatgccgcctgagttatgctcaaaaaaaaaa

SEQ ID NO: 10122 - DNA, 394 bp, Triticum aestivum
  Clone ID: PAT_TA_10122
agttcacaacacagcactattattgattgttacatatatgtggggacaaatatatatggtcatggaagtgtaagctgcacctgcatgtgtgcgagcaaccgtgaccccgttacatcaagtacaaaattcgtggccacgtagaccttctggcacaccctgaatcgggcgccccaccaggccgtgtgcgtgcccacctggtcctgtaacaggggggagttgcaagcaggctaattagcttattctctctgcacctggatgagcgggtggtggcggtgggcgggggcgcagtgcgggcagatgctggtgcggcaggcgaggcagaagatgttcttctcgttcttcttgcggctctcgtgcgccgagcacgccacgaagaaggtctcctccaccaggc

SEQ ID NO: 10123 - DNA, 694 bp, Triticum aestivum
  Clone ID: PAT_TA_10123
tttattacatgcctaccttaatggtgtcaaatagttcaggttcatgcaatagaaaacgacgaaaatacacatgtccaaagattcttgcagtggaaaatatggaagattccttctaaaagacaatgttaatatattcgtgaactccttatgttgcttgtaatatttttaatcaagtcttcttgcgtgtagctaatagcagacattataggcggatcggcgaaaggaccatagagccatccattggcaatgtactggtatgtggcctcggtgtagtgaactccatcccagctcacgtatgttgtggggtccttgcaggcagtcacgcctggcatgccacatatggcgctagtattccagttgtactccccgccgcctccgcaacaagcccgtagagcatcagaatcggcgactccgaaatggctaggattttcaaggattgagattattgggttgtagaagtcggcgaagatgatcctcgcatgggggtacttgcccttgagatggcccagcgcctcacggaggacaaagttgtggtaccttgccacgtggttgatgtctcttaggcagccaatatggtcgtagtcctccatcttgctgaggcttgagcgtgtcgctagcacgatgggtgagcacccgttaggaggattcccaggcacaaccacgtatattgcaccttcgctgataagcctctcca

SEQ ID NO: 10124 - DNA, 1005 bp, Triticum aestivum
  Clone ID: PAT_TA_10124
aaacgcgctttgtgctgaccaattggcaaattgtgcatgccaaggtttcaaagacagcttctcgtcctctggttgatacaagtcaaaaacacatagcaggcaggcagagaatatgcacgcattgagcatgttgaggtttacagcggttcagcttaacacactggactataatgctatactaagtagaaggcacaggacaccttcagcccttcacttaaaccgcagtttgtcaggatgccggcgatggtcttcatgtggagttctttggagcagcctcacaagaaactggccaagctgaagaactgagtcttcacttaatcgcagtttgcaggaggccggcggtgggcttcatgcagagttctttggagcaaaaagcaccctcacaaaaaactggccatactgaaggattgagtcatcgggagaactgacgggtccaacatactcatcatgaaaagtccactgaaacagcgattcatcgactcttagaagaacatccaaattttcatttctcttaaccgcgacaatatgttggaacagtttcacactcccagatatcttgtcatcaaacagcacaatctcatcgtcatagccagtgcttaaagcagtgaacttcacgtgatgaggatggtcaacctctgcatagacttgtactaccgcctcaatacttcgtgcaatgatcatgtatgtcaggtccaagttgcaatcaacacccaggaatccgaccacccagcataatattcaaaatttgcacggacttcaatctcagcatatgcagaaagtatatgcttgtcagctgatccatccccttccttccttaacccagagatcaacttctagtagtgcctcgtccagtacatatattcctcgacacgggctacaaagaggcaagtcaaaggattcctgattcacaatctctacagcagtatctctaggacagttaaagagataattccgtcgctggtccaagtcgtcgcgaacagcaagtattccatacacactaatggg

SEQ ID NO: 10125 - DNA, 489 bp, Triticum aestivum
  Clone ID: PAT_TA_10125
ctccctccgtaaactatataagagcatttagcatcatttaaatagtgatgctaaacactattatattactttacggagggagtataacttatataattgtatcacgctacaaaactggagaataaaactgtagtccctctaaaatgccacttgacaatttctgatatgaatcaagtactaagatatcttaaagatcttacttaatcttaaaaaaacagtttttctaaagcacatctagatgtgccataagtaaaaatatatttagaatcagccccaaccaagacgaacctatcaagaacaagatctttcatcagttctaaaggaggaaaactttgaaggttcttctagcccccgaatgccttctgaggatatttacggccgtagccagctcggtatcattttcccctgtgctgtgaaaaatctcagtcgctgatatccatgtgcaagaattcagtagttatgcaaagcaaaaaagatcagaaaaaaggc

SEQ ID NO: 10126 - DNA, 785 bp, Triticum aestivum
  Clone ID: PAT_TA_10126
acagaaatacagtttgtgatcgatgtaagcaggacaattcgcagctcagacacaattgaacatgatgacttgcaccgctcctacttaaaactgctcaacagataagaaggcaacatactaaactgaaacacaagtctctggcctgaccggccgcatgatcatgatgaattgaacaagaacaaccaacttgcaatcatcatgcttaaactgctaaagaaaacagaccaacttgttggtagtagctccaaaaacaaaggcaacagcagcacactcccagacgatggatttgtccattatgccttgcaccactgctgcgcggcacatcggcgatcagttagtccttgctagcgacaacaacctgccacgatctggagtgtagaagctcatgtaaggtaggacgctaaagtagactccggcctcgccaaccttcctgaccaaccctgacttgaggttgatcataaatcaagccagcatccgtgctaatgaagatgacacccacaccctctgcagaaccaaccacacatggttcgtcatcgggattggcaataggaattattttctccagctcaatgaccctgcattgtacccagtcagcagcttcttctgtatccaccttccttgaccacatataaaggctggaatcccgagtgcaggcaaagcccagtgaactgttctccatcaccatgagggaaacgtagtacacatcctctgccggtgggtcaatcatggataagaaattcttgcccaagtcatacttgacgactggattaccccaccgaactgtg

SEQ ID NO: 10127 - DNA, 295 bp, Triticum aestivum
  unsure (1)..(295): unsure at all n locations
  Clone ID: PAT_TA_10127
aggggtgaatacattnntntgctagcagaatattaatacaccgaagcaatttctaatagatnaataatctcccaaattaacaatatattttaccagtaccaaactgaaaaaataacaagttgcttgcactagtcaaatctgaatattacacaacccaaaacgttacacagttctgaacattacacttctaaagtttgcaataagttgagatcacacacacacacacacacacacacacacacagagagagagagagagagagagagagagagcaaccagattcatattcagagaa

SEQ ID NO: 10128 - DNA, 672 bp, Triticum aestivum
  unsure (1)..(672): unsure at all n locations
  Clone ID: PAT_TA_10128
tgaatcgcgatngttnatttgttnggcaccatcaagtatcgcccaaaaaaacaaacagaaacaaggaaccacgcgtctgcgcccactcaagaacgcggcaggaggatatgctgcatgtgttctgttagcgtcaagaccttgtgttgctgtaagatcaatcctatggtgtctgagacaagcaccaaactgatgggttacctctgtacatcggcacaggggcgtgccgcaaaaaaatcctcaaacccccagcggctatttcaagaagagggttatactgtgatcggcatctcatactgtacagaacccaccggcaacgggagaaggggtccatatggctccggcaaaaagcaaaatgtgggcaggatatgagatctgcagccctgtcaaacgacgatggcagaggcgaaggccctcttccctatcgccttgtagccagggatagtccagccttgcctctcgttgtaaacttccacagtttcaacagtttctccattggattcagacccgccaatgaggtacacattatcgtccgctgtcactgcacacccatatcctcttgggacgctgaacgggctgcctatcctccacgaattggcacgagggtcaaagatctccacagtggacatcatttggtctccatcgtaccctnccagagcatatagtgcttncccc

SEQ ID NO: 10129 - DNA, 691 bp, Triticum aestivum
  unsure (1)..(691): unsure at all n locations
  Clone ID: PAT_TA_10129
cccagcgtccgcccagcgtccggcttggatgaacatattgtcatccacatgnacggtgtaaatattttggctgttaattatggttccgttggtggatgccaatatccccggccaatgaaagtaccatcaaaatggacattcaattcatacactattctgaagactgctgaccaagcaccaagaactccatcatttgtagagcaattaatagaaactgaaagtggactcggtgaagtgatgaaaccacctgagaaatctttctgggctaaatattggatgtacatcattcctcttggtctcattgtcatgaacgccgtcacagcagcagcaaacataccggaggagcaagctggagggcagggtcaagctccagcacaaagggtgccaattgctgctccaaggagaagatgatgacttcatatattctttgcatgccataggtactttatctggcaaagctatttcagcatcacagacgtcgtttgtcacaaccgttccttcacctgtaagttatacccaacatcgtttaagtttcagattcccaaagaatggataggggatggatctgcttgaccttccccagaacaggggcactactagcggcaacaagactcacttgtttttttttctcgcattcagaaactcccctttgttgtagaatcccctcagaaaggttgcgtgttctggtcgc

SEQ ID NO: 10130 - DNA, 1423 bp, Triticum aestivum
  unsure (1)..(1423): unsure at all n locations
  Clone ID: PAT_TA_10130
gggggggggggggggggctnnnnnncccggccgctcagcggccgggcggcaatcgctcgtcacccaaaacatggccgcgcggcgtcgctccctcctcatgctcccgcccctcctcctcctcctctcccacttcctctccctcgccgccgccttccagtcggacgagctgctcctccacgacgacgacgagttcgagggcacccgggcctcctccaccccctcgctccggccgccctcgacgccgccggtagtgtcctcccgccgccgatccgcggacgcgacgcaggcggctggcgcctccgagtccaacaccgtccagttcaccctcgagcacgacctcggagccggcctagggttcggccccgccgggtccttctccgcccgcctcaagtcctcggcccacggctcccagactctcactaagctccgatttacgaggaatgagttgactgaggatgaaaagaatgcatttaagaaattactggaagaagatagtttttacacaataaggctaccgtctaatgtgttggatcctacaagaaacgattatatttattcctcaatcaaagcgaagatgcattccacgtgacagcttggatgaacatattgtcatccacatgcacggtgtaaagattttgggtgttaattatggttccgttggtggatgccaatatccccggccaatgaaagtaccatcaaaatggacattcaattcatacactattctgaagactgctgaccaagcaccaagaactccatcatttgtagagcaattgatagaaactgagagtggactcggtgaagtgatgaaaccacctgagaaatctttctgggctaaatattggatgtacatcattcctcttggtctcattgtcatgaacgccgtcacagcagcagcaaacatacccgaggagcaagctggagggcagggtcaagctccagcacaaagggcgccaattgctgctccaaggagaagatgatggcttcctatattctttgcatgccatagattcacaaagaatggacaggggggatggatctgcttgaccttccccagaacaggggcagtactagcggcaacaagactcacttggtttttctttttctcgcattcagaaacccaccttgttgtagaatcatctcagaaaggtcgcgtgttctgctcgcatctacacgcgtatttttgcctgttgatagaaattaccatcagtccttaactcggttcaaactgcatgccttaatattcagaactagcttaatttaccaatatcaaacattgtatgttttgctcataaccctactgtatcaacaaattcgtgctgcttgcattgcattgtcgacggtttggtgctttgactcttggtgcctgagaatatgtaaatgcttatcttcttggacaaaaaaaaatcattgatgtttaaaa

SEQ ID NO: 10131 - DNA, 914 bp, Triticum aestivum
  Clone ID: PAT_TA_10131
ctcctcaagaaatggagaagcgccatggttggctgttgcttgaggaaatgaggagatgcatatgccagcaatgctgttggagcaaggaacacttccatattctataaggccgatgccaaggaaggtgagggtcctgtggctggctgctgctaggaatagcaggcagtagggcctaagtttctttctgatttgaagtgtgcagattggggcagatcgcggcgacgaggctgcactgtgggtgttcgtgtgcctggaggaagaaggtcggacaattccgagaatcagacctgccaatatgagaggttaaatgcaagaaacgagaataaggcccatgccaaggaaggcgagggtcctgcggctggctgctgctaaggatagcaggcagtagagaagtttctttctgatttgaagtgtgcagattgggacagctcgctttctgtgggcaaccagctgaatgctaaaatgtcataaatggctgtgaacagatcggatatgattcgtacatcagatatgtggttttggattatggtaggactcaagatatgtgacctccaaggaaactgcaaactcaagatatgtggtcttggactagcaagatttgcatccagtgacacccctacaacagttttctggatggagcaggaccatgtcgccacctgatggtatagagctgatgaactctgtaacgttctatcatcaccggaagattagtactggaatattagttcgatatgctgaactttacaagccggtgtaccttccaacgtgtattatgtcgaagtgtgtgggattattgattttatgtctttatttttactaatatatatttatacaaggaatacaatcaacaaaatgtgtatttctcattcaaccagtgtcctcgtatgtaaagacaagtaatgcttcgagcacat

SEQ ID NO: 10132 - DNA, 570 bp, Triticum aestivum
  unsure (1)..(570): unsure at all n locations
  Clone ID: PAT_TA_10132
ttcgagcggccgcccgggcaggtacacttttgttgatttgtcaaaaggaacatactgtaataaacaggacaagcacctttacagaagttggcattacaataagcttaatggcctttcggaataacttctgtggcactaaaagagttaccccgcaattacagtcaacagttaatggcttcactcttagtggagcaaggaaaatagggagcacagatgaaaatgctcatacaggaagaccgtcatcgatggggagtgggaaagtgttctgcacttggagagcaaagcctttttcggtcaaaccattccttttctgggaacctttgttaggcaagccttgtggcatctgtaatcctgatccccctcatttctctcccgcagttctccgtcccttcatcctccctctttgggggcccctgcctcccccgcgtccccgccaaaataatcaatcgtgcaatcaagatatgtaggtaaacaaaagaaagaaagctgttcactacaaatctcatctaactttgtcgtattctattctccctcatgtagtaatgnttatagcatcaaaatgagagaaaa

SEQ ID NO: 10133 - DNA, 694 bp, Triticum aestivum
  Clone ID: PAT_TA_10133
tttggtggttcttgtctccgtgtttccgtctagggtctgggtctcggggctcccaggtcccagctctagccgctcgctccacttcccatctcgcatctgctacccgcagcgcgctgaaggggagagaagagaccagcctccagtcggcatttggtcgttcccggaggcctttttctgtataaacccagccaatccctgcactaaaagtttgctacgcgctcagctctctcccccctccagctgccgcgtggtgcctgctggctcctggttcttctgccttctccctgcctggtctgactaaggggagccaacaccggcctgccccctccccattccttccatcggtgcgtgcctccattgtcgccgctgctgcggtggtgatggtcgtctgctgcgcctcgcctccactcgcgctctcgagttcaccgaccgcagcctagctccccccgccggtcctacctacacccagcagaccaaccaagaacgccaagcaatcatctcaacactgcacctcgcgccccccacattcgcatcgctgccctcccattcctcttccggcacccccctccccctcccgtgatctctcgctgcctccccgggccgtctgggccgtccgcacgccggccatcccccctgtgccttcagcccccgccccggcgcccgcaacacacactatgcaaagccattggataga

SEQ ID NO: 10134 - DNA, 763 bp, Triticum aestivum
  Clone ID: PAT_TA_10134
aaagaaattacctagaccacattcatcaacaagaaaacaccacgtatggcacaagctgatgtgttagcttcctggggtaatgctggaaggtcttcacaaccatgcttacactcggtcgtgggagttcatgtcggacttccagccaagcagcaggcatgccacctcctgccaccactcgcaggtcgtcatgtatagcaccatgtgagctcctcaaccccgctcacgcccccggcatccgtgaccaacagccgcattgtcgtgttcaccggtagcctaatccccagatggtaaagtatcaaacaatatgagcagtgtcctaataagccctctagatacttcactggtttaagaatcttttcctgacataacaaattttgaattttcctttgcacatgtttgattgagataaattttgaacttcctttgcccatagtaatatatctgaatcagcgcccgcagagaatgtaattttcatcataggtaatcttttgcttgggaagaacctttccaatcattttattggttcatctgtctctagtaaggcacatgcaaacttccctctatttgtagtctgtaaaaagccttgggtatttctcggttttatagtgcagagctcaacaactgaaacatcaagatggaaactgggacgggctcccctccgtcggatgtttgtagacgacatcataatcggggcaagtcatactatgcctctgatgtgtcagacattaccaaacggacaacggaggcttcgccagttcctcgt

SEQ ID NO: 10135 - DNA, 1377 bp, Triticum aestivum
  Clone ID: PAT_TA_10135
aacttcaactcacgattcaagttgaccttaaataagctgtatgcttggagcttagtttcctatgaccgagttgttatgctagactctgacaatatgtttctccagaacactgatgaattatttcagtgtggccacttctgtgcagtcttcatcaacccttgcatcttccatacaggcctctttgtgctgaagccttctatggatggttttaagaacatgctacatgagctagctggtgggcgtgaaaacccagatggtgcagatcagggcttccttgctagctatttcccagacttgcttgatcagccaatgttccatccaccagttaatggcaccaagcttgatggaaattaccgccttcctctaggctatcagatggatgcatcttatttttatttgaagctccgctggagtatcccgtgtggacctaatagtgtggttacatttccaagtgctccatggatgaagccatggtactggtggtcttggccagttttacctctgggactttcttggcatgaacaacgtcgtgaaaacctagggtattcatcagagataccgatggcattattccaggctctactgtacattggagtcatcgcggtgaaccggctagcacggcccagtttgtcgaagctctgctacaacagaagaatggagaaaagcaccatgttcttactcaccacgctcagagtagtggcagcatggtccatacttgcagcctacaccattcccttcttcctcgtcccacggaccgtccatccgctgctaggctggccactatacctgctcggctctttctccctctctttgatcgtcatcaactttttcctcctccacccccttgccgtcctcacgacatggttcgggatcatcggcacgctctttgtgatggcatgcccatggtacacgaacggcgtcgtcagggcactggcggtgttcgcgtacgcgtttttatgcgcgccggtggtctgggcatccttggtcaagataatgagctccttgcaggtcctgatcgagagggacgccttcaggcttggggagcctaaccagacggccgagttcaccaagctttactgaggtgggcaggacagatacatatatggtgacttgtagtgtcgttcgatttgatcagctaatcccagttcatgttggcaattctgatggccatttcagctgtacaagtaaaaccgccgagtttgggaactacagttgttgaacctatgtaacacgaactggaaccattggaacccatgatattgtcctcttggacgtgtagatgatatatatatggtgccgaggaaagggggaaattgatgcttgtgcgcatgtgttggttctggtaaaaaaaaaaaaaaaaaaaaaaaaaaaactcga

SEQ ID NO: 10136 - DNA, 796 bp, Triticum aestivum
  unsure (1)..(796): unsure at all n locations
  Clone ID: PAT_TA_10136
ataggnaaccttttttctaaaaaaaacaagnaacctggcacaccggcgcactcagcgttgtaggtatatgacaacgaagaatgtgtacacctgaatcacctagaccagacattcccttttgcatactaaaaaaccagggaatgctgactataggaggaaattagattcctctcacgaccatattttaacaggctagtagttaaacaagtgctaaggttcacagaagcagccgcagcataggatacgcgaccctggaatccgtcctgtctggcgaatcagatcggccttctgaactgcccttgctgcttgcttgttcatcttggcgttggctgatgcccgcttctcctcggccacacggcgtgccagctccagcctttcggccatcctcgccatggcctcgcttctcattttctccgcgcgttcctctagtctcttcatttcggattcaacttttgttctttggcggctctcccatgcttcgatcttcagctcttccttcttgaatcgtgccgtgtgtttagaattttcggcgtcctcgaatgctgcagcacgagtagcatattcctgcttcatcctctccagatcagcgatgctcggcgtcgcagagactaattctagctcctctttgctagcccatgaagcgatgttcatctttcctagttgtacacctagggcagcaatttctttccttgccttgagcctgatttcatcctctgacaattcattcatgccaccttttctgttgaaataaggaccatcatctgcattgtcttctcctattgatgccgtcgatcgt

SEQ ID NO: 10137 - DNA, 707 bp, Triticum aestivum
  Clone ID: PAT_TA_10137
taatgacctgcacaacgtaatttttccctaatttaattgctggtattgaaaattgtacctaatttaaacttgaaagtaggctatagctttattcatatccatcaggttcaaacaacccatgacattattcgattcacaggtacatatgtttaagaattacagaagcaccaaataaagaatgatgtaccagggttctatacttgtagtattacagatggtaaagaaagaggtgacagacattccggttgctgaacaaggtgaagcggaatggccctattgtgctctcctggatgcagaaggcacgcacgactctagtccaaccccttgtgatggtcggccgccaatcatgtagtttgagaggtaatcctgagtaaaccgcttcaggatccactgcaaaggaaaaaagattcagacattgtcatctaacacaactcattacgggcagtaaaaagaaggctacagggttcttacttaccatcctgcagttcaccctttgtcttgcataaagtgtaaacaaatagttcgattgacatcttttgacccattttagtaacaatctttatcagtttcctcacttgatgctggttcatgaatatctcattgccccatacgcggaaaggattggagtgtggatctttagcaatgacatatgtacctaaaagcaccaagttaatattacactactaggaaaaagctactagcagcgc

SEQ ID NO: 10138 - DNA, 467 bp, Triticum aestivum
  unsure (1)..(467): unsure at all n locations
  Clone ID: PAT_TA_10138
ctgtagtctatatgcttntcaacagtgtattatctatgagtaagaacagtaacagtagccttctctacgagcttatagttacaaaaagtgaaaagtcaaaacaacattgcaattaacgagaacaaacacttcgtagcaactaatcaacaaaccttggttaacaaacagacaaagtactctacggcgcccgaagaagaatcgctaaacacagttggagcagcagggccaccatgcacgtcgtcccacggtgcaccgccggtggcgaggacgccgacgcggtcgaccccgtgatcgggttgtcgtgctggtagtaccacgggaaccacggcaggaccgggttcggcggcggaggagccggcccggccgggacggcgctgaacggtggcgcgaggaaccccggcatgaccccaggcggggtcagctggaagctccctggcggaggtggcgggtagctgccgccgaagccg

SEQ ID NO: 10139 - DNA, 1127 bp, Triticum aestivum
  Clone ID: PAT_TA_10139
cgtccggaacattgtcggagctgacttgatttgcaatttcgcgactgaaactatcatccagatgggatgaagaagagaagctggagcaattcagctcattcataacacctaataatcctggctttggccaacactctgcacgaggatattcagtggtgccacataaacaactgcaagaagatttggtcgctaatcggggaggcattgtcggtggtacaaataatttgtgccaagtttcattagacaataactctgtccaagtatttgatatagaagatgacatgccaattgaaggtgctggctttgattcttcaaaagcaaagaacgagatgatatgctctagcatggatgtcataatgcaccctggcatacatactgatgatcttcctgtaattgaagatggttacaatcttacactttctgattatctagcggctgatataccatgctacacatcattgcgacctgatcttcaagctggtatatgtaccaatgattctgagggcatccctgtcatggatgatccaatatatgggtctctcactgatattggtttcatggatgtttggagccagccagctgaggacttcgagaaattcttctaatccgctgccaaaaccgggaattgttcaaaagcgtgacaaaaataacatgtgtagcatagcgtagggaagaataagcagattgcccctcctgtcaaagaaaaggcaatcatactgtagcaatagagaaattctaatgccgatactagtttgatggagcaagtctctgattcaaagttaattttatgtgcagttcgatattgtaggatatgtagattctttttgctgttttattctggaaatagttgcggaaccagcctgcatatattggatgattgaacacagcattgttttgcgaacgcgatctttctccagggtgaaaacctaagatcttggtcggcctttggagaacctcatttgttgtctgggtgctgtctttagtagtggttagagtgctgctactgcgggtgattgatcaccgtggcgggtcttttttctttttttatccttttattttcttttcttggttgtgtgtattcttggatgttttgtaggcatctatattgttgcagaggctggatgtaa

SEQ ID NO: 10140 - DNA, 738 bp, Triticum aestivum
  Clone ID: PAT_TA_10140
ctgggtccttcaccaggggccgttatcatgaaaattgacggacagtgtacataggtatcttgttcaaggactcgagggtaaaaagcgccgcacagtgcacattggtatcatgttcaaggactcgagggtaagatgaaccccagttctggttttggtaagatggattcggttaaccacgcaagaaaatagagcccaaaaatgtatgcaccgtccagtgcatgtttacaccctttctgtgtcagatcttctaaaatgatgggcccgcaagcccccgtcatctaaataaagagggtgtgaccattgagggtcgaacccctgtgtactgcatctaggcgttgcttgagtccatcctgtcgcctttttagacctccacagaagatatcacccatggtgcaagcatttacaaggatcatgtcaaactgtgtacccaagttgaaaattactgtgctcagttgatcttgggcttcggcctccttggtcgcaaaagaaaccaaagcaacccaaaaacaactataaaagcagggatggttgtcatgtctagctgtacgtcaattttcctttgacgagcacattttgcagggtgtagacttgagatggttgagttcacagcatgagaaaatccattagaagcctcctcgagcgacgacatgagctttaccgcatcaccataccgcaaccctctagacataaaggcaacccttctccacatgttaacaacggaattgtacttttcaacca

SEQ ID NO: 10141 - DNA, 425 bp, Triticum aestivum
  Clone ID: PAT_TA_10141
cgtccgatgcggcccagctagcagtagcagccgacttggtaggcgtgacaggagattgctagctcggagcaatctgcggtcaccgacgaagagatgcggcccagcgagcctgatgccccaaagaccccgtcgtcgtcgaagtagcgctccgaggcaaagcgatggtcagaaggtcgtgacccggtcgaaacagcagcgctccaaggccaagccacatggttcagaaagggtctaatcggtgatagacaaaatcagatagcagtaagtgaagtggtgtatataacagagggattctattcaacaattcccatagggtttgttcttgtagccttttgtccaatatacatagctgtcgatcttggttggtggatatgggttgtggataaattgcagagctttttttttcccagcgttttggatctatc

SEQ ID NO: 10142 - DNA, 1024 bp, Triticum aestivum
  Clone ID: PAT_TA_10142
ttggtctcccaaagctggagatgcagaaaaacttggggacggatggcactcggaggagggtcctcattcagatttttctgggccaacatgtggaagcacagcgtgcgtggctatcataagaaatgatcaactggttgttgcaaatgccggggatccccgcggccggatctcatcgacgggtcaggctcgcgatttgtcacgagatcacaagccagaacttcagtcagaaaaagagaggattgagaatgctggtggttacattgttgctgggcgggtcaatggaagtttcaacttggctactgctgtcgggggcccggaggtggtagaaaataagcttttaccagccgagaaacagactgtctcagctgaacctgaagtgaacacagttacactttctgaggatgatgaattcattgttttggcctgtgatggtatatgggactgcatgtcaagtcaacaagtagtggactttgtgcacgaaaagttgaagactgaggatagtctatctgccgtgtgtgagaaggtgctcgaccggtgcttggcgcctgagagtggtggggagggttgtgacaacatgacgatgatcttggttgtgctcaagaagcctaccgacccggccgctacttctagctcggagcaatctccggtcacgcctaccaagtcggctgctactgctagctcggagcaatctgcagtcaccgacgaagagatgcggcccagcgagcctgatgccccagagaccccgtcgtcgtcgaagtagcgctccgaggcgaagcgatggtcagaaggtcgtgacccggtcgaaacagcagcgctccaaggccaagccacatggttcagaaaggctctgatcggtgatagacaaaatcggatagcagtaagtgaagtggtgtatataacagagggattctattcaacaattcccatagggtttgtttttgtagccttttgtccaatatacatagcagccgatcttggttggtggataaattgcagagttcttttttttccccaaaaaaaaaaa

SEQ ID NO: 10143 - DNA, 808 bp, Triticum aestivum
  unsure (1)..(808): unsure at all n locations
  Clone ID: PAT_TA_10143
ttttttttttttttttttttttttttttttttttttttttttctttcaaacaaacaattgatgtgattaacatatgcatgtgccagcanttcatactactgttttgcagcagcccccattttacaaggaacatcagtccaaatgtacatctcagtttacacttcaaaactccagcagctcagtttttggaaaagaagtcatgtccttccggtaggataagataaattgtgactgacatcttgagagatgcgcctagttagtcataaaactttgtctttctttctggtgcttgcaggaagcagctgtaacatgcagaagaacgcgtctagagaccatgggtcgtaaaacacaagacaccatatgttgtggcactagcaaatccatgtcgcggagttgcaggtcacctacatatgccaggagtgcatgtgtctaatcaaagctccgtatggatcaggattgacaccttcacaagacatcaaatgcagcagcagcatacggcttcttgtcacgagcaaatccattttgccgaggtcatgggtcgtcgacacgccgagagttcatgggtcacgatcaagttgactatgcatcaggatctagaaaccttcacaagcaagaaatcaaatgcagcagcagacggcctgtctgtcacgagcaaatccagagcggtgggggtggcctacgtgcctcaacaaacaattgtatagagagcaacatcatcatctgagaacaggccaaggaatccaaggtctttccttacctcaagaacaagcatgaatgaatactcgtacctgcccgggcggccgctcga

SEQ ID NO: 10144 - DNA, 848 bp, Triticum aestivum
  unsure (1)..(848): unsure at all n locations
  Clone ID: PAT_TA_10144
tttttttttttttttttttttttttttaaaagaaattcggaaatattattaataggtagcgcttatatgaacatagagtagcagtcttacatcctacaaagacttatacctatagagatgatggactgcagagcctaaattttctaaactcaagcatccacaaaatgaaatcatctcatgatgatgatgaatgataaccactaaacataactcctttgtccttttttgttgccacgaccattcgactaaaattttaattatgaaagagatgacagcaggccgatgatctgaactacaaccgaggagttctttcctccctctttctctaaattacatgtctgcaaataagtttcagaacaacagggatggcatggaattccagtgaatgaaaatgaataaattatggctgacatctccgtttcaccttcgaagctgcatctcacaagttgactataaccattctagatgctcataatctttggaagtccatcaagctttgcagcatgtacaaactgcattactccgtacgtggtttcattggaaacaccgatatattgtaccttccctttaccaattagttcctgaaagctttccattgatccacacatgggacgcttggcctccatttggttgaattgtaactgaattcaccgtaacgtgcgacatacctatctagccggcaatttctgcggtgtccagtatgttgatgccctgattaaaagaataagagagcatatcatgggattccttctctgttctttgctatccaaagatcattgttctaagagttatctcgctaataaggagatctgaatctcccagcttcttnnncggcctggtgccgaatt

SEQ ID NO: 10145 - DNA, 636 bp, Triticum aestivum
  unsure (1)..(636): unsure at all n locations
  Clone ID: PAT_TA_10145
nnnngttaaaataccattattagtaattagagtaagctggttatatagcaagggaccgaangactaagtagcacattacaggacagtcgaacatcacaaaatactaaaagcaaggcgtttatacaaaggctggtgacagttacatagcagtcttgataagtacacagagtgagaaccaatggtggagctcatcatggcgagtgataccgctggaagcatatgattgccaattccaaccactcgggtatcgcttcatcatccagaatctcatcggagtccatgacgactataaccatcgcttgtctttggatattttcaaccgagagcagtctcgtacaaaggtatctcccctggcgtcgctgctgaatgctcgaccctgggtggcctgaagtgcacttatcctgtccaaaaaatcattggaccttctttgtgtggcctgggtggcctgaaattaatcacacacatgcatcttgaatcctgttcatccgtaaaggataccatgttggatatgtcatcttcatcctcgtgctgggtggcacacatgcatcttgaatcctgttcatccgtaaaggataccatgttggatctgtcatcttcatcgtattgaaactgatgaaagcatgccacaagaattag

SEQ ID NO: 10146 - DNA, 1121 bp, Triticum aestivum
  unsure (1)..(1121): unsure at all n locations
  Clone ID: PAT_TA_10146
gcaaggnattgacagnactgagnagctctttcttgattctatgggtggtgatcccggtggtgacgcgcggctgcagcctgcagccgagcatgaacaccagcaccaggcacatactcaagtacctcaccggcgaggccaaggcgtacgtcaacgagtcgcacgcctacgtgcatgtcaaggacgccgccgaggcgcacgtcagggtgctcgaggcgcccaatgccgggggacggcgctacgtctgcgccgagaggacgctgcaccgcggcgagctctgccggatcctcgccgggctcttcccggagtacccgattcccacaagatgcaaggacgaggtaaatccgccaaagaagggttacaagtacaccaaccagcctctcaaggaccttggcatgaagttcacccctgtgcaagaatacctctatgaagcggtgaaatccctgcaagagaagggattcattcaccaaggcttctggcaccaaggggcctgctagtagagggagttcgccgcctcagaattcaacggcgcccgtgtttatgtcgaaactttgatgggcttctgcacaaagtaacaatgcagttcgccgtcatgggaattgtaattcatttgattaagtgatatgtatgttgctggccagttcttgtatgtagcaaactgccaactttgtgtagtagcgccgtgttggcctgcactgttgcctggaacagtacaccgctacagagcaacttcagtgatgcatgccaaatattttccctggtcgatgttctcccccaccatctagttgttcaccttgtctgactcagcgggtacaaaaacccgatcaagttggcacttggcagcagagcatacaagcgtgccctctttggactctcgttcggagagtgatgctgttttggccaacttctgcttgttgttggtcgtgatcttgtttatgcgcctctactaactccctttttgatctcgtgtatgcatacctgtcgaaattgatggtgcagcttgttacgttcgctattaacatgatgctcttatcctaagatgcaaactagatctggcaaaagcaaagtgaggccaccttccttgccaaatatagctctntncttagtttactncatgctccttt

SEQ ID NO: 10147 - DNA, 657 bp, Triticum aestivum
  Clone ID: PAT_TA_10147
ttggatttctgtcgtccgtcattgcatattttgcataaaagcccttgaggtttttttattcaacccgcaatcctttttaagggggttaatctgaaaaaaacgattcgttcttacaaaaaagaccctgtattttcgagtatttaatccttattgcagggggcagccatgacggggaggcggcgctgggcggcgcagctaggcgggaggagcgctctgaaatgaaggaggagaaaagtggagagtcggcgggctgggtcaacccatcggcatctcccaatcgatccggatcggagcgactcaacgagcctgcgggccggtatgcggctctcctgcagagggcggcgaccgatgggcgagcgatggcggccgaatccaggtgagtggcggcgggaccttgcaaggcgccgggtttctctgaggcggcgccatggctgctccggcgtgctcctgaaaaaaaacgagggaggatgagtgagagaaagaaaactaggaggaaggagagaaacgaggggaggcacaggagtgcactgtgttgctggttgctccggccaagatgggatgaggcgagacgctcgtctcttgttaaaacaataaacaagtgcgaagattcagccgagcattgctggttgaacttgtcagcttcacaagttgactcca

SEQ ID NO: 10148 - DNA, 548 bp, Triticum aestivum
  Clone ID: PAT_TA_10148
cccaagcgaccgatatctgttgatgacattgaggtgtttaagtttgaggaatttgatgacaaggacactcctctgatgccaaagtctgagcatcaaccgaaggtgaagaaaccgaaggctgcttctgcatctaaatctgtgaagggcccttgtgtggacaaaaacgcaacacggttgatgaggggcatgccatccgcacgaagaaaaggcctgctggactgcatgatctcacagcagaatgttgcgcaggagccccgcaggggctctcgaagtgaccctctgggcaaaaagaagacgtccgctgccaccgagttggtgtcagttctccagtactaattatttattctagtcaggttcgaatgtctaaaatccttttgctgtacgtagtttccaatccatcccttttctcggggaccaactcaggatgcaatagagcttaagagtttaggctaagattttcctttctgctttctgatatggaattccttgcccatatatataaaatatcttttttgctgaaaaaaaaaaaaaaaaaaaaaaaaaataaa

SEQ ID NO: 10149 - DNA, 469 bp, Triticum aestivum
  unsure (1)..(469): unsure at all n locations
  Clone ID: PAT_TA_10149
cgtccggggaaatggaatttcagattccaaaaaaatggcctcagaagtaaatggaacagttgaaacttcatggagaaaaccacattatgctaatgtagtttcacaaggatctagcggaccagctcgccgcttgactgtgcttaccagggagttgacatctactgatacaaggtctaaagttacaggacaagtaggtagctggatatcatctaaagctgcaggacaagcatccagttcgatatcatctactgatacaaggtttaaagctgcaggacaagtagttagtttgatatcatctactaacacaaggtctaaagtggtttcaaatagtagttagttggacatcatctactgatacaagatctaaagctgcaggacaagtagttagttcaacatcatctactgatacaaggcctaaagctacaggacttgtcgtgcaactttcctcaacattgttaacnccatgttt

SEQ ID NO: 10150 - DNA, 976 bp, Triticum aestivum
  Clone ID: PAT_TA_10150
ttttttttttttttttttgcaataaatctctttttttcatttttttttttttttttttagatttaatcagtttcacatttatattctgggcaatatatagcaagtccttaacggcgctatacaagtatacaacacaaccttttttttctactggctatacaacacatctaattcaactgacctctattatttgtcattccatttttctttgtcgagggtatatgtaacctgtgctacaatgacaaccaaaggttaactggttttgatatttctgggataagcagcaggtacccttgattgagctggctgaaagatgtcaaatgatgacgatgctagtgatctcctggatgccataggagaatcagacagtaggggctcgtaaactgagttcttattcttgactggcgctgtcaaactggcgttggtcgaattgtctttctctgatctgagttgagattccagatttaccagggtgtacattggcccacgagatcgctcggccttctgaagaatgttaatcgcactcggactgtatgtgtatctgaaatatttcagagctaatacaggacccatgccaactccactgatcagcagcagcgctatccgggatgacggttgtctgcaaaggcggaacataacggtgtacattccagaagtgggtatactgctgataaaaaagttgaggacatagaaggcaatgaggtttccccatatggccagaagttgcagaaatgtgaaggaattcatctccaatgtcacaacaaatgcctgcaaccaaatgcttcctgagagtgcaaccattgagagctcctccatctcgcttttctcattagcgtatgcatggatggttattaagaaaataacgattgcatgatacaacgatcgaccaaaccaaccagcaaaggtacttggattgagaagccttccagcctggcagtaaagtaatatctctggattttgcatcactgtcttttca

SEQ ID NO: 10151 - DNA, 561 bp, Triticum aestivum
  unsure (1)..(561): unsure at all n locations
  Clone ID: PAT_TA_10151
ttttttttttttaaatgtaacgaacgacacaacactgacaaatagaatgcggctggaacttacaggatgaggtttacacttgactctgcagagtcacagcctacaaggtatatgctgactatctgagaagggaacattccattccccagccaataggtcagccttgaaagacaattttgatgagtatacatatatatatatcctaagaaaggtgcaagcctataccaacaagtaaaaaagtttctggcgaaacaggcgtgtagggtgtgtcaattcaagtattcaactgcacctcagcatgttcaagatcttcagagttggaaacgatggtgtcccaaatatcatttaagggtgaatcatcacatcaaacggccagcatattgtgctccaaggtatttttgttgcanctggggccactgcaccaagaactgattggncatccgtaacttgtacaacagtnaancacttaacgaaacttctcaccctgcganacttcaantaaaatggnggacatccagncaacacttcananaaaantgancaatangggatcatnccgga

SEQ ID NO: 10152 - DNA, 1208 bp, Triticum aestivum
  Clone ID: PAT_TA_10152
tacgagccactatagggcgaattgggtaccgggccccccctcgagttttttttttttttttttagaaagaattctcatgccatttcaacttcgaaagatggccagtacagaatgatcttatacatcaggaagaggcaaagagatatgccatgtccagttgtccacaaggagcaacatgctcatagaaataaaagaagaaagaaatttgctctgccttctagaaaaaatcatgccatctacaatacaacactctgttaatatctactcttgtcagcgccattgcttcgcaatctcctcatcaagcatatgggtggcctgctgcctggacctatcatccagattggtattgcttgccaataaacttcgtagggctcgcagttcatccgggctagctctctggaagagccccctcaggacaatacttggtggattctgaggtagggtatgttgattactagtggcagcatgaggcctgtatctccagtactctgtacagatgcgatctctatcccgagcctcaattgcccgtaaaggtttaggaaataagtttcctgcaaatttaccagcgacctatggctccagcagactaacataactggaaatatctcctcccgtgaatgcctaccgacccacttccatcctcaacccccatctgaacattctccaaaactttgcacgcgaactcgttatggaaacttcaccctggccagcacctacactgtttgttaagacatttgtttttactgagaacaccgataggattgttttattaataataaaatatcattttataagaatatgtacaaaaaattaagggattggcaagtgcaaggtcaagccccaaagaaagacactactgacaggattagtgttgaactcatccctaattatatgtgactgcaggagcaagcctttcttaaaaccggtctaccaggataggaagctggggatgacattttcaaaataatggtattggtcctgaaattagtcaagtgaatgccaagcaccaatgtctcacccgaactatttctggtgataagagcccaaacatttcaagaccatcgatagatcctggaggctgcagtgtaggaacgttaggccttcccatactgagttgcctccgtatttccatgttcagcctctctctgaccatgttccagcacttggtaggcgactcattaatgaaaacttcacctgggctcgtgccg

SEQ ID NO: 10153 - DNA, 614 bp, Triticum aestivum
  Clone ID: PAT_TA_10153
aggatgttgctttggaggacaaggaagatctattttggcagcaaggagtgttaatcattcgaacaatttatcatggtgctatggaagctcttccgtcaagcttaaccttgaggaagaaaatcttggagatattaaatagtgttgagctggcacattctgaagagctgaggttggaggcgtccgatgacctgaagaaagatttctctcataatgaggactactgggattggctcgctaggcttcagcttagtgactccactaattccagtactttgaatagaaaggaagctgtattggataagcttaacaaatcaattcaggtgtatgatgaagctgtcagaaagttgcctacttccaaaatgtactccctgtatgcaaacttctggttgggtgttgtattctccgacagagaggactccatctcattattccatgatgctgattttgatgcttcagaattcacttcagctatactgaaagtttttgaaaatgctgaatcgtgtggatgtctctccgaggatcttgcctgccagtatgtctcactttgtttgaaacttggaagatcagaagaagcacctgaaagaatggggaaggttagaatcttgcgaaaagct

SEQ ID NO: 10154 - DNA, 863 bp, Triticum aestivum
  Clone ID: PAT_TA_10154
tatctcgtgaaacaatatcttaatatacttggtctacttccactggttctagagctgatgcggtccgccctcgattgtttttcctcgcgtatctgtgtctttcttgcacctgttgccagtcttactgtgctacggccggatggccgggtccatgcgggccagtgctcgctcattactgtcgccgcgctgctctggtccggtgctcgccttcctcatcgccttcgcgtgctgctgctcgtcggcgccatctttgtcccccgatgggtctagtggtctttgttctccatgtcctctgcatgcctctcactgagggaatgagcgtacccctgcacgatgtccttgcccatgactatcccactaagccacagaacatcgtgcgatgctaggcaattcagcggcacctactgcatcccatccagtggtcactcctgggaccctctgcagaccaaaagtacagcacccaaaacggctcagacttccccagcgttcatccaccctggcggttgcacagaccatgtccccaaaatcagaccactgtgagctcttctccatcactgcttttctagcatttccggcttccaccgcaatagaggaggtgaacatcgcggaccataagatacgtcagtttcatatggtcctaaaccattaatcctctgctgcataatgtgtttcttcttgtgacccttttgcgacaataaataagtagaagctgccccttcaccctcctcatagccattgtcctcagctcacttcgaaacaacatatagaaggctaaaacatcagtaagagcatgagatacatgcaaatacgacaggaagaaattgaggtagtattgataaataatacatacaacagatatctca

SEQ ID NO: 10155 - DNA, 768 bp, Triticum aestivum
  Clone ID: PAT_TA_10155
ttttttttttttttttttatacgtgcctatgcacgagagcaatatatcatgaccagtagcctcgtcatcatgagccgtgcagcaagagaacaagaaacgagacaagcaagcaacgctgcactctgtcaaatgtagtcaccctgcacaatcttcctggcgatgaacttccccaggaaatcaaatccatggcagtagagagcttcgatctcagcacgcgtgcccgtctccaccatccgcgtcaactccgccctgtgcgtgtcctgcagaaacttagatgacagcaagcttttggcgatctgcaaatcacgaggtttcaactcttggaatgcactctgagggataagttgcagatcatctcctcttaggccaagccattttacattgcaagcgggtatgtatgtttccaagccctttgatttgcttccatggttgtaagtacactgtatcgagcgcccggcaggcttcccggcctgattccaaacccattggtatgcttccaaaattctaactcactcattcaagacaacccctcgtggcgatggaagcatggccgagtctagtgccctcgcaacacgaacgaccagaatattatacgtattcacctaacagacggcatatgttcgcatcagccacttcactgtgacttcgcgcctctcacgcccatgctactctgctcgtccggtccgggccccccgtcttggcgcccccagtccgtccctctgccgtgcgctccggggcttcgtccccccgtctacaccggacgcgtgg

SEQ ID NO: 10156 - DNA, 1716 bp, Triticum aestivum
  Clone ID: PAT_TA_10156
ctttttctctctggttattacctcgcccccggccatgacgggccccgcgaccagcgttcctactgtgcgttcattcactcgttgcggccgctcgccgtctgcaatggcaacacggtctttttcctccccgggcctaggcagccccgcacccccctggcgccattgctatctctcacttggcgcggcagctttgcgcctacactggctggaccgaccttctccgctgcgatctgccccgtgtcgggcttcgcgactgctcgcctccctcccgccttagccttccctgggttggcgtgacagccttgcgccgtcgcgttccgctacgttccccgccccctccgccctccctctggcgttctccagcgaagcctcctgcccgccctgccgtcgcctgcattgggtgcgccctcattgcaatagcccacttctcttcccccaacccatggctattacgtacaggatcgtgcacccagcaatggtgccgaaagtggtttcccaaaacttcacatgcgctgctcgcgtctgctcctcgcctacgggggtgtaaagagagatgccaatgttcatcccgaaaagaccaacgacagccactccggcagtaatgacaaccgtcgcggtcgagagcatgacccccatctgtagaagctgattctgcttgtcgtccaacattatgttgatgtaatcctcggtgtcatcaacatactccctcagatgcgaaagcttatttagtgtaccgtcaatttgcacaaagtaggcctctaaaagcatctccagttcttcaatgttgggcttataaccaatagagctgccattgcttgcagttccagctggctcgcttcgataatcctcatccatatcctcctccaactgagatgggtcatgatcatgatcatgatcatcaacctcaactctagatgaagtctcactgatatcttctcgagcaagtttttctgtcaagtacatttcagccatatccatttcatcgtccaatagatgctcaagctcatccctcaccttctgcacgcgtccagagattgccaccagccggctcttaatttgcctaactcgctcaagattcagggtactgatctttgaagttagctcatccaatgctggatatgcctctttctccagagtcacagtctcctcttctagagatctacaagccgactcgagacacacttcaagcgcacggaactcaaagggtaaaaccttggtgcttccatctttcatagcagtcaatgtgggcacactgctgctgtgagtcatttcacccaccgcattaggagtcctcttagccatctccagttcatgtcctttagatgaactaggagcaggaaatggtgaagcaattgcagatgattcaccatccatatcagtaaactctgcagcctggtccgcggagtaagcgagcacgcgggcctggaggtcgcggacgaagcgcgcgaagtcggggtccttggagttggggagcagcacctcggcggcggtgatgacggccttgacgcgctcgaggttgaccacgatggcgcgctcgcggccgaggatcgtggacgggtaggacaccaccgggtcgagcaccctcaggtcccgcgccggcagccccgtacgcgccatcaccgcgtgcttcccggcctcctccacccgcgcccgccccgacgccggcaccaccagccactcccggctcgccgccgccgcggcggcggccgcccccgc

SEQ ID NO: 10157 - DNA, 1071 bp, Triticum aestivum
  Clone ID: PAT_TA_10157
tttttttctgtctgcttggttgtgtctctggtttttgttgtttttggtcttccttgttcttcttttttttgttgtggtttcgattgaatttgatcatccaatatcttcttgattaataacagcagaaggttgtgaccaggaaaagttgatagtggtctaccttgatctacaaaaataagttgtggaaactataaaaaatgggaagagaaaatttatcgtagctgggataatctaaaagacaaggcaaaaaagttgatggaccattgcaacatagaaaatgccgttccttcgtctgagcagatagactgaacactgcttcgcgtctcgtcgctggctgcccacttgagcgcagccgcggccatgtaaaatctgctgccaaattggagtcgaccttcagccattctctgtgcaatcactaatcagttccgacaactcaactatggtacaacaaaggcataggaaagtacctcagatgccaacgggaattcgctgcagcacaaggtgagatgcctcaccaagacacatacatcaaagaaacctcgtacaggttcaagtctcgacgcaatcagccctgaaaggaataattgatgacctgcttaattaaatgatgcattcatattccccacaattcaaaatcatccgcggggagcttcctctctggctctggcatacttgaacaggaatacaacagcagtggtcgggaatagtagaacaaacatgaccgtacaacaaacttcttcaatggcagtactacaagatgttgacaaatgatggagcatcttcccttggtcctgccaacgatcgatacaggtacagcttatcaacggtatccatttccccttcattttccttcattacttcaaccaccagattaggcatttgctgagctacatccccacaacccttcacagttagcctgcatgagttcatccaaaagaacctcatgttgtaaaaatagttcaggccagagagcaatcctttgtcgccaaaagggctatccctgacctcaagcttctgcaacctagtgcacccctcaaacacgtgttgaagagacatgtcactattcccggc

SEQ ID NO: 10158 - DNA, 898 bp, Triticum aestivum
  Clone ID: PAT_TA_10158
tcggccggcacgagctctccctctccctctccctctccccggctgctccaccgggcgtctgcttccgcttctccgttgctctcggtcgcgcatgcgcgctcgcccccggcccccacgttcgtctgctccatccactgcaagctatccggacatatattgtatggaagaacccatgtgccaagcttcctggctcttgcgagtgcagattggaaccaggcaccacagggcaaagcatgttcaggtctgcaagtgataatggttgacccacaggaagctaagcgcttagcagtgagacaaatgcaagaaattcgtgccatgagagaagctgaagaaacgtcgtcaagcagaagctattaacggcgcattcgcggggatcggcttgacgccgacgctagtatcggagcattggacggtgataggtttgattggagcgttggtattgtatatgtcggacaggaaaggttatcttggggacagactgcagctcttcggacagctttgtcacttttttcgtcgagcagtgctcgaaatcttactggcgggattttgtaaatttcctcagcaaataggagagctctgaactcttaccttgctggatccaacctaattttcatatctcaatcctaagctcggatgtacaataacgcttggatttgcacgtgaaatgatctactcggctatttttcctgagacttgaaaatcaaacgttgtatttatattcttttcccatgtactcaacattcaacaacgtattcccttccttcttgaaaaattgtactaaatagtttcccatgattctgtttagcagcttagtggtagttcgatccaccggtcatatatatgccacgattttaggtcggctcccttgaattttcttttgcggttggtgccactgtta

SEQ ID NO: 10159 - DNA, 700 bp, Triticum aestivum
  Clone ID: PAT_TA_10159
cttttggctcaccacaacaggcaccaatggccaatatatataatgatcaagaataatatgagatatccctataggtattgtattacaagtttacaacgggcatcactcctaccataaaaacagtaatttaatctagtttttttccagtagaaatgagtaacacagacagaaagggccttctagttataaaggaaatattgtgtactaacactggcactgcctattgtatggttctgttgcaaagggcctattaagcaaaattaaaggacaaacctatcgacctaaagctaagaatggcactcttcatgcactgggcactcaagatgaaataagcttctgtttctcctcatcatactcagcactgtcactttcatccttaagttcctccgatgccgttccatgctgagctgatgcgatatttcctgctgatagagtactccaccagcaagagtgaatagcaggctaaccaaaccaaatgcactggcgtgcttgtcccagattgtcacattgattgccactgtgaggaacttgttcacaaccccagtcaccgtgaatgccgtggctgagattgctttcctagccgcaaagccaaagaagctgatgagtaacccaaacaagcatgacaatgccaccgcgacaaaggcatcaagctggaaccaaccctcgccccgtccttcccccgccccgtgattcgactgct

SEQ ID NO: 10160 - DNA, 1754 bp, Triticum aestivum
  unsure (1)..(1754): unsure at all n locations
  Clone ID: PAT_TA_10160
cgggctgcaggnaattcggacgagggaactagtctcccgctcccggctcctttcctttcccttccccccctcccctaccttagcgtctcctcgccgctaccctcctaggtctcggcgccgccgccgacgccgccgagggtctccggcgaccacggacgcggttcgctgttacccctgactgtccggcacgaatttgaagttggatataagaaatcaacctagcgtctgtcttgttctctgtgtagcgctttcctttggattgcagagaattttcaaacaaaccaacaacaacttgcatctgactgacttgaggtaactatgccaaaggacaggagctcccgttcagtctcgcacgagggctgccgatctcgtgtctccccatacaagttgcggagtggttctcgcaggtcagaggaggctgctgccgccgccgccgctgcagcagcaaagcaggctgcagaatgggaggaggttcgctgtcctgtgtgcatggatcaccctcataatgctgttatgcttgtctgctcgtcacatgagaaaggctgccgccctttcatttgcgacacaagctacagacactccaattgccttgatcagtcgcgcaaagcctccaaggagtcctctaaggattcaggggcagcagaatgcgctgagtgccagcagccagttaaactggcatgtccattatgccgtgggccggtcagccattggactaaggattatgatgcacggaagttcatgaattctaaggatcgagcatgcaccatggagtcatgtgagttcaagggtgcatacaaccagttgaggaagcacgccagggaggatcatcctgctgtacgaccaacggaggtggaccccaatcgacagcgagactggcataggatggagcagcagcgtgatcttggggatttgttcagcatgctgcgttcggggatcagtggcagagaagatggggttggagtcagtgaaggtgacgagggcgtcagtgagagatccttgcacgccacgtccataacgatggtcttcattgtgcggtcaggcaggtccatcctacactacacagacggggaaatcccaggtcgtcgatcaagaacaattcttctagttggggagcctcgtggtgaagcctcccgagcaggaggatcaagcggcaatggtgatgctgaggccactactaccgacaatgaggaaactgacctggcaatgtcaacacaggcatctgctggttctcaggaagatgctggagaagccgatggcgatcctgcgcagtgatgctgcctaaggttagctcccttgctctcttggactgaaaagcctagcagcaagccatttatcgtggtttgccgggagtcgggtgcatgttgggaagaaacatccgtgccagcttgtctcaggcgtagtcaggacattctgcctacaagcaagcaagaagaaatcacggagggaacgtggtggagctgagtagtgtcgtttacatcctgctggaatctgtcggcaaacataaacatttaatggtggcgttgtattattggaacatgtcccatgtttggtactccggtgaatcgtttccctgcgttgtaattctctctagctcttctgctgaattccatttcgctgccttgtaattgcatctgaatagatcttttctgcatttgaagaatttgttgtatagcgttcaggtttctagttccacttatgcctggaggaacctgagaaatcggaatatggtcgatgacaggtcgacgcggccgcga

SEQ ID NO: 10161 - DNA, 621 bp, Triticum aestivum
  Clone ID: PAT_TA_10161
tcttcttccttctagcactgcccagtgcagttccgcgtaatttacataggggggatgggatggggataggttacaacacttgatgtgtacccaaaaaacagcatcctagttgctgcacaagaagcgtaaaacctacctagatgacacacagataactactctcagattgcatttatacaaaaagtggttactctgaaactaaacgctgccgccacaatgcagttctaatcttctgcaaagctagaccccatccagagcatcatctgcctctgcatactgaacatccatgtcgcccaaaacatcgtccgtctgcggtcgagaccgaagctgtgcgcataccactaccatggtgcggttgctaaccgccgcagcatctcatccgtcctcttcgcactggactccatctcctccatttccacgtccatctttttcagagtgtccttcacacttgacatcatggactcgagctccttcatttttgctccggcacgtgcccgctccagtttcatctctttgtacccttcatgctcagcagggtctctaggtagagcagaaaggctgaggagatcatcgatgcgtttgagcaagaacttgacattcatgcccaggagctcaaaggcc

SEQ ID NO: 10162 - DNA, 762 bp, Triticum aestivum
  unsure (1)..(762): unsure at all n locations
  Clone ID: PAT_TA_10162
tgtttatttctctattntatgtttgtncaatgacttgaactacatacgacactcccaacaagaaattctcacaattcatgttcatttctcttcgtagttctccgatttctggtcaaactagagcctcatgtatttctgaacaaacatgtgcattgttcaaccaggaggcacataatctttaagcatatggttcgcactctcactcctttgtgtgctggtcatttttacacaaaaaactcccttaaattaaggcttcgctcatttcttacggatttcaaacaggtttgtcatgtacgaatgtgccctaagcttgtatttgtccagcaacatctcccaagcttgctcgaattcatcttctgtcaagatgtgatttatgaccttatgaaattcagatctgaaatcacttttcttcgtgtacagactacccaatgactcttttgctttcttcagcacatgcacttgcaccaccggtgtgttgcatccggcataactttcttgatagccagctccatagcccggttctggtttgttagtatggtcaccggtggagacccgcccatcattcgaaggaatcctgagaaaacccactcaaaactatcttcagtttcatcacgcacgagcacacctgccaggatcacactccgaaaatgattatttacccctacaaacaggccaaaaggcatgtcgtacagattagtccgataagtcgtgtcaaatgttatgacatctccaaaaaatgagtactgaagcctgctgctncca

SEQ ID NO: 10163 - DNA, 658 bp, Triticum aestivum
  Clone ID: PAT_TA_10163
tttttttaaaagaactgaacccatctttattttaaaaatgtttatttacaccccaaaaaattgttgtgatcctctatcaacaagtcctgacaaaatttccgagcctttgggaggggaacatgaatacaagttaaataggagtaaaccaaaccgagtcgatcttcagttgtatgggagcaaaatttcgcctggacagatttacagtcgaatgggttccttcacgctggaggctttcgttcgatgggaccgtttcgagcctgatctccgtgagcgcctccctgctggcttcttggaagctctcccaggttcctttggtgcgctgtctgggagcatctttcgaggttgctgcacacgcaccacgggagggggcggtggaggtggaggtggaggcggcggaggctggctccgtaaggcagccagcctttgctccatgagttctctgtggtatgcctgaacaacaaaatcacgcctttcacaatccaggaacatgtctgcagtccaattaactcttgaccttattttatccctcactgtgctgaagcttatctgatctcttgaggtgaagcggtcaacttcattaaaccaaaggcatgtgaagagattggtgatgggtatgtgctctcttattatctcgtgcccctcagggacatcgcttgta

SEQ ID NO: 10164 - DNA, 833 bp, Triticum aestivum
  Clone ID: PAT_TA_10164
tatttttagttgcactttgtactacatcagtacaatggcagactttacacatccctgtaacattgccaagtttacatgtcttgaattaaacatgttcactacttggccacaaaaaaacctgattgttccatggaaatatgaattttcatatttgtcaacagcacaacgagaccttcgctagcaaaaaaaaagcacaagccaggcatatcacaaattccgtgggcagtgctatctccaacatgatattctcattggaagacgccgaacaaacttccagagcagttgttcctcttatggccttccaggccgcacttggtacatttcgggactttcctttgcttctttgttgcgcctccatatgaggggcatttagatgctttatgacccctccctctacaaattgagcaaaactttgttcttggcttgctgacattttcataacctggctttgctcttgcatttgttggcctgcctcggtccctcttgcgtgatacaacattcatcgatcctgacagtccgtttgctcctggtgtcacaggcgcatcttggtcatgggctggagccgcggcctggtcatgtaaccctcgcccatcgctctcctggttggtatcgtttagaacacttattgcgtccagcaactgcttcattgcagctccataagcttcagtgttcttatcccccatttgaacaatctcgagcgccttactgtacaaggaagagtgacgataagttgcgtccttcagtgcagaattgcatgctttatatatcatcagatgctctggcaggttctcgcaagcgttcttcgtccatctcttcatgatgtgtacttctag

SEQ ID NO: 10165 - DNA, 648 bp, Triticum aestivum
  Clone ID: PAT_TA_10165
tctcagaaggtgaagcaggtaaatgttaatgttgacatatgaaaccacaggtaaagatagattcatgccagcataatcctgggcacaacatggatagacaacctatctcctgaaacctactgttctacttcattaacatgagtctcaatgacaacgatttaactgactctcctaactaagattcgtcctggttgctgatgtccatcaacagttgacaacaggcttttattgattcagacaatagcaacttcacgggagcgccagtgcccagccgctgctgctgccaaagcgacaattctcagagcccgcatacacgacaagcacagtctaactgtcattagtttgaggtgtctctcatgccgtcgtttccagttttcccctgaatcgtgtccagttccagcctgaatttatcgcatttcgagccatcgccgcatatttctttgccaatgtcagctactttactcagccgcattgcatacctcatggtattttctgattggtctatgccagggctgtccaagcatttctccctgtactgtttcatctgctcttctttaaatttggcagtccacctgggcactatgtattgccctggtatttcattgaccccaaactgtgtgaaaagtctgaatatgtggcagcacggta

SEQ ID NO: 10166 - DNA, 701 bp, Triticum aestivum
  Clone ID: PAT_TA_10166
gctattgaactttcttctatccatcataagaacagatacaactgtctcgtttgaattgctgctcaccaaaaagggccactcttgctttacgaagtgttattgaggttactacaaaggttactattagatttgtgaactaaaggccatacataagttgtactgatccacatgggaagatttgctacgtgcaccttatggaatcatacaagataccattgttttcatcttttttatgccataactacacatcagcaagtctagcagtgccacctctcgacatagtctcctttgcgctagttaccagtcttgttccttggcgaagcctcaattccattggtggcggcggaaggtttacaagcagagccggggagcagaatcggaggagcggcggcgcgttgggtccctgggccgcggcgggttatatagttgaacttgcatgatcaggaatgacagggaacggggccgcggacctcgtcgccggcttgcggctcgtcgtcggggggccggcggccctgcgccaggtggcgccgggccgcggcggcgctggctgggccggcccctccggcctcattcgctgctgcacggccgccgccctgggcgcgcgcgttggtggtggtgatgaacggcgtggtgactgaatttgaacggactgtgagcttaggcggcagagggcgacgctggagctgcagtggcgacgtgtg

SEQ ID NO: 10167 - DNA, 521 bp, Triticum aestivum
  unsure (1)..(521): unsure at all n locations
  Clone ID: PAT_TA_10167
gctttacaattaacctgccgnttctctggttgtcaccttcgtttcaattaagctctttgacaagtcagctttacatcaggtatttttgttaactgtttccatatacgacatccttcaacatgtctatgaacactggtacctcatctactttcagtctggcttgacttaggctcgacattgccgtgccgcaagcttccactctcgcctctgctgtcttcgctggaactcgtctgcccgtgctcctcctgangtatttacatattttggnggncanacatcccctcatcaatgtttccaangcatgaaagaagcaantacccaacaangacattatacaatggcgatnacaantaangtggcttcatggcanacatccctcttcaatgtcccctgngaaatgccgctgttgcctaaatttttcaaacatcanttctccaaatngcccnaaacntgcacatgcatccggtnaaaaacccttnttccantcatgcccaagttcatttcttaannangccggatca

SEQ ID NO: 10168 - DNA, 1555 bp, Triticum aestivum
  unsure (1)..(1555): unsure at all n locations
  Clone ID: PAT_TA_10168
cgtccgcagttatcttatttacaaaagcatatggccaatgttttaactcttttggcagattctgttgatggagagggtgatgaatctatggtactgacaatggagacttttgagcaccttggattcttgttgcagttctccgaaggaactcctttaagccaagctgctccattttttgcgaattctgatccagacatgcctgctgctcctgttccggctactcaagttcatgactggattctgcagaatatagcttcttccttggaatatactgcagaaaaagctataaccaaggaaaacaatcaacggagtgtatctgatcctgatgtggcaatggctgatgctgtcacaaatacaagaatccagagcagctcatcaactggtgcttctgtgcaaaacaatcctggatactaccgaaatacatcttttgtggagggtatctccaaaacttctgttgtcaaacacgggtctgatattaaagggcattcaataaaggtattgaactgccatgattctgttatctacatcctagcccctctcaaatatgctacggtgtatggatgttctgacacaactggtgttcttggtgctattggcaaggtggtaaaagttgagcattgtgaacgtgtgcaaatagttgtggcttctaaaagaatttgtattgccaattgtcgagaatgtatcttctacttgggagtaaatcaccaaccacttatcgtgggggacaaccataaattacaagttgctccatttaatacttgttatccacaacttggggagcatttggcacaagttggtgtggaccctaacgtcaacaagtgggatcaaccttttgtgctgggagttgttgatccacacgattcattatctcatcctgcaggggtttctgatgtccaagccgagtctgccacttgtctagatcctgatctattcacagacttcatgattcctagttggtttgaggcagaaggtcctaccaaatacaatccatttacgttacctgaagtttactgggcatcacagaggaaaaagaatgcttccctggaagacattcaaaagaatatacgagagctggagcttgatgataaccggaaaaaagaattggcatgtgcccttcatgctcaattcaaggactggctatatgcttcaggaaatatccgccagctttactgtttgcaaggcgaataagcatatatgatcttcatccgtaagtgcttaggcacacctgtgaagattgtgcatcctttgcccggtccccttccatagtccagtcctgtccatccgaccgcatcatccacgctgacttctcgtcgactgagctgattcaaccatgtagtgtttgtcaatgtaaaagaaataatgtactgcccatcttgtctattaattctgatcggcttccccttgtgttggttgtggttggtgcaaggatccnaaatgggggtttggtagtttcatatttatatcctttgtaacatatacgaccatgaaagcggttactcgattctttagtggaaataaacattttttgctcatcaaaaaaaaaaaaaaaaaaaaa

SEQ ID NO: 10169 - DNA, 331 bp, Triticum aestivum
  Clone ID: PAT_TA_10169
ttttttttttttcacacggattcggattcatgtttacataaaaagtggtaatgaagccaacatttcgctcactagagcaacactgaaaacgaaaaagaaataggaaaaatcacgttccagcattaggttacttcgtaatttacagctcttccaatgtacaactgtattttccaaaataggacagcatctgaactatcaacccttcatgtacatacaaaatgtcaaacataatgtacactggtgcattttttgcacgcaaaagaatattatgccttcagaatttttctgccgcttggagctctcatacaacttcaatctccttttgtgttct

SEQ ID NO: 10170 - DNA, 705 bp, Triticum aestivum
  unsure (1)..(705): unsure at all n locations
  Clone ID: PAT_TA_10170
cgtccggcccccgaggagttcccggtctccgtcggctgcgccggccatgtcgccgcctgcaacacctcgttgcctctccttctccgttcattcttttcccaagtccagccgcagccgccgccggatccggttgccctcgacccaacgcaggacgccgcagcccctacaagtccagccgtcgccggatccggctgagtttagctttctggtcggtgcagccactaaaaaagcattctacacaaaaaaatccccaccgagaagctctcaattgcgttgctcttcttccacatctccattcctctagcacagagctgctcttcttcttcttccctctatccatccatccagcgagcccacgaacccacatcgtcagcgctgctctccttctcttctctctatcagcggctgctctccttcctcttctatccgttctccagccacaccaagctcacgcacgcccgtggcggctgcttcgcgttcgtcgcccggttgcggcgcggctgcatatcgtgtatgggctcgtggtggtcgggccgcgcgcacggtgctggctgggcttgtggcggggggcgcggcagcgctcgcctcgaccttggaggcgcgacagtggtgtggcccggccgcgcacacggtgttggctgggcctatggcggagggcgcgacagcggtggtctactcnnngtcgacgcaacaacggtgnnntnn

SEQ ID NO: 10171 - DNA, 1358 bp, Triticum aestivum
  Clone ID: PAT_TA_10171
aacgtccgcggacgcgtaggggttcagacccacgcaccgtacacaccaccaagcccatgtcggaggcgtcctcttcctcggcggcggccccggtctcggccccgccccctgcgccggcgctggatccggaggcgatctccctcatggcggaggaggcgccgtcggaggagattactctggtcgtgaagtggggcgggaaggagtacacggtgcgggcgatgggggacgacacgctgttggagctgaagcggcgcatctgcgagttcaccgacgtgctccccaaacgccagaagcttctctaccccaagctcatactcaacgacgagtccgtcctcctttccttcctccccttcaagcccaacggcaagctgaccatgatcggtactgttgaagacgaaatatttgtggaccgaccagatgatccagaggtgctcgatgattatgaaattttcaaagatgaagttactgctatcaaggataatgttctctacaagcaaaaagtgaaacgtcgtgcaagccagtataagatcaagctcttgaatccatgccgcgaaggaaaaagattgcttgtgttagacattgactatactctgtttgaccataggtctccagctgagaatcctttggaactcatgtgtccatttctccacgaatttcttgctgctgcatatgcagagtatgatatcatgatatggtcagcaacaaatatgaaatgggtgcagctgaagatggagcaacttggagttcttagcaaccccaactacaagatcaccgcccttctggatcacatggcgatgataactgtgcatgctcctgacaagaaggtcttcgactgcaaacctcttggtgtcatctggaccaagttccccgagcactacagcgagaagaacacgatcatgtttgatgacctcaggaggaatttcgtcatgaacccacagaacggcctcgtgatcagaccgttcaagaacgccagtaagaaccgaggccgcgatcaggagctgcgaaagctcacgcagtacctgctctccattgcggagttagaagatttcagcaagctggcagcacgacgggtgggagtccttcatggacgaaaccggcaagagacgcaggcgcaggtagttttcttcggtatagcgatcggcaggcaaggactaggccctactactttttgtcaagtgccatcgaccgcacacactagcgcaccggaatgagcaggaaaaccctaatgtccacttgaaacacaccgcgaaaaacaccccatgcttaatctgcgttggactttttggcgagttacacttgtgtcggagccttcagctgcgcgcttttccagtttcaacgtggaattattagcttttcac

SEQ ID NO: 10172 - DNA, 728 bp, Triticum aestivum
  unsure (1)..(728): unsure at all n locations
  Clone ID: PAT_TA_10172
caatcaaaataattccaatcgggnttgtccaaacatnaatcccttgggaggcccccacccaaangggaanctacaccttggacagtgtttgacaggtttgacactactngatgaatcttcatgttgcacttggtcttgaaccccacaggcaagtttcggattcaacaatgcaacttctaggctgcaccacgagctcccatgatctatcctcaatccatgcatttgtccgtgacacattagctaggccgatcaacatgcaccctaagatattggtcaaggacactctggaacacctggaaagaaaacagttccttcctattgagaagtgtgtccattgcagcatattggtcatcaaatgcactgtagaatgtcttgtagaactcagtctgttcttctgttgtggtttgttgatccatctcgtcaaacttcctagtcagtatctctgctcctgtaggtccaagtatgttgaggactaaaccttctaatgtccttgggaaagtatgcaccattgctagtagcatactccgcaactcgagtggttcaactggcaaaatgatttttgcaacggggtctttctccaagagagatgaatcatctgcagcagtcttctttctttcattgctttggctggaagatgtatcctgagatgcagattctgctatgtcattttgggtcaaccgcttcaacactgtcatgaaccattgacatgagttcataaagcgcttgta

SEQ ID NO: 10173 - DNA, 642 bp, Triticum aestivum
  Clone ID: PAT_TA_10173
tagcaaagaataagagtaccacatagtggacatattcatttacgttgctcgatttaacatcattgcagggcaccaatacaataacaactcaggttatgagtgggagcctcactgagtaaacatattagaagatcatcttgcaagcatcatataaaataatatggtcaggtagaaaagtaacatagaaaagtacctgtacttagagagttgaattaatttctacgtccataggatgacaaggtcaaggctaatgatttaactactgaaagtaggggaaaatgcatcagagctaaaaggatctcaaattcacctacaccttttgtgttagcatttccaatagagatgaagttgcaaaaggggacagttttggtgcgtgcacctccatggctgaatgccatactgttctcgtatatagctgatagaaaagaatgttgtcagttctacaggttggttttctgaaaacagaaaataaaagctcatggagtgcctagtcatttcaggggtgatcactattcactgaattgcttgacatttcataaaataggagaacggtagtcagtcagcttcctccagcttgtagattggtgaaaccaagttcccctttgaaaacgtgagaaaacagagaggagagaatgactgctg

SEQ ID NO: 10174 - DNA, 694 bp, Triticum aestivum
  unsure (1)..(694): unsure at all n locations
  Clone ID: PAT_TA_10174
catatcggagtacattgcaacctgggaaaaggaagttgcagcctcagaatgccgtcaaaagaagttgcaccctcagaattatgtacagtaaaactcaaggaattcaggaactgcttcgtgccacctgggcctggccacctcgggtttatatacactcccccacaaatggaggtgaaaagcacctacaaccctatcaaggctgctgccgagggcgggacccagggatcgcagtgaagcttccggtgtcagacatgtaatagtggttgtagttgatcctcgtgaccaaatccgcgagatggggaaagtggcccacgttgagcttgaaagataggatcctcaagaggaacacgacgcactcgtcgaattgcttctcgatacgatccaactccatctcgcatcttgccctaacagatgcggcagtccctccggtgccgagagtttgctccacattgtggaagtctagcgccaatcctagtatagtcttgactcgactggcgatcagagcccacaacttgtccgaggccacaaagcattgtctctgaatagaagaaagatatgcctcatgaacttccatgacttcgtccaatgtagtagcggatgccatgccatcacaaagctcagtccaggcactatgatacactcgatccatgacatattgatgaaatgcatcgacgaaatgcangagcttctgccc

SEQ ID NO: 10175 - DNA, 510 bp, Triticum aestivum
  Clone ID: PAT_TA_10175
gcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgcacggacgcataatattatacaatatgtcgactatatacgttttaatggtaaccaatgg

SEQ ID NO: 10176 - DNA, 573 bp, Triticum aestivum
  unsure (1)..(573): unsure at all n locations
  Clone ID: PAT_TA_10176
tatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaattccgagaccctgtcctacttgccaccgctcaagcacggaggcctcctcaaagcaggtccgactacctggatccgtccaagtgggtgccttgcctccgattcagcaagttgggttcatcttcccgtngagcacaaccatcccctggggtactacgatggccggtactgggcaatgtggaactgcctatttccggatcaccgacgccaccangtanacgaaggttggaaggaggtcaagaaggatacccttaccctatttcgcatcatcngttcacaaatcgtaagtcatgcgtaacttatccctnaaccacnggtgcaagatccggaaggctaaacacnatcacgacagcatttaaatcatgcatttgcaanccgacat

SEQ ID NO: 10177 - DNA, 731 bp, Triticum aestivum
  unsure (1)..(731): unsure at all n locations
  Clone ID: PAT_TA_10177
cacaggtttctggacaaattgttggaagcatgcacatattgtttcagggtgcaaccagacagcacatcaacagggtgattcaaacagatggtggaggaggtcaagaatggagtacccacatgacagcagtatgtccagcaattcaatcaggatttctgacaatacaatgcagcacaagggttgcaagtgcatgttcaagcttgcaatgcagcactgtgcaagcacacacagggctgcngagggagtgcacaggcaaggcactgaaacaagctcaactgcaacagacaaggcacaatgatgatgaaagtgggcacaattggcaagttgtgtggtgcaaactgctgacaattgctttgggtgttgtgccatgtgctgcncaatgttgatgctgttgctgtgatgtgtggtgtgcactgaaaggaaatatgtgtatgtccatgttcatgtaccaacatggctcgagaaagcatgctcgtatgagaatgctatcggtggctatgtatatgaacggacgcataatattatacaatatgtcgactatatacgttttaatggtaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggtacctttttttaagaggaaacaaaatttaa

SEQ ID NO: 10178 - DNA, 662 bp, Triticum aestivum
  Clone ID: PAT_TA_10178
ttgtacaatcttaatttacggactgttgtttagtaccatcttaagaactaagtaggatgtaaaacacatatgattgttattagtagtatctattttatgacatgcgttaaaatcaagcaattgcacggtagtagtgccgctacactttcccctcgatgtagttgtgaacctgtgatgttaactttgagaacccaaactggcaggaacacgtacgtactatgattattaccaggagaatcaattaccaacgggcatgtaccctcgatgccgtcctcgcatcttgctccccttgcactagtacacaaacaagcaagcagcctgctagatggattattgtggaaggtagcttacatatggatggattcctcgtggatgctagcagataacgaggaccggtggctcctagcgcgggaggcgcgcatggtccatatgctagttctgcccaagccgcttaaattcttcatgcccgcccggagggagggatggctgctgacggccccggctagatctgcccacgactccggtggctgcgcgctcctcatggccgcctccttgggcttcctcgagccttgtgggaaggagggaacgaccctggggcacagggttgcgttggcgacatacagagaaaggggcgagcggcggcggcatgagggcctcaggca

SEQ ID NO: 10179 - DNA, 650 bp, Triticum aestivum
  unsure (1)..(650): unsure at all n locations
  Clone ID: PAT_TA_10179
gcaagctatatacctacatagtacagccatggcccccaccggtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctggattccgtccaaagtgggtgccttgccttgattcaagcaaggttggntcatcttcccgttgagcacaacgcatcccctggggtactacgatggccggtactgggacatgtggnaactgcctatttccggtgcaccgacccacacagtgttcaacgaagtggaggagtcaagaaggatacctggaccctattccgcatcatcggttngacaactgcgnaagtgcatgcgtcaactnatcgccttaaaccacgggctcaagatcggnaaggctaaacagncatcacacaggcatattaagtgcantgattttgcaccnaaattctttggtttctccattacttctattgncaaaannttagncagtaancanaggncaaaaaa

SEQ ID NO: 10180 - DNA, 1015 bp, Triticum aestivum
  Clone ID: PAT_TA_10180
gtcagcaacggtgaaaggatcaggtgcatgcaggtaaacaacatcgtctctgtctttctactcattttctagctgacggacggaagtcaataacatcaattgtgtagaactagaattctagcctgttaatgtatcaaaaatgtcaatcttatttgcaggtgtggcccatcgagggcattaagaagttcgagaccctgtcctacctgccaccgctcagcacagaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtgggggatagggtcaaaattgaagtaagtcgttatgattcaagcaagggacgtataatttatagacttccccataaggattcgaagcgtatcgaagactcgaaggatagcgaagatttgaaggatagcgaagatttgaaggataccaaagattcaaaggattaggtttttctttttttttctagggtaataaattctaagttctaaaattcaagcgaagagacttttttttccaaaagattacctgcccgggcggccgctcga

SEQ ID NO: 10181 - DNA, 615 bp, Triticum aestivum
  unsure (1)..(615): unsure at all n locations
  Clone ID: PAT_TA_10181
ctcctccgataatacaataccatggcccccgccgtgatggcttcgtcggctaccaccgtcgcacccttccaggggctcaagtccacagccggtctccccgtcagccgccgctccagcggcagcctcggccgcgtcagcaatggcggaaggattcaggtgcatgcaggtgtggccgattngagggcatcaagaattccgagaccctgtcttacttgccaccctctccacggaggcctccctgaagcagtccactacctgattccgctccaagtgggtgccctgcctccaagtttaacaaggttggttcctccttcccgtttanaanaacagtcccccgggtataacgacggccgatactggacaatgttgnaactgctattttcnggttgaaccgacccagcaagtctcaacaaggtggaggagtcaaaaaggatacctgaccctattccgcttatcggtttnanaactgcncaattcattcttaactcanccatcaagcacggttcaagatntgaaggctaatacantaaaaatgctntanattgctttgactcatttnnnaaactgttccacaanaantttctcgantttttttaanaaggtgggaaanttaat

SEQ ID NO: 10182 - DNA, 435 bp, Triticum aestivum
  Clone ID: PAT_TA_10182
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgttggccatccgagggcatcaagaattccgagaccctgtcctacttgccaccgctcaagcacgggaggcctccctttaagcaagtccgactacctggattccgtcccaagttgggtgctttcctccgagttcaagaaggttgggttcatcttcccgttgagcacaacgcatccccctggggtactacgatggcccggtactgggcatgttggaacttcctatttccggatgcaccgacgcacgcagtaccag

SEQ ID NO: 10183 - DNA, 861 bp, Triticum aestivum
  Clone ID: PAT_TA_10183
gagcaatctgttgctataatggatcttattgaggagcgttgggaagagcttatcggtgatatgcctctgaagatatgttatcctgctattgagaaccatgaatggcgaattgtgacaggctgtgatccaaaaaatactagatggagctatcacaatggaggatcgtggccagtacttctgtggctgctgactgcagcctgcatcaaaactggacggccgcaaattgcaagaagagcaattgacctagcagagaggaggctgttgaaggatggctggcctgagtactatgacgggaagcttggtcggtatgttggcaagcaggcaaggaaattccagacttggtccatcgcggggtatttggtcgccaagatgatgttggaagatccttcacatcttggcatgatctccctagaagaggataaggcgatgttgaagcctgttttgaagcggtccgcatcatggacaaactaagatggcgacgataatttttcgggaagcaaagtcagctgaaaacacgaattcttggggtagcatctccttgtctgctgacccccttccttgacttccaaaccgggttggtttgtgtcttctggatttttcttggttgtacaatatctcagctcgtttcctgagttgaaaaaaaagaagcaactgcagaaatgggcattttatttttttctctctctttctcaatctctgtaagaagacactctgattcttgcttaggtcataccctataaataatggatccttttggttaggctcaactttgttgtaccagtgggactatacagatgagtaagctgattccacttccctgtgaagcataagtgctatttctaacgaatgaaaaaaaaaaaa

SEQ ID NO: 10184 - DNA, 601 bp, Triticum aestivum
  unsure (1)..(601): unsure at all n locations
  Clone ID: PAT_TA_10184
cttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaattccgagaccctgtcttacttgccacccctctccacggaggcctccctgaagcaagtcgactacttgattccgctccaattgggtgccctgcctccnatttaacaagttggttccttttcccgtgagcacaacantccccccgggtactaacgatggccatactgggacatgttgnaactgcctatgttccgggtgcaccgacgctacacaagtgctcaacgagtggaggaggtccaagaagganacctgaccctatntcggcttcaccgttcgacaactacccaagggcatgctcanttcattgcttcaagcaccggntccaaganctggaaggctaatacnatngaacaagggctagttgaanggttgtgaactantttgtcanaaccnctgacacaggcaatttatc

SEQ ID NO: 10185 - DNA, 532 bp, Triticum aestivum
  Clone ID: PAT_TA_10185
gaaaagcagcaattaagatggtttaatagtaaaggttcaacagcagcatcctaacaggattcaaaggttctgaggcaccaagtgcggcaaccagcttaggaacgcaacataccaggagtcccaacaggccatcacaggccactaccacatactactagtactagataaccaagcgcataaccaaaagttggaagagcactgctatgcagacgatgttttgaagacgatttgtgtacgacaactaaatcaagccgtccatgcatatgactaaagtggggccaacggatggattagccatcgtttccttgtcgtgcaggctgtgcgtcgtccgcacagcagtttcgaagttggaacgcgcaagtkcagcaggctggcgggctggctcagcagaagaacatgctgctacggaccttctcatggaggcgaggcagctcctgcactggggcactgccggcagaggtgtggccaccaccctggctcgacgacgtctctgacatctcatcaaactttatgaactgcgccacctgagctg

SEQ ID NO: 10186 - DNA, 602 bp, Triticum aestivum
  unsure (1)..(602): unsure at all n locations
  Clone ID: PAT_TA_10186
gaattgggtaccgggccccccctcgagttttttttttttttttttttttggcgaaaattaagggcagcacttcagctgcaagtttactgaattgcatcacaacaggaagtctggcaacaatcatatcaagttcatgatgtccaggtaaaaatctatcacaccataaaagacagttctactttaaggtttatccgataacatggaactcttaacatcctctcctcctgcattaaagcagctgatgactaacgcaccatcagaatcactcgtggagggtgcccagaatgtcgtcatctctgtagaggaggtactctttctcaggagcaagcttgacttcaagaccaccatactcaggcaggagcacatggtcaccttccttgagagcaacagggatcagcttcccttccttgtcacggggtgccagggccaacagctatgaccttaccagagttcagctgcttggaggtctccgggaggaggatgccgccggcgctcttcttgggctgcaccaccttctccaccagcaacccggttgaagggacgggattaagacgccgaatccccgccatcgccgccgcaaacgagatnagatgcccgctctt

SEQ ID NO: 10187 - DNA, 622 bp, Triticum aestivum
  unsure (1)..(622): unsure at all n locations
  Clone ID: PAT_TA_10187
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaattcgaagaccctgtcctacttgccaccgctcaagcacggaggcctcctcaaagcaggtccgactacctggatccgtccaagtgggtgccttgcctccgantcaagcaagttgggttcatcttcccgtgagcacaaccacccctggggtactatgatggccggtactgggacatgtggaaactgcctatttccgggtgcaccgacccacacaagtgtcaacgaagtggaggagtcaagaaggatacctgacgcgtattccgcacatcgggttcnaaacatcgcaagtgcatgcttaactnatcgcctcaacaacgggctcaagatccggaaggctaaacactatcacacagcatattaaatgcattcatttgtaaccgaaatgcttggtttctccattacttctaatgtca

SEQ ID NO: 10188 - DNA, 486 bp, Triticum aestivum
  unsure (1)..(486): unsure at all n locations
  Clone ID: PAT_TA_10188
gcacgaggcttctttgccgctttgcgtgcctccctctctcgctctctcgtccgcagcagctgggacgatggggacgatgaggtcgtcggcggtggcggtagcggcgcggaagcagcagctgctgccatgcttggccctgctgcttcttgcgggggcggcgtccgcccaggcccagaagtacaacgcggtgttcaacttcggcgactccatcactgacacgggcaacctgtgcacgagcgggaagccgacggcgatcaccttcacgcagcccccctacggcgagacctacttcggcacccccacctgccggtgctccgacggccgcgtcatcgtcgacttcctcagcaccaagtttggggtgcctttcctgccaccgtccaaggcgaacggcacggacttcaagcagggtgcgaacatggccatcacgggggcgacggccatggacncgcccttcttncgcggccttgccttcggacaagatctggg

SEQ ID NO: 10189 - DNA, 1129 bp, Triticum aestivum
  Clone ID: PAT_TA_10189
tcaagaaagaacgcaaaacaattgaggcacccaaacagaccagctccacataaacattttgttcaatgactaaactataaataaatggcacaaacagaccatgcccacaggaacagatgtacagcaacagggacatataaacttccttgcggaagtaccatctccacagaaaacaataccatgataaatcgtactaatcggcgccacccctaaatgtgtttaagtagcaaaatatgacaaaaaagaacaggatgagaactgacttctatacttgaagactgattaatcataaaggacatggcaaaaattagccactacaaaactgttaacaacacctagagtcagtttaggtgagatggcatccagatagagtggtaccatcaaccaacagcaagacaatggttcaaaaaccaactattataatgacaatgcaaaacagtccaaatattggctggacctcccagtacggaactgtacaacgtacagtcagtttaaatgagatcacatccacagagagtgataccatcaaccaacagcaggaaaatggttaaatagcagccactatgaaaccaactgttagaatgatatggcaaaacggccaaaaggttagctggaactcttagtcatagctcacatgctctataatacatagagcagccagacatagaacggttaaacacaccgcagaatagatgccactggcagcgcatctcccttggggttttgccgcgccaagaatgcatattcattacagggaagattactgcttcctgctgaaacacaaacagttatttctgctgacttttccagagtcaaacgcgaggtacccatctcagtcatagttcatgcttctgtttacaggagtgatcaaagcagcatacctattggtttgacgagaacatgactccgggtactttcctctgctccacaagttcttccaggctggagcgccgggatctcgaagggcgccgccgccgccgcctcggcgtgcttccgatctaccgtcatggccgacccgatccggatcgggtccagatatctagcgttcgcaatcttgtcgcctgttttcttcgctgcgtcgacttggatagagagtaggaggaagagagaaatacaagtcgggggaccc

SEQ ID NO: 10190 - DNA, 656 bp, Triticum aestivum
  Clone ID: PAT_TA_10190
gggtgcttccccatctacctcactgtctacggcaccaacagcagcgccgactacgacagcctcggctgcctccgcaagttcaacgacctctccacgttccacaacaacctgctccaggccaagatcgcccgcctccggaagcgctacggccgggcggcgcggatcatgtacgccgacttctactccgccgtctacgacattgtcccggaacccaagcaaattacggtttcaacgcggctttcgaggcgtgctgcggctcccggggggaggcaagtataactacgccaacagcgcgaggtgcgggatgccgggcgcggcggcgtgcgccaacccggccgaccacctcagctgggacggcatccacctcactgaggcagcatacaagcagatcaccgacggctggctcaacggggcatactgcagcccgcctattctccacacctaaacattattttatttatttatttattatgtggagctgtggtagtattatttattatttgctcagaggttgagttttcctaatggaaaaaggaaatttgattcagtggcctatggtggtgctgagattataatgtatacgttgcccaagaaaaaaatttggaggaaactctcgaataaagtgtaattgctttcgtccaaaaaaaaaaaaaaaa

SEQ ID NO: 10191 - DNA, 542 bp, Triticum aestivum
  Clone ID: PAT_TA_10191
tggggaacgcggaaagggatctcgccggaacgctccatggagctcgccgcaaccggcgctgctgccctccggcgatcgttggcgtcggggtatccggtggttccgagggagaggagaaggcggatgccggccagggtgtcctgcgtcggccgcggaggcagaggcgtaggcgggggattcgccgacgaggcgcacctcaggtactacgaggcgccgccgcggaaggcggtggaggcggcggcgagggaccttaccaagctccgggccatgggccttgtcgccggcgacccggccaaggagaagatcctctcggaagccactgagctgctgctaaaggagttgaatcagatgaaggatgcagaggacgagctgaagaagaaggacgagctgaagaagaagcagaaagaggagaaggctgccatgaaagcactgaagaagcagcagaaggaagcgaagaaggctgcaatgaactgtggagatggctcctctgaatcaagcgagagtgagtgtgaggaagagcagtccatgaaaatgagttgtgt

SEQ ID NO: 10192 - DNA, 510 bp, Triticum aestivum
  unsure (1)..(510): unsure at all n locations
  Clone ID: PAT_TA_10192
ctccgctctgctctctgccccgcccgccggctcatctccgcgcgcagaggcagcgtcgcagcgagcacaccaccttcgacccctcctcctccccgtagcctgccggctcttcccgccgcctcgcttgcgagtgagacgatggcgaggccgtcgtccgtcgccgatggcgacgaggctgccgctgttgcttgtgctgctgtcgtcgctggccctgcaggcggcggcgcaagaagtacaatgcggtgtacagttccggcgactccgattaacggacacgggcaacctgtgcaccaacggccgccctcgggcgattaccttcagcaagccgcctacggcgagactacttcggggagcccaactgccggtgtccgacggcgggcatcgtcgatcctcaanacaagtacgctcccttctgcccctccaagtcactcggcgattaaanaaggcgcaaatggancaacggggcacgcatggagcccctctcggtcctcggctctcgggaantttgga

SEQ ID NO: 10193 - DNA, 969 bp, Triticum aestivum
  unsure (1)..(969): unsure at all n locations
  Clone ID: PAT_TA_10193
ctccgctctgctctctgtcccgcccgccggctcatccccgcgcgcagaggcagcgtcgcggcgagcacaccaccgtcgaccccctcctcctccccctagccgctcccgcgcgcggccggcggtgtcgtgatggcgaggtcgtcgtcgtcgccgacggcgaggttgccgttgccgctgcttgtgctgctgctgtgcttgtcgtcgctttccatggcggcggcgcagaagtacaatgcggtgtacagcttcggcgactcgatcacggacacagggaacctgtgcaccaacgggcggccctcggcgatcaccttcacgcagccgccctacggggagacctacttcgggagccccacctgccgctgctccgacggccgcgtcatcgtcgacttcctcagcaccaagtacggcctccccttcctgcccccctccaagtccacctccgccgacttcaagaagggcgccaacatggccatcaccggcgccaccgccatggacgcccccttcttccgctccctcggcctctccgacaagatctggaacaacgggcccatcagcttccagctccagtggttccagaccatcacctcctccgtctgcggcagcagtgagccctcccctcagtcctctcccatcatgcttttcttttctttcttcactcccttcaaagcccagcccaccatgtctgcatgctctgctgctcccttaatgcacgagcagcagcatgatttcctgctccatccagctgtcgccgctgccactgccatgccgctgccgccattgataagagctntactacacacttttcatggggcctggcgaattgattcgcttacgcgtngtgtactatcactattgntgcangctgcaagagctacctggcgaactcgctcttcatcttcgggggagtcgggggggaacgactacaacgcgatgctgntcgggcactacaacacggaccaggcgagcacg

SEQ ID NO: 10194 - DNA, 671 bp, Triticum aestivum
  Clone ID: PAT_TA_10194
gaagcgccgactacgacagcctcggctgcctccgcaagttcaacgacctctccacgttccacaacaacctgctccaggccaagatcgcccgcctccggaagcgctacggccgggcggcgcgcatcatgtacgccgacttctactccgccgtctacgacatggtccagaacccaagcaaatacggtttcaacgcggttttcgaggcgtgctgcggctccgggggaggcaagtacaactacgccaacagcgcgaggtgcggaatgcagggcgcggcggcgtgcgccaacccggccgaccacctcagctgggacggcatccacctcaccgaggccgcatacaagcagatcaccgacggctggctcaacgggccatactgcagcccgcccatcctccactcctaaaacattaattaattaagtaattctttatttattgacttgtggtagtattatttattattttattttattcgagcttgagttttcccaaaggaaaaagaaaaattcattcaatgtcatatggtggtgctgaaatgtatacgttgcccaagaaaaaaacgaaggcaactctcgaataaattgttagtgcctgcccggagcgacttacgtcggcgaattccctatatgatgcttattgggtcaaaatgttggttattcacacaggcttccatc

SEQ ID NO: 10195 - DNA, 563 bp, Triticum aestivum
  Clone ID: PAT_TA_10195
atggtccggagccccagcaaatacgggttcagctcggtgttcgaggcgtgctgcgggtcggggggaggcaagtacaactacgccaacagcgcgcggtgcggcatgtcgggcgcctccgcctgcgccagcccggcgtcgcacctcagctgggacggcatccacctcaccgaggccgcgtacaagcagatcaccgacggatggctcaacggcgccttctgccaccccggcatctcccactagccagccactcccgctggccgatcaaccagctcatgcatcgtcgtccatggatccatcattaatcaatcaatcaatcaattattattattattatttgttcagtcgggttaattattataaggaaacgtttctggggactggctaaggctgggttcccggtctgatctgggcgcgtgtgtgctgatgaagaaaggggaaagaatgacggcaactgtcgtggatatacgcattttgcataactgtataactgatattgtttgttcaaaggggggccgtaccaatcgcctaagtgatctataccgcgctacgggcgtctttaaact

SEQ ID NO: 10196 - DNA, 805 bp, Triticum aestivum
  unsure (1)..(805): unsure at all n locations
  Clone ID: PAT_TA_10196
acgggagaaggaaacaaagaaagctgcaaagaaggccatgaagatgaaaaaggaggaagagaagaggatggccacactgaattcctgcaaggatgaggacagttcatgctcatcggagtccagcaacagtgagtgtgaaggggaagtcgtcagaatgagccgctgtgccaccatttctgtgcctcgaacaccatctgcaagcacagttttccccatcatagtgccacaaatctcagactccgttgcactggatgctcagatcatttctgggtctgcaaatgcaatgcagcgcactaccaccagcattgcggttgtcgaaaaaccagtgctgaacagaatcgaggtctgcatgggtggcaaatgcaagaaggcgggctcgctcgccgtcctgcaggagtttgagacggtggttggcacgggcggcttgtggtcggttgcaantgctttgggaatgcgggttaggcccaaatgtgcggcttcggagtgagggctctgtacagaagaacagtcccatctgcattggtgtaggcttggatgatgttggcaccatagtggcaggcttcatcggagatgacgatctgggcatgaactgatacgatggttacctggactcaggttggtatttacagacctgtattactacgacttgttttgtctggcaaatgtactactgcaactttgctgcacaataatacattgtagataatcacgcccctgacgagctgatgtatgttctgagcttaatgagctgctgtttactatatatatactccctgtttcatccaaaaaaaaaaaaaaaaaaaac

SEQ ID NO: 10197 - DNA, 1179 bp, Triticum aestivum
  Clone ID: PAT_TA_10197
gggaacaaaagctggagctccaccgcggtggcggccgctctagaactagtggatcccccgggctgcaggaattcggcaccagagaggacgagctgaagaagaagcagaaagaggagaaggctgcgatgaaagcactgaagaagcagcagaaggaagccaagaaggccgcgatgaactgtggagatggctcctctgaatcgagcgagagtgagtgtgaggaagagcaatccatgaaaatgagctgtgttgccaccacatcgatgcctgcaattgagcaaggaatggcgatgtcaatgtcagtgccccaaattgctgcatccaacattgcaacagctccggcaatggattgtgacatggctgcgatgaaggccatgaagaagagagagaaggaacaaaagaaagctgcaaagaaggccatgaagatgaaaaaggaggaagagaagaggatggccacactgaattcctgcaaggatgaagacagctcatgctcatcggagtccagcaacagtgagtgtgaaggggaagtcgtcggaatgagccgctgtgccaccatttctgcgcctcgaacaccacctgcaagcacagttttccccatcatagtgcctcaaattccagactccgttgcactggatgctcagatcttttccgggtctgcaaatgcaatgcagtgcactgccaccagccttgcggttgtcgaaaaaccagtgctgaacagaatcaatgtctgcatgggccggcaaatgcaagaaggcgggctcgctcgctgtcctgcaggagtttgagacggaggtcggcacgggcggcatggtggtcggttgcaaatgtttggggaaatgcaggctaggcccaaatgtgcggcttcggagtgagggctctgtacagaagaacagtcccatctgcattggtgtaggcttggatgatgttggcaccatagtggcaggcttcatcggagatggtgacgtgggcatgaactgatacgatggttacctggacctggttcaggttggtatttacagacctgtactcctacaacttgttttgtctggcaaatgtactactacaactttgctgcacaataatacattgtagataatcacgcccctgacgagctgatgtatgttctgagcttaatgagctgttgtttactatatatactccctgtttcatccaaaaaaaaaa

SEQ ID NO: 10198 - DNA, 756 bp, Triticum aestivum
  Clone ID: PAT_TA_10198
ccgggctgaggaattcggacgaggctctgccccgcccgccggctcatctccgcgcgcagaggcagcgtcgcagcgagcacacaccaccttcgatccctcctcctcctcctcctcctcctgcttcttctctcgcgtacacggctgcgcgtgtgacgatggcgaggacgtcgtcgtcgccgacggcgacgaggctgccgctgctgcttgtgctgctgtcgtcgctggccttgcaggcggcggcgcagaagtacaatgcggtgtacagcttcggcgactcgatcacggacacggggaacctgtgcaccaacgggcggccctcggcgatcaccttcacgcagccgccctacgggggagacctacttcggggagccccacctgccgctgctccgacggccgcgtcatcgtcgacttcctcagcaccaagtacggcctccccttcctgcccccctccaagtccacctccgccgacttcaaaaagggcgccaacatggccatcaccggcgccaccgccatggacgcccccttcttccgctccctcggcctctccgacaagatctggaacaacgggcccatcagcttccagctccagtggttccagaccatcacctcctccgtctgcggcagcagctgcaagagctacctgggcgaactcgctcttcatcttcggggagttcggggggaacgactacaacgcgatgctgttcggcaactacaacacggaccaggcgagcacgtacctcggccgcgaccacgcta

SEQ ID NO: 10199 - DNA, 725 bp, Triticum aestivum
  unsure (1)..(725): unsure at all n locations
  Clone ID: PAT_TA_10199
agtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctggatccgctccaagtgggtgccttgcctccgattcagcaaggttgggttcatcttcccgttgagcacaacgcatcccctggggtactacgatggccggtactgggacaatgtggaaactgcctatttccggatgcaccgacgccacgcaagtgattaacgaaggtggaggagtcaagaaggatacctgaccctattccgcatcatcggattcgacaaatcttaagtgcatgcgcagttancgccttaaacaacnggtgcaagatcccggaaggctaaaaatcatcacacaggcatttaaatgccatgcatttgtaatccgaatgcttgggttcctccaattacttctaatgtccaaaanatttantcatttatttcaaaaggtcaaaaaatccctnntatcnacgggtattttcnggncaaatttnaattgcncaanctttttg

SEQ ID NO: 10200 - DNA, 1394 bp, Triticum aestivum
  Clone ID: PAT_TA_10200
ttctttgccgctttgcgtgcctccctccctccctctctctcgtccgcagcagctgggacgatgggaacgatgagctcgccgtcggtgccggcgcggaagcagcagctgctgctatgcttggccgtcttgctacttgcgggcgcggcgtccgcccaggcccagaagtacaacgcggtgttcaacttcggcgactctatcacggacacgggcaacctgtgcacgagcgggaagccgacggagatcaccttcacgcaccccccctacggcgagacctacttcggcacccccacctgccggtgctccgacggccgcgtcatcgtcgacttcctcagcaccaagtttggggtgcctttcctgccaccgtccaaggcgaacggcacggacttcaagcagggcgcgaacatggcgatcacgggcgcgacggccatggacgcgcccttcttccgcggcctcggcctgtcggacaagatctggaacaacgggcccatcagcttccaaatccagtggttccagcagatcaccgccaccgtgtgcgggaacgactgcatgcggtacctgcgggactcgctggtggtgttcggcgagttcggcgggaacgactacaacgcgatgctgttcggcaactacaacccggaccaagcgagcaggtacacgaccaagatcgtcaacaccatcatcaggggcgtggagaaggtggtggcaatgggggccagggacgtggtggtgcccggggtgctccccatcggctgcttccccatctacctcaccgtctacggcaccaacagcagcgccgactacgacgccctcggctgcctccgcaagttcaacgacctctccaccttccacaacaacctgctccaggccaagatcgcccgcctccggaagcgctacggccgggcggcgcgcatcatgtacggcgacttctactccgccgtctacgacatggtccagaacccaaacaaatacggattcaacgcggctttcgaggcgtgctgcggctccgggggaggcaagtacaactacgccaacagcgcgaggtgcgggatgcagggcgcggcggcgtgcgccaacccggccgaccacctcagctgggacggcatccacctcaccgaggctgcctacaagcagatcaccgacggctggctcaacgggccctactgcagcccgcccatcctccacacttaaacattattttatttatttatttatatatggagttgggtagtattatttattatttgatttgaggttgagtttaccgaaaggaaaaagggaaatttgattcagtgccgtatggtggtgctgagatgtatacgttgcccaagaaaaaaaaatggaggcaactcttgaataaattgttaatttttcttccagctaaaaaaaaaaaaaaaaaa

SEQ ID NO: 10201 - DNA, 1492 bp, Triticum aestivum
  Clone ID: PAT_TA_10201
gacagggaaatgcattttcacattttctttttccaccttccaaagatcgtgatgcacaatcaaggtttcttatcacaagaaacatcgaaacagagaagagttcccatgcctaacagaactacaaacgaagcacaaaaaactagcttaggagcttattagttctgcagaggaatccaatccggtcgaccatttgatcttcattggagcgcagcagcggacaccgaagggcaagccgaccaaacaccatagacatggtttggccgccggtaggggatcacaacccttcgaagaactcgctcatctcagcatcatggaaggcagagttgtgcatggcccgatcctctgatatccacattgggtaaggataatcagactgcagcatgccctccagcatgccttggtccaagccatccaggtagagaggttcctgctggcccatctccacgccagtgttggctccaccattccaggagcccccagtgaccagctcgacttcaattgggtcggcttccatcaatctcaataattcttctatatcaaaaccgtctgcttctccatccggcaaactggaaataggctccaatggctcgaacacatcctctttcgggatgtgctccttgaaatgcttgagccaagcgtcaggaacagtgtcttgatggctgtaatgctcgacagactccagcacaactgattctgtggactcaagcgcatctggctgggagtaaatctcaggagcttgagcttgtctcggcaaggaagaagcaacatctgagtggttggtggacgttgtagtagactcgcatgatgctgaagcaccacgtacaacaccttcgattgccgctggtacagccacagcaggagcttgtgcaggatgcacagggaagttggtacgagccagtgcgccatacattgctctggctgcctcgtcataagcacgggcagcatcctcagcaagtggggaacgttcccagccagaagcctgctcacccgaatttggctcccgaatttcagcaacccacttcccccaagtacgttgccttacaccacggaatccacattgtgtattctcaggtcctcctttcccctgcatacagcccttctttgaaccctttgcaggtggcttcctcgccctctttgcaccctgtggatcatgctccagttgttggttcacttctttccatcgcctgatcgtttcagagactgaattaggcccatcacgtgatctccgaggtcgctttttcctattggtttgacgagaacatgactccgggtactttcctctgctccacaagttcttccaggctggagcgccgggatctcgaagggcgtcgccgccgccgccgccgcctcggcgtcccacgcgtccggaaaagtcattgataagcttgctcagacttatctaccaacaccttttccatcaacaggcctgtcatcttcatacttcagatttacatagtaatgatggaagaacgcatctgtcgtccggacgcgt

SEQ ID NO: 10202 - DNA, 1420 bp, Triticum aestivum
  Clone ID: PAT_TA_10202
cggatttgggtggtggagaaaggggaacggggaaagggatctcgccgcaacgcaccatggagctcgccgcaaccagcgctgctgccctccggcgatcgttggcgtcggggtatccggtggtcccgagggagaggaggagtgggatgccggctagggtgtcctgcgtcggccgcggaggcagaggcgtaggcgggggattcgccgacgaggcgcacctcaggtactacgaggcgccgcggaaggcggtggaggcggcggcgagggatcttaccaagctccgggccatgggccttgtcgccggcgacccagccaaggagaagatcctctcggaagccactgagctgctgctacaggagttgaatcagatgaaggatgcagaggacgagctgaagaagaagcagaaagaggagaaggctgcgatgaaagcactgaagaagcagcagaaggaagccaagaaggctgcgatgaactgtggagatggctcctctgaatcgagcgagagtgagtgcgaggaagggcaatccatgaaaatgaggtgtgttgccaccacatcggtgcctgcagttgagcaaggaatggtgatgtcaatgtcggtgccccaaattgctgcatccaacatcgcaacagctccggcaatggattttgacaaggctgcgatgaaggccatgaagaagagggagaaggaacaaaagaaagctgcaaagaaggccatgaagatgaaaaaggaggaagagaagaggatggccacactgaattcctgcaaggatgaagacagctcatgctcatcggagtccagcaacagtgagtgtgaaggggaagtcgtcagaatgagccgctgtgccaccatttctgcgcctcgaacaccacctgcaagcacagttttccccatcatagtgcctcaaatcccagactccgttgcactggatgctcagatcttttccgggtctgcaaatgcaatgcagcacactgccaccagcattgcggttgtcgaaaaaccagtgcagaacagaatcgaggtctgcatgggcggcaaatgcaagaaggcgggctcgctcgccgtcctgcaggagtttgagacggaggttggcaccggctgcatggtggtcggttgcaaatgcttggggaaatgtgggctaggcccaaatgtgcggctgcacagcgagggctctgtacagaagaacagtcccatctgcattggtgtaggcttggatgatgtcggcaccatagtggcgggcttcatcggagatggcgacgtgggcatgaactgataagatggttacctggagcaggttcaggttggtatttacaagacctgtactactacaacttgttttgtctgggcaaatgtactacaaaaactttgctgcacaataatacgttgtatataatcacgccaaaaaaaaaaaaaaaaaaaaactcg

SEQ ID NO: 10203 - DNA, 1390 bp, Triticum aestivum
  Clone ID: PAT_TA_10203
ggccagggaaatgcattttcacatttctttttccaccttccaaagatcgtgatgcacaatcaaggtttcttataacaagaaacatcgaaacagaagagttcccatgcctaacagaactacaaacgaagcacaaaaaactagcttaggagcttattagttctgcagaggaatccaatctggtccaccatttgatcttcattggagcgcagcagcggacaccgaagggcaagccgaccaaacaccatagacatggtttggccgccggtaattcatcacaacccttcgaagaactcgctcatctcagcatcatggaaggcagggttgtgcatggcccgatcctctgatatccacattgggtaaggataatcagactgcagcatgccctccagcatgccttggtccaagccatccaggtagagaggttcctgctggccaatctccaccccattccaggagcccccgttgaccggctcaacttcaattgggtcggcttccatcaatcttaataattcttctatatcaaaaccgtcagattccccatccggcaaactggaaataggctccaatggctcaaacacatcctcttcggatgtgctccttgcaatgcttgagcccagcgtcaggaacactgtcttgatggctgtaatgctcaacaggagtaagcacaactgattcggtggactcaagcacatctggctgggagtaaatctcaagagcttgagcttgtcgcggcaaggaagaagcaacatctgagtggttggtggatgttgtagtagactcacatgatgctgaagcaccacgtacaacaccttcaattgccgctgctacagccacagcaggagcttgtgcaggatgcacagggaagttggtacgagccagtgcgccatacattgctctggctgcctcgtcataagcacgggcagcatcctcagcagtggggaacgttcccaaccagagcctgctcacccgatttggctcccgaatttcagcaacccacttcccccaagtacgttgccttacaccacggaatccacattgtgtattctcaggtcctcctttcccctgcatacagcccttctttgaaccctttgcaggtggcttcctcgccctctttgcaccctgtggatcatgctccagttgttggttcacttctttccatcgcctgatcgtttcagagactgaattaggcccatcacgtgatctccgaggtcgctttttccttccaggctggagcgccgggatctcgaagggcgtcgccgccgccgccgccgcctcggcgtccttccgatctaccgtcatggccggcccgatccggatcgggtccagatatctagcgttcgcaatcttgtcgcctgatttcttcgccgcgtcgacttcgctagagaggttc

SEQ ID NO: 10204 - DNA, 1562 bp, Triticum aestivum
  Clone ID: PAT_TA_10204
ctgctccgctctgctctctgccccgcccgccggctcatctccgcgcgcagaggcagcgtcgcagcgagcacaccaccttcgacccctcctcctccccgtagcctgccggctcttcccgccgcctcgcttgcgagtgagacgatggcgaggccgtcgtcgtcgccgatggcgacgaggctgccgctgttgcttgtgctgctgtcgtcgctggccctgcaggcggcggcgcagaagtacaatgcggtgtacagcttcggcgactcgatcacggacacgggcaacctgtgcaccaacggccgcccctcggcgatcaccttcacgcagccgccctacggcgagacctacttcgggagccccacctgccgctgctccgacggccgggtcatcgtcgacttcctcagcaccaagtacggcctccccttcctgcccccctccaagtccacctccgccgacttcaagaagggcgccaacatggccatcaccggcgccaccgccatggacgcccccttcttccgctccctcggcctctcggacaagatctggaacaacgggcccatcagcttccagctccagtggttccagaccatcacctcctccgtctggcggcagcagctgcaagagctacctggccaactcgctcttcatcttcggggagttcggggggaacgactacaacgcgatgctgttcggcaactacaacacggaccaggcgagcacgtacgcgccgcagatcgtggacaccatcggcgccggcgtggagaagctggtccgcgatgggcgcggtggacgtggtggtgccgggggtgctccccatcggctgcttccccatctacctcaccatctacggcacctccagcgccgccgactacgacgccctcggctgcctcaagaagttcaacgacctctccacgtaccacaacagcctgctgcaggccaaggtgtccgccctccaggccaagtacaagtcggcgcgcatcatgtacgccgacttctacgccggggtctacgacatggtccggagccccagcaaatacgggttcagctcggtgtttgaggcgtgctgcgggtcggggggaggcaagtacaactacgccaacagcgcgcggtgcggcatgtccggcgcctccgcctgcgccagcccggcgtcgcacctcagctgggacggcatccacctcaccgaggccgcctacaagcagatcaccgacggctggctcaacggcgccttctgccacccaggcatcacccactagccagtcacttcccacgtggtcgatcaatcagcttatgcatcgtcgtccatggatccactcattaatcaatcaatcgattactattacttacttacttacttacttacttatttgttcggtcgggttaattataaggaaacgtttgtggggactggctaaggccgggttcccggtctgatctgggtgcgtgtgtggtgatgaaggaaggggaaagaatgacggcaactgtcgtggaatagtagtgcatctgttgctgtgaacctgtaaaaaaaaaaaaaaaagggcgccgctcgcactagttctagatcgcga

SEQ ID NO: 10205 - DNA, 681 bp, Triticum aestivum
  Clone ID: PAT_TA_10205
ttttttttggcacaaatgcatcaatgcatccaccattaataatccaaataacgcaagtattttgacgaaaattaagggcagcacttcagctgcaagtttactgaattgcatcacgacagaaagtctggcaacaatcatatcaagttcatgatgttcgaggtaaaaatctatcacaccataaaagagagttctatttcaaggtttatccaataacatggaaactctaaacatcctctcctcctgcattaaagcagctgatgacttccacaccatctgaattactcgtggagggtgcccagaatgtcgtcgtctctgtagaggaggtactctttctcgggagcaagcttgacttcaagaccaccatactcaggcaggagcacatggtccccttccttgagagcaacagggatcagcttcccttccttgtcacggctgccagggccaacagctatcaccttaccagagttcagctgcttggaggtctccgggaggaggatgccgccggcgctcttcttgggctgcaccaccttctccaccagcacccggttgaaggacgggatcagacgccgaatcgccgccatcgccgctgacgagatcagacgccgctcttctccttcttcttcttgggaaacaagcaagagaacgcgacgcttccaccggacgcgtgggcggacgcgtggg

SEQ ID NO: 10206 - DNA, 1521 bp, Triticum aestivum
  Clone ID: PAT_TA_10206
tttttttttagacatgccacggaaatgcattttcacattttcttttcccaccttccaaagatcgtgatgcacaatcaaggtttcttatcacaagaaacatcgaaacagagaagagtttccatgcctaacagaactacaaacgaagcacaaaaaactagctaggagcttattagttctgcagaggaatccaatcttctggtccaccatttgatcttcattggagcacagcagcggacaccgaagggcaagccgaccaaacaccatagacatggtttggccgccgcaaagggggatcacaacccttcgaagaactcgctcatctcagcatcatggaaggcagggttgcgcatggcccgatcctctgatatccacattgggtaaggataatcagcttgcagcatgccctccagcatgccttggtccaagccatccaggtagagaggttcctgcaggcccatctccacgccagtgttggttccacaattccaggagcccccagtgaccggctcaacttcaattgggtcggcttccatcaatctcagtaattcttctatatcaaaaccgtctgcttccccatccggcaaactggaaataggctccaatggctcgaacacatcctcttcggatgtgctccttgcaatgcttgagccagcatcaggaacagtgtctttatggctgtaatgctcgacagactccagcacaactgattcggtggactcaagcacatctggctgggagtaaatctcaagagcttgagcttgtcgcggcaagttagaagcaacatctgagtggttggctgatgttgtagtagactcgcatgatgctgaagcaccacgtacaacaccttcaattgccgctggtagagccacagcaggagcttgtgcaggatgcatagggaagttggtacgagccagggcgccatacattgctcttgctgcctcgtcataagcacgggcagcatcctcagcagtggggaacgttcccaaccagagcctgctcacccgatttggctcccgaatttcagcaacccacttcccccaagtacgttgccttacaccacggaatccacattgtgtattctcaggtcctcctttcccctgcatacagcccttctttgaaccctttgcaggtggcttcctcgccctctttgcaccctgtggatcatgctccagttgttggttcacttctttccatcgcctgatcgtttcagagactgaattaggcccatcacgtgatctccgaggtcgctttttcctattggtttgacgagaacatgactccgggtactttcctctgctccacaagttcttccaggctggagcgccgggatctcgaagggcgtcgccgccgccgccgccgcctcggcgtgcttccgatctaccgtcatggccgacccgatccggatcgggtccagatatctagcgttcgcaatcttgtcgcctgttttcttcgccgcgtcgacttggatagagagttgggcagaggcgtggaggaggagagaaagaaaagcggacgcgtggg

SEQ ID NO: 10207 - DNA, 1499 bp, Triticum aestivum
  Clone ID: PAT_TA_10207
cttttttttttttttttttttgaaagcaacaaattagatggttcgatagtaaaggttcaactgcagcaccctgacaggattcaaaggttctgaggcaccaagtgcagcaaccagcttaggaacacaacatcccaggagtccaacaggccatcacaggccactactacatactactagtactagataaccaagcgcatcaccaaaagttggaacgcgcaagtgcggctggctggctggctcagcagaagaacatgctgctgcggactttctcatggaggcgaggcagctcctgcactggagcgctgccggcagaggtgtggccaccgccctggctcgacgacgtctcagacatctcatcaaactttatgaactgcgccacctgagcagccgcaagatgtgcatagcagattggagaaacaactgatatggctgtcgtgctcctttggtacacatatgagagcgagtgcacaagatcctgcaggtcatccgcagcaaagtgtatctcatcatgcaggatatggtagtgtgttggccttgtagtcccaatcattccagcatgagcgcacatgtagaagtcataattccttggatggcagactgcattatctacaacagtgcctggagggacattgtcaggagatccaggtatgaagaatttggtgtggtgatttttctgggcaacaatcagcgtgaacttggggttccaattttcatccaagaacttgcaggcctcaattatttgatccaattcaatgttcagcacctgattaaactggctctcactaacaccatccctgaagatgatgatctgatctggtttcctttttccagaactggtgtagaagtcaatgagacactcccgaacaaggccatcatcatcagttccttgtggcttgaacaatgaatctatcatttcgagctttggtgactgcgagcgcactgaagccctatatttcgagacaagaggccattcccgagaaccaacaactgctgcaatggacggtatatcagactgtccaggggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcac

SEQ ID NO: 10208 - DNA, 2280 bp, Triticum aestivum
  unsure (1)..(2280): unsure at all n locations
  Clone ID: PAT_TA_10208
gccggcctttccgggatttacctccgcggaaccaccttgcctcgagattcgcgcggccgtgtctgcctctgggtccgcgcttccgttgtctagcgtcctgagctgagctagatctctcagctcgctcttcgccggcgctttgggcttagatctggctggggcgagtaggcggaggccggccgcggattcgtgacgagggaggggagccatggagctgggggcggccgggatgcggcggtcggcgtcgcacaactcgctgtccgggtccgatgacttcgacctcacacacctgctcaacaagccgcggatcaacgtcgagcgccagcgctccttcgatgaccgttcgctcagcgacgtctcctactccggtggccacgccagaggaggcggaggctttgacggcatgtactcccccggcggcggtctacgctctctggtcggcacgccggcctcctcggcgctccactctttcgagccccaccccatagtcggcgacgcctgggaggccctccgccgctccctcgtctttttccgcggccagccgcttggtaccatcgccgctttcgaccatgcatccgaggaagtcctaaactatgatcaggtgtttgtgagagatttcgtgcccagcgccatggcgtttctgatgaatggtgagccggagattgtcaagaacttcctgctcaagaccgttttgctgcagggttgggagaagaaggttgatcggtttaagcttggcgagggggccatgcctgcaagctttaaagtgctacatgacgataagaagggtgttgataccctgcacgcggattttggtgagagcgcaattgggcgggttgcaccagtggattcgggcttctgggtggatcatactattgcgggcctacacaaagtcgacggggaatttgactctggcagagaggccggaatgccagaaggcgatgaggctcattctgagcctgtgcttgcctgagggatttgataccttcccgacattgctatgtgctgatggttgctgcatgatagatcgtaggatgggtgtgtatggctaccccattgaaattcaatcccttttcttcatggcactaaggtgtgctcttctaatgcttaaacatgacgctgaagggaaagattttgtggagcggattgcaactcgtcttcatgctttaagttatcacatgcggagttatttttggctagatttccagcagctaaatgatatttatcgttacaagacggaagaatattctcatacagctgtcaacaaatttaatgttattccagattctattccggactggctatttgatttcatgccttgcgagggtggtttttttgttggtaatgtcagtcctgcaaggatggacttccgttggtttgcacttggaaacatgattgccatagtatcatctcttgctacacctgagcaatccatggccataatggatctcattgaggagcgctgggaagagttaattggtgagatgcctctgaagatatgctatcctgctattgagaaccatgaatggcggatcgtgacaggatgtgatccaaaaaatacgagatggagttaccacaatggaggatcttggccagtacttctctggctgctcacggcagcaagcatcaaaactggacggccgcaaattgcaagaagagcaattgacctagctgagaggaggctgttgaaggatggctggcctgagtattacgatggtaagcttggaaaatatgttggcaagcaggcaaggaaatttcagacttggtccattgccgggtatttggtcgccaagatgctgctggaggatccttcgcatcttggtatgatagccttggaagaggacaaggcaatgaagccagttttgagaaggtccgcctcatggacaaactgatatatcgacaagagctttaggggagcaacgtctggattgaaaacacgaattattcgggtagcatttctctgctcatcccttgttttgactttcccaacggaaagttttattttcttctggattcctcggctgtacaatatctcggctcatttattgagttggaaaagaagcaattgtggaaatgagtattctcttttcttttcttttcaatccatcgttgtaagaagatactattgattcttgcttggtcattccgtagtaacgggatccttgactcaaaactttgttgtttgggttgagtatatagacgagtctgctgatccagcttcctatgatgaacatagttttatctaacgaataaagattgctcaatccngctaaaaaaaaaaaa

SEQ ID NO: 10209 - DNA, 2331 bp, Triticum aestivum
  Clone ID: PAT_TA_10209
ttgacaaccaaccgaataagacatgtacaagctctgaacatgccacctagaacaatcccatagcagcctcccaagtagggatggatttttgaagtactttagtcagaaaacagaaggcaaaaaaaaggaatatatctagctcatcctaccctctagattcagcacaagtgatggtatccatgcgagaccacaaaacaaacagaaagaaagtcaaactcagcaagcagagagatggaaagcagcaaattagatggttcgatagtaaaggttctgaggcaccaagtgcggcaaccagcttaggaacacaacatcccaggagtccaacaggccatcacaggccactactacatactactagtactagataaccaagcgcatcgccaaaagttggaacgcgcaagtgcggctggctggctggctcagcagaagaacatgctgctgcggactttctcatggaggcgaggcagctcctgcactggagcgctgccggcagaggtgtggccacctccctggctcgacgacgtctcggacatctcatcaaactttatgaactgcgccacctgagcagccgcaagatgtgcatagcagattggagaaacaactgatatggctgtcgtgctcctttgatacacatatgagagcgagtgcacaagatcctgcaggtcatccgcggcaaagtgtatctcatcatgcaggatatggtagtgcgttggccttgtagtcccaatcattccagcatgagcgcacatgtagaagtcataattccttggatggcagactgcattatctacaacagtgcccggagggacattgtcaggagatccaggtatgaagaacttggtgtggtgatttttctgagcaacaatcagcgtgaacttggggttccagttttcatccaagaacttgcaggcctcaattatttgatccaattcaatgttcagcacctgattaaactggctctcactaacaccatccctgaagatgatgatctgatctggtttcctttttccagaactggtgtagaagtcaatgagacactcccgaacaaggccatcatcatcagttccttgtggcttgaacaatgaatctatcatttcaagctttggtgactgcgagcgcactgaagccctatatttcgagacaagaggccattcccgagaaccaacaactgctgcaatggacggtatatcagactgtccaggggatccatgggacacatccattcccaagatgagagttgggacctttgatacaagaggtatacttggggacatttcaatttgtagcagtgagttcattccaccaagttttgcattgatcttcagcagaacatttgtcagatattggtcattgacccttgttggggccacacattgagtgacaatcccaaagtcagcgaaggcattttcgcttccatggaccataaacatctgagttcttcctctcagcaagaatacacaagagaaacttgggagccccaggaagcttagacttcacttgctcaaacatatcctcaaccctttttggagcaggtgcacgtctcattgcaccattctcttcaattacaatatgaggtttttctactgtaatgcccttcatgcccccacacttgatgaggtcattgacaaggttcatggtgttacacctagccgaaaagtttacaaccgcccatctgtcaaccacgcaagctctagcaagcctctgcagaagcataactagcaaagttatggatgaaaacatgcaggataagaatgcagtcaaaacaatgaccttgttgttgaaattccaacgtccattccttgtgaaaatatcttcaccatttccagctttgagcttgggggcctgcagtaccctaccagacacttgagtaaagccttgagctatcgaaattccacatgccttcagcatgggttctgtatcatagctactgcgtttcagtacatcagacaaaactgacatcctctcttgaggcttctgcctggacttctcaacaagagatgatctttgtagggtactcaaagatttggtatacctttgcaaaggcaccagctggcagagctcaatgggaaaatatgttggccgcctaggtttcccaacatttatacaagggaaatcaccagagtacctcagctcaatgccacggttcttcacaaagtaatcataaacagatatttctattgcttcagggtcaccatttccagcaaatacagaatacaagattgttggtttgagtgagaggaattgttatgaacagatgttttccctcaagcaaaggaatggtgggaatggtgaccctgaagcaacagatatttctattgctcggacgcgtgg

SEQ ID NO: 10210 - DNA, 707 bp, Triticum aestivum
  Clone ID: PAT_TA_10210
cagggcaccaatgcatcaatgaacccactattataataatccaaataacgcaaggcttagcagccagggaagtaatttgacgaaaattaaggcagcacttcagctgcaagtttactgaactgcatcacgacagaaagtctggcaacaatcatataagttcatgatgttcgaggtaaaaatctatcatcacaccataaaagagagttctacttcaggtttatccgataacatggaaactctaacatcctctcctgcattaaagaagctgatgacttccgcaccatctgaatcactcgtggagggtgcccagaatgtcatcgtctctgtagaggaggtactctttctcaggagcaagcttgacttcaagaccaccatactcaggcaggagcacatggtcaccttccttgagagcaacagggatcagcttcccttccttgtcacggctgccagggccaacagctatgaccttaccagagttcagctgcttggaggtctccgggaggaggatgccgccggcgctcttcttgggctgcaccaccttctccaccagcacccggttgaaggacgggatcagacgccgaatcgccgccatcgccgccgccgacgagatcagacgccgccgctcttctccttctccttcttgggaaacaagcaagaaaagagaacgagacgcttcccccacgcgtccgcccacgcgtccgcggacg

SEQ ID NO: 10211 - DNA, 915 bp, Triticum aestivum
  Clone ID: PAT_TA_10211
cgttagacagaaaatatgaaaggataaacaagttgggcaagtgagcgcagggagagatgggccaaaaattagagtaaagaggaagtaaggagaggagaacagtacgtagaagaaaggccggagaagcaaaaaggggagaaagtgccgacagaggagagaaaggtggagaaggaccaagaggttgttcacaatgcgggggagtgtgtaaaaaggacagccaaggaaattggaaaacggagcccataaaaaggcgaattgggggagagggcccccccccgggttatatgtatttgtgtggcgaaaatccaagggcagcacttcagctgcaagtttactgaattgcatcacgacagaaagtctggcaacaatcatatcaagttcatgatgttcgaggtaaaaatctatcatcacaccatagaagacagttctactttaagatttatccgataacatggaaactcttaacatcctctcctactgcattaaagcagctgatgacttccgcaccatctgaatcactcgtggagggtgcccagaatgtcgtcgtctctgtagaggaggtactctttctcaggagcaagcttgacttcaagaccgccatactcaggcaggagcacatggtcgccttccttgagagcaacagggatcagcttcccttccttgtcacggctgccagggccaacagctatcaccttaccagagttcagctgcttggaggtctccgggaggaggatgccgccggcgctcttcttgggctgcaccaccttctccaccagcacccggttgaaggacgggatcagacgccgaatcgccgccatcgccgccgacgagatcagacgccgctcttctccttcttgggaaacaagcaagaaaacgcgacgcttccacactcttcgcttttcgcctccaaggatc

SEQ ID NO: 10212 - DNA, 2096 bp, Triticum aestivum
  Clone ID: PAT_TA_10212
ggggagagtcttatgttatatatggtaatcgccccgcctatagtgctcggaattctatctcgcccttcctatttttaaaataaaaatagaaaaataggagaaaaaaaatatgacagaaaaaaaaaataggagcagaaaaaaaaaacccgagagaagcaaaagtaactttcgaaggtttagttacggaagccctacccaatggaatgttccgcgttcggctagagaatgacaccatcatcctaggctatatttcaggaaagatacggtctagttctatacgaatactgatgggggatagggtcaaaattgaagtaagtcgttatgattcaagcaagggacgtataatttatagacttccccataaggattcgaagcgtatcgaagactcgaaggatagcgaagatttgaaggatagcgaagatttgaaggataccaaagattcaaaggattaggtttttctttttttttctagggtaataaattctaagttctaaaattcaagcgaagagacttattttttccaaaagattagattcatagtttaaaaaaagatacggaaatatgaaaataagagcttccgttcgtaaaatttgtacaaaatgtcgactgattcgtaggcgtggacgaattagagtcatttgctctaatccgaagcataaacaaagacaggggtaatctttcgaaaaagaactttactttctaaaaagtaaaaaaaagtacccgcggaaatgttccaattccaaaataaaataatttcatttaaaataattaaagtaaagggtttattttaccctgaaacggatatctttgtatctttttttcttttttttatttctaactcatatttatgagataataaaatatggcaaaagctataccaaaaattggttcacgtaagaaagtgcgtattggttaacgttagggaatgcacgttttagtttacggaagagtgcacgtagaataacaaaaggggttattcatgttcaagctagtttcaacaataccattataactgttacagacccacaaggtcgggtggttttttggtcctcggccggtacttgtggattcaaaagctcaagaaaagcatcaccctatgctggtcaaagaacagcagtagatgctattccgtacagtaggtttgcaacgagcagaagttatggtaaagggcgctggtagtggaagagatgccgcattacgagccattgctaaaagtgggtgtgcgattaagttgtatacgcgatgtaacacctatgccgcataatggatgtcgaccgcctaaaaaaagacgtctgtaaaagaattaacccgctttcaactttcatttcaagagaaataaacgattcaatgataaaataataatactagtctattatggttcgagaggaggtagcaggatccactcaaacactacagtggaagtgtgttgaatcaagagtagatagtaagcgcctttattatggtcgtttcattctgtccccgcttagaaaaggtcaagcggacaccgtcggtattgccttgcgaagagctttacttggagaaatagaaggaacatgtatcacacgtgcaaaatttgggagcgtgccgcacgaatattctacaatagcaggtattgaagaatccgtacaagaaattttactaaatttgaaagaaattgtattgagaagtaatctctatggagttagagacgcatccatttgcgtcaaaggtcctagatacataactgctcaagatatcatcttaccgccttccgtagaaatcgttgatacggcacaacctatagctaacttgacagagcccattgatttctgtattgatttacagatcaagagagatcgtggatatcagacagaactcagaaagaactatcaagatggaagttatcctatagatgctgtatccatgcctgttcgaaatgtgaattatagtattttttcttgtgggaatggaaatgaaaaacacgagatactttttctagaaatatggactaatggaagtctaacccctaaggaagcactttatgaggcttctcgtaatttgattgatttatttcttccttttctacacgcggaggaagagggcgctagtttcgaaaa

SEQ ID NO: 10213 - DNA, 857 bp, Triticum aestivum
  Clone ID: PAT_TA_10213
gtgcctcctcctagcaagctatatacctacatagtacagccatggcccccaccgtgatggcctcgtcggccacctccgtcgctcctttccaggggctcaagtccaccgccgggcctccccgtcagccgccgctccaacggcggctagcctcggcagcgtcagcaacggtggaaggatcaggtgcatgcaggtgtggcccatccgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaacaacatggctcgagaaagcgtgctcgtatgtgaatgcaatcggtggctatgtatatgcacatgcacataatatattatacaatctgtcgactatgtattcgggtaattaataatgagaaacatctttgccaccgcaaaaaaaaaaaaaaaa

SEQ ID NO: 10214 - DNA, 3213 bp, Triticum aestivum
  Clone ID: PAT_TA_10214
cttcatttttttttttttttattttctttttttttgagatggaaagcagcaaattagatggtttgatagtaaaggttcaacagcagcatcctaacaggattcaaaggttctgaggcaccaagtgcggcaaccagcttaggaacacaacataccaggagtcccaacaggccatcacaggccactaccacatactactagtactagataaccaagcgcataaccaaaagttggaacgcgcaagtgcagcaggctggcgggctggctcagcagaagaacatgctgctacggaccttctcatggaggcgaggcagctcctgcactggggcactgccggcagaggtgtggccaccaccctggctcgacgacgtctctgacatctcatcaaactttatgaactgcgccacctgagctgccgccaagatgtgcatagcagattggagaaacaactgatatggctgttgtgctcctttggtacacatacgagagcgagtgcacaagatcctgcaggtcatccgcggcgaagtgtatctcatcatgtaggatatggtagtgcgttggccttgtagtcccaatcattccagcatgagcgcacatgtagaagtcataattccttggatggcagacggcattatctacaacagtgcctggagggacattctcaggagatccaggaatgaagaacttggtgtggtgatttttctgagcaacaatcaacgtgaacttggggttccaattttcatccaagaacttgcaggcctcaattatttgatccaattcaatgttcagcacctgattaaactggctctcactaacaccatccctgaagatgatgatctgatctggtttcctttttccagaactggtgtagaagtcaatgagacactcccgaacaaggccatcatcatcagttccttgtggcttgaacaatgaatctatcatttcaagctttggtgactgcgagcgcactgaagccctatatttcgagacaagaggccattcccgagaaccaacaactgctgcaatggacggtatatcagactgtccaggggatccatgggacacatccattcccaagatgagagttgggacctttgatacaagaggtatacttggggacatttcaatttgtagcagtgagttcattccaccaagttttgcgttgatcttgagcagaacatttgtcagatattggtcattgacccttgttggggccacacattgagtgacaatcccaaagtcagcaaggcattttcgcttccatggaccataaacatctgagttcttcctctcagcaagaatacacaagagaaacttgggagccccaggaagcttagacttcacttgctcaaacatatcctcaaccctttttggagcaggtgcacgtctcattgaaccattctcttcaattacaatatgaggtttttctactgtaatgcccttcatgcccccacacttgatgaggtcattgacaaggttcatggtgttacacctagccgaaaagtttacaaccgcccatctgtccaccacacaagctctagcaagcctcttgttgttgaaattccaacgtccattccttgtgaaaatatcttcaccatttccagctttgagcttgggggcctgcagtaccctaccagccacctgtgtaaagccttgagctatcgaaattccacatgccttcagcatgggttctgtatcatagctactgcgtttcagtacatcagacaaaactgacatcctctcttgaggcttctgcctggacttctcaacaagagatgatctttgtagggtactcaaagatttggtatacctttgcaaaggcaccagctggcagagctcaatgggaaaatatgttggccgcctaggtttcccaacatttatacaagggaaatcaccagagtacctcagctcaatgccacggttcttcacaaagtaatcataaacagatatttctattgcttcagggtcaccatttccaccattcctttgcttgagagaaaacatctgttcataacaattcctctcactcaaaccaacaatcttgtattctgtatttgctgggcttgtttttatccttaaattcttaagtgcacgcttggccttagcccaatcaattttattagggtggtcaaccttctggttggccagcagaaaatcaacaacagggccaggtttcacaatcattgttgtagaaacatcaatattaagagaaagcccgctctgtgtggctcgaaagcttgagtggaaacctcggcagcccatcacacccccacccaagtccacaaagtttgaaggattgttgtgaaaaaatgactggcggactaacaggcagccctgtttggcagagtgctgtcttaatatgatatcaataacccgaatggcttcttgcgtgtgctctgattcctggcctttgagtgccattgcaatagcactcatggggattctagcagcaaagctcaactccaccttgaaggttttagtttgatatggccttttcactctcttcttgtcatttcctggactgtcgtttccagggctgccatttgcaggagtctttccactggaaacatcttcaagaaccacaacaaactcattgttaatttgtgggagggcaccaatggtaaaaagactcttttcaccatcataggcaaagtctttatgggctagctccgatgcataagtctgtgaaagcttatcaatgacttttctaccaacaccttttccatcaacaggcctgtcatcttcatacttcagatttacatagtaatgatggaagaactcatctgtcgtcttcaacgagactttgaaatgatttgtcacaagctgtataggatttcccctcttgccaaaaccaggacgagcaatcagggccctcttaggctttgagatcttctttgcttcttcaggtttgataggcggcaggggtggtggtggtggcaagtcatcagccgactcagcttttatcggctctgcatttggcgggagtggtggtggtggtggcaggtcctctccgtgtgactccatttcagcaaacccacaatggtccggaggagcagaaccgctgaactgatctgcgagggcgcaagggaggaagccttgccgttggcctccgcgagagagggcttggctttcttttccgttccccttcggaactcgtctctccccctcccctctcctcgaacacggacgcgtgggtcgacccgggaatccggaccg

SEQ ID NO: 10215 - DNA, 1048 bp, Triticum aestivum
  Clone ID: PAT_TA_10215
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggtaaccaatggaaaatatctccaccaccgtgcttattacttcctctgtaaattaatatagagcgtttcgatcactgctttagtgatctaaacgctcttatgttagtttacagaggggatactttttattaatagtggacggttggacgttgtcttagtttgtatccctgaaatgtatggttgtaaacatggccccacagaatgttggccaacaatataatattagttgtatttataagtgtg

SEQ ID NO: 10216 - DNA, 1497 bp, Triticum aestivum
  Clone ID: PAT_TA_10216
gccggccggtccggactcaagccagagtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcatgtaccaacatgactcgagaaagcatgctcgtatgtgaatgctaccgatggctatgtatatgcacatgcacataatattataagtacgccgacttctacgccggggtctacgacatggtccggagccccagcaaatacgggttcagctcggtgttcgaggcgtgctgcgggtcggggggaggcaagtacaactacgccaacagcgcgcggtgcggcatgtccggcgcctccgcctgcgccagcccggcgtcgcacctcagctgggacggcatccacctcaccgaggccgcctacaagcagatcaccgacggctggctcaacggcgccttctgccacccaggcatcacccactagcccagccactcccactggtcgatcaatcagctcatgcatcgtcgtccatggatccatcattaatcaatcaatcaatcgattattattattatattattataattatttgttcagtcgggttaatttttaggaaacgtttctggggactggctaaggctgggttcctggtctggtccggtggcaaaaaatcggggcgcgtgtgtggtgatgaagaaaggggggaaaatgacggcaactctcgtggaatagtactgcctgtgttgctgtgaacctgtaacctccccgcaaaaaaaaaaaaaagaacctgtaacctgataattgttttgttccacggaaaagtggtacagttgaatgaaaaggaatgaaataataaacacgataaaaaaaaaaaaaaaaaaactcgagactagttct

SEQ ID NO: 10217 - DNA, 1649 bp, Triticum aestivum
  Clone ID: PAT_TA_10217
gccggcctggttcgcgtcaagccagagtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatgtcgactatatacgttttttttttccattggttaccattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctgatccttccaccgttgctgacgctgccgaggctagcgccgttggagcggcggctgacggggaggccggcggtggacttgagcccctggaaaggagcgacggaggtggccgacgaggccatcacggtgggggccatggctgtactatgtaggtatatagcttgctaggagc

SEQ ID NO: 10218 - DNA, 842 bp, Triticum aestivum
  unsure (1)..(842): unsure at all n locations
  Clone ID: PAT_TA_10218
ttgctaatgcttctcttgaagacaagttgtcatccacagaggcgcagcttaagcaacttcatgccgaaaaggcagaagcatctgctgagagtgagaagctgatctctggattgaagcaagatattgccaatcttaagacagagctcgagttactgtcctcacagaaagctgcagttgataataaggtgtctggtttgctgagtgatctcgcgacttgtgatgaaaagatgaaggagatggatagccacttgcatcagctgcacctggagcatgtgcaagtgattgcagaggcagatgccgcacggaagtccgtggcagacctgcgtgcacgggtctgtgagctcgaggaagaggttgagaagcagaagctcatggcctttgacagtgcagaggggaagcgggaggcaatcaggcagctgtgcttctcgctcgagcactaccgcgacgggtatcagcacctccggcaagttctgcagggccacaagaggccgatggtgatggcaacgtgatcagccagccagcagcttgctggatcctcttctctctggatgcctaaagtcagtatgtcaatgtaatgtaaacatccctttccccttcccctttcttcatgtagcttcggtctactccttaggagtcttggtaaagcttgtgctctgtagttgcttcagctactggtaccgtctattgtgtgtgatgtaatatattttggaccattatgccattcctttttcaatcaatctgcccgttgttgccgtgagtctgaagatgatcgctgtgtttgttctctcaaatcctgacgaacttgattgctgacaaaaaaaaaaaaaanaaaaaaaaaaaaa

SEQ ID NO: 10219 - DNA, 2089 bp, Triticum aestivum
  Clone ID: PAT_TA_10219
ctggaggacggccccgcccggcatctgcagccccctctacgctcccctgccctccagccggcccctgaaggaggcccctcgccggccgcgccgatccccggcgagatctctggtctaccttttacaagattccctatttatcgtgagaatgaagcgcatgagtagaatgcccacaaggaaggcccattcatggtggtgggacagtcatattagtcccaaaaacaacaaatggctatgctgataatctaagaagagatggataagcaagttaaagacgatgctgaagctcatttcaggatggaggagagtctttggcaaagatggctgaggatgtaagtaccaggagcggcctttgcttgtcacccatgttgaaaatttctacagcgagtggcgtgctcgttgcctgagcgttgatgacaatgtagactggggaactacgaaaagagatgccatcatctcgcaaatcacaggacgcaccgtatgtctgaaactgacgccgaggcacagtctactcccgcatctcctgattctgaaaagaagacctcaaaagagaaaagctaaaaaggcaactgattgttcatcaccatcttcttcttctgattctgattgcgagatcggtcaaccggaacaggggaatggcaatgggattgcttatgcactgaaagaacgagttattgagctaaaagatgagctcaaggaaccattggagaaacttgaggcactcgaggaaaagaatatgcggtgccaatgtgaaaaccttgaagagaagttgctagcttcgcaatcagaaatcaacagccttcagaaggatcttgaagaaaagatccgttcattggagagtatcaaaggaattagcagtgaaaaggaggatttggaagctgcagttctggaaaacaagtacaagttcgaggaattaaaaggagaaatggccttagcagctaagcatcatgaggcccaactttcatatcgtgaccttgaaattgagaaatgcaagcgggagcttgaggaagtatctgagaggtatacctatgataagtctacccttgagactgaaatcagagagctccaagaagtggtcaagaacttggaaggaaacttggcaaaactgtcggaagagaagttgcagcttgaggaacaggttatggagcttgaacaaacatctcacagcttagatgattcatctgccgaaattaagaagctacaaaaggtaatcaaggatctgcaagcaagactggaaaatgattcaaatgagaagagagtgctcgagtcacgtgctatcgagtttgagcaagttcatagggagttggaggattcgagggctgaaacagtggagctacaaactagaattgagaaactcaaagctgatctggaaggagcacttcaagagaaattgatgttggagggctgtgtcaaggatctggaacatgccattgctagtaagttggagaaatcctctcttgagaagtcctctctcgatgctgagatcctacaactgtcagaagctaatgcttctcttgaagacaagttgtcatccacagaggcgcagcttaagcaacttcatgccgaaaaggcagaagcatctgctgagagtgagaagctgatctctggattgaagcaagatattgccaatcttaagacagagctcgagttactgtcctcacagaaagctgcagttgataataaggtgtctggtttgctgagtgatctcgctcgagcactaccgcgacgggtatcagcacctccggcaagttctgcagggccacaagaggccgatggtgatggcaacgtgatcagccagccagcagcttgctggatcctcttctctctggatgcctaaagtcagtatgtcaatgtaatgtaaacatccctttccccttcccctttcttcatgtagcttcggtctactccttagtagtcttggtaaagcttgtgctttgtagttgcttcagctactggtactgtctattgtgtgtgatgtaatatattatggaccattatggcattccttttcaaaatcaaaaaaaaaaaaaaaaaaaaaaaaaaaaaaaaagaaaaaaaaaaaaaaaaaaaaaaaaaaaaagcggccgct

SEQ ID NO: 10220 - DNA, 1405 bp, Triticum aestivum
  Clone ID: PAT_TA_10220
gtcacggatacggggcggtgggggacgataggacgctcacacggcggcgttcgccagcgccgtggcggacctgggcaggcgcgcgggcgacggcggcgcggcgctggtggtgccggaggggcggtggctcacggggcccttcaacctcaccagccacttcaccctcttcctccgtccgcccacgcgtcccctcgcatcccaggacctggacgactggccgctgatagcgccgctgccgtcctacgggagggccggggacgagcccggcccgaggtacagcaacttcatcggcggatccaacctcaccgatgtcatcatctccggtcacaatggcaccatcaacgggcaggggcaggtgtggtgggacaagttccacgccaaggagctccactacacgcgcggctacctgctcgagctcctctactcccgcgacatcatcatctccaacgtcaccttcgtcgacgcgccctcctggaacctccaccccacctactgcaccaatgtgaccatcagcggtgtcacgattctcgcgccggtccactcgccaaacaccgacgggatcgacccagattcttcgtctcatgtcaagatcgaggactgctacatcgtgtccggcgacgactgcatcgcggtgaagagcggctgggacgaatacggcattaagttcaacatgcccagccagcacatcgtcgtcaggaggctcacctgcatctccccgacgagcgccatgatcgcgctcggcagcgagatgtcgggcggcatccaggacgtgcgcgtggaggacaacattgccatcaacactgagtcggccgtcaggatcaagtccggcgtggggaggggcggcttcgtcagggacgtcttcgtgcgccgcctcagcctccacaccatgaagtgggtcttctggatgaccggcaactacggccagcaccccgacaactcgtccgaccccaaggcgctgccggaggtcaccggcatcaactaccgcgacgtgttcgccgagaacgtgaccatggccggcaggatggagggcatccccaacgacccctacaccgggatatgcatgtccaacgtcaccgcacagctcgctccgaaggccaagaagctgcaatggaactgcactgatgtccaaggagtggcatacggcgtctcgccggagccatgcccggagcttggggcagagggcaagccctgcacattcccggaggaagagctcgtcatcggtccgcctgaactgcccaaatgtacctactgatatatcatgcgtatgggatgttatagccaccagggttagaaccaaacagatgatgtactttgtgtcttagtatagtcaagcagtttgaaaatgctgcagaataaacacatgtgggcaatggaatgaactccccaaatgaatttcccctgcccc

SEQ ID NO: 10221 - DNA, 967 bp, Triticum aestivum
  unsure (1)..(967): unsure at all n locations
  Clone ID: PAT_TA_10221
gccaagttggcagcccgccgatgttccggccgcccgtgctcgaacaaaccggccggcccacggtccacacaccccaggtgctcggacgcacggccgggcatcatggtcgtcataactcagaaccccatgaaggtggtgaccaagcaagaaagaaaggaactttcggcgcaaagaaaaccacaccccagggcaggaacatgacctactctcgccattccatgtttctgatcgatcgaactcttcggtgaccaaaaaatgagaaaagggcaggtcgtcgatgtacagaccacaggcgctcggacgcacggccggcatcatggtggtcatagctcataacccatgagggggtgacgaagcaagaaaggaagaactcccggggcgacgagcccaatggccttgtacttcgcccagacaagcaccattgggtcgaccttgcagccagcggctgcggccatgcattcggcaattccatggcatgatgcatataaattggatctgtagattcatgaagctccaagcgagcaagaagtttcagtccacctttactcatggcctccccttctcgtctggtggaccgcctggacaatctgaacaagctttacgcgactggcactcttgttgatcccatatgagtcattaagccgttttgtgcgcaaggttgagatagttggggcctataactgtgttttgatcccatgaatgtcattttgcaccgaaggtttgtaaccattggggaatgttttcttgctctgatgtatcaagttgccatgggggtgatctagaggtctcttccttgtccgaagtatgtcatacctaatcaagacatgttcatttaatttacccgtcatgtaaatgacacaacatgattcacttgtgtatagtgtaaaaatatatttatttatggcacacaggtgttcaaattttagttgtaaacgtgtatagtgtagaaatanattattaagggatg

SEQ ID NO: 10222 - DNA, 496 bp, Triticum aestivum
  unsure (1)..(496): unsure at all n locations
  Clone ID: PAT_TA_10222
cgtccgcggacgcgtgggcggacgcgtgggcggacgcgtgggttgatatattggaggttggagatggaggtgctggtggtggagtatcacttgctggtacatggtggggcaaggaagctttggcattggccgaggaggtttcaacatcattcgatggcgacttaaaaatttatgctttcaaggcaactgcaagtttagaaatcagagttcgcatcgagaagatgtccactaggtatggttctccaactattgatgacattgaagcatacacaattgcataccgtgcaaagttggatgatgcagagtcagcaggcaggataccaaagaacgtatccttggaggtgtcatcccccggcgtggagagagtcatccgtgtcccggacgaccttgaacgcttcaaagaacggtcgatgtatgtcagatacgttatgacaagcgaggatgcagccacggcccangaaggcgacggtgtgttcaggctcatttcgtacctcgg

SEQ ID NO: 10223 - DNA, 1204 bp, Triticum aestivum
  unsure (1)..(1204): unsure at all n locations
  Clone ID: PAT_TA_10223
aaaaaaacggattttttttcatgaatgttcacaaggacgtgcctacaatccctaaaaactccaaatacaaatttggatttaccattttggtttcttccaagaatatttcgaattcaaatttggagtttttagggattctagacatacatgtcttgtgaagaatcacaaaataaatccagaatttcttggaacttacaagcttgattttcgtggcatggtacaatgtaatactacatggtaagaaataacatgtcatttctacctcaagatggagctacatgttacaatatatagtatatatacgcccccatcacgcaaaatttaggggcgcactccacatatatcaaaaacatgtaccgggctgtctatgaccgactgaccgactctaaaccaatacaaccgaggacgctcaacgatgaccttgtcgagatctgaacgaaccgtttgccgatttcagacaatttccacccctccacctgtgctctccagaaaaggaaaacccaaagaatgacccactgtaagcagcatgaaccgattggctgtccaagcccacttgcaaaaaagaactctccaactgagacagtcatagcagcatcccaaaaaatgttgtttgtcacctcttgctcgacatggatcttgtccctaactactcactgatccatgagtaggtcaccagacacatattgtcttactcagccaccctctcgtagaaaaggatataagcctcgcagttgagaacctcctccagagaggtttctctgacatgtgaatcgctcgcgtaaaaccaagatttggaggagcggctctgctgctgccgaccccctatcttgccagatcttacatatgcgacataatgcccccctgtcatgcttcccatgtgctcgacgacagctaccagccgataagtggtgatgtcattatcctttgatcttgggtccatgtacggtcgtatatcgagtgtctccttaaagcggacatgccctttcagttttctgaaccgaccatgagagtcgtggctgaatctgttcaaagtaatcgtcaatacaggtggtgccttgctgataagaattcttctcattgcagctctgaaaacctttgtttcatcctctttctgtttattttggttatcttgtcctttgtgtgccttgacaaccatcttcattctcttcctccttccgatattnccttgtgaagccatcttcat

SEQ ID NO: 10224 - DNA, 894 bp, Triticum aestivum
  Clone ID: PAT_TA_10224
tcgtctaaggatttaaaaatatacgcacttttacatgtatgttatctcagatttggataacctcagagacacatgatggcattaacatatcaggattcaggaatcaaattatcagtttcatcacgaattagcaacgacaaacaagtatcgaacaggcatataacagccaacagcggacaaacaacatccactaaggcaaagaacaccgtgacaggaattagcaccttaccacacggagagaaattttggttctgccatacgcagtcccaattttcatagcccattcttggttcccgtcaatgtggatccagtgggcacttcccctcggcaagctgtggcatagtactcagcgaggtgcggtgcagcttccttatgagggcatatatacacctcaaagaataccttctcggttgccttgaagattggatagtacttggggacgcgcttgagcaatccatttgccattagaaacattataacgtcgtacctgggcctgagccggccttccaggctaagacagagtattaccggcagacgagcaatgtaggccggttccaaccccaccttagagataaggaactcggacttacgcaggagcatgccctttgatctcctcagcaacgatggatacctagacagagcaatgcgcacctcggcatcggaccacctgaacgtgttcttcaagtagtccagtttggcggcgatctcctcctcgctgaggaacgcgacggcctgcagcgcttccctaaacatcccagagccgcggggcacgcctacagcttcggcgcacgctgccatcgcccggacgcgctcggggttggtggtcagaagcctcggcgcattgacgcacagcgaggcaatatgtcgaacatctaccccgcactcccgcacctc

SEQ ID NO: 10225 - DNA, 830 bp, Triticum aestivum
  unsure (1)..(830): unsure at all n locations
  Clone ID: PAT_TA_10225
cgtccgcccacgcgtccgtcatcatccagcttctctttcacagtttccaggacttatacttcgtgaaataaaaggtttttggcgtgtggcactgtttatctcaattcttgtctatccagaagttggcaatgccagtgattccctcggtaagcaggatgaactagataaaaggaaagagagatacatcagtgtggagcgatcaataactaaccttgatcttgatggcgtatggaaaatgaagccgttgcttgatggaaaggccattatgggggtcatgcaggtcaagtccggaggtcccttgattggaaaatggcaacaacggctagtcaagtggcagcttgcgcatcctcagggaactatggaggagtgcatggagtggatgaagcagtcggaacagcagtcaaaacgccagaaaatagaatgcagcacttgagcatcattgactgacattttgattttgagcttaggcagtccttagaactcagtgataggtcacaaacttcacatggtctctgtccgtgggtctctgtccgttgatcttgattgctttgccaccatggctacttttgcgttcctggtttccttccattggagatggatgggacgttactctctgacatgtactccctccgtgccaaaataagtgtcaactttgtaataactttagtataaatttgtactaaggttgagacacttattttgggacggaggaagtagtaaaatagtttttctccacctgagtctatttgagccttgtatgaatatgtttctccaacaaaaaagtaggnttttactccaaaaaagnaatgcaagacacaagatgtnatggg

SEQ ID NO: 10226 - DNA, 1353 bp, Triticum aestivum
  Clone ID: PAT_TA_10226
gcaattaggcacttgcatttctgaattgcgtccccaaaatggcatagaggtgtatggccctatgctttgctgttgctggtgatgcaacacccctgcagctagcagcattcagttgagatggttcttcggttagcgattgctttcagctgatacacgccatttttccggatcggtccatctgccggccgatcgccgggcagcctctactgaaaggaagctgaccactggtgctttgctgggctgagctgagccatgggaggaggagattatcaccagcagagcctcatcggcggtgcggctgttcatggccatggagggcggattcggggtcggaggggagcgacatgcagctgggggaccccgacgacggcgagacgcagaggggctccggcaaagacggcggagggaagcggcagcagtgcaagaacctcatcgcggagcggaggcggcgcaagaagctcaacaaccgcctctacacgctccggtccctcgtccccaacatcaccaagatggaccgtgcgtcgatcctcggagacgcgatcgactacatcgtggggctgcagaagcaggtgaaggacctgcaggacgagctggaggacccgaacccgcgggggggcaccggcggcgacagcaaggcccccgacgtgctcctcgacgaccacccgccgccgggcctcgacaacgacgaggactcgccgcagcagcagccattcccgtccgccggcggcaagggggcccggaaggaggaggccggagacgaggaggggaaggaggcggaggatcaggacatggagccgcaggtggaggtccggcaggtggaggggaaggagttcttcctgcaggtgctttgctcccacaagtccgggcgcttcgtccgcatcatgggcgagatcgccgcccttggcctccagatcaccagcgtcaacgtcacctcctacaacaagctcgtcctcaacgtcttccgcgccgtcatgaaggacaacgaggcggccgtgccggcggacagggtgagggactcgctgctggaggtgaccagggaaatgtacggcgggggcggcgcgtggtcgtccccgctccctccgccgccgtcgacgaacgcgaagctcgatggcatggacgggcaggcggtgccggcggcggccggggaccactaccagctgcaccaccaggtgctgggagggtatcatcatcagcatctgcagtacctcgccatggattgatagattccctttattattcgctacgataggtcgcatggatggattaattagttgatatactacgtaattagttcccttcctgctcgtagtttgttttccctcgtttgttcgttaaaatgtgtgaagtttaact

SEQ ID NO: 10227 - DNA, 2242 bp, Triticum aestivum
  Clone ID: PAT_TA_10227
ccacgcgtccgatccgcggcacgcggcgccgagccgcagccgaccatcgcccgcgagcgccaggcccttcacggccctggcgtggggagcgccgaccccggggcggccccgcgcgggacgcggctcggcggcccccacggccgcgccgacggccgttcgcccacgcgcccggcgacccggcgcttgcatttctgaattgcgtccccaaaatggcatagaggtgtatggccctatgctttgctgatgatgatgatgcaacacccctgcagctagcagcattcagttgagatggttcttcggttagcgattgctttcagctggtacacgccgtttttccggatcggtccatctgccggccgttcgctgggcagcctctactgaaaggacaagctgaccactggtgctgagctgggctgagctgagccatgggaggaggagattatcaccagcagagcctcatcggcggtgcggctgttcatggccatggagggggagggggcggcaccgtggaggctgcgctgaggccgctcgtcggcggctcccacggctgggactactgcatgtactggcggctctctcctgaccagaggttcttggagatggcggggttttgctgcagcgcggagttcgaggcgcaggtggcccctcccgccgacgtgccttgctccatccctcttgactcctcctccgtcgggatgcacgctcaggcgctactgtcgaaccagccaatctggcagagcagcggcggggcgccgggtccggatctcctcacgggctacgaggctgcctccagcggcggcgagaagacgcggctcctcgtccccgtcgccggcgggatcgtcgagctcttcgcgtcgagatatatggcggaggagcagcagatggctgagctggtcatggcgcagtgcggcggcggtgggcaggggtggcaggagacggaggcgcaggggttcgcgtgggacgcggcggcggcggcggcggcagacccggggcggctctacgcggcggcgtcgctcaacctgttcgacggcgccgggggaaagcggctccggcgagccgttcctggcgggagtgcatgacgacggcgcggcgggcgtggggtggcagtacgcggcggagagcagcgagccgccgtcgacagtggcgcaggagcatcagcagctgcacggctcgggcgtggggagggcagattcagggtcggaggggagcgatatgcagctgggggaccccgacgacgacggcaacggcgagacgcagaggggctccggcaaagacggcaaagacgcagaggtccggcggcagcagtgcaagaacctcgaggcggagcggaagcggcgcaggaagctcaacgaccgcctgtacaaactccggtccctcgtccccaacattactaagatggaccgggcgtcgatcctcggggacgcgatcgactacatcgtggggctgcagaagcaggtgaaggacctgcaggacgagctggaggacccgaacccgccgggggtcaccggcggcgacagcaaggcccccgacgtgctcctcgacgaccacccgccgccgggcctcgacaacgacgaggactcgccgcagcagcagccgttcccgtcggccggcgggaagcggccccggaaggaggaggccggcgacgaggaggagaaggaggcggaggaccaggacatggagccgcaggtggaggtccggcaggtggaggggaaggagttcttcctgcaggtgctctgctcccacaagtccgggcgcttcgtccgcatcatggacgagatcgccgccctcggcctccagatcaccagcgtcaacgtcacctcctacaacaagctcgtcctcaacgtcttccgggccgtcatgaaggacaacgaggcggcggtgccggcggacagggtgagggactcgctgctggaggtgacgagggagatgtacggcggggccggggcgtggtcgtccccggtccctccgccgccgctgacaaacgcgaagctcgatggtatggacgggcaggcggtgccgacggtggccggggagcactaccagctgcaccaccaggtgctgggaggatatcatcaccagcatctgcagtacctcgccatggattgattcatcccctttattacttgctactataggtccatggatggattagttttctttttctttagcaaaagaaaaagagggttccctctccgatttcgttaatgaaaccaaagacaaccaaaaaaaaaaaaaaaaaaaa

SEQ ID NO: 10228 - DNA, 1062 bp, Triticum aestivum
  Clone ID: PAT_TA_10228
taagtgggtcccactggtgaagtttcctatattctcaacatacataactactatttcaaataggagagaacaaacatagttcatcaaataacactacattagccttttacaatccattacaatattacaatttatagtctactacagagccaaaagaactctttgcaaagtacggcttcactgcttcgcacttggcttcacggattcacactaaaaaaattaggactggagctcctagttgatgagggcggcagagcgggagacgagctcgatgtcgttgccatcgaggatgatctcatccttgaccttctcggactgcatctccgccagatgcagcaacaacgccttcgacaaccacaacagtagcaccaataatgaccctgcgtgccatttcatatcatcattacagaataaaaaaaattaagacaaaggcaacaaatatagcttcagcattacggaattatcatgtaactgttgagcagacaggaatatagcttcaacattatagaattatcatgtaactgttgagcagataggaatatagcttcagcattatagaattatcatgtaactgttggctgtgaagctgtcaagcagaaacctgattgtaaactatggactatgagatgtcacagccgatccagtggaccgtgagatgtcaagcagagcaacatctactagagcaacagctccatggactaaaataaatgccacaaggatcatgagaaagagctaaaaaggtttgatgtaaaagagtgaacatgaagctaccattggagtgtactactgttgaggccagaaccaaataacatcaatggcaacactaaatgtaagtggtagaacagatctaaaaaggtaaacaaaatatgaattatggttcacttaagatgtgataaatttttagcaaatttgttcgtgggagtaaccttaatcgttcaaaatcagagttgaaaatgcaaggaaattaagttgcaaaagacaatgaggtattctatttacacaacattgtcaacaataaatacaattctctacgagctgccagggctgctaggtgggcacacc

SEQ ID NO: 10229 - DNA, 925 bp, Triticum aestivum
  Clone ID: PAT_TA_10229
gcgggagcaatgtcggagcagccattgccctcctcctcctttaagcaggcagccgcagcgggggctccaacggccggctagctgcttaaaggaggaggagggcgggagcaatgtcggagcagccattgccgcagccgcggagcagcatgagggaggcgctgcagaaggaggacaaggagaaggcgtcggcggcggcgccccctgccaaggagaaggcggccgtgcccccgccccccgtcgccgcgccccccatggccaagaacggcggtggagggggcaagggcggcaacggggcccagccgccggcggcggaggagacgacgcgggagatccaggtggtgcgcgaggcgtaccggcagccggcggccccggcgtacgtgatgccggaggagccgcccgccatggtggagctggtggggtggtacctctacggcttctgctccttcttcatcacccacctgctgctgccggtgctgttcccggccatcgtcacccaggtcgccttcccctcctccgacttcacccccgaccaagtacaccgtcaagggcgccttgcgtcagagatgtccatgtaccagaggctgaccaggtactccattgacttctctagctcccacatgtcgcccctgggctggagcgcgctcgtgggcgatcggcatcctcctggcggcgctgttcctcacaaagtgttaagttcgattactgcctcatgttgatggcattgtttctttttggtgatctaatgtcgcttaggttgctgctgctgtgctggaagcacaccacaactttagttgatgtgtatctatttttgcttgttttagttgatgttggacgtgcagacttgtatgtgctgttgtgtgtatttgaatgaatgatttctgaatttaatcatttaattgagagaattatcgagtgtttgctgttc

SEQ ID NO: 10230 - DNA, 2376 bp, Triticum aestivum
  Clone ID: PAT_TA_10230
ccacgcgtccgcttcacagctctctctctctctacccccaaaaccccattgcattcccggctttcaaatccgccaccttttcgtccgcctatttctctctccaccctctactgctcccgagaagagagaagagagagagaggaggaacccaaggcgaggccggcctcaaaagaaccactcaccttcccgcagccactctctctctcatcacgcacatcacacacgcccgctggtagctgcagccgccgctcgctctcaccggtagctagccggccgttggagcccccgctgcggctgcctgcttaaaggaggaggagggcgggagcaatgtcggagcagccattgccgcagccgcggagcagcatgagggaggcgctgcagaaggaggacaaggagaaggcgtcggcggcggcgccccctgccaaggagaaggcggccgtgcccccgccccccgtcgccgcgccccccatggccaagaacggcggtggagggggcaagggcggcaacggggcccagccgccggcggcggaggagacgacgcgggagatccaggtggtgcgcgaggcgtaccggcagccggcggccccggcgtacgtgatgccggaggagccgcccgccatggtggagctggtggggtgggaccgccccctcgtcggcgcccgccatcctccccgtggcgccgctcctcacccgggtcgcgccccacctagaccggtgcccgtccccgccgcccatcccaccccccgggccatgtttcgggtcctgcttctccctgctcaccggcttcttcaagacggtctccagtggctcctgttctacatccttcttcatcgccgcgtccatcatcatcgcctgggcggggcacacccccaacctcgggctgatgatccgcgggcttgcccgccactcacccaggttgcgcaccacctcgacaggggccagtaccagtcgctcatcctcatcgccgcggcaccgccatcggccggcatcggggcggcgctcatggctgcgttcacggaccacatgtttgtggtgcactgaccatctcaccgggcctctgggtccgtctccatcttcagtggactcatctggtctgaccgatatctgccagggtcgtcgtcaacgactcagggaagcaccttgtcctgcgccgccgcgctgctgccagccagctcatcctctactgcacctgccatcggcggcatcggcgcggccctcatggctgcgttcatgtaccacatgctgtcgcgtcaccctccgcctcaccggcctccggctcctctcgcacgctctacgccattggcggcgtctgcatcaagccggtcctggcgcccccgacgtgcccacccgctcttcaccctccacggcattcgagccgcacttcatcagcccgctccagttccgcctgcccatccgccgccgcccaccggccagctgctggggttcggcagtgttcctttcgtcttttgccccaatgtgcatcttcaccagtggcacgctctatgccattggcggcgtctgcatcaagccggtcctggtgctcgcgctgtgaatcctctacttcttggccccgctcatctcgctgacgccgctccacccggtccggaggatcagttcggccgacgccgcgcgcatgcaccttgccgggtccacatgagcgccttccgtctcccgcgccggggccctcgtcaagagccacaggtggagggccgcccacatcatcatcatcgccctcgtccagagcaccgccaacggcatcctctactccttcggccgcatcctgctgctcgacgcctcgccgccgggcaaggagggcgcgttcgccatctggtacgcgtacgtccgctgcatgggcgccatgatcggcttcgccgttgcatctgctggccctgggcgcgcgggagggtcctttgctgccgccttcctgggcagcttcctcggcatcatcgtgctcatcttcggcaacgtcagcaacatcggcgcgctcaaggccgccgggcacctcaagggcatggaggacgacaagaggatcggcgagaagggcgagggcatgagcgccgtcgccgactccggcgagtctagggggagggtatgattgattacatggggctggaaagaaagattgcttgccgccattgttgttgtggtgggttgtgcttgtgagaagggtatgatttgttcttcttttttttcttgttttttctttcttgttcatgtctcagtgacactgttaatccggtgctctgcccctttgatgcatgatgattatgatgatgttgacatagtggtagagggagtgctagcagctctgttaatgtgttaaattcttttttgcttgaagacagacaattttgtaactgatgcatgaaaaaaaaa

SEQ ID NO: 10231 - DNA, 753 bp, Triticum aestivum
  Clone ID: PAT_TA_10231
ttttttttttttttttttttttttttttttttttttttttttttttttttttttttcttcagacctcaacttaaactacaggttaaccacccaaacttttcatcagtattcaacttaactacggatagcttaaagtatctactacatacatccaaaaggtaacacaatccaacatataagccaccacaaagttatagcctgcaaacgaaagaaccgagtacagccacttctttcccaaaataaacttgtatcattgttttcatctagagaagccactggaagacaattgaaattgaacagtcataagttgactcattgaaggtgatgagcacaaccgggcccgtggctcgtgaagtggctgagatgaactcgctgaaactggtcttctcgatcaccatcctcccatgttgcttgcacagcttgaaagatgatggcatgataacatgtgtatcacccaggtaagcttccagagagattctagcactgattggcatgtcaacaaagttcctcaagctaaagacaacgagctttggaattttcatggtgaacttctcagtatttgtggcagtcatgacatgcacgaacggaacgcagtgcacgaagcttgaagtccggaaaattgaccgtacaaacaagcggttgttgtgatagttgaactccaagccgcgtggcatcacagcagagcaaactagctcgtaccttgcattgctgaggttttcaaaagcaatagaaggtaaaggaagaatcctttcg

SEQ ID NO: 10232 - DNA, 418 bp, Triticum aestivum
  Clone ID: PAT_TA_10232
cgtccggcgagatacctctctctccccgtgcagcgaaccctagcgctctcaccctctcagccccgcacttcctcctggatctcgatgcgccgccgtccccaaccccactccctccctctggatctcgacgcgccgccgcccccaccccactccctcccatgctgtccaccggcgttcccctcacactctcaccgctcggccctctcatccgcctcccgtcctctcggccgcggcgccctccccatcgctatcccccaaccccggcagcgacctcaacagccagataccactcacgctcctcatcgtcctcctcgacctgctcctcccgcccgcgctcctcttcaacttcctccgcgccggcgtccaccacgcctccgcacatagcgtcctcgcccaggccaggggcttccacttccgc

SEQ ID NO: 10233 - DNA, 776 bp, Triticum aestivum
  unsure (1)..(776): unsure at all n locations
  Clone ID: PAT_TA_10233
tgattntgtagaggaaacataagcttcacatgcatataaatatgcaatttgagagtttctcatccaaacaagatttggaactgaaacctattccctccattccaaaatagatgactcaactttgtactaattttagtacaaggttggccatctattttggaacggagggagtagctaagattctttgtgccttttcagtgaacaaccaaacaggagaaattgaacttaggcccatttcagtttccttggcgaactggtattccagccaatttaataccgagccctccaatacagacacccaaacgcagcctaacttatttttcctacggagaaatccacatcatatctgaattgtgcaataaattaaaataaaatgtaagcatgattagttctgaaagtattgactaactgactcacctctggaagttgaagaaatgacatttccagaagctgcataaggtaactctcaccgagttgccaattagagaatccaagagcaatccattggatgaattagatcagctttaatcatgatgtgaccctttggaaagattgcacaataagcaaaacataacttcaaggatgggagacatgaagttgtagcttaacagtaaggttccaagcacttcatgtcctggatggtgcatctatagaagtagatagatcccatatatggattggttccgaccaatccatccccnatacagctgggactcaacantaaccaagtgattgancagctaaagcncacttgcactttccgcaatatccttcca

SEQ ID NO: 10234 - DNA, 689 bp, Triticum aestivum
  Clone ID: PAT_TA_10234
ccacgcgtccgccctcctgctccgcctccaaaaccctacgctccaccatgccgagcctcgccgccgccgccgccgctcgccgcgccggggaggccctccgccgcggcgtcatgggcggtaggtatctctcttccctccgcccgtcacccgctactgctgccgcccccgacagcgacgaggtgctggtggaaggcaaggccagtgcccgcgcctccgtgctcaaccgccccggccatctcaacgccctcactaccactatgggagctaggctcaacaagttctatgaatcatgggaggacagccccgacattggtttcgtcatgatgaagggcagcggccgagcattctgtgctggtggggatgttgttggattgcgccaacttatcaatgaaggcaagctggacgagtctaaagattttttcaggactttgtacagtttcatctatgttctaggcacatacttaaaaccacatgttgccattcttgacggtgttactatgggtggtggaggaggtgtttccattcctggaacatttcgcgttgccactgatagaacaagtgtttgccaacccagaagtacatattatctgggttttggatgctgctgccttattttatttgtcacacctaactgggcatgttggggaaatacctggccttgactggtgaaaaaactaatggagttttta

SEQ ID NO: 10235 - DNA, 799 bp, Triticum aestivum
  unsure (1)..(799): unsure at all n locations
  Clone ID: PAT_TA_10235
nnntaattgaaattaaccttgatcggcactgcactaactgagtgaataaataaatgaacaaaggaatgtctgaaaacacgtacactgtgcccatcaggtttacatggtttacaagagagctaacaacaagaacaacactcaataaacaagagatgttaaatagcgaagggacgagcgagctctggaaaaagatgatcgaaagactaattgcggcctgctcttgctgctaattgatgcgaatggagtgatggttcgggtgcccttgcaaggcgtccctgaacgcagactcagcacgacgatccacttcatcaatatcactgctgccgcggtaggcgaatgctaacttgatttgcttgagagctaacaggtgctctacgccaactggggtagcgccgccccagtgcctctcagataaatgtagctcgagcctttgtagcttgggcattgacccgacctcaaagcacaggtgtgccataacatcgtctcctcctgcgtgtacctcatgacgctgttctcgaaagtctgcctgaaagtactccagagctggaaataatcctgttctgattacgataactccattggcagcaaaatgaaacaagtataatctgaattccatcagggagcgcagctctccaagaagacgaatgtcatcagttgatgtctccctaacacgcaggtccaggtaacggaaataatggagatcaccaatccaccttgggattctgaaggtcacgattccattcattcgaagtgtctcgatatggaggggaggatttgataatgataacagactgtcatt

SEQ ID NO: 10236 - DNA, 654 bp, Triticum aestivum
  Clone ID: PAT_TA_10236
ccacgcgtccgaaggatttcttcgatcagagtggggatgagatcgtccggctgaagtttgtgaataaatatgatccatcagatgagcatcatgtactggggctctatgactacttctatcatcaggaacatcttttcattgtcactgaattactgcgagcaaatctgtatgagtttcagaaatataaccaggattctggtggtgacttgtactttacatttcctaggatacaggcaattgctcgccaatgcttaaaagctttgttatatttgcaccatttaaggatcattcattgtgacctaaagccagagaatatccttatcaagagctacagcaggtgtgaaattaaggtcatcgatcttggaagtagttgcttcttgacagacagcttatgcctgtatgtccagtcacgttcttatcgagctcccgaggtcattctgggactgccatatgatcagaggattgacatttggtctcttggttgcatccttgctgaactgtacactggtgaagtactatttcctaatgaaccagtgtccatgatgcttgcccgaatgatcgggatgattggtccaatagacatggaaatgttagagttgggacaggagacacataaatatttcaccgatgattatggccttttcaccaagaatg

SEQ ID NO: 10237 - DNA, 676 bp, Triticum aestivum
  unsure (1)..(676): unsure at all n locations
  Clone ID: PAT_TA_10237
cgtccgacctgattcacccggctgaaccaaaccgagtgcaggatcatgtggaagatatcatacttgacaggcttcgcgtgccacaaaaaatgcctctgcaccttcttcacattggaccgcatggttatgtacctgctctcctggatcgccagcaggatctccttcagcctcggcacgtctttctccgccaccaccacggagaaggcggtccagtcgagcgcgtcgtcgaacgggagcacgaagttgtcagcgatgatcaccggcacgcactcgtagtagatcgcctccacgatccgcgggctgttcacctcgtaccccatcgggcagatgcagtacttgctcgacttcatgtgcttggcatagttcatccgccgggtgatttggcgtgggatccgggtgtatattcgcatgtccgcgtccttgcctccccagtacttgacaaggacgggccgaacgcggccatgcatctgccctgcaaagaacgccaggatagatctctctgccgctggctttccaccgatgtctctcacaggtctccttgcagacttgatatatgtttctggaagggacacatctcttccgcggatgaaaaccccttctgagacatcggcgttacagagagctttgatggtgtttttccgcaattcatnnntgtaatttggtcgcggacgcgtgg

SEQ ID NO: 10238 - DNA, 637 bp, Triticum aestivum
  unsure (1)..(637): unsure at all n locations
  Clone ID: PAT_TA_10238
gcaatacacaacnctaaagaccttacaacagtgttgaacgcaaccacctgacatatatgttcataaccaagtccacagcaataactcagacacacacacacacacacacacacacacacacacaagtgcntgcagaactcagtaccacgcnngcccacatcagctaaagcngggatagttgctcaatataaacaatnacaccttncaganggggaccgcaccaccaaaaccggcaccggttctagctctggtattcctntgggaccanggagacttctctctgnctctgggcttnttaggggatgaagaanaagacgcctctgatacaatctttgaaaactcgtnatnattttcatgatcgaagtatatgaagtcggattcgagcattccacctaaatcanacccccacttatggtgtaccggaaagccatactgagcgttgttgcccgngaaatanacattcccacaagatggatgtgcaatcttacatgaagtacggtcgcaaatgatgcagcgaatagaatacgcattgatggaatctttcacagggcancagaaaggcacatttgntgactgctcaactttactatcaactatgctncagaattcggcaaagaagagtgcccacgatctggta

SEQ ID NO: 10239 - DNA, 731 bp, Triticum aestivum
  unsure (1)..(731): unsure at all n locations
  Clone ID: PAT_TA_10239
tataaaatagggaaaaaatagattaagtactggaggaaatagtaaaatgactcaagagatcagcagttacaaaagaaaaaagtaatattacacttgcaattagaccctgagccactagtaaattatacttgcaatgacagcaacctagcattacatcccgacatttcttcgtcgtcgactgatgctgtgtttcaagcaagaaatcccagtaagagctcactaacagtagaagtgtacaacaatgaaggttacattacatcctccctcagcctatcatgcatacattacctttctacaggaagatggacagctccggcggttggatgaacgagaagatggcttcaccgaacacctcgtgcagcgaccccaggagatgcccggcgtcttggtcctccttccaggcctgcctcagcaccgtggagaccctttgcgcgtggttgtttccctggtctctccggatcgcgcctgctgctgtcatgctttctaccttctgtccggaggatgaggcttgcatcatgctggggttgggtagctgggcggagaacccgtccatgcttcctggcatgtttcctgcccctggagctgctgaacccatgggactcatcgatacgtccgacgccatcttcttcagaggtggctgggatgcggacaggtctgtactagacttccgtttatttgggttgntggttgcaactctgctattgctcctcagaatcggccgagctgacgaa

SEQ ID NO: 10240 - DNA, 860 bp, Triticum aestivum
  Clone ID: PAT_TA_10240
cggcgcggcggctgccgcccaccccctccggggccaggacgcccgcggagcccccggggtccccggcccggccctggcgccgcccccgcccccccggccgcccccgccgctccaggcgccggcgctccacgtctcgccgggccgcccaggcccggccccgcggccgcgccgccccccgccccgcggccacggcccccacggccgccccccccacggcgccgggcccgccggcgccggcggctactaccaacaacaccagcaccccagcgccaacgcccgcggctactaccagcagcagcacccgggcggcgacgccggccgctactaccagcaaccaagagaggccggcggctactaccagcagcagcaccccagcgcaggcggctactaccagcaggagcgccgcaacccccaggcgtaccagccgtacccgccgccctaccacttcgacacggcgccgccctcgcagatgttcagcgacgagaaccccaactcctgctccgtcatgtgacgcgacccgccgcccgaaaattcactcatcagcgccgacgacctgcgccggccagccggccgggagagaagatcaatgctgacatagtagcagacagcgacgaggctctccactagcttagcttagctctagttacttggatcggaggcatccgtccatccatgaaccgatgcgtgcctccgatcaaattttggttccccctgccttttctctgctgtctctgcccctgatcgaccattgttcgttcctgccacgagctccattggttaattaatttgattttaacccagttgttccgctaaattaagaggtgaatgagatcgacgaatgggtcgcaaaaaaaaaaaaa

SEQ ID NO: 10241 - DNA, 646 bp, Triticum aestivum
  Clone ID: PAT_TA_10241
gcaggtttttgttagattgagtagagagggggaagcaggtggaggccgccaactcactcacgtattacaagagaagttgcatgctttgtctactgctatcaactcgttgcagcttgttgaaccctcatgtgcctggctcgattcgatttgtgaagctgatgatcaaatttcgccaagcaaaaagcctcgtaatcttttgatggagaactctgcttttggcacagattcagaactctctacattgcagttttgtgttgacattgaaattcttgaaaaggagtacacactaacagaagcactttatatgcttagtactgtaaattctaaatccaaattttctgaaagctattctatcgaagccttgactgacattcttgtaaatgagaatttgtatgacctggcattcaccatcgtgctgaaattttggaaggagtcaggaatgaaaagagaattggagcgtgtctttgcagctattgcacagcaatgctgcccaaacagagtaggcaactcagggagaaatttgactgacactcaacagctgctacttctgccttcttccgaggatgatggatgggatggcaatagcaagactattgctgtggcccatcaagtgcagggaagttgccagtgggaaactcttgaacta

SEQ ID NO: 10242 - DNA, 1799 bp, Triticum aestivum
  Clone ID: PAT_TA_10242
attcggcaccagcagaatgcggcctctcctcagcgccgccgccgccgccgctgtcctcctcctcctcctccccctcgccgccggccagcgactccgcggcttctcctacctcctcgactgcggcgccgcggccccctctcaccgacagccgcggcctccgctgggaccccgaccgcccctacagtctccgccggctccgcccgcccgctctcggtccagggcctcctcgaccccaccctcgcctccctccgcgtcttcccgtatcgccccgccgccaagttctgctacgcgctccccgtcgaccccaatcgccgctacctcctccgcccgaccttcttctacggcccctcctcgacggccccgcccgtgttcgacctcatcgtcgacggcaccttctggaccgccgtcgacaccgccgatgacatcctggccggcagcgcctcgcactacgaggccgtgttcccggccaggggcaggaacctgaccttctgcctcggcgtcaaccccgactacaccgactccggcccgttcatcaacgcgctgcaggtcatccagctccatgattcggtgtacaacgccacggatttcacgggcagcgccatgggcctcattgcgcgcaccaagtttggctcgactggcgacgtcgagaggtaccctgatgacagttttgaccgctattggcagccatttccagacagaaaacatgcagtcagtagtacccacaacgttacctcagccgatttctggaatcttcctcctcctgacgtatttaatacagctttggtagcagaacaaaattcacccttggtgttgcaatggcctccaatatctcttcagaatggcagctattatgtttctctttattttgctgatacattggctaatagttcgaggaccttggatgtgaatattaatgattaccagttttacgaagggacagtaacatcagctggtctttctgtctttgcaactcaatggattctctcaggcctaaccagagttatattgacttctaagtctgttcttccaccacttatcaatgctggcgaagtctttggaatttttcccatcggaagactgacaattacacgtgatgcgcttgctatggagagtatgaagagaagcctccaaaacatacccgatgattggattggagatccatgtatgcctcatggatatgcttggactggagttacatgtgatgaaggacaaaatatacgtgtcatatcattgaacttttcaagtatgggtatctccggatctctgtcacctgacattgcaaatctgactgctcttactgatatatcttttgcaaacaatagcttgtctggaactattcctgatttcatcaatctgggaaaactccatcgattgcacctgaacgataacaagttgaaggccacttttgcccagtcgttggggacgattcagcccttgcgtgtactattcttgcgtggccgcggccggggtggagcagttccacagaacttgctgaacaaaacagggttgactagcaagttttgtccgggcaaccagttcacacaaccacagtgctgactgacagtcaaacactttgttgaagacagtaggatggtgtgtttgttcttttagggtggctagagcaagattttgtaaccagtcaaatgtatgtaccggcccgggcggccgccccagtgaaacgagttggcggaagcaggtgaagataaacaatcctgattgtacagtgccaattctgtagtttacattgtcagtgtgtaacgcgaggagaaaatgaaacactgttaaattctctcaacgag

SEQ ID NO: 10243 - DNA, 836 bp, Triticum aestivum
  Clone ID: PAT_TA_10243
gcctcccccggatttggggtgggacagagttgagcgccgtcgcgcaccaccggaggtggagatggaaaagaattacagatggtgcccaacatttcctaatcttacagacctgacgcttcatagttggtgtgtgtgtgggaatttctatgcgctgacagtcttccttcagaactcacctaatcttaagaagctaactcttgatctataccagccttggtatgaaaatggggttatatgtgcaatcactggtgagctggaggatagatcatttacatgtgagcagcttgagattgttgaaatcatatgctcggagggaaatgagctgctaccttgggtgaatcagttcttgcttgatagtggcataaggcctgatcagatgcgtgtcagttacgaggactaaggccaatggatgcatttgatgattcaggtcctactacaggtgaaattacatgggatcacacattggcatgtcatctcaggcaaacattattacattatttcctcttgggtctatattcgctcgctctgttttagttggaatgaacatagcatacgtgtttgctgcccttgcctttttcacacagtagtggtgattttgaagcatgttctgctgacggtgaaccaaaagaaacatagacttagatgtgtcattttcctacgtggtgccattctggtagaacgttttactacatgagacgtgcagaattgcctgttttggttggagtttatggctctaaatctccgaggatacttttcttgtaactactctgttagctcattcggattttgtgatgttattgatcaaaaaaaaaaaaaaaaaaaaaaaaaaaaaaacc

SEQ ID NO: 10244 - DNA, 1702 bp, Triticum aestivum
  Clone ID: PAT_TA_10244
taccggtccggaattttccggtcgacccacgcgtccgggagcctcactctcgtgccgagcatgacgtcaaggatcttcttctgcagatcatcgttttcgttcggcttggacggacgaggtcgagctgcaagacaacctcctcaccggcgacttccctgctgtggtcggcgctgcggcgcctaatctgggggagatcaacctgtccaacaatcagctcaccggtgcattgccggcatccattggaaacttctctggtgttcagaagctgctgcttgatcgcaactcgttctccggcgcgttgcctgccgaggttgggcggctgcaggagctctccaaggctgaccttagcggcaatgcgatcgagggaggtgtgccgccggagattgggaaatgccggctgctcacttacttggacttgagccggaacaacctctctgggaggatacctccggccatccctccccgcggccgactgaactacctcaacttgtccaagaaccaccttgatggagagatacctccatccatctccacaatgcagagcttgacggcggtcgacttctcttacaacaacttgtccgggctcgtcccagggaccggccagttcagctacttcaatgccacatctttcgttggcaatccaaacctgtgtggaccataccttggtccatgccgccctggcattgctgatgctggtcacaccaaccatggccatggagggctgtctagcaccatcaagctgctcattgtgctaggcttgcttctgtgctccattatatttgctaccgcggcaattctgaaggcgcggtcgttgaagaaagccagtgatgcacggatgtggaaactcactgcattccagcgccttgatttcacctgtgatgatgtgctggattccctgaaagaggagaacattattggcaaaggcggggctggaactgtgtacaagggatcaatgcccaatggtgatcatgtggccgtgaagaggctctctgcaatggtccgtggctcatcgcatgaccatggattctccgctgagatacaaacacttgggaggattcggcatcgccatattgtgcgcctgctaggcttctgctcaaacaatgagactaacctactggtgtatgagtatatgcccaatggcagtctcggggagcttctccatggcaagaagggcgaacacctgcactgggacactcggtacaagattgcaattgaagctgccaaggggctgtgctacctgcaccatgattgttcaccgctgatacttcaccgtgatgtcaagtcaaacaatatacttcttgactctgactttgaagctcatgtggccgacttcgggctggcgaaattcttgcaggacaccggcgcatcagaatgcatgtccgccattgctggttcatatggctacattgctccagaatatgcatacaccctcaaggtcgacgagaagagcgatgtctacagcttcggtgtggtgctcctggagctcgtcaccgggcggaaacccgggggggagtttggcgacggcgtcgacattggccaaggggtcaagatgatgacgggcccaaacaaggagcaggtgatgaagatcctggacccgaggctgtccacccgtccgtgcacgaagggaatcacgttttttacgtcgttttgttggcaccgaggaacacaaggtgcaagggcccacgattcctgaggtcgtccc

SEQ ID NO: 10245 - DNA, 1055 bp, Triticum aestivum
  Clone ID: PAT_TA_10245
ttttttttttttatattttcaataacttatcatatattgtaaaacagcaggtaatatttcaaggaaaagtacaaatgaacctaccgttcaagtttgaatgaacttgtacttaaaaggcattcttttacaaattcactaaggcaagcaccatggtcagacgtcaataattccagcacaccaaatgtcctaggcaacttgttgcttcttgcttttctttttcgtgcctttgcttctttcgccagattcagattttattctctttggggcatacatctcagcatcactgtcattaaggtcagccatctgagttccttcctcatcctctgcaacccttctattcttctttttcttctttacctttctgactgtttcagcatcgccttcatccgggtcgaccatttgtgtttcttcatcatcctctgtaacagttttcttcttctttttcttcttttcctttctgactgcttcagcatcacagtcatcagggtccaccatttgagttccttcttcatcctcttcaacaaatacattcttctttttctttttttcccttctgactgcagcttcagccaccattgaagaatctggctgcttggatttagtctcctcagattcttcagctgagaaatgtgaatcaataaccactgtcatgaggtgctgcttgagatagaccgcagaaagcggctgccttgtatttgtatcccagattcgcaagtagctgtccaatccgcaagatgctatcaaaggcagctccggatgcctaactatcgatctaatacttccactgcatttaccaacatagcatccaagtagttttcctgttctcatgtcaaaggaagcgaggtctcctgttcctgtcccaatatagacagtatgtccatctggatcccctgcaactgccttgattggtgactccctaaaatcaactgaaacaacaggtcttctttgcgaagcagtattatataagcgaacctgatgattatttgtgccggctacaattttacggtgatcatccttgcacaggaaagtttcagcagtgaaccaaggtttggtaa

SEQ ID NO: 10246 - DNA, 1508 bp, Triticum aestivum
  Clone ID: PAT_TA_10246
gtacccggtgctcgctcacggccgctgcctcgccgcactgccggagctacggcgccgccaagacattcttacagaccccacgcccatcccgcgtggcaccgcccctccacctcccctcacccccgagcccccactcaaggcaaccagcgcatgggctctcctcaaggcagagtgctgagggacaggccccagtcgagacctgagccgtccgagcgcaaccagcgctggggttctctgagcggcagagagtccctggacggtctccggtccggtcagtagacatcgccgtgcctgctgctgacctccccaaactgaaggatgtgagcgaatcaactttaaagaacgggactatttcagggagcttggaaccaaaagtggtccggcctgatcagctgaagaagccgcgggggaagccatactcatataaagatgttcagccaaacaatactgactatggtgacaaagtgacatttcaccctgcaaatcgcaactctttgagcggtgcaaatcccaagggtccaagcggcgtacctgatacatacatgtacaggcggaatgggcatgccctgttggccattcacgaagggtagattttgaataaagctctacgacttgttgcagcattggtcatttgccatgcaatgctgatcagatttgttttactggtggattgtataggtcccggtacgccgcgatgccgaagccgctgcgacgctcaaaggcaggtctcccaggggaaacgccgtatctgctgcacgttcaaggcagaccgagaggccacatgactctggtgcttgtccccggccatcagagcgcaaccagcgcatgggttctcctcaaggcagagagctgagggacaggccccagtcaagacccgaaccatcagagcgcaaccagtgcttaggttctcctcacggcagagagtcccgggacaggtcccggtccagatctaagccatcagagcgcagccagcgctcggtttctcctcgccgcagagagtcgagggacaggtcccggtcaagaccggagaggactagtagggaccatgggcgttccgacagaggttccagtgaccaccaccacgaggatcaccatgacaggaagagaatgcgcgtctcttccaccgtcgatggtgacacagagagcagccagaggtccaggcacagttctaggagcagcctgaggcgcgacgacgtgagcgacgacgagcagaatttcaagaggaagtggggacgatgatcaccggccgccatggatggatgcaaggttctgaataaagatggtggacctgttgcagcattgctggtgtccattgctttgctgatgagacttgttttactagtcattgtatatgtctcggaaagcggggagtgtaattcctcccgcagaatgttaaaccgttattataccagagattgtaatatatcagagagttcccagatctcttcctctgtaatgcaatgttattattatatcaagataaatgaaattatcatcagctaccaaaa

SEQ ID NO: 10247 - DNA, 1200 bp, Triticum aestivum
  Clone ID: PAT_TA_10247
gattccatctaaagcacatgagagtgcgcggatctgaattcaagatccaactcattcctgtttacgagggcacttttaagaacctgctactggacttgtcgaggctggcgacccggccctcaggcttctgtgggcccatcggcgcctgccaggctccgcccccgctgggggtggtgctctgcatggccgtcatcacctccccgcgcgtggcttccgcctcgtctgcgctgcacttcgcaagccgctcggggtttcgccgcttccggccgactcgggaggctgctgggcgccggatcgctcggagcagtggctgccaagaagcaattgctggaatggatgaagcagaatcgagaagggtgatgcagtctgtcggtaagattcggatgaccaggagatcttggaggagagaacctaggaaagttccgttaatgagaaaggtcttgtacttcgggcaaggaggtaaaacccacactaagcaaggctatgatactaccgcagctcagctgttaagattcatcagaaatttttacgcgcacactggaggccgtactacatatcttcctggccggcacttgatgattagcatgcttgaaggagaattggccatgtcacaccttttctcggattttatggctggcgcggtcgccgccctggtcatggatactggcatgcatggccacgcttgaaggtgcatgggaaccgtatgctgattgagcagtagcagtccttagttgagcaagaagatctttgagctttggctgtgctgaggaagaggttaggattgccgctgaatgccacaacaggcagctccaattgtagttacgcgatgaagatgagaagggatgtcatttgtatttgttggttattaggttaaccgcagtcctcgacattactatatgctatcgatgggtgcaaaccgtcatcagtctagctggctgtttctctttagatgttgggtaagtgttatgctgttgatggatggtgctatccccgttgctgccgatctttcttcttccttctttggtgaagtatcttccagcgattgtaactcagaactgtcagtagtaaaaatgcttagttcagttctgctccattacttttatgtacagcgcactgttggaaacattggatggcactgtttgaaagtgaatgagcacagttccacagccagttccgtggaagttttttttaaaaaaaaaa

SEQ ID NO: 10248 - DNA, 964 bp, Triticum aestivum
  Clone ID: PAT_TA_10248
ttccccatacccaagagggtactacagatgcagtagctccaaggggtgccctgcacggaagcaagtggagcgcagccggacggaccccaacatgctggtcatcacctacacctcggagcacaaccacccgtggccgacgcagcgcaacgtgctcgccggctccactcggtcccactacgcgaagaacagcagcaacacagatgcagcttcgtccaagaacagcaagaactcctcgcgcaaccagcacaagccagtcgtcaaggcagaatcaaaggaccaatccgccgccaccccggccgcgacgagcacgaccaccacggcgaccacaagcaccggcaacaacacacctccgatggctgtgaaagaggaggccgaaatggagagaaggataggcggtgatactacagcaacggtgggttattacagtgaccatctcctgcagcagatgttcagccagagctacaggccgatgatgcccgaggaggccggcggctatcaccaccaggacgacttcttcgccgacctcactgagctggactccgaccctgtcagcctcatcttctccacggagtacatggaggccagacctggcaaggagaaggcagcagccaaggacgacgtggattcattattcatgatggactgggcgcccgctagtgctgctgttactacttctgcagggagcgcgcttgagcaaggggacatgggtttatgagttttgacgtcaattagttaccttaaaacataccaggcttgcaccatcgatgcatgtgcaaatgcgaacaccacatttgaggacatttagatataggcttgaaataaccttgatgataacaggagcaagaaaaggaaagtatgggttttccccctctctctttactctttatattagttattacacactgcgtgctccttcctgaggttattgagtatggtttggtgggggtgatctagtatatagtac

SEQ ID NO: 10249 - DNA, 483 bp, Triticum aestivum
  Clone ID: PAT_TA_10249
aggaattcggcacgaggagaacacttgcagtttgcagctagagcttcgagccgtccactcttgcaatggcttccagctccatgcttaagatggccgcacttctcatgctggccctgttcgccgcacagctgctgatgaccacgatggcctcagtcgcctgctacaacgatgagtataaggcctgcttcacgacctacaagcccactcccacttatcagatctgccatgctcaggctaacctgatctgcggtactaactgaggcatgccaaagaggaagaggaacacaactcatcatacacctaggttatccgctttgtgctttctgagagtccccgtattttctttcctttattttcagttgttattattatatgtcaatgtcctttatttcaagtgggttaactaaagatccctcgggtacttctgtacgcatcattgtgttataataaaaagttcctccctttttctgtctaaaaaaaaaa

SEQ ID NO: 10250 - DNA, 934 bp, Triticum aestivum
  unsure (1)..(934): unsure at all n locations
  Clone ID: PAT_TA_10250
gatnactgacacacaactcatttggacccagggtctttgagctgcctgtttatactggcccatcacttcaataccgtgtggttacatctttcccaacaatgctgaatctaagcaacaacaaattcacaggtgtgatcctcccacagattggtcagtggaacgtgcttgctgtacttgacttcagcttcaacaagttatccggacagatcccccaatcggtctgcaacctcacaaacttgcaggtgctagacttgtccagcaacaatctcacaggtgctatcccagctgcattgaacaccctgcacttcctttcagcattcaacatttcaaacaatgacctagaagggcctattccatctggaggccagtttaatacatttcagaattctagtttcaatgggaatccaaagctgtgtggctctatgctcactcacaaatgcggttcagctccaatacctccatcctccacgaaaaaaacgagacaagaaggctgtttttgcaattgcatttggtgtgttcttccggaggcatcgctgttcttttgttgctggcgcgtctccttgtctcaatcaggctgaagggcttgacaaggaaaaaatagaagggagagtaatggagatgttgaagcaacttcattctactccagttcagagcaaacattagtggtgatgcggatgccacaaggcaaggaagaagaaaccaagctcaaattcgctgacattttgaaagctacaaacaactttgacaaggagaacatcattggatgtggaggcttgggttttctctacaaggctgtgctgcctcctgccgcctcgctggccatcggaatgctcagcggtgggatgtggctgagggtccccgcgggcaatgcagcggttgaggcgctctcccnagcacaacgtgaaaatcttgtacctcggccgcgaccacgcta

SEQ ID NO: 10251 - DNA, 470 bp, Triticum aestivum
  Clone ID: PAT_TA_10251
gggaggagcccaacaagaactacttctcgcttgcgttcgtggtgtccaagtacgtgaacgcggcgtgggagctcgcccgggggctcgttatcggacacgtggacggggcggagtacgtggaggggtggacgatgagggtcgcccgggcggtcgggctgatcatccccggcctgccggcccacgcgccgcaggactacgtgaacgccaccagactcggggccgcgtcgctcgacctgcttctccgtgaccattaattggttactacgtataggccatacaatccaacttggttgtttagccgtagtgcgagagatccatggaaattggttacatgtcaaccattgttgatgttcgatgaaatctgcgttcgagcatttccatgattcttgcattcttcatgccactcccaccataagtgttattccctccgttcacttttataagtcgtttcagacaaatgaaaaaaaaaa

SEQ ID NO: 10252 - DNA, 572 bp, Triticum aestivum
  unsure (1)..(572): unsure at all n locations
  Clone ID: PAT_TA_10252
gctgtagacatgtctagtgttttaagttcatgttgaaatatccaaaacatctttatcataatagcgaacgaagggagtacattgctactttactagctgtccagtcctttggcttgagttgatcgatgtggttctcgttctcatgttccaaggaagtcagagatgcagatatatggtggttcattttcagggtaggaattcaggtccgacgaaactgaagcttcaaccactgcaagcctcaacaggcgacggctatcctacggtcaggtgaaaaaccctctacagacaagctgcatcccttcaccgctcctgtgtactagacgtttatgcctctgttcattttatttaggcacgccgacagtaagtttcgcgcactagatgctaccacagtgcagctgtatatttcttcagcacagatgcttcttttaatctttgctgctagtaatatactgtatattgttgaacaaacattggcctgcttgtcgagtgggtattgcttgtccactactctaagcaagcatgctgggcgctgctgagtggcaatgtcatgcgactctggactnnnnaaaaaa

SEQ ID NO: 10253 - DNA, 1133 bp, Triticum aestivum
  Clone ID: PAT_TA_10253
gctccccgagctccgtccggctcgttcgtctgcaccgccgccggcagggtctcgtcggacgacagggcctcaaaaaggctcggagagctacgccgtcgccggtcgcccccgcctcgggtattcggcgatgcaagatccgccgccgaagtgggaaaccccagacagtggaccgattgctcctatgtgcaatccaaagggctcaccctcccagcaagatgatgattctcgaggtggagaagtgattcgatcattggacgaccttccagaggatacctgccgacgtattcataccctgatgtcactgcaaaacgctgcacgcttggctatagcaaaacgcgcattgacgagatcatggatgatctcctccccccttgacttgcacatgtgaagagaggccgtctatggagatccactctccaaatttgaccatcttctgcaaaatcactcgggcattggcatgaagaaactaaggactggactttttgactgcgacaagcttgcgaccggtgtcgccttctcctggcttcgtcttgctgttacagcagggaattgtaagaactcacactttatctgcccgctacctctgtggacgaagcatactacagtttcccatgctcgctctgatttgaggcgtgccaaaactcggtcccgtgccccgtcataggcttctgtgctttccggcccacggccgcccggcgacgagaagcttcaagaaaagaaaccagagaaaggtaatcataatctggtgaaatagcttcatttccccttcgtgacatttgcgcggccttggggcggtggggtctccgggattgcccgggggtactgtgcctctcgttacccgggctgctgtcgcgcctttcggccctcggaggggctttgcgcggaaagcttctactcatggactgctttgctcctggtctctccatctttctcttccctgctcggtccgtgccgctgtccttcgcacctgccgtgccagcaaagaatgtacacattgagtgtttagaatttggtcagtccaacattgtcttgcatgctcggaccaagcttctgtcctatgcaccaaatgttgaaacacttgtcatatcatcgcctaatgagatgacccgtacaccaacgctatctcgcaaatt

SEQ ID NO: 10254 - DNA, 716 bp, Triticum aestivum
  Clone ID: PAT_TA_10254
gcttctcctccgcctccccctccccctccccctccatttcactctttccctacctttccccctctcaccatctggatctccattgcttcgatctccgatctctccctgtaccttgcagttccaaccatggtgtcttcttcatcctccatgccagcggtgtcgctcaccgcaccagaagacatcgcgcctctcccccttatccggtgccccagatgcaaccttggtgtgatccagtggttcatctctgagacctcactcaatcccggttgccatttctacaagtgcgagttccgcgatactgggcgttgcagcttctggaaatgggagaacaagtacatcgactaccttcgcgctcgttggtcccatgtgtttcttcccgcagctcctcctccacatgaagcgcccaccttgatcctgcgtgagattcagtatgacatcaagatcgcactcgccgtcgccctgggtactcttgctgccgtaatgacgctcctagtctcaaaaatgtagttctccatgaatgatgtaataggttaggtttatctaattagcctaatcagcacgccaagttgttgtcgatccatgtaatagttagttctgaacctggcagtccccactaagctagctctgacagccctctgttaattttaaatgaagtcatacagaggtgcttatgtaaaatatggaatccaatatagcatgattctctaaaaaaaaaa

SEQ ID NO: 10255 - DNA, 827 bp, Triticum aestivum
  Clone ID: PAT_TA_10255
caagaaacagctgctgctttattagcttcttccatccaccccaaagatcacaggacaaggagagaaaagggagtgatattttcagagatttccgaggagagtggaaagagatcgatcgaccaagaaccgaagatgtgcatggaccgatctccggtgccggcgaagaagatctggctcgccatcgcctcccgcctcggcctccggccaacagctgggctgaggaagctgaggaaggaggtgaggacgtgcgagtaccgcgacgtgcacatcatgtgggagatgctgagggaagatggactccccggtgcccctgcaggagaagcaggccgccgccgccgcggccgtcgcgcgcggccgccgccgccaggaagaagaaggaggcgtggagccgcttcgtctactactgctgcgcgttctgagctccacaggacgtgaccgatgcacgcggaaacgggacagctggatggaaccgcgccgtcagagttagagcaggctagcagagaggccgtgtgtagatagaaacagcattggccctctcacaggctgtgcaaatagccaattgcgtgtggatccgtcccaaatggtccattggagatcatcattgtgcgcaaaaacaggattcagattatgaggatgtgaattcagaggatggtgaacgagatgtgcggcgtacagccaaagaaatcatattctcttgcctgaagaaccacatattaccggcacgtagggttttccccggagcagagagaagagagctatgtttgtagtaaactagtaatttgtacaaaagaaattgagaaaaaaataatctataacaaaaaaaaaaa

SEQ ID NO: 10256 - DNA, 522 bp, Triticum aestivum
  Clone ID: PAT_TA_10256
gggtcagtgctaatggagatttgccctctcttaattctgcactaattttgccatcccacaactctttcagcctcccgagctgggtaagtaacacccttatatattttttgcaaatgtaaatttgtcttctaataattttgcactaatttctgctaatgtaattagtcaatggtcactcccgggaagtgacttgattgtgttttctcttaattctagactggatctctttcttagttttgttagcttgacatcgctgttcatcgcaatggagatttatgaggaatatatataacccgcatgccgttcttagatggtggaagagaaagagcgcaagcatcttcacctggagacggccatagctagatgccatagctttttacacctttaatcctagagttcctcgttccgatccattccactttctcctgctccccctcaactctttatgcctcccgatcagctgggtaagtaatactgctgatcaatatgctaatggagatttgtcctctcttaaaaaaaaaa

SEQ ID NO: 10257 - DNA, 705 bp, Triticum aestivum
  Clone ID: PAT_TA_10257
gggaatcaagtacacctccggatctattcagctcttaagaacagaggattctggtcttggcctcgcatatttgtcagaactgaccattcaattatgggagaggaaatcaaatttttatggcgtcaccggctgggtgcttctgcaaaaagctattcaattgcaggaggtctttccacaaggaatgtttagtgcggcgcgaggggtgcacataacagggtatgccgaggagacaaatgcgattgttctgtctgtgttgagagacgacttcatgctgcaagttgacacgatggagatcaaacatattcagaaaagaaaaggagatggatttacctttccgtacgcaaatttctatgttgcaggtatgcaagttgatggtggagacataggagatgaaaattgggacgtagtggatgaactaatgcactatctcggtgtccctgctcatcttgatgttgatgagttttgaactatgggattgaaggcactcactaagggagccgaaatcgatgccactgatgcactaagcacaaaggatccaagtactacctcgatcttcaccacaacctgcctccacccctatagtactccttttctttatgttggcctattcagttggcctagttggctactttacctatctttgtattttgtgtctctcgactagtgtggtcatttgagtgtttgactccattatcaaaaaaaaaa

SEQ ID NO: 10258 - DNA, 791 bp, Triticum aestivum
  unsure (1)..(791): unsure at all n locations
  Clone ID: PAT_TA_10258
tcctgctcgtcggtggtgttctcgccttgctccgctacagcctcttctcgcagttcgaccctggcaacgcaaaggcggcccggtattggccgtcggcgggaaacttgcagcggcttccatcgtggggcggcggcggctgcgacgacacctccttctcggtgcccaaggagttctcctgcccgatttctttggatttgatgcgcgaccctgtggtggcgtccaccggccagacgtatgaccggccatcaatcatacagtggatcggggagggccattccacctgcccaaattcagggcaggcactggcagacaaccgccttgtgccgaatcgtgcactccgcagtttgatatcacagtggtgtgggatgtattgtttccagtatgattccccanagagcaacgaggggatggccgaatgcgtcgccaccgcgtgcagcagcaaggcggcaatcgaggcaaataaagccacagccaggattctggtcaggatgctggtggagagttcagatagctcaaaggcagtcgctgccaaggaaattaggttgctggccaaggctgggaagcggaacagagcgttcatcgccgagctcggtgcaatcccgttgctctgcaggctgctcctgtcatcagatcagattgcgcaagagaacgcagtgacggcgctgctcaatctctccatttacgagccgaacaaaacgcggattatggaacaggagggttgcttgtggcttatcgtcagcgtgttgcagaatggctggactacagaggccagagagaatgcagcagcaact

SEQ ID NO: 10259 - DNA, 669 bp, Triticum aestivum
  Clone ID: PAT_TA_10259
ccgccccccgaccccaggctcggcgccgcaccggcgccccggctggacctccgcgtccagggctcccacctcgcccagtacttccgccgcaagtcaaaactcacgcataagggcctcttcgcctacccagccgtctccgccgcagcccctgccgccgacgacggaatcaccccgccaccgccgcgctactccatgcactgggtctccgaggcgcaccgcaacgggtggcacgtgctcctgggacgccaccgcgctggtccgtcggcgaggaccggctgccgctgtcgctgcaccggccggccctcctgctgtgcacgctcgacgacacgcactccgcaagcagccgtccgccaagggtgacatgcctgctccgtcacggaggaggtccttccgacacctccgccctggccgccaccgcagccgcaagcagaaacagtcgaatggagtggtggtgattgagtgtcgcccttgctaacacaaactactgctgtcgccgtctcatcgtgcgtgatgtgcttgcatgcatgtcccgcaaaataaagctgcatggatctgcttgtctatgagtaaggtgtgtgtgtatgtttgagcacgaattgtttcggggttctcggaagacggaacacatgtacatctaaattggttatgttcatcgttttatatctaaga

SEQ ID NO: 10260 - DNA, 757 bp, Triticum aestivum
  Clone ID: PAT_TA_10260
agtgaagtatcattcggaatcaggcgtgcagctttatccattgctattgacggtttatgcaccggtgggatctctggaggtgctgataataaaatagccatgtttgcccttgatcatcagaaggtgtgacatcaatcattctatgttctgttcctgctatataagctccttttcatgaaaatgcatgctggcacgttttctctcaggaatgcaatagaaattgagagacccggtgtagcgggtacagcgattcggccagacaacaagattgcagcatctgctggttgggatcacaggattcgagtgtataactacaataaaggaaatgctctagcgattctaaagtaccacagcgctacgtgtgctgcggtcactttctcacatgactgcaaattgctggcctcatgctcggcggataccacggttgcgttatgggagctgtatcctcccaaaacgcccggcaaagttgacatagcaatagaggaggttgagaaatagaatctgatcatggtgtgccatatgatcatggtgtttgtaacttggtgaaacatcgtatctgttggcttcagtagattgatatagatattgccatacatggatgtggaggacagtaaacaagtgcttgtgaaatttttgtggggggaaaaaaggaacgttcatctgtcgtctgtaacttagtgtaacctacttattcgtacttcgggtccgtgccgccatgatcttggccccccaagataatttcaaaaaaaaaaaaaaa

SEQ ID NO: 10261 - DNA, 1297 bp, Triticum aestivum
  Clone ID: PAT_TA_10261
ccaccccccccctgcttcagtcttcccccccgccgcaaggactcccgcttccccgcccacccgatagccaccacgtccgccctccccaccccgcgcgttgccctgggcgagctcatcaaaatgttttcaaagctcaaccttgacgctcgtgacatgaccgcgctctccggtgcccacactgtcgggatggccacctgcgatacttacagggaccgcgtctacggcaccgaccgcgatgaggagatcgacccatacttcgcacagaccacgcagcacacgtgccaaggtccttctggataaggcgccgtttgacgtgcagacgccgatgaggttcgacaacgcttactacaaggaaccttatcgcgcggcgcggcctccttccccctcgacgacgatctctacggcggtgggaggcctgcatgacagtctccgtggagatgtacagcgccgatggtgaggccttcccgagggacttccccaaggccatggtgaacatggggaaacgtgcccccgccccacgggaattcccgtggagctgaggaccaggtgctccataacaaacgcctcccgagccctcacgaccaactcgccgagcgcatcccggatgttttctatgctcaaccttgacgcgcgtgacttgacagcgctctccggtgccctcaccttcgggatggccagctccgatactctactgtgaccgcgtcttcggcaccgaccgccatgaacgtaggtcgacccatacttcgcacagaccacgcagcagacgtgccaaggtccttctggtaaggcgccgtttgacgtgcagacgccgatgaggttcgacaacgcttactacaagaaccttatcgcgcggcgcggtctcctttcctcagaccagactctctacggcggtggaggcctgcaagacaatctcgtggagatgtacagcacggacggtgaggcattcgcgagggacttcgccaaggccatggtgaagatgggaaacgtgcctccgccccatggaatgcccgtagaggtgaggctcaagtgctccaaggcaaacaactattgattgcttgatcccaagtgcatcatgcaacccggcctgatcatattggattcagttaaatgtacaaattgtaacagtactagtacgtgttcaatttttaattcttttgcccatacaatgtcctctcaacagaatgttcgacacaaatattccaatacatgtgtgtgcgcgcgtaataaatggtgtttgtaaagttgttttaacgggaaatatataatgatctcatgttcgattgttaaaaaaaaaaaa

SEQ ID NO: 10262 - DNA, 849 bp, Triticum aestivum
  unsure (1)..(849): unsure at all n locations
  Clone ID: PAT_TA_10262
cgtccgccctgcttcttcttatcctcatcgcagctgtttctcctcctctgctctccatccacctgacgtcaccacccagctctcctcttcctatctactccagcaaacccacaaacggctggctggccttggcgttgccgatgactgcactcccctggagtgcgctcggccgtgagaccagaggacgcgtgcgcgcggccgtcagaccagaggaggccatgggagctcccctgtgccgtggtcccgatcttgccgcgaactcaccgccccttgctccggattcgggcgatcccgcgccgctcatcctcgcgttgaccgtgagaggaggaggccagcgtctcgtccagcagcggcccaccagagtcgccccggcctactacgccacagccagcctagcacgcgaggctcttgccggctagatcgaggggatccttccttctttgtcagcccaactaactgaaatcggcctgcatctgcacccctctttctgatcccgtgcttccaacgatactcatctcgttctatgcttgtaggccgatgtgaagccagccgctgacacgccgttgcagatcactagatctggagtgcccccgctgcatcctgtccacgtcacacctgcggtcaacgaccgccgtcggaaccctcctccctccctccctcctcgaggactccggttctncttcgttgccttcccatacatgatgggttatttcttnctcttttttttgcctttgattactcatgtctggtgagaatnctgcccgcggatcccgctttgtttgcatgtgtgnatggtctgggtctgaaactctgttgaggggccccccgcggagtccaaataccatagga

SEQ ID NO: 10263 - DNA, 407 bp, Triticum aestivum
  Clone ID: PAT_TA_10263
gcgaggagcgcaacacctcggcgtcctggaagctggtgcagcacgaggttcacagggtcgccagggccgtggcacaagcatccgccgtgctcagcgggagcctcacatgactggatcgcagtccgtcagcaacggaaagagcatcagcattgtttccggccgtgcataatcatgccggtgccgactattaatcctctggccaatatgtttcaggccgtgcctcgcatgatgcgaccagtgtacatatgctttggaatttggatagatgtgtgtattgtgcttgtgcgcgcactgtattctgttaatgagctgcaaaattatgtagtaatagtaatacagatcagggcacctactgtgttgtacagattgaagtttggtggacctgctgatgttttaaggagcttcca

SEQ ID NO: 10264 - DNA, 972 bp, Triticum aestivum
  Clone ID: PAT_TA_10264
gagaggtcgtctgccgccgacgtcgcccccaacacccccaagccgggcgccaacatcaccgacctcatcgccctctttgccaggttcaacctcaccgctaaggacctcgccgtgctctccggcgcgcacaccatcggcaaggctcactgctccgccttctcccctcgcctctacaacttcaccgccaacaacagcgcctccgaccccacgcttgacgccaactacacggcgacgctccgcggccagtgcagggccggcgacctcgctaccctggtcgacctcgaccctggcagcggcaccacgttcgacctcgggtactacagggacgtcgccgcgagcaggggcctcctctccaccgacgccgcgctgctcctcgacggagacaccagggcctacgtgatgcgccaggccaatgccaccgcgcccgacgagttcttcgccgatttcgccgcgtccttcgtcaacatgagcaagatcggcgtgctgacgcaccacaagggcgaggtaaggaggcagtgctctgccgtcaacccgccgtcggcctcctccttggcgcctgtcaccatgagtgcgcacgccgtgctactcgcgagctgtttcatctccatcgttaccatggcgcttgtgctctagctagcaacttgtgtaagtgattgatttgggttttttgtttttgttttttataaggggtattggcgttggtttttctctcctctcttcgcgggcgcatgtactcctctctcaccaattctcattgtaagcacatatattgctctctgatggtgaccatcgctgcaggctacggcgcttgtgcttactatatattctctcctgtcctttttactccgggtataagatttatgtcaagtcaaactttgcaaggtttaacaaaattgatattagaaaaatatcaacatctatagtatcaaatccttttctaaaatatacagtatcaaatatatgtaatataca

SEQ ID NO: 10265 - DNA, 574 bp, Triticum aestivum
  Clone ID: PAT_TA_10265
gagggtatcaatggccaagacttagtatccgggcaagtgcctgacatccagatacctagtagctcattctttgaacatgaacagcctatcatcaatggtaccaaccagaactcagattacagtgcaaacagcggtgagggggagaatggcacccggaaactgctgctcctgtcagaggactcccttccgccacttgccgacttccctacttccaacttcggcgatgcttgcagcacctcaagttgtgaggctgtgggcaacagcacccagctccctatttggtctgactcattttatgatgagttcatgagcgagtttgcatgagtgctgccgcccagggtgtcccactctttggtttgctttttcaattttagtttctcacatcttacctcttatctgtgatgtggtttccattgtagtgctgtagctccagttggatttttagcgctatagctttccgcgtgcattggcaacccatatgctcctatgcatatacagtatacgccaaaacacttgtacatatacatctgctcctatataagtcttccagcctgaaaaaaaaaaaaaaaaaaaa

SEQ ID NO: 10266 - DNA, 884 bp, Triticum aestivum
  Clone ID: PAT_TA_10266
ccgagctcggcacgagggaaagatcgagaggcagagccaacctactcaactcgaggccgtgttgctgaggtgagacacgcatcgcaatggggagcaacgagggcggcgggtgcgacggcgagccggtggccggggggcccgacctcctcaaggttgtgttgctgagttcagacacgcaccgcaatggggagcaacgagatggtgttggtgccggagatcaagcacaccaagctcttcatcaacggcgagttcgtcgatgccgcctcgggcaagacgttcgagacgcgggacccacggacaggcgacgtgctggcccacatcgcacaggcggacaaagccgacgtggacctcgccgtcaacgccgccgcggacgccttcgagcacggcaagtggccccgcatgtcacgctacgacgaggggcacggccatgcacaaccttgccggacctgattgagcatcacatccgcggggccgatccggcgctatgacgccgccgccgccgacaagatccacggcgagtcgctgcgtgtgtccggcaagtaccaggggtacaccctcaaggagcccatcggggcccgtcggcatcatcatcccgtggaacttccccagcctcatgttcttcctcaagatcagcccagcgctcgccgccggatgcaccgtcgtcgtcaagcccgccgagcagacgcccctctcggccctctactatgctcaccttgcaaagctggctggcattccggacggagtgatcaatgtcgtccctggcttcagcccgaccgccggcgccgccatcgcctcccacatggacgttgacagcgttgccttcactggctctggtgaagtacgccgcctcatcatggaggcatctgcccggagcaacctgaaga

SEQ ID NO: 10267 - DNA, 2173 bp, Triticum aestivum
  unsure (1)..(2173): unsure at all n locations
  Clone ID: PAT_TA_10267
cccatctaacctggcggccccctcccgcacctcctgggccgacgtcgccgacgctgaacatgcccctcccgctcccgttccagcggcggcgcccgccacatccaacggccccgcgcgtgccgaccgctcctcctacgtccctccccacctccgcaaccgctcctcctccnaccgcgcctccggtgtcctccgctccacccccgcgcgccgcgcccggcctcctcggccgccccaccagcggcgtcggtgggaggttcgggggaggcggggccccacctcgtaggtgggaccgggagcccaaccctttcggggacgaggaggaggtgccggcggagcccgtgcccttcgacgagcaccagaacacggggatcaactttgaagcgtacgaggacatccccgtcgagaccagcggccgggaggttccgcccgccgtgggcacgttcgcggagatcgacctcggcgccgcgctgaacgacaacattcgccggtgcaagtacgtgcggcccacgcccgtgcagcgccatgccatcccgatctcgctggctgggcgagatctcatggcttgcgcgcagactggatcggggaaaacggccgccttctgcttccccatcatcagcggcatcatgcggggcccgcccatgcagcggtcacagctggggcgggagtaggaccgcctgccctcttgccctcatcttgtcgcccacaagagagctgtcaatgcagattcatgaagaggcgagaaaattttcatatcagacaggtgtcagggtagtggttgcgtatggcggggcccctattacccagcagttgagagatcttgagaggggtgttgacattcttgtggctactcctggtcgtttggttgatttactggaaagggcaagagtatccttacagtcgattagataccttgcccttgatgaggcggatagaatgctggatatggggtttgagccgcaagttaggagaattgttgagcaaatggacatgcctccacgaggtgtaaggcagacgttattgttcagcgctacattcccgggagaaatacagagaatggcatctgactttctggagaactacatattcctggctgttggaagggtcggatcaagtactgagttgattgcccagagagttgagtttgtacaggaggcagataaaagaagtcacttgatggatctgctccatgcgcaaagagacagttcagaacaagggaagcaagctctcacacttgtctttgtggagaccaaaaggggtgctgactcactggagaactggttgtgtacgaatggatttccagcgacttctattcatggtgatagaaaccagcaggaaagagaatatgctttgagatccttcaagagtggtcaaactccaattctagttgcaactgatgtggcagcccggggcctcgacattcctcatgttgctcatgttgtgaactttgatctccccaatgatattgatgactacgtacacaggattggtcgtacagggagggcaggaaaaagtggaattgcgactgctttcttcaatgacaacaactcttcgatggcaaagtctctagctgacctaatgcaagaatctaatcaggaggtacctgcgtggcttactcgctatgcagctcgcccatcctatggtggtggtggtggaaggaacagacgtggtgccggaggtgggagccgctttggtggccgtgacttccgtagggaatcttcttcctttggcaagggtggtggcgccagtgactatgctggaggcagcagctacgggggcggtggctatggtggtgctggagctcccagtgcctgggattaatgttgcagttgttcgcttagggtctatcaagtttaggttgcttttattctagcttcttattagatatacatttttggcaggagctgagatgcagcgacagtatgagtgaactgtgtcgtccccttttcttctggttacaaccaaggtagtcttatcttcagatatccgttatggagagaatcttgaggactttcaagcacacaccgaggttcgcagttaggaataggatttctagagactgaaattccttgttagggataatagtagctggtgttggcagactgacagcgcttgatgtggaatttctctccgcatttcttgtctatgtctattttcggttagttgtagagcttgc

SEQ ID NO: 10268 - DNA, 427 bp, Triticum aestivum
  Clone ID: PAT_TA_10268
attcggcacgaggcaaagtcccccgccctcgcagcgctcctcctcctcctcctcctcctcgcccgcagcgcggaggccgaggccagggaggtgccactcagctgggagctgggcgtggaggacgtggcggacgacgggttcggcgacgtggtggtgggcgcgtgctgcgtagcaactacattagctacggcgcgctagggacagcgtgccctgctccgtctgcggcacctcctactacaactaccgccccggcggccaggccaacccctactcccgcgggtgctccgccatcacgcactgccgcggctaggactccgatccgtcccatgccggttgattgagagtaatttgtgtcagagactcatagtcacagtgtgtgccacattgactcactaataaagatcaaggatgaatatgaaaaaaaaaa

SEQ ID NO: 10269 - DNA, 666 bp, Triticum aestivum
  Clone ID: PAT_TA_10269
ccgccaccaaccccgtctcctccgccaccttcaccaccgccgccgtcgcctcctccaccaaccccgtctcctccaccaccttcacctccacccccgtctccatcacccccacctccgtactacgaggtctcacctgaggaacggtacctttcgccgccacctccagcgtaccaagagccgacaacgcctccccgttacgacgtgccagctccctactacgaggtgtcaccggaggaccggtaccactcaccgccaccccaagcttaccaagagtctccacctccgccctactacgaggtgtcaccggaggaccggtacctgtcgccgccaccgccagagtacgaagagccgacaacaccgccccactacgacctaccagcgccgcccaactacgaggtgtcaccggaggaccggcacctctcgccgccaccaccgacgacgtggaagatgccggcgtacgactactcgtcgccgcctccaccggctgccgggcagccatgaagttgattcttttcgggattttttttcatacattctgatcatatacgagtttgctgtggtgaaacaatgccgttaatatcattgctgtcttcttcttctttttcattctactttactccctgttctgatttgttcgtgttgttcatacagatgatccatatgaga

SEQ ID NO: 10270 - DNA, 477 bp, Triticum aestivum
  Clone ID: PAT_TA_10270
ttcgagccgccgcccgggcaggtaccacttgtatcggcaactccggcgaccttgataaatctttatcagatgctattgtagataacgatgttgttgttgttgctgtgttgtcgggcaaccgtaactatgagggtcgtgtgcaccctctaactcgagctaactacctcgcctcaccacctcttgttgttgcatatgctcttgctggcaccgttgacattgattttgagaacgaacctattggaattggaaaggatggcaaggaggtttacttcaaggatgtatggcccacaaatgaagaaatcgagcaggttatcaagtccaacgtgttgccgaagatgttcgtggacacgtatggttccatcatggagggcaacgacgcatggaacaatttagtggtcccgaaagagacgctctacccatgggatccaaaatccacctacatccacaagccggcgtacctcggccgcgaccacgcta

SEQ ID NO: 10271 - DNA, 970 bp, Triticum aestivum
  Clone ID: PAT_TA_10271
ctgcaggtctgaatttagctagtatagtgcttgtgcttatactaccagggatcgatacacctatggttgacaggaaaattattagtcagagatagaggagctccgcggctgtagtccgggcggcactgctcgtccttggcgcgctgctactccctgcccaccatgtgatggccgactactcggccgtggcaccgacgcccccgccgcctaagccggccagtgccatttccaagcccccgttgccagccaatgacaccaacatgtcgccgtccccgtcgccgcctgtccagccggtgccacctttcgtggtcgtgcagggcgtgatctactgcaagtcatgcaaatccaggggctacaaccgcggcatggacgcctcaccgatccaaggtgcaacggtgaatctggtgtgctacgggaagaaggtggtgaacgtgacggcgacggtgtcggacgagcacggctacttcctggtgatgttctacgacctggccaacttcaacgcgcgcaactgcaagctgtacctgggcacgtcgccgacgccgctctgcgacaagcccgtctacccgccgaacaagtggatcgggctctcgctcgtcaaagagaccgtcacctcgccgccggcggggctgcagggcgtctactgccccaccagcgtcctcttctacggcccctccgccggacagcattgcccattttattgaccgcgccgcctcgatccagctggcactgagtaataatcaactagtcatatgcagttgatggatgattcatgattgacagtgttgtgcttgcagtggtgcatatttgtgcatttatgtgttcgtgttcctaacagctagccaatttacgttaagttcttctagttcgtggggttggtgcaattccagtgtagtgctaatatcttgagcttcagggcctctgtcccctcacataactatgatccccgccaacgtgcattaaaaaaaaaaaa

SEQ ID NO: 10272 - DNA, 576 bp, Triticum aestivum
  Clone ID: PAT_TA_10272
cctccccccttccatcgctcggtcgaccgatcgatcacgatggaaaccagctccgattcccttaaaccctgtgtctcccaacccttgggccccaagggcgctgggctggctgaagctggcgacggcggcaccatgttgaaagcgtcgccggcgcctagcaagcctccgcgtgctggtggcctcccggttcgcgatgctgacgcggttccacgcgggatacttccgcatcagcctggccctgagcgggcaggcgctgctgtggcgcacgctgagcgacaggtccacggacccgagcgcgctgcatcccttggtgcagtccctgccgtccgcggcgttcgtgctgctctggtcgctggcgctgctcaccctgttcgcgctctgcgtgctctacgtggcgcgctgcgtgctccggctccccgccgtgcgcgccgagttccggcgccacgtcggcgtgaactacctgttcgcgccctggatctcgtggctgctgctgctgcaggccacgccgttcctgcgcccggacgcgccgtcctaccacatgctatggtgggccttctcgctgcccatccttgtcct

SEQ ID NO: 10273 - DNA, 1033 bp, Triticum aestivum
  Clone ID: PAT_TA_10273
ttttttttttgaccttttattatttctttttagcactgatggacaaatatgtgcatcagtggttattgccagaattttacatattacaagcgaaacaaatttgtgtaggcagaaatatcacaatttctttagcctcttaacaaccgcttggctggcgaagaattcctgaacttcttcctatacaagaaaaaacctatggcaccgagcaagggccaagatgttaccacagcaatgtacgccagccaccagaccgacctcccctgggatcgaatgagctggttaatggatttcttaacgggggcgatggcatctcggattttatctgtggagagctcttctctctgctcttgtgaccctacaaggccttgggcagacggtacattatcctctgtgccgcttgtgttcttcaccgcactgtgactctcatcctgtaacacactggtgatcccattctgttgtacattaatcacatcactgccttccatttcactgacagcctgattatgcttatccaaggattcgtgagtgttggtatcctcgtttgtcactgcagctaccattccatcttccatgagattaacatatggtcccttatcgatggatgattccagcggagattgcaatccatgctcttgagtcttctgtcgatgcatgcaaggactatcatgtagagcagagaaaaactcggagacaggttccacccaccatagtcttccagcagttaggccttgaaaaaaaccaagatggccaccattaggtgtagttgccaaaacaatattcttatttgccctgcattcatcccagggaatggcctcccttgtgcaaagggggtcatctaaagcactgatacaaagcaacggaacagacacattaccaatatagtttgcacagctgcacttgcggtagaatgtgtccactgtctcgtactttgcaacaacacaagttgcatgatggtcaaattccctggtagagcgtgacgacgtaatagcttcccagtttgcaagtcgtaccaagactggttgatgtagttttg

SEQ ID NO: 10274 - DNA, 593 bp, Triticum aestivum
  Clone ID: PAT_TA_10274
gtactctaggactagagtgtttcatcgatcatggcgttcgcggtcgtgggggatgcggccgcggtaacacagctcatcgggcaggcgatcgggctcgtcgccatgatcatccgggcggtggagacggcacaccagaacaggctcgagtgtgagcgcctcgcttgccgtgtgtccacggtcgacggcgtgctgtctgacctgccgcgggcccaggagatggcgccgccgctcaaggtgctgaacaacacgcttgaggaggcgcaccgcatggtcatcgcatgccagaaccggggcgccgccagccacttcttcggatcccgccgccacgccgattgcttcaatcaagtcaacaacaggattacgtccgacatcgtcatcctcaacctcagcctaaacagcttcatggcccggcgacacttcaaccacgtccttcatcccaatcacgtcggcgtaccgactgccacagtagccatggcgccgccgtggccaggcttcagctctggctccctgaagactcaactggtggtggtcccgcccccgtagctaattcccccccccttcgctcacccgctcgacatgcgcgggacgccttc

SEQ ID NO: 10275 - DNA, 779 bp, Triticum aestivum
  Clone ID: PAT_TA_10275
ccccatacccgtcatatatctatcgtatagctacctagtatacgcagcaggtagccaccacaaccatggccatcgccattgccatgcccaagctcgcccttgtcattctggtggccgccttcctcgctggcagcggcaccaccaagggggattgtgagtaccggctgaaggtgaagacgggggactggcctggggacggcacggaggctttcgtgaacttctggttgttcgccgacagccagcgcggcggcggccccatcgtgacacacgaggaagacgccgatggtgccaggttcaaccgtggcagcaccgacgaattcagcttcacggacccgaaatgcatccggccgtgccgcatcgtcctcagcgtcgacgacagtttccgggaacgtcaggactggctctgctattccgtcgacgtcaccgtctccggggacatctcctactccaagtcgttccatgtgaatcagttggttgagtctcgcagccccgccgaggtcgacgagtgcgaggacgcggccgcggcttgagccgtccgtccgtccgcgtgattgcatgtactacgtattcctcccgcgctttccctgcttgcttgcttgtgttgtgttatttcctcaggtgaataatatataattaataataagcgggaagatctttcattcggtagttgtttctcccgccatgtacgtccgtactcggttgaatttgtgtcgtcgttcccgatgcaatcttgcagatggatggcaggagtatctgttgagtaatctcatgtaaagata

SEQ ID NO: 10276 - DNA, 623 bp, Triticum aestivum
  unsure (1)..(623): unsure at all n locations
  Clone ID: PAT_TA_10276
ggcaatgccgacgacgactctgcgggggataggtctggtggcacttaatcactatctgcggacgcgtcagctgttcgtccgcgtcccgacgccgccctcgctttggagaattgctcgtgtggcacttcctcactgtctggtcagccacggtcagttcgaccagaatccgttctagctattgagtcagatgttgattagtgtctctagttgggtgccgccgtacaattggttcggtggccccaggtgtgagatgcatgctgttctcttggtggaatgattcctctcgttttgttattgatcgaggtctgtctgtccctccttgtatgtctttccaagaaggatgcaaatgaacgcagtgggatcgatgtataaagtaagcagttctgctatctttctctatcgttctcctttaatgattcatggtgatcactttgcaggctgtagaggaatttcgggaaggctgcaaagctcctccatcgtgcctgcctgtaggcaaaagtctgtagcatagctagctagctagcaggaactgagggtcagttgctgtacatgtagtctcccgtctttaaagagtttccttttgttcacccctgcggtaagaactaatatgccccanaaaaaaa

SEQ ID NO: 10277 - DNA, 757 bp, Triticum aestivum
  Clone ID: PAT_TA_10277
ataatggacgccctcacccgcctccaccggtcgctcgccggcggcgacgacgaggagtggcaggaggacgacatcctcggtgataccgagggcctctgctctctgtcccctctccagcggctctacgccttcgcggcttgcttggttgctggactcgccctcatgatgctgtcacttattgttttcgccagacctatcaaatttgctctcttgtttacatttggaaacataatggcagttggcagcacagtctttgtaatgggggtaaataaacaattgaggatgatgcttgacccagttcgtgtttatgcaacggctatttatgttggatgtgctgtttttgctctgattttcgctcttttgattcatgacaagctgctaacattgattgcaatcatatgtgagatatgtgcgctcttctggtatagcttgagctacatccctttcgctcgacggattgtctccgacctgatggtgaagctctgcgacactgaactatgatctcatcgctccggcaaatgcagagaaccggttcatctccatcgctccagcagtgcaggtatcccgcccatttccctgtgctctgacgactggtggctggatcaagctccgtattgggcataaatgcttcacgagcggcacccaacctgttgtgcgtaaaacccccgcacctcacccttgcctacctctccaccccttcgcgaaaccaaattctgtgcaaattacagagttgctacaaaacccagatataaacggc

SEQ ID NO: 10278 - DNA, 1760 bp, Triticum aestivum
  Clone ID: PAT_TA_10278
gctccacggggagggacaaagcgcaaccgatggccgctagtactacgaaaggtgttagccgcactcaccactctgctgctctccctagtccagcagtgggaactcgtcctcctcgcactcgtttctcttgttcccctcctgctgttgacccggagccggcgcccgtggtcccagatacaaatgaagctgccaccaggtccggcgccgctgcctttcggcggcaacctgcaccaggcgggtccgctgccgcatcgaacttcgcgtgatctggcacggcgtcccgggccggtgagccagcttccgctcggcaaagcaccgaccgtggtgttgtcgtcgccgggtgcggcatgggaggggggcaaggcgcatgacctcggctgccgcacacggcctgcggcccccgggccgaagcgcctcacctatcacctcaggaacgtggcatgcgcactattcggctcatatcggcgcaacattcgtaagctcctggtggtcgaacttctcagcggccgccgcgctcaggtccgcatgggccgcacggcaggagcgggtgcaagcaacttgtcagcacccttatgcgggcgggagggaagccagtggcgctgggaccaggactgacttagacgggcagaagcctccgacgccgcagtgccgctcggcgccacggatatgcccaggcatatcaatgggcattgccactgtggagtttacacttgccaatatgctatgctgcttccagtgggcgcttcctgatgggatggagcctgaagatgtcagcatcggaggaggaaggaaaaataaacttccaccgcaaaaccccgctcctactagtgcccaccatacgttagggtaactagcacaatgtccgtgtatgtgtattgctgcggagcaatagaataagggtgtgtctacggcgccgtgctctgcgccctctcgatgggagcatcgtggcagactcaacttcaccaaggaccatgtcaaggccctaatcttcgacaccttcattgctggctgttggacacgagctctgtgacgatcctgtgggcgatgtccgagctgatacgcattcccgcgtcttgctaagcaaggtgcatcccgagatctgggctgttgtgggcaggaacgatagggtgcggtcaagaagatgtgtccaaactcgagtaccttaaactagtggtgaaggagaccctgcggctgcacccaccggcaccactgctagtgccgagagaaaccatgcggcacatccagattggcggctacgatgtgccagcaaagacacggatctacgtaaatgcatgggcgattggtagagacccaacaagctggcctaaccacccagaagagttcaaccctgagaggtttgaggggaacgagattgacttcaagggggagcatcctcagatgctgccgttcggcaccggggcgacggtcatgcccaggcatagcattcggcattgccactggcaagttcacccgtcccggcctcctatggggcttccagcgggcgctgcctgatgggttggcccctgaagatgtcagcatggaggaggaaggaaaaataaacttccaccgcaaaaccccgctcatactagtgcccaccatacgttagggtaactagcacaatgtccgtgtatgtgtattgctgcggagcaatataataagggtgtgtctatggctcatatagatgtacataacaatgtcacatctaagtgatgtctatgcacaaagtgtgctcccatttactccgagttcctcttttctct

SEQ ID NO: 10279 - DNA, 1898 bp, Triticum aestivum
  unsure (1)..(1898): unsure at all n locations
  Clone ID: PAT_TA_10279
gacttgcatttgctgagtgccgggggccggggacgcgcccggcggaattgtatgacctgagtcggatagtcaggttcttggacacttgggggattattaattacctcgcggctggatctgtgcaccggggcttgaggctggcatcatctttaatcagggaggagcaaacaggggagctgcagctggcgtctgcaccattgaagtcaattgacggtctgattttgtttgatcggccaaaatgcagtgcccgagcagaggatattgcttccgtggcatcaacttcgtctgctctggaggtgccaaatggtgatactggctttgcacacttggacgaaaagatttgggagaggctgtctgagaacttttgtagttattgttcacaacctttgcccagtttgcactatgaatcacaaaaggaggcagacattgctctttgctcggattgcttccatgatgcaagatttgttcctgggcactcaagcttagattttcagagagtggatggaacgaaagatggatcagacaatgatggggacagctggactcacgaggaaactttactgttgctggagggcttggagaagtacctgcccgggcggccgcccgttgctgaacatgtcggaacaaagtctaaggcgcagtgtattcaccattttattcgtattccagtggaagatggtctgttagagagcattgaagtaccagaagcatccgtttcatctagagtacaaagcaatggattttcgtattcaattccccacggcggcatttcaggtagcgttcctcaaagtagccaacctggacaacagcttccatttgttaattccgctaatccagtccgtccgctggttgcatttttggcctctgcagtaggaccaagaatagcagcatcctgtgcaaatgcagcattatctgttttgacaagagatgattccaggatgtgttcagaaggcaatgatgtcatgggtcaagctgctcgtccaaactatgatgcctcatcatctgtctctcccgaaaacgtcaaatacgctgcaatgtgtggcttgtcagcagcggcaacaaagtgcaaactttttgcagatcaggaggagcgtgaaattcagagattagcggccaccatcataaatcaccagttaaagagattggagttgaagctgaagcaatttgcagaggtggagaccttgcttttgaaggaaagcgagcaggttgagagggccaggcagaatcttacagcccagcgtgtccggtttatgtcagctcgatttgcttcctccggaggtcccatgcctggaggcagcagcagcaccatggcatcaaatccaatgaatcaagccagccctcgaccaccagcaatgccaggatcaatgcctccggccagcatgcaagcgttttacggcaataacatgcaggggcatccagcccagatggctttcttgcagcagcaacagcggcaacaacagcagcagcagcagcagcagcagatgctctcatttgggccgcgcctgccgctctcagctatccaccccggctcatcgtcatcggcagcacccagcatcatgttcaacactggcatgcccagttcggctacccctaaccatcactccatgctgagaccaccaccctcggggagcaacaattcaagttttggttaaggagagattctttgcctcatcctaagttacccgtgtttgtagctctgatgccaaccattgtaattcaattgcacaatcacacaggtagatgcatttagtcttttaggttttccatcctattcctattcctttctcccggaatctctcggctatctcataagatgaatgtttgatagggaagattgtgttatagagaagggggagntncaccctggtgcaagtaattgctcccagctagatgctaca

SEQ ID NO: 10280 - DNA, 724 bp, Triticum aestivum
  Clone ID: PAT_TA_10280
gcaggcaattcggcacgaggccacgcacactcaagtctccaatggccaacgagcacttcttccccggcgagtacttttcctccggcctcgccgcgccgttccttggcgcatcctacgtgcagccgccgtgttcagggttcgaggccgccgcggctatggccttcgggctgccgtgggcggaccagcatcttccagtagactcctcagccaccacggcgcactttgactccgcgctcagctctctggtctcgtctcctgccagcgccaccgccggcggaggcttaggcttcgcgcacggcggcgaggatgacgtcgccatcggcgacctgatcggccggctcggcagcatctgcaacggcgccagcgccaacaactcctgctacagcacgcctatcagctcccctccacgcggggcgccgcaggcgttccggggctacggcgccatcgccgcgctggagaccggcaggctatcccgggtgtcaagcagcaagtcgctcgtcggcaacacctccggcgttgccgcgacggcgccattggatcagagcgcccaactggagatgagccccgagacggacagccagcccgcaatgcaggagccgcccacgaaaaagggcgccgcctgttccgcgcggaagcgcaaggcggccccggcgaagggcaaggcgaaggcttctttaccccgcagtacagcccagttgctccgtcagttcttcttctccctctc

SEQ ID NO: 10281 - DNA, 591 bp, Triticum aestivum
  unsure (1)..(591): unsure at all n locations
  Clone ID: PAT_TA_10281
gcccaatttgtagagaagagagtgggagaggattgtataaaggccttggggccacgttattgggagttggaccgggtatagcaatcagcttttatgtatatgaatccttgaggtctcattggcaaatggaaaggccgaatgattccaatgccgttgtgagcttgttttctgggagtctatctggtattgcagcgtcgacagctacatttcctcttgatcttgtaaagcgacgtatgcaactacatggggcggctggggcatcacaaatcgaaaaatcaagcataactggaaccatccgccaaatccttcaaaaggaaggtcctcgtggcttctaccgaggcatagtcccggagtacctgaaggttgttcctagcgttggaatcgccttcatgacctatgaggtattgaaaagcatgctctccagcattgatggggatgatgagaactaaggtcgcaaagcagttgcgttgcctttttttttgccgccctaggttactatcgtaagaccagtgtatgagagtgattacaacatgccttgccaggcagttttgtaggtgtggtaggataaagcaagctttacctnaggttatg

SEQ ID NO: 10282 - DNA, 358 bp, Triticum aestivum
  Clone ID: PAT_TA_10282
gtcggaggaggcagccggaggtggaggcggaggcgggggtgccgccttcttcgcggcgcgcttgggggccatcgccggagactagctagggtttgggagaggaaaaaaggtgggcggcggcggcggcggactcggtggtttgctctcgcaatttgggggtttatttaggggaaggaaaatatcagcgtactccctacgataaccctttctctcctgtgaggcattcgggcttagcaggcccatgtccacttgggcctcatggccttatacggtccatcattcatctttctggctagactcacccacagctccaaaaaaacaaaaactagactcactgtttttttaggcaaaaaaaaaa

SEQ ID NO: 10283 - DNA, 729 bp, Triticum aestivum
  Clone ID: PAT_TA_10283
cccgcccccgcctgcgagcacccgaccgcccaccccttactgcgcaccgattttgatcacccccggtccaattttggccttccaactccaatcgatcgcccgcctagccaagaattcgagttcaagatgggcaaccgtttccacacagcgcaggggcgtcgcggcgtcgacgccgtgcgttgcaccaagaagagcgcggtcccggtggaggaggagggggagaaaggtactccaccggtgaacgaggtgaagatcagggtcaccacgaaccagctgggaggacctgctgcggcgcctccaccgggaggatcggtgcaacggccccctcctctcgccgcccctcggcgcggcccgcgccgccgacgcccgccccgcggggcaggccgcactgtggacgccgccgccgcccgccacacccgtgtggctagttatccgcccgccgcttctggttcgtcttcctcgggtgtccggcggtttttttggcttgtcgcctcctgctcggctcgcgcattttgtgtcgctcccccgctccgggcgcgcaggtcggggcatagatgcgctcctggtaggcctgggaatagatgagcttgagataatctatgtaattaaagtaaataaactcgtggtgcattttagacagtatggtgacatgtagaaatataggcatataataagtgaatgtaaatcgagaattggtagctaggaagcctaggaggctccttccattgc

SEQ ID NO: 10284 - DNA, 431 bp, Triticum aestivum
  Clone ID: PAT_TA_10284
cgtccgcccacgcgtccgaaataaaccaacgaaaattgtcccaactctcctagtgtcatccacaactatcaatgctcaggctgaaaggtctaacaaattgaccttttgttttccacaacaaaaacacactaggaaatgcatttgtgagatgccaacaacttttgtcaatgtagcagtattttttgcaagtctgtctgaagagggcagaatcatattcacgtagatagaaatgatggtgattaaccgaccaagccgccgtccattgagtctacctgttagagcttgaattttattgttctgttcatcagttttttttgtagttttcttaatgcactgcaaagccctctcatgtatagtgattttattcatataactactttagttggttcatcagtttataggttaccccgtcttcgacaatggatgtcacg

SEQ ID NO: 10285 - DNA, 453 bp, Triticum aestivum
  Clone ID: PAT_TA_10285
ccacgcgtccggagaaataaaccaacgaaaattgtcccaaactctcctagtgtcatccacaactatcaatgctcaggttcaaaggtctaacaccgcacgcctccgcctgctacgccatggccaccgccgcccgctcctccttggcgacatggagccttgcgcagtgccgtgacgacgtcctgcggtaggactgcatgctctggttggccgtggcggtgcggacacaggctacatgctcagccttctcaacacccagaacgccaccggcatgggctgatgtatctggtcgcgttcaatcaagcgcaatgaagctcatgtccaacgactccggcgacggtgcgaacaaggggctggcgatggacatggcgcatctcggtggcggcggaggcggtggcgaactgtgggttgtgtgtggcgcaggccgtggccgaactgctcaactactggcagaca

SEQ ID NO: 10286 - DNA, 905 bp, Triticum aestivum
  Clone ID: PAT_TA_10286
ggcggccgcgtccccgcagctcctacaaccaccgccagtactactcacatagctagagtgttgcagtagctagctcttactagtaactattagctgctgctgctgctgctgctactacgatgctcatccatcatcgtccctgtaaatccatatggatggtattatgttctccgtggcccggcccttcacgcgcatgatcaagaaccgcgagtcggcgtcccgctcgcgcgcgcgcaagcaggcccacgtcacccagatcgagtcggaggtgcaccagctgcgcgcggagcaccagcagctccgcctcaagtaccaccagctcaaggcttcggtggaggtgtcggtgccggtgaggaagacgctgcagagggtgctctctggcgcccttctgatccttcttccttcccgaggggccgagatcgaagcaagcagctcctccagccaccaccgccactactactactcacatagctagagtgttgcagtagctagcacttactagtaactattaccagctactactacggtgatcatccatcatcgtccctgtaaatccatatggatgttattgtgttcctccttttccttctttcactaggccggccggggttgtctcaatctttttggtcactcagctaaactagaggtggcaatgcgcgaggaaagggaagaagactcagcagcttaatctgtacagcggcagctgctaccagtagtagaactcctagtaatcatacccgttgtggattagccaggcagcagctggttcttgttttgctgacttggtgattaatgatattatggtgctactttacttaaaaaaaaaaaaaaaaattggtatacggtggagtacccggaaaaaaaggggggccgtccaatctcccttaagagtggtaaaattatga

SEQ ID NO: 10287 - DNA, 982 bp, Triticum aestivum
  unsure (1)..(982): unsure at all n locations
  Clone ID: PAT_TA_10287
gccgcccccgctcaacctccccgtcctcggcttctacgtctgcgacggcccgctccccggccccctcgtcccccggcagctcagcctggacgcgctgttcgccaacgacaaccgcttcaacgtgtcgctggcgtcggggagcctgaccaactccacagcgtcggtcatcgtgctcgccaacaccaagctggccggctgcctgccgccgagcatcggcgacatggccgacacgctcgcggagctcatcctgctcaacaccagcatcagctcctgcatcccgccggagatcggccagctgaagaagctcaaggtgctggatctcagccacaacgaggttcgcgggggagctgccggagagcatcggggacatggagagcctggaggtgatcaacgtggggtacaacatgctgtccggcgcggtgccggagaccatctgcttgctgccgaacctgaagaacctgacggtcgtgggcaactacttctgcgaggagcccgtgtcctgcctccacgtcccccggcgcgacgaccggatgaactgcatccccgactggccgcaccagcggtcgcacgagcagtgcatcgccttcgagcaccgcccgccggtgcactgcggcgccgacggctgcattcttccgccgccgtgaaagcctttccgcgtgcatggacgcaccctacgtaccgacgtacgcatgacaacgccgcgcacgtggttggtgttagtggtacacgtaccataattctaagcatcatttgtggggtttaggagcggtgatatcaagagtcatcgaattagtcatggtcgctaatgcacagttattcgattataattgtgtcgtcagncgcgcgtcgtgtgttggtgggtcaagtaagtgggagaatattaactcaatgtggtgtccttacctttgttgctcacatagncacagtgatctctcaaacaaattacattaacatggcaaatagattacataatcaaaaaaaa

SEQ ID NO: 10288 - DNA, 1270 bp, Triticum aestivum
  Clone ID: PAT_TA_10288
gaattcggcacgagcagaggtgtgtgcgtttgatgattcttcagagaagtcgttcctgcccaagagggacctggagtggttcttccgcgggccgcgggaccgcaagtaccccaacgggtcgcgcaccaaccgggccaccaccacgggctactggaaggccaccggcaaggaccgcaaggtgtcgtgcgacggcggcgccgtctgcggcgtcaggaagacgctggtgttctacaagggccgggcccccggcggcgagcgcaccgactgggtcatgcacgagtaccgcctctgccaggacctcctccacggcgcctccaacttcatcggcgcctacgcgctctgccgcgtcatcaagcgcaccgaggccggcctcctgcacggcgacgcggctgccaaggcgaggccgggccaccagcagatgagcaaggtcgggagcagctcctccctggtcaccacggaccagcagctgagctccctcacgcccagccctccgcgcctcgacatcgtcggcaacgccttccagcttcacagctccccctctcccctgtacggaggggaggtggtgtccgggatgggcgcgcctctggggttcccgcagcaggacgccgccgccacattcttcatcgacggcgacctcgccggcgcaggcgagacgacgcaggcgcacatgcctttcttcgacgacatgggcgtggtctcggaccacgagctcagatgggacaccttgccgctctgcaccaacaacgccttctccaccaccgccggcgcggcggagctctggaacccggtggcaccgaacgccgccgccccgatgctgtgcagggaggccagcgacgacctggcggcgtttttctcgtccttggacgaaaacaacatggtggtctactgaagctctcgtttcacacccaagaaaagatcgtagtaatttcggcaacagaggaaataattccagaaacctaattgctctcggcaacggcggtatattttcagccagtgtacggggtcgtataccgtatgatatgtaagagtacgtagtattgctacgcgcgcgtgtgtgtgtgtcttgtacagttgtactcggagtgacggcctattttagcactgtcttctctcgctgtggcacgacacttccatctcttcctttactgtgattcagtctctgtactagctgctgctgctgctgcaatttacgcagcaatatatatgttgtgctcccatttcgggcgatgtaaaattccccattgctattatacaatatataaccttcttt

SEQ ID NO: 10289 - DNA, 1440 bp, Triticum aestivum
  Clone ID: PAT_TA_10289
cgtccgcggacgcgtgggctgctagcagcatttttaattggacagcggatgaatagggaaaccgatcgtgagctaaaaggatattgtctagcctttgatgatgaactaggccctcccccaattgctgatgttaattccttgacacactatggtgagccctatgatgggaatacacgcttctttaggagtactctgttcgttgcggcggttagagcctgctatggtgaggcttgtctccttcatggcgttgaatggatgccacctaagggtgggataacagaagggcagatgcttaaattcatgggtgcaaacacacacttgtctcctacgcaggccaaaacactattggaggataaggatactggttttgcatatctgaatctccaagaagcttgcccaccattatattcgattatcgggctcagggagcatattaagatttcgcccccgcggccgccctcgcggccgcctcaacaatttgtgagagcacggggaagggagtcaatggttgctggattttatcatgtgggctatgaagatccattgcttatgcttatgagaaggagaactgttcatgctggattagttgtgaagggtgaggaaggtgcactttctttgacaaccaaagaaagatcggcccatgcttccaaagggattccagtgaaccactgctcagggttccggacaccaagcagcgcaaacttctccgaaactgacggtatttcgagagaaagtttcagagttgctgtggatgctcaggaacttggtttcaaatccactgaaactccaagaactgataaatcagtactgaaaaacttggagctgggtttgtcagcgctgggtggagacaaagggcctgcttatgaccgaatagttcttaacgcagctatggctgaccacttgttaggctgcagcggagctcaggatatcaactccgcgcttgacagggcaagagaagccatcgacagcggtaatgctctgagaaggctcatgaactacataaaaatctcgcacaaggtgtcctagctagtcgcagccgtgtgctgactgtacaattttggtcccaatatatactttgcctttctcaactgggaaatcgccttacacgccactggaaaattttgtaacccctcgtcatggtagtgtcactgagaaggtagtgtcactgagaaggtggggccaggccccacatgtcgttgacgcaaacgatgagaaagtattgcagtggccgaaagagatttgtctttcagtttgctcagttgacacggagtgtggacttgcgcgaatgctctcttaccaggccttgttaacaaattaagtttaaccgaaaggaatcacagtttgttgaggattttatttgcggtgagaaatacttggttaatctaatgttggtcatgtcatcagagggggcgatgatctgtataaacatatgcaaactat

SEQ ID NO: 10290 - DNA, 1471 bp, Triticum aestivum
  unsure (1)..(1471): unsure at all n locations
  Clone ID: PAT_TA_10290
ggcacgagcccctcgcggctccgccctcctcccccccgcgcggctccgccctcctcccctacgcatcgctctggttttcaattcggctcgtttcgtttcggttcttgttcttctttttgatgactggtcgatgagaggtccgtcgtagcggtgatgacaaatttgtggactagagtttctgatgccgcctcttcagcggcatctgcagacaaccccttggctgtctgagctcccagatctcatcccatcgaatccatccgttcttgtacttctttgctttgattgatgcgcgttcattaccaattcctgaggatgatttgtgttcctcatggcgattagtctcggacgctacatgcgattctctgatgtgtggtatatcctgattggtggcgtcctctgtgccagcttatcctggaaacgccacatacattcacacgccgccctctcttgctctgttctcttcttttatctgtctgtcttgatccagatggcctactgtgatagatcgtacaagcttttaattagtgtatgtggatgatgagatcacaagtaaaaatacagttatccctgtcttacttcctcggaagggtgctgagaatactttcaatctgacacggttacttgcagcatcatgtgcagtatgattggttatagaagctgtgttccgtatgcattgtgagatcctgtttgctttgaggctcgaatgtgtattgtttttcttttgatttgattcggcctgtatggcgaggatgaagaagaaaatcattcggattcccattgatttgtaataaacatgagatctttaaccagctacttctgactcgaatcatacaatctgccctcttttggcgtccgtcgtgtttttcttggtgcctgtggtggtgtttgttcgtgttttccttggagccagtgatgttaatcaaaatatttgctactcttgatggggcaacgaccccatttgatgatcacaaccaccaagatctctgaggccctggaagtcacctttcttaattttttctcggctcgcggtacagctcccacatgaaaggtcttcagtatgctccagttctgaacaagattaaaattgtacgggtccttcccctaaacgatgcaactcagttgtccggtgctcccctgccctcagttgtcacgtgcaacagttgtaaactatgtcactgtttctgcttcatattcggttgaagaaatacgagattgctgtagtttttttacagctttgctttgacaacaaaacaacagcattgagaaacaaaagggcaaagaaaatctagatcttaaatacttgattatttgtactccatgcttggagaaacaacatgatgtgtggagtaaagatttggacggacggtatcagttccgggccaaataatataagatgcctggagtatttctttacatttttgtctgccaatacagaagcaatgttgtgtgccatgctctgctnaaaaaaaaa

SEQ ID NO: 10291 - DNA, 238 bp, Triticum aestivum
  Clone ID: PAT_TA_10291
ggaaattttttagatttgttgttacagtacacgatatatatataggtgtctttttttgcccttgtgttagggggtctgtttgagaggcgatgccgctgtttaggagttgttctgggctgagattggaattgattacctagaaacccttgtgcactgctgtagtatccttgttaaacataagtttggaaaatcaataaaggaattgctgagaagcaacaagttgaccataaaaaaaaaa

SEQ ID NO: 10292 - DNA, 1430 bp, Triticum aestivum
  Clone ID: PAT_TA_10292
tttcggcccgagggttcttcaggtcttcatcaatggcaagtttgcaggtagcagtaagggcaatgctagtagctccctgatctcattgacaacaccagttacacttgtacctggaaactctcttgggcatcttctgcgggcctccgtcggtcgcacggtggctcggtgccctctcggctccgctctgcgctccccggtcccttggccttctccaccacgcgttcgaccacgcaacagcacacgcgatcgtctgagtgcaacagttggtctgacgaactatggtgcattctttgacctagttggtgctggaattaccggtccagtaaagctgactgggccgaagggtacgctcgatctatcttctgcagattggacataccagatcggactcagaggagaagacttgcacctgtataatccctcagaggcctctccagaatgggtatcagataactcttacccaaccaataaccctttgacctggtacaagagcaaatttacaactcctgcaggtgatgatcctgttgccatagacttcacaggaatggggaaaggtgaggcgtgggtgaacgggcagagcattggtcgctactggccgacaaatatcgctccacaaagtggctgtgttaattcatgcaactacagaggaccttacggcgcaagcaaatgcctgaagaaatgtgggcagccatcgcagactttgtatcatgtgccccgttcgtttctccaaccaggcagcaatgatatagtccttttcgagcagtttggtggtgacccaagcaagatatccttcacgacgaaacagacagaaagtgtatgcgcacacgtgtctgaggatcatcccgaccaaatcgatagctggatctctccccagcagaaattacagaggtctgggccagcacttcgtctggaatgccccaaagaaggtcaggtcatcagcagcatcaagtttgcaagcttcgggacaccgagtggcacctgtgggagctacagccatggcgaatgcagcagctctcaggctctggcagtcgctcaggaggcatgcgtcggggtgagcagttgcagtgtgccggtgtcagcaaagaacttcggagatccatgcagaggagtcacaaaaagccttgtggtcgaagctgcatgctcatgagtcatggcatgtttgataaatgttattagtaggaagtaaaagcagattgagggggtgaaaccagattcctcctctttgtagacaaacaggcaagaaacaataattgttcagaaatgctagtcggatggaataaaatattccaaaatctattagagccatggaagctagtaaattgtctacttagaatgggttgtgctacttgttagtagaacaattctacacattcctacaatgtattctttcgcaatgagagataagtcaaaccgagaaaaagggggggaaa

SEQ ID NO: 10293 - DNA, 968 bp, Triticum aestivum
  Clone ID: PAT_TA_10293
cgtccgcggacgcgtgggctccgccactgtttccccaaatccacaagactgctccggccgagccagctgcatgggatggccggagggctgctgcgagagctgaccggagacggcgcagcttcaccgccacacgtatctcgctgctagcagcagggagacggcgaagtacacaagcagcagagcaacgacgagatccacgagcttgacgacaacggcaagctggagtctcctcccgacgagctcgacaaggaatacgacgccggcgatgtcccggagcagcacggccgacctggacgaggatgagggtagcaaccagacgaggggcatgcctgggccgccgtgctatcttacggctgcacggggcctctgacagcagggtcgcgatagctggacctcggcgccctcctgcctggccaagccccagtagcaaaaccaaagatactgtccaataaagtttgaattttccacattgcttcttatggcattgaaagcttcttcaaaggcttcctcttcctcatacttgtacatgcaagcactgaaatcagcaagtacatttggtccttcctcgtcttttttcttatgaggtacaattcctgaatcatccgctgtttcaatttcaaatgcttgcaaggccgaaattttcctctgtgatggcatcaagtggcttgccccagaaggaagacaaaatggagataatctgcatcgcctacagatcagcttgccttggtttcactctgaacatgggggacgatcagaagagagataaggcaaaagggagttttttttgaagggaggcaaaagggagtttatctcgccacctaaagaccacagatgaacgtacctccgccgtgtgtcgtggttctaagtctgacagtagagtggggggtgggtattgagaggcaaggtcttagctatggagaggttgtaaacacaagagatgtacgagttcagaccctctcggaggaagt

SEQ ID NO: 10294 - DNA, 597 bp, Triticum aestivum
  unsure (1)..(597): unsure at all n locations
  Clone ID: PAT_TA_10294
gcggcgcgccctcgctagcctagcttcgcgccccgccccccccccccgccctggcccgccgcgccgcgcaactgcagggcctgcgcccccgccgcccccgccgccgcccccgcccccgccgcgcccggcgccgcggcccccgcgcggctgcccgagcccgcggcagctccgcctgtgcaggtcgggtccagggcagggtcgccgggcacctcggcagggcccctgcctccgtgcctctgtgcctcctctgcgccactcctcggccctgcgcccgccgggggatccggtgcctaagttggtctcctatcattctcgacgcagcctccagcgtggcgctccccatatttgctgctccccttccttgctactttcctgcctcggaaaccaacaggtcaacgttaaccaatagcctaaccatatcttttggtctcactactttgccattttggcggcgtgttttcgcctagaagtcatgttgggtgcgtgcagccttagtactcaaggcccatgtacgccatgggccaagtacctcctgacgctcatttgcgcataaaacaccccgtaaaaaaggggggccggtncaattccctaaggatc

SEQ ID NO: 10295 - DNA, 462 bp, Triticum aestivum
  Clone ID: PAT_TA_10295
ttcggcacgaggagtccaaccctcttgtcggcgaaaactcgaaaacaagccaaaagaggaggattatttctacgctaacccccacgagtgcctggccaattcaagcctgtgcagtggaagcaaggatacagtcactgtaaggtgagcacatttgcagcctcgcctgtgcaagttactgtttgtgatgatccgcggactgaagccggcaagcaggcagagtcgccacgatcgtttaactggcgttcccagtgttctgttgtataggccaggtttttcttttttctttctatgctgcaatccattcatttattttcaagctagccaaagtagggatgctgtgtgtaaatttttgttggtcgtttgcgctattgttcaccggtgattaaattcatgatgatatcggaagggatatacaattgccacggtgaccaattgagagacattttggttccaaaaaaaaaa

SEQ ID NO: 10296 - DNA, 651 bp, Triticum aestivum
  unsure (1)..(651): unsure at all n locations
  Clone ID: PAT_TA_10296
cccccccgccccccgctgccgctgcggcggaatgggcgcccgtgcgctgccgctgaggcggaagaggagcctctgccggcgaagcgaacctcgcgactcgcgggctcctgcgtgtttggtggcttgcaggtcgacgcggtggcgaaggatttggtacccaggcttcctcaagagactagattgccatggtttctgaggaaaccaaaccaaagaagcaaagagacgaggaatgcattataaactgtctcccaggagaactcattgagcggatatttttgaagcttccagtgagcactttgttgaggtgcactggtgtttgcgagcaatggcacaaaatcatccgagatccccagtttgtcacatcacacctccagcatgcatcccattatgcccttctgttcttcccacaagagtcggtctcacgcgagccccatcctgctgatgctatcctgattgatgaagccttcgcactgtcaacatatgcagtgccagtgattgggcctgatgatttcctttgtggttcatgcaatgggcttctttgcttatacacaaagtcatcaacactcaagatagctaatcttgcaaccggtgaatttctgcatcttgagaaacccgctttngnagaaaaacncttgntnanaaggaantttt

SEQ ID NO: 10297 - DNA, 387 bp, Triticum aestivum
  unsure (1)..(387): unsure at all n locations
  Clone ID: PAT_TA_10297
ataggccacgccaatattccacgccgaaacacacgcgcagaccggcgagccatagctgatagccccggccgtcgacgacccaagcgcgccaccccgtcgaccgatctaccagtacgtgtccggtcgcccctcgccgcatgcagctgcgccggaagggggcttatttttgctaaccgcacgacatgaggaggttcttgccggcgggagcaggggagccctcctcctcctcctcgtcggggtccgcacgggaaagcacgagggcaagcgaggccgccgctgctggcggcggtctgcgctacggaggggggagacatctcccctggggccgcggcaacgacctcctccaacggccagttccgcnggaggccaaggggganatgaaaggac

SEQ ID NO: 10298 - DNA, 322 bp, Triticum aestivum
  Clone ID: PAT_TA_10298
gaatttcggcacgagggacatcacgggcgctcttctacgacgagggaccgcaacgaggatctacaccggggaacagcaggggtctggtgcatgtgtggtctaattgatcaagttagtctcttcgccgcacatatcagccccccaatctctgtacatacacttgtacctgcatttgcattcccttgtcgcatacaccagtcaattgtaatggccactccggtggtcggactatagtgggtgggattgtaccttgacttgttttgtgttgttattacaccattggttagagtaataaataataatctgatgtgtaaaaaaaaaa

SEQ ID NO: 10299 - DNA, 782 bp, Triticum aestivum
  unsure (1)..(782): unsure at all n locations
  Clone ID: PAT_TA_10299
gccggcacgtcgggaacgcggcgacgatggcggggttgtgctcggcgtcgttgaaggtgaggtagcacgcgagcggctcctcgaggcccctcgccgatgcccggacgtcgtcgtccgccgcgatcatctccgccatgctcgccgggaagtccgggtcccccgactcctttaccacgacgaggctctcctgcagccggcgcgtcgcctctacggcacggtggtcgccgccggagtctgcggctggcgtcctcctcttcagcctgccgcacggcttcacgtgtaggctgtagccgccgccgtgccgccgctccctggccgtcggcgatgggctgccgcttcccgaggcctcctcctcccggctgaacttctctgtggtgcggcgtcggccgtgggcctggtgagcatcggttgcagcttcagctccggtaccattgggctgcgggctgcaccggacgatctctgctcgggatgtagtaggacgccatgttcggggagcacggatgcggcagcagcaccccctataatgacgacgatgacggcgtcaccatcggcggagcacgatcacttctgtggtgctcgcacaggagcccggcggtggcattgcttttgttaaggattagatagccatgcatattttcagacagtgcctgttgtgccttcttgctttttgtttcggcctgcatatagtctagatggcccgtctattcatataatcatatatgatccaacactactggaatttcattgtacgccatgctncttcgccgagagcacatacacgt

SEQ ID NO: 10300 - DNA, 2145 bp, Triticum aestivum
  Clone ID: PAT_TA_10300
ggcgtgagacaaagaaagctgaaaagaaaaagaagcagaagaagaaacagacagctgtagatgttggcaaaggagctccaaacacagtttctcaacatccaacactagaaggtgaagttgatgcttcaaatcaggctgttactaagcatggtttgccagatgacacagacgaacttttttggggttccactgccagagtggaaagctcttctagagcagttggacctccgctgggctttcgcgcccgggtgttgccgcccaaaagtcttcctgaggggtatgctatcaacagagctgaatgggaacctagtgctctatccgagcctcatgcagcggcaacccagaaaggttggaaacctaccctaggacccaggcctaaatcgctgctggaaattcaagccgaggaacgactaagagcacagagggtagctgcggacagtgcccagataaccatgccagcgcctcctgtgccatcaggtccttggaataccatgtctgcatcttctgagcaacaatttgggggtgcaggtaaatcactgggtggccaggaaagtgctggtgactccaggaacaagagaagtcagttgcatgatttgttagcggaagaagttctggcaaggtctagtaatgcggacaatgagaacacaggcaatgctaatgatgtgttgtttcctctatcgcctgctgttgttcagtctgatgctcctgcttttgatgatgatgacttcattgaggccaaggactcgaaaaagaacaagaagaaggggacaaagtcaaaaggatctgcagccaaagccccattacctgttagttccattgattcatcagctatgtctataccagctgaaaagggcaaatcttcaaagcaagcgaaacaagaaaaggaaatacctccggctcctccaagtggtccatcctttggagattttgttccttggaagactgaccagacaaattttgcgcctgctccagcatggtccaatgactctgcgaaggtgcacaaacctttgtctttgagagatattcagagagaggaagaaaggagatcaggtgttgtccaagcaacaaccaccctcacctactccagcaaaggtttcggtgaaccaacggaatcatggtaatgcttcttctaagcaagcttctgggtcttctccatcaaaggcagttgcccctgtccagatgagttccaatccttccaatcgttccaagtcaaatgctgaagatgatctgttttggggcccatctgaccactccaaacaagataagaaacagtcagaattcccaagtctagcaagtcagagtaaaagttccatgacgaaagaccagtcttcagtaaaccgtcacaagtctcaggctagcaagttgccactttcaacggctcctagtgctaacctcattgggaaagggaaggcagaggcagcaaacaagcagacagaggcaatggacttccgggattggtgcgacagcgagtggtccaggctcactggaacaaatgatacaagtttccttgagttctgcattaagcagtcgactgctgaagcagaaatgcttctccgggagaacgttggctctcttgaccgcaacggtcagttcatcgacaggttcctcaactacaaggcttttctgtccacagatgtgatcgagatggcattcagagcgcccagcaaccgcgctccccgtctgaaccccgcttctgcagccaaaggagggccaagtgccgaggcagagcaggatacaggaggaaagaaaaaagggaagaaagggaagaaggtgagcgcagcggttttagggttcaatgtcgtcagcaaccgcatcatgatgggagagatccagaacgtggattagtaggtatgcatacaacggtggcaccgtgctgtacatacttttggcgctcttgatagattgttttgacttgttgcgatggcaaccgagcttatgcggtggtgattttcgtctcttttttcgagaaagtgcatccattgcccaattttggcttcctgtaactcaccagattttgttctcgatagaacttcactgcagatgaacatagatcaattttgttatttctggctgcgtgttgcaatgcatgatgtttctacgtcagtgctaaaaacagacacataaccttctcttgcaaaaaaaaaa

SEQ ID NO: 10301 - DNA, 478 bp, Triticum aestivum
  Clone ID: PAT_TA_10301
ccacgcgtccgtccaaattcgcctgccccgccccgacgctctaacttggcaggaaccctaaacccaccgagctcatctcgtccgcgccgccgcccggggaacccaccaagctcatctccccggcgacctccctccaccaccaggacctccccgaccccacgcaccgccgccggcgagggtgaccacgcgaagcagtcggcgcctacaccgtctgtctccggctgtgcagcccaacaagaccgccacagcccacagaaccccaggaggccgggtggcataaaccctaggaaactcgcggctctcccctctcacccgacagagcacgccgcgacccgtcgaccacgagaatgagcgcggagaccgatgcgacggcggccggcgggctcgcgggggagatggaggtcgaggcgtaccggcgtctcttccccctcgcgttcctcgagcgttacctccgcgagtccggccggtctgacgcccg

SEQ ID NO: 10302 - DNA, 1482 bp, Triticum aestivum
  Clone ID: PAT_TA_10302
cgtccgacgggaccgaaccgaggagaccacgcctcctccgtctctcccactcccacggcagcaatccagcgacgcccggcaagcaaccagcggccgaggcggcgggggcctcgggtcttcgggcagcccaccgcgccgcggcggcgatccaccggggtggcggggcggagatgtcggacgcgctgatcaacggcctcgccggcgccggcggcgggatcgtcgcccagctcctcacctaccccctccagaccgtgaacgcgcggcagcagacggagcgggacccctccaagccggcgttcaaggacggcgccgtccgccagttgtgcctggtggtgcagaacgaggggtgggagcgactctagggcggcctggcgccctcgctcgtcggcaccgcggcctctcagggtgtctactacttcttctaccaaatattccggagcagggcggaggcagcatcccttcggcgatccattagaggaattggggatggatccgtcgggatgttccaatcactcactgtcgctgcactttctggatgcgttaatgtacttctcacgaacccaatttgggttgttgtcacacgaatgcaaactcacagaaaggcaaacaaacagcaaggccctcaggatcagggtttgacatctgctcttgataaggctctacaacctgccccagtggaaaatgtccctcataaaactatcaatgttattcaggatctttacaaggaagctggagcgtttggcttctggaaaggggttattccagctcttattatggtcagcaatcccgcaattcagttcatgctgtatgagactcttcttaagaagctgaagaagagacgtgcctctaattttaaaggggctcaaggactgactgctattgaagtttttcttctcggagctgttgcaaaactgggtgcaactcttgttacatatcctcttctagttgtgaaggcaagacttcaggcgaagcagatgattgatgatgacaagaggcatcgctacaaaggcacatttgatgcaatcacaaaaatgatgcattatgaaggcttatcagggctttataaaggaatgggcacaaaaattgtacagagtgtttttgcttctgctctcctttttatgatcaaggaggagctggtgaaaggtgctcgattcttggtaaccggtgacaccagcctggtaaagaagttgccttcaaagccctcaagatgatctaggtctgcgcagaagtgttagttgctgattatatatcataaattgcaaacagagtaggcaaaaagagctcgcctctgaggtatcaggttacagatggtagacacaatgggtatgtaaacttgagattatacggtgaccactatgattcttgtaggtactgggataaactacacattggataggatatttaagccattcatgtaatgtaaaatatattcaggaacgttgaaacatcaaaaataagttggtagcgagaattgcaaaaaaa

SEQ ID NO: 10303 - DNA, 753 bp, Triticum aestivum
  unsure (1)..(753): unsure at all n locations
  Clone ID: PAT_TA_10303
ggggacacgcacccgctcgctcgcctcgcctcgcccccctcgtccgttccagttccacccagattcacaaacccgccactgcaactccttttcgcggcagcaaacaagatcgccggccggcgcggcgcggcgcancgatggacgcgggcgacctctccatcgtgcaccacatcggcctcgtgctgctcgcgctgtgggccgccgcctccttcggctgctgccactccgtcgtcttcctcatcgccttcctctacctatacatggtaaatgcccgctgcgcaatgagactgcggaaagcgaatacaacatgcggaaatgaaatctgcctaccaacaaagactgctttctgatggagaatcagtacgttggttaaatcatgcagtcaaaaagatgtggcctatctgtttggagaagattgtttcacaacttttaacggcccatcataccgtggttcttgggtaaattcaaaccttgggcagttagtaaagcaagtgtccaggagctttacatgggtagggattcaccaatatttacctcgatgagagttctgcctgagacatcagatgatgatcatttggttttggagctagggatgaacttcctatctgctgaagatatgagtgttgtgcttgccatgcagctgcataagagtgtgggacttggaatgaccgcaaacatgcatttgactaggatgcatgtcgaaggaaaggttttacttggtgtgaagtttgttcggagttggccatttcttgg

SEQ ID NO: 10304 - DNA, 879 bp, Triticum aestivum
  unsure (1)..(879): unsure at all n locations
  Clone ID: PAT_TA_10304
cntccgacccaaccagctcgtatccgcctccccttccctgctcccgtgcgtgtccagcaccacaggagaggtgctgctcgagccctcgatccagcgcgcagatgctcgagcgctcctcctcgtgacccgccgccccggcgaaccgtcaccgtcggcgaccacttccatcaggccggaccccgctcccctcgttgcttctccttctcccgttccctccgttttccctctctcacttactctctgtcatctccaggaaactgcaggaggcaagcaccatgccatggcatcccctgctcgacgaccgcgtcgccgtcgttgacttcgcgcccatccccgcctgattctgcagcgccgccgcccgtcttcttcgttcaaggcaagctctgctgctgtcctgctcgagctgccaagtccctgtcgcctcgccgctgtaccccgtcctcgacctcattcagcagcccccgccgcaagccgcgacctccacaacctcctcccgaatctgctccgcctcgcctctgccggattcggagcagcaccggaccaagcaggaccgtgcccttcctctccagctcccctctgttttcttcctagattaccggcaacgctctctctcangatctctcttctctctcgcttctctccaacagggaaccgaaccatggccaccggcgtccaagggtcgccgccgcaaggatttgctcgcctccgctgcctccggcgccanccctgtccccgggaggatgcaaccccgccgcttcaaatcctctgcntcgcccgtgggtcnagcnagagacataaagcagcgcgttgacgccgctcgcaaggccttttgctcgctggnaangccaacctgctcagctctatccggaatgcaaggcn

SEQ ID NO: 10305 - DNA, 2099 bp, Triticum aestivum
  Clone ID: PAT_TA_10305
cgtccgcggacgccgtgggttttacctcgaagcatccttctcgtccgcttttgtttcccctcgacggcggcggcggcggcggcaaccagggtttagaggaggagaagcttgctcggcgcaaaaccctagccccgcaccttcatctacggattcatcgcgcctctgcagcgcatccttgccgagtgccccgcctcgctgcatcggcggtcgcgatgagggtgaaggtgatatcgcgctcgaccgacgacttcacgcgcgagcgcagccaggacctgcagaaagtattccgcaattatgatccagcactccgtagtcaagagaaagctgttgagtacactcgagcccttaatgctgcaaagttagagaagatatttgccaggccatttattggagcaatggatggtcacattgatgctgtttcgtgcatggcgaagaactccaattatgtgaaagctatgttttctggctcgatggatggggatattcgactatgggacattgctgcaaggaagacagtctgccagttccctggacaccagggtgctgtgagaggtttggcaacatctaccgacggcgatcttctgatatcctgtggtgttgattgcactgttcgactctggaaagatcctatgcgtaagatgatggacactaatgatgctattggagatgcttcccagccgtcagcagtctatacatggaagcatgcattttggggggccggacaccagtgggatcgtaatgttttcgcaactgtgggtgctcaggtagatatatgggaccataacaggtcggagccaataaataccttcgaatggggtaaagatacagttctttctgtgcggtttaatcctggagaacctgatgttttacttacatcatctagtgatcggagtttaacactttttgacctgcgcatgtcatccccagctagaaagttaatcatgaagacaaggtgcaattcagtttgctggaaccctagggagcccatgaacttcactgctgcaaatgaagatacaaactgttattcttttgatgctagaaagctgaatgaagccaaggttgttcacaagggccatgtttcagcagtgatggatgttgattacaacccaacaggacgggaatttgttactggttcctacgatagaacggtacggatcttcaattataacggtgatcatagcagggagatataccatactaagaggatgcaaagggtgttttgtgtgaaatacacatatgatgggacctatctagtttctggcagtgatgatacaaatcttcgtctgtggaagtccaaagcttcagaacaattgggagttattcttccaagggaacgcaaaaagcaagaatatcatgatgctgtcaaggcgcggtatagtcaccttccagaaatcaggcggattgacaaacataagcacttgcccaagccgatctacaaggcaggcaagataaggcgcgccatgattgaagcagaaagccggaaagaagaaagaaggcgagcgcacagtgctccagggagcaggactatgcagcccttcagaaagagaaggctcatcacagaagttgagtagggtgggatctgaccatcgcgaggccaaacaaagtggcattacgttggagtattatttttggtcgagtgtgagtgatgggaagctgggaacatatttattatgtgtagtgtcatgttgttacttgcaaaccttggacaacgtaccggattacttttgagaaggaaataaagaggacttgttgtatgtgcgattcagcgatgataatttgagtgaaacctgaacggaacaaacgaggagattggaaagaatgctattttgaaactgatggatgccgtcgattcgtacatccctgatcctgtgagggtgcttgataagtctttcttgatgcccatcgaaggcattttctcaatccagggtcgtggcactgttgtgactggacgtattgaacagggggtaattaaaactggtgaggatgttgaggtcataggtttgacagagagtggtccggtgaagactacagttactggtgttgagatgctcaaaaagatgatggatcatggagaggctggtgacaatgttttttcttct

SEQ ID NO: 10306 - DNA, 667 bp, Triticum aestivum
  unsure (1)..(667): unsure at all n locations
  Clone ID: PAT_TA_10306
agaccccctccccccacctcacgactccaaaaccccccactcccctgcgaatcccccgccagnaaatcgcccgagccatggccgccgccgtccggagaaacgtcgcttcctcgcctgccggagccgcccgtcttcgccaagcctcgatggtgtagggagaggtgctggacggggcaggtaagtgggagagcgaatgggggcgattggaggcaacgagtccgtgcagtgggacaagatgaatggggcggaggtggtgaatggcggtgggagtggcgcaggaagcctggataggatacaggtgttagtgagggtgaggccgctgagtgacaaggagattgcaaggggtgagcctgccgagtgggagtgcatcaatgacaccaccatcatgttccggagtaccttcccggatcgacccacggctccaaccgcatacacatttgacagggtatttcattctgagtgcagtacgaaagaagtctaccaggaaggggtcaaggaagttgccctctctgtagttggtggcattaactcaagtgtttttgcgtacgggcaaacaagtagtggaaagacatacactatgactggagtgacagaatgcacagtagcagatatatatgattatattaacaagcatgaggagagagcattcgtgttgaagttctcagca

SEQ ID NO: 10307 - DNA, 569 bp, Triticum aestivum
  Clone ID: PAT_TA_10307
ctagtagtagaatcataccaacctcatctcgtaaccacgccctgcatctgtgatcgatctatggcatccgtggctcggaccaccgtgctgctcctcctcctggtcgccgtcgtcattctcgtgcccactgcatcggcggccggcaggatgctggccaatcaggtggccggtgccggggaacggggcgaagccaccaacgcggcccgcatccttgttgatgcggacgtccgcgccagtgccgacatcctcggcatccgcactgagagtgccgtccatgccaaaggcggcggcaaggctgatagccgcagcaacatcaacaccgtcgacgcagggcagcctcggcgtccacacccaaatccgcggaaaagccgacagccgtggcttccgcgggccatttaacccatgaacctcatcagctagctaatctgtttcccaaagggaggtgcatgcattttgtgttggtcgttgttcgttcgtgcatggatttgtggaaggttcgtacgttctggatgtgttggaaatatttattcaactagatattccccacgcgttgcggcgggacctctgct

SEQ ID NO: 10308 - DNA, 1173 bp, Triticum aestivum
  Clone ID: PAT_TA_10308
cccaaatctacccccagaagttgtcgtattgcattgcccatcttgttgagaaggcctaccaacagcacactgagccactcgaagcaccccgcgaatggccggaccgcataaattcccagaaggaggtgctgtttgtgggggagcccgaggaagtgctggaggccacacagcctgctgagttccagcggtgcatggtgccgctgtttaagcagatagggcgctgccttaacagtgcccatttccaggttgctgagcgggctttgttcttatggaacaatgatcacattgtaagcctgattgctccaaaaccgcggtgtcatatttcccataatatttgaagcacttgagaggaacttacagagccactggaatcaagctgttcatggcctgaccgcaaatgtgcgcaagatgtttttggacatggatagtgatctatttgatgagtgccaccagcagtacattgagaaagaagaaaaagccaaagaattagaggagcaacgggaatcggcatggagacaattggaagctgttgctgccaaggcttctggggatgacatggttttggtcaaataggtaatatattcatcccgctttcatttctccgttagtggttgcgtcactaagctaccgcgcttgttttagacttgtaagttaatcctgtatcactgctcgttatgtatgctctccgttatgcttttcccttttgtttttaagcatttctatgagatgcattaccaccttttgtactgctgagtctttgtttttaatttggtcatggcagtccgcaaaaagatggaatatgtttgtgtatcggacttgcggccgtttatggacaccattgacattagtaattctgcgacgcccttatcgtctctgtcatcattccgactccttgatcgaccctgtttcggaagccgttgatgcttgcccccgttgtctgcccgcgcccgggctcgcacgagtcgacgcccagccatcgagctaccaccactctcggccccggggccggggcgggtgctcgcgctgctgcgctcctcctacctttgttgcctgggctgggactttccaggtcagcgtgccgtgggtgtaacctcccggtcggcgcttggtcgaaaccccgtggtggtagcagtggccaattcttcctatctatgcgcaacgaggtcctgcgat

SEQ ID NO: 10309 - DNA, 856 bp, Triticum aestivum
  unsure (1)..(856): unsure at all n locations
  Clone ID: PAT_TA_10309
gctggtacnactgtttctccgtcttagaagcatacatacacacacacacacaccaagatgttcggcggcgggctcgtcagcgccggcggccgcgcccggaccggggcccggctcaagggctcggtggtcctgacccgcaagaacgcgctcgacttcaacgacctgggcgccaccgtcatggacagcgtcaccgagttcctcggccgcggcgtcacctgccagctcatcagctccaccatcgtcgactccaacaacgggaaccggcgggaanggtgggcgcggaggcgagcctggagcggtgggatcacgagcctgccgttcatcaccgtgggcgactccaagttcagcgtcaccttcgactgggcggtggacaagctgggcgtgccgggcgccatcatcgtcaagaacaaccacgcctcctgagttcttcctcaagaccatcaccctcgccaacgtccccggcctcggccccgtcgtcttcgtcgccacctccgggctgcccccacaggcctccgaccgccccggccgcttngcacgacacgtacctgccaacaagatccggggcggccttaaccttacgnganacagcttcgaactgggggggacgacagagggccgnccaggngcacnncncnttaccgtnttacattacacgactngggaaccgccanatcttggggtcaaggagttcctaccttgcgtgngacggcgaagtttanaacacccntgagacgttttcgtgggnaaacnantncgggaaagnttngcnttaananngattntggnctttaggntggggggantnngcntcnntannnttnccggngnnnttttnnatntanttnnggggnanncn

SEQ ID NO: 10310 - DNA, 437 bp, Triticum aestivum
  unsure (1)..(437): unsure at all n locations
  Clone ID: PAT_TA_10310
ccacccccgagaacccacccgccgccgtctgtctcctccctcgtcttcatctcctcgccgccactgctgccacctcctccctgtccccggcctccttccgcgacgcccccatcgatcctgatcccctctcctcctccctcgtcctcatctcctcgcccccaccgctcccacccaccgaaccgatcccaatcccttccagatcgagagagagtgagagctcacctcctcccttccagatcaccgccgccacctccctccggtggagctcgccgttgtccatggcctgcccctggcccgaggtccttcgctcctccagacccggcctcctcctcggtcctgcccgacgcgttcgaccggggctcngacgcctacgcccgcaacgccgccaccnncgggggcctcctctccgacctgcgctcntacgtctnctagggann

SEQ ID NO: 10311 - DNA, 942 bp, Triticum aestivum
  Clone ID: PAT_TA_10311
cccttcgtgctcttgccgcacccgacgcgcagcccccctcctggtcagcgaggggcggcatccatcccttgggtggcaggcaggtcgggcacctaggtcgtcgtactgctcagcccgagacgccacttatacaggcggctccccgcgggcgagaactggcatggggtccacaattcgttcagtttcctcccctcaccctataccttgcagtggatcaacatcgtatcgcaaggagcggctaccagctaggaaaggcgacaaacacgctctaggtcaaattaataaagccccaggtaatcgtgggacggccgttccgtgtggtggccgccttagtgttgtggtaacggattcaggagcacttcttgcatttgggtggggactgtacgggcagtgtggacaggggaatacagatgatgtgttgagcccaacatgtgtatcagctattctgggagtcaagatgcaagatgttgccgcagggttatggcatacagtatccatatctgcagatggtgatgtctattcgtttggtggctccctgtgcgcgctgctgggggctgcttctgatcaagctgagactataccaaaactggtagatgcccccagcttggaaaataagaatgcaagatcagtgtcttgtggagctcgtcatagtgcaataataacagatgagggcgaagtcttctgctggggatggaacaagtacggccaggtaggtatctctttgctttactactacgatttttcacaggtgaggtggggaaaaaaccttggtgtgatatgatctctgatctgagctttggagttgcgcgtgcgtgcagttgggcctcggcgattccatggacagaaacgtgccctgcatcgtacccgtggacgagtaccacccgctgaacgtgtcgtgcggctggtggcacaccttagtgctcgcggagtccccgacgtgat

SEQ ID NO: 10312 - DNA, 737 bp, Triticum aestivum
  unsure (1)..(737): unsure at all n locations
  Clone ID: PAT_TA_10312
aacgggtcctacgcctacctnaacatggttcctcaccctgatgggtccaacagggtcttcctgggcacccaagccgggaagatagtgctggcaaccgtcccggatcaggggtccggcggcacgctgcagttcagcgaggcgggcctgtttgtcgacctgactgaccaggtgcatttcgactcgacgttcgggctcatgggcatggcgtttcaccccgacttcgcgaccaacgggcgcttcttcgcatcctacaactgtgacaggacaaagtcacccagctgttctggtaggtgttcctgcaattctgatgtgggctgtgacccctccaagcttggcaccgataacggcgcccaaccatgccagtatcaggtcgttgtgtcaagaatattctgctaaaggctccgtccgtcaaatgtttctgaggttacatctgccgatccaactgaagtcaaaaggatttttactatggggttgccttacacaaataaccatggaggtcagattcttttgggacctacggatggatacctctatctcatgatgggtgacggtgncagaagaatcctttaattttgccccaaaacaaaancccttctggggaaattatgagctttacatcnaaataccccngacaatacgaaaggttnnttatccccaaagcccgaactaggaggctatatagaggncatggggnacaccacggggcactgganggaaaacacaccaagtcgtaaatt

SEQ ID NO: 10313 - DNA, 1012 bp, Triticum aestivum
  Clone ID: PAT_TA_10313
ctcttctctttccttcagcagccgtcttgttcgtcccatccgatctctgcccacaacaacccgaagacgccgacgaggtagccatgggcgacagccagtactccttctccctcaccaccttcagcccatcggggaagctggtgcagatcgaacatgcgctcacagcggtcggatcaggccaaacctcccttggcatcaaagctgccaatggtgtagttatcgccaccgagaagaaactgccttctattttagtggacgaaacatctgtgcaaaagattcagtcgttaactccaaaatcggagttgtctacagtgggatgggtccagattttcgtgttcttggcagaaaaagtcggaagcaggcacagcagtattatctggttgtacaaggaaaccattcctggtacccagcttgtccgagagactgctgctgttatgcaggagttcactcaatctggtggcgtaagaccatttggtgtatcactgttgattgctggttatgatgacaatggcccgcagttgtatcaggttgacccatcagggtcttacttctcctggaaagcatcagctatgggaaaaaatgtgtcaaatgcaaagacttttcttgagaaaagatacacagaagatatggagcttgatgatgccatccacactgcaattttgactctgaaagaaggatatgaaggtcaaatctctgccaacaacattgaaattggagttattcgagctgaccgtgaattcaaagttctaactccagcggagatcaaggatttcttggaagaggtggagtaagctgccggttgacaacttactgtccaacatgaaacgtttccgagcaagtctccatggagcttgtctgatttgctccagtaacttgcatttgagtccttgtgaatgcacattgtagacattgaagatataacctaatgttaggtttatgttttgtttggctctggtctatatgattatcagtttgcaaaatgaagcactaacgaaaactataattgcaaaaa

SEQ ID NO: 10314 - DNA, 1233 bp, Triticum aestivum
  unsure (1)..(1233): unsure at all n locations
  Clone ID: PAT_TA_10314
ccggtcgccgcggtgccccatccgtcggcatcctcgtcccttccctccactcggtcccccccaaccccgaactacgccccgccggcctcgatggctcgggtcccaagccactaccctccctccccccctccgtccctcctgtctagcagccgccgcgcactctcgctccatccgctctcctaccgcggcccgactcagccgacaaggtagtcccgcgcgtccgccatgggcgacagccagtactccttctccctcaccaccttcagcccgtcggggaagctggtgcagatcgaagcaagcgctcacggccgtcggatcgggccaaacctcgcttggcatcaaagctgccaatggtgtagttatcgccaccgagaagaaattgccttctattttagtggacgaaacatcctgtgcaaaagattcagtcactgactccaaatattggagttgtctacagtgggatgggtccagatttccgcgttcttgtcagaaaaagtcggaagcagggcacagcagtattatcggttgtacaaggaaaactgttcccggttgacccagcttgtccgaggagactgctgctgttatgcaggagttcacacaatctggtggtgtaagaccatttggtgtatcactgttgattgctgggtatgatgacaatggtccgcagttgtatcaggttgacccatcaggatcttacttctcctggaaagcatcagcgatggggaaaaatgtgtcaaatgcaaagacatttcttgagaaaagatacaccgaagatatggagcttgatgatgccattcatactgcaattttgactctgaaagaaggatatgaaggtcaaatctctgccaacaacattgaaattggagttatccgggctgaccgtgaattcaaagttttaactccatcagagatcaaggatttcttggaagaggtggagtaagttgcccgtggacagtttactgtctcgaacaagaaaagtttccggtccatgaagcttgtctcatgtttttaattggtcacttaaacatattgtaaactgattcgctccagtgacaccggaagaacttacatttgaagccttgtggatggcattgtggacatggaagataacctaatgttaggtgtatgttttgtttggccaatctctggatttgcttggtcattttaatctggtccctcatgattatcagcttggaaaaaagcanaaagaaactatcgtggggaacttaccag

SEQ ID NO: 10315 - DNA, 976 bp, Triticum aestivum
  Clone ID: PAT_TA_10315
gtcgagctgaaatgctaatgtctcggttcaaaattagaggtacacatgcgggggctcgacgagcggcgctcttggggcggagggggacctgacggcgcggcgattctagggcggaggagctcgccaggaccatttagatcagggccgattaggccggaggggggtgctgcatagatcatgcgtgtgtggttgatttgattcgtttcagataaggaatccacagccagcgcagcaatccaccgcggcagggggtgtgatatggggtttcacagctgcaggaatgtagtgttcattttcagagcaccaacaagaatgttctccagactgagggaggtgcttcaattcaacacagattagtgtttctttgttcattttcagagcagcaacaagaatagttgttctccagactgggattggtgcttcatttgcggcacatactagtgtttcttagttaatgttcagaacagcaacaagaatgttgttctccagactaggagtggagcttctcgggttgtcagagcatcgccggagcatctccggtgctgcgacggagcatcgtcgggccgccaaaacattatcagtgctgcagtggagcttctcaggttgtcagagcatcgccggagcatctcaggtgctgcgacggagcatcgtcgagccgccgaaacatcatcagtgctgcagtggagcttctcgggttgtcagagcattgccggtgctgcgatggagcatcgttgagccgctgaaacatcatcggtgctgccgtggagcttctcggggttgtcagagcattgccggtgccgcgacagagcatcgtcgagccgctgacgctatggaggagcatcgcctgagctgtcggggcatcacgagcagagcaatggagcatcaccagttccttaaggaattacgcccgtggtgttgggacagtagtgatgttgtgttggggctggaaatgctgcaaagagacatgggggcacgg

SEQ ID NO: 10316 - DNA, 813 bp, Triticum aestivum
  unsure (1)..(813): unsure at all n locations
  Clone ID: PAT_TA_10316
cggcgcgcgggcctcgggcaccgcctccgcgcccgcctccccgggctcgccgcgtaccacctggcgcgggcgctgccgcagggagggcgacccggtccgcccgcggggcggggcgcgccgggtggcggcgcggcccgggccgagggccccggggacgaccggcccctgcccgccccgcccggcgtggccggacgtgtacggagtctgatggtgccggcggacaccaaggcgctgcggcggctgatggacatctgcgcgcacggcccgcccaagtacctccccgagtgcctcgcccgcgacctcctccgggccgggcaggttaaccagggagtggggaggagcgagctgatcaaggggatcgcctccgggcccggcttccagatcactccgctcccccaggaggtgcggatcgggtggggcgagttcgaccagatcttcccggtggccaaggcgcacaaggtgatcgagaagctcggggagaaggcgacggtgaggatcatccccgacacgggccacctgccgcagcaggaggactccaagctcttcaaccagatcctcctcgacttcctgctgcctccgccttcctcctccaatggcgccgccgccgccaagtagctagctagataggccgtcgcttggttgatatggtgcaggttttgagagagaatcaacccggtcggcttgggtgtgggtggtgtaatataagtggcagcagtgggcgtgcaaggaagaagatgttgttttgtttcatgcaagcatcgtgttcttctggttcatatacgatgattgatacgagacnctacgtttgtttta

SEQ ID NO: 10317 - DNA, 1267 bp, Triticum aestivum
  unsure (1)..(1267): unsure at all n locations
  Clone ID: PAT_TA_10317
gtagtaaccaaacacatacccaagcacagaaataacagaatggctgcgtccgacgagacgccgatggtgcaagacctggcgtcgaccggtgtcgaggagccgccgagccggtacttagtgcacgagcaagaccgtcacggtgacctgctggccgccggcgaaatgccggagcccatccctctcattgaccttagccggctcatggacgccgatgaggccgacaagctccgggctgctctacagacatggggcttcttcctggccaccaatcatgggatcgaggattctctcatggatgcaatgatgagcgcgtcaagggagttcttccgtcaaccgtccgaagagaagcagaaatgcagcaacctggtggacggcaacggcaagcactaccaggtggaagggtatggcagtgacaaagtggtttctgaggatcatggcctgaactggaacgaccggttgcatctgagagtggagccagaagatgagaggaatttcgctaagtggcccagtcaaccggaatctttcagggatgtgctacatgagtacgcatcanaaaccaagaaattaagagaccttgtcttgcgatcaatagccaagctcctggacattgatgaggattacttcgttaaccagatatcaaacaaggcctccgggtttgctagtttgtactactaccctccatgtccgaaggcctgacctagttttggggcctcaggccctcactccgatggaagtctccttaccatccttttcaacgatgacaacgtcggtggcttgcaaattcaaagagatgggagatggtacaatgttccgaccaagcctcacacattgttgattaacctagcagnctgcctagaaataatgaacaatggaatctttaggagcccatttcataaagtggtgacgaacgtcgagaaggataggctttccctggctgtgttttacgccgtggatgcggaaacgatgttggagccagcgcccggtttgctggatgacaagcgaccatcaagatcgcatggattgtgggaggcatctgcgcagtcaaagtcgccttcatataaaaacatcgccagcagcctccaactgtctggagtagcttgatgtaggaggggggctacagaatgtcaaagaggaagtatcaagatattgtgagtatgttgtaaaccatacatattgagatgtccatataaggacacatacagtttggactgaggaatgactttggcgcgaggtacattgcctttccttggtgaggccttcgtggtag

SEQ ID NO: 10318 - DNA, 1365 bp, Triticum aestivum
  Clone ID: PAT_TA_10318
ctggtggcagataccacacgcgcccaaactcttacccaagcacagaaatggctgcgtccgacgagtcgccgatggtgcggccgacggtgcaggagctgacggcggccggcgtcgaggagccgccgcggcagtacgtgttgccggagcaagaccgtcacggcgacctgctggcagccgacgagtttccggagcccacccccctcatcgatcttagccggctcacggacgccgacgaggccgagaggctccgggcggctctgcagacctggggcttcttcctggccaccaaccatgggatcgaggactctctcatggacgccatgatgagcgtgtcgagggagttcttccggcagccggcggaggagaagcagaaatgcagcaacctggtggacggcaacggcaaggactaccaggtggaagggtatggcagtgacaaggtggtgtccgaggatcaggtcctcaactggagcgaccggttgcatctgagagtggagccggaagatgagaggaatttcgccaagtggcccagtcacccggaatctttcagacatcagggacgtgctacaagagtacgcatcaaagaaccaagaaaataagagacctcgtctttgcgatcgatagccgagctcctggagattgacgaggactacttcgtcaaccagatatcaaacaaggctcccgggtttgctagattcaactactaccctccatgcccaagggcctgacctagttttgggcctcaggcctcactccgacggtggtctccttaccatccttttcaacgatgacaccgtcggtggcttgcaaattcagagagatgggagatggtacaatgttccagccaagcctcacacattgctgattaacctagcagactgcctagaaataatgaacaatggaatctttacgagcccagttcacagagtggtgacgaacgtcgagaaggataggctttccttggctgtgttttacgccgtggatgcagaaacgatgttggagccagcgcccggtttgctggatgacaagcgaccgccaagatataggaaaatgttggccaaggatttcgtggctgggctctttgaacatttccgtcaagggaagagattcatcaacaccctgaaaatataggttcatcgtttattatggagctgtagcagtgattgcctatgaagaataaagagatggttttatttgttgtgtgagtgggggttttgtctagcatctcctttcttataagcgacacagttcagttaacccatgtaatgcactccgtaatgtcaaataaaaatggtgcactcgcatattcgggagttattgatgacatataaacactcacaacttcaggtaaaaaaaaaaaaaaaaaaa

SEQ ID NO: 10319 - DNA, 863 bp, Triticum aestivum
  Clone ID: PAT_TA_10319
ggcttccataaaacacacacaatggtaggcacaaagctagtagccctcggctatgttgtcctcttgagcattggactggccaatgctgcaagggtggttagattcggcagtggaagcgccacgggaacgggagcgggaggaggagagggtgggggaactgtgagtggtggtggctcgggtgctgggagtggaactgggtctagcgtgagttctagtagtggtagccatgcaagcggtggaggtggaggtggaggtggcggcggaggcggtggccaaaatgggggaactggatatggtagcgggtccggctctggctctggttccagtcaatatagtcaaggatcttcatatccttatggtggtggctatggtggatatactagcgctggcggtgccggtggtggcggtggtggagggaaagctagtggttatcaaggatctagtggatatggggctggtagtggcactggttctggctcagctacagctactaacaattggtatagacaaggtagtacaaatgcagatgctggtggaaacggtggtggcaatggcggaggaagaaatggtgggagtggtgcaggcaaaggtgctggatctgggtatggcaatgccaacccctagtccccttcatgtgaggaatctaaaaaaatggagcccaacctactgtactgtgtcaaattgatagctttgactcttttttcatttatttgttatcatcttacatattatcaaataagggcttcattgttctagtggaaaatgtactagtgttcgtgatatattacaagaatgttacatcgcaatgtatcactattaagttatatacaatcgttttggccaattgactcgcaaaaaaaaaa

SEQ ID NO: 10320 - DNA, 659 bp, Triticum aestivum
  unsure (1)..(659): unsure at all n locations
  Clone ID: PAT_TA_10320
ggttnagcgctactctctcccaggatatgcgtcaaactgctaagaaatttatgaatccaaactctctcattgaagttactgttgatagtgattctaagcttactctccatggtcttcaacagtactatattgttctcaaggaagaagaaaagaataataagttgttaagctggttggatgctttggaatttaaccaagtcgttatctttgttagaactaagaatagagccgaaaaactcaaggatatcttggaaaagaatggattcccatgtttgacaatgcactctgacatgtcccaagatgagagactaaagcagtatcaatcattcaagaatttcgaaaagagaattatgattagtactgatttgctaggacgtggtattgatatccaacgtgttaacattgtattcaattatgatatgccagatgaacctgactcttacttgcacagagttggtagagctggtagatttggtacaaagggattggccatctctttcatttcttctgatatgccatcgaagattggaaattatgaaagaaatatcactgatcaagaagtattggacaatatccaaaagcgttttgaagttaagatcaaggaaatgccaacccaaatcgatgttggtacttatatnacatcataaattattcgaaaa

SEQ ID NO: 10321 - DNA, 662 bp, Triticum aestivum
  Clone ID: PAT_TA_10321
ggcagggcaggagcctgcagaccagcctgtggatactgcccagcccggccgccttcggcaccgcgacgccattggcgaccaccaagagcaggaactactcagccggcgacgtggcggactacctcgtcgccatcgggtttggcgaggccgtcgggccgtacgagtcccgcgtgctgccgctgttcggcggggagctgccgcatcccggggtgccggtgacctccgtcatcggggtcggggtggggacgccggaaaggatagactacccccgggatgacttcgacgcaacgccgtccgtggtcgccggggatggcgacggggtggtgaacctggcgagcctcgtggcggtgcagacgccgtggagccgccatggcggggattttacgctggtcaaggtgtccaacatgtcgcataatgaccttctggtggatgatcgagcgctcgacatcatcgtccgagagattcaacgggctgattagttattacctcattcacctggacagccgttggatcaaaagcttgctgagattcgtgttgttgtgtcgttgtccagttgcttgtttgtccgatgattgaccgtgcagccctctcgttaatgggcctttttctttttctattggttgccgtcagctgttttatagtagggttatcatgtttggttt

SEQ ID NO: 10322 - DNA, 669 bp, Triticum aestivum
  Clone ID: PAT_TA_10322
gcggcagcagctagtagcaaagcagctggagtccccggacttccgccggtcaaccatcgacggccaaactagcgccccaaccctcctcatcaccgtcgtggttgacagcgctttccgtgccaggagcgtcgtccaatggcatggcctctgccaggggcctccgactggcacgttgccggcgggctgtatcgacgacgtgacgtcaacgtactactactatgtggctgatcgtgcgtgctctgaacgagactgcactggaaagttcaccggagtgcaaggaggcgaggctggacggactgccggcggttgcgtgcgccatgaaacaaacaatcatgtacatccttctgggcaggggccatatgcgtgccccgaagcgcaactcatggcaaactgtcctgtcattcgcctcaatgaagatagtgcggtcgagcggctcctccggtggtccgccgtgacattggaggccgcaggctgctgggttgctggtatatgcgggggtagggaccatgttctctatgcgtgccctgaatcgcaactcatggcagatggcttcggtggctaggcacagcgcgggtttcaccgtgtaatcgaaatgtttggaataatacttactttctctcttctatgaggagcatataatcgaaatgtttggaaaagctaaaaaaaaaa

SEQ ID NO: 10323 - DNA, 709 bp, Triticum aestivum
  Clone ID: PAT_TA_10323
atccaccgcggtgccgccccacgcgcccgctcccctcccccctcgccgccaacccccgcagccaccgcaagcccgcaaccgccctcctcctccatcctctcgcgctcccctcccacatctcatccacccctcttcatctcggaccggatctgagacgtgtgggcgcggaggcgagcttctccggcggcggcgacctgcaggcaaagggcgacggcagcggcgctggatttgatgcagcgccatggatcgccccctgctgagagatgaggatgctggactgccatcattcctccttcactgtgcggtgcctcctgcgagtgtcacctcgtcccaccggcttccagcgccgtggatccgccgggatggagggcaacaagtgagagggagcaggagaagaggtgaatcgagggagtgaaaggagctcacacgggaaggggcgcctcctcccatgacggcacgatcagcggctcttgctcgaccccatgatacacaacacagtggtaggctcgactccctttctcccctctcccaatttctaaatcgttagatcgattcatcttgatcttagacgttagttagtgattttgttctctcctttccatctaatgaaggattccttcttctaagattagttagtaacttaagcaccaaatatgaatttattaggacaaagaaaagagcatatggcaaaattctctgaaaaaaaaaa

SEQ ID NO: 10324 - DNA, 546 bp, Triticum aestivum
  unsure (1)..(546): unsure at all n locations
  Clone ID: PAT_TA_10324
attcggcacgagggagatggtggacctgcgcacgctgctgctcaactgcgcccaggcgctgtccacagacaaccggcggaccgcaagtgagctgctgaaaagaatcaggcagcattcgaccccaaagggtgatgcggcgcaaaggctggcgcattattttgccgaggcgctggatgcacggctggcgggtagggggagcgagctgtaccagtcgctcatggcaaggcgtacctcggttgcagactttctcaaggccaaccagctttacatggcagcttgctgctgcaagaaggtggccttcatctttgccaacaagaccatctgcaatgctgtggtagggaagagccggttgcacattgtggactatggtctgaagtcaaggactgcagtggccgggcctgttacctatgcttgcagctagagaaggtggaccaccagaggtgaangatcaccggcattgacctccctcaacctgggttccaaggagcctaccacattgaggagacggggcgcaggctcagcaacttcgcccgcgtgttcggtgtg

SEQ ID NO: 10325 - DNA, 1420 bp, Triticum aestivum
  unsure (1)..(1420): unsure at all n locations
  Clone ID: PAT_TA_10325
cggttcagggagcaggagctgcaggccatgaaggagctgttcgaggagctgccggacaatatatcgatgtccatagcagcatctgtcaaaaacattattgaggccccggcgcgggccttgatggaggagagggcggctggcttcaaattaggtttgttctcccggcggttcgatggcctgtgggactccatgcgtcagctaacctcgacagaattgaaattcctagcgatttccatgtttacttgtgatgagtcctttgtacgctgctgctccacattgaagtccatctcagcagttatcgacaggcttggtgattgggtgccagaattgacaggggtaataagacagactaagaaagatgaagctatcctcataagggatgtggatgtggtaatgagacagaataaggaagatgaagatgtcctcacaagggatggggatgtggtaatgaggcagaataaggaagatgaagatgtcctctcaagggatgaggaggaggaggaggaggaggatttggatgtgcgtacatatgaggtggagaagaaggctgaggagtattatttcgctgcttatcgtagatactgggaacgtagacatggcaatggttgcaactttgaagacccaacggtgttcacccccatgcaggccacccgctccttgcctgccttccccggcctacccaccaatgatgctaaattattgaggaccatgcagatctactccattaaagtggcagaaacaaaaggtatccccctcgagtggccctgaatgtataatggtgtggttgctgcccgagatgttgtggaccatcgtcgcaaccatctcttccttcgcactagggatgattgccaaatccttacggaagagaatccttttttgcacttgactggcccgtctcgtgcaattatgtctgggtgacactgttatgattgaagtccaactacaactaaagggcagagtgcagtctgaagatgcagtattgatcggtaaagccttcacttatgatgatgatgatcatgacgatcatgggtgatagtcacctcccaagggcctttgcacaatttcaatgaagggctgggagaaccaagtgggaatgtcctcctcaanaccccaatccnaacaacgtaanccaaggacttgtnaccttgggcaattgtttaatgggagataacggttgcttgnccctcccttggttgaaaaccaacaccttacaagcngagaggtctataaaccttatggaacaanttantacagtagcctcaagaaacttgttaaaacctgtgaattgggtaanagtcttggaattnccatgcancgatgcnnggaaaccagtcaccgaattgcggaattancgncaaacagtcangggcttcgaatatcgaaaacagtcacggntncgaattcgncaagggccgncatn

SEQ ID NO: 10326 - DNA, 494 bp, Triticum aestivum
  Clone ID: PAT_TA_10326
acgctcagcacgttaaaggaaaaaaataccaccttatgcatattggtgcttgacgacacgcggcagcatcagcagcagcagaggaagattatggtgcaagatcagaagtcccagttccagatgttcgccgatgttcagagaattcatcgtgccgtggagcaggcgtccaggctgaaccaggccgtgtcgtcggtgatgggtggcgcatccaccagggcgaccgtgtcgttcggcggccactacagcgggttctgacgtgccagaagcttctagaatccgtcgacgcatccatgacatcctagtgttaggcatattgatattgagattctttatttacattggtcagggccccgtagcccgtagcccggctgtgtgcatgtgcttatgcgcggctggcttgcaccccgcctctcctccccgcgcatgtacattgcctacctgcgggtgtgatttgttcccgcgaaagtacttcatccactaaaaaaaaaaaaaaa

SEQ ID NO: 10327 - DNA, 1249 bp, Triticum aestivum
  unsure (1)..(1249): unsure at all n locations
  Clone ID: PAT_TA_10327
ccggctccgccgtggcgccggcggactgctccaagcttgtcttcctaggcttcgagctgcacaggttcagggctgccgcgctgtctgtcctgggtgcagcggctgagggacttggtgcttcggccattggtcgcgcgaccggcgacgtcgcggcggctcgtggtggcgtccccgcgcatgcacagctagtggctcctgctggaggcgtgcttatgaatgctgccgctgctgactgctgcaatttattcatcatagtgttcgagcttgacagcttcaaaggatccacgcttgcggtaatgggagcaactacggaggaacaaggtgaatgggctattgttggtgggactggtcagttcgctatggcgcgtggtgtcatccagaggaaaatgcatcaaaaattagctgatggacaaggagatgtgttagagcttactatcgaggcattctgccgcaggaaggggcagccggagcctccggccaccactccgcagactcctaccacccagccgattcagcctcctgttcagccgcctcctgccaccacccagcccattcagcctcctgttcagccacctcctgcccccacgaagccgattcagcctcctacccccactcccataaagaatggaccatggggcggaacaacgagtgacaaacttcatcatttcaacccaaacatgtctacaggcctaaagagtgtgacattcatctattatcgggctgttaatggacttcgtttcaattataccggcgccgtcggctctgttggctcctgcgcgctcgtcggttctgccggccatggccccgacgctaaaaggcaaacagttcacctaggccctagggagtttgtgacggagctgtcaggaacacaccaacatgaaagaagatcaaataatattgctatatattcccttaagctggtcaccaacctcggcaaaactcatggacctttcggaagtgccaacataggcgccgctttcaggttttccgtgcctccaaacagcaaaattgtgggcttctttgggggatctaccggttacgccgtgaattcaattggtgcctacacgctcgaaaattctgcttagcaaagcatgattacttgatgcagctgcaattttcggttgtagccatatcacggttagggtttaacctaagccagcgttgctttatttgttttattttacacaaataataaagattgtaaggatctacctaccctatnattcacaagcaatttaggttcttctac

SEQ ID NO: 10328 - DNA, 652 bp, Triticum aestivum
  Clone ID: PAT_TA_10328
aagattagagaatgaactgaaattgccggagtcagcctcctgcactagtcatgctgaagttttaagagagaaggatgcacagatcaaaaagctggaaaaacagcttagggaattgatagaagaaaaggatactgttcagtctcaacttaactgtttaatgaaaagtgacgctgacgaccatgccaatgaccgcactgcaaagcgatgggatgtccatagtcggtcctcattaaacagcttagggaattgatagaagaaaaggatactgttcagtctcaacttaactgtttaatgaaaagtgacgctgacgaccatgcccaaagagggtattgtcggttgtggagacaattttgtcggtcctcagagtcttttgcgcgaaatgcatccgaggaagcactttcggtttcagacacttatggaggttcttatcaagatcaaggtcacgcagtgtttgatgaatcatatgtcttcagtgctgatcatgatgacttgtcagttcccaatcaaacaatggatcttcctcaacaaacaagggttcggaagccaatttcaccttggcaccctcctagtaactattgctctgtgccatcagagccggacgccatgtaggaagtatctttcagaagtgcatctgaagtttctgaagttcatt

SEQ ID NO: 10329 - DNA, 915 bp, Triticum aestivum
  unsure (1)..(915): unsure at all n locations
  Clone ID: PAT_TA_10329
agctccctctctctctatctccccctctccctctccctctctctctctccatctccaggtgcttgcccccctgactctgtttcctctgtccccgttttatgcgtctcctctggactgcctgcttgcttggtctgataatattgatagacctcctttatctggtggagatatatatggatattgaattccatttgcttgaaactattacaaacaaatttgcagataaggttggcagtggtgggtatggtgaagtttacaaggggttgtataatggaaaggagattgcggtgaagaggcttcatcccttgcaaggacttgatgataaggcatttgacagtgaattccgtaaccttagtaaggtcaaacataaaaatgttgttcagttactaggctactgctaccaaatagttaaaaagttcgttccatacaatggagaactagttatggctatggaaatggagagaattctctgtttcgaatatatggagggtggaagcctcgataaacatattggagatgaatcttgtggacttgactggcaatcatgttaccaaattatcaaagggacctgcgacggtttaaatcacctccatggagcacatgaaaagcctattttccaatcctgggacttaaaaccatccaacatattgctgggtaagaacagcaaggacggccaaaattgcagatcttgggttgtccaanactngttgcctcaactgaaaccataaaacacagatggcaacgtccaanggacaatngggtacatgcacaagaatcatanacgnggtactntcaagaatatgacttttaatcngggaatntaatctgnaaatatncaggaacaaggcaccccntnntataaatgcccnganatnacaagcntntttaagaatggaagaaggtcaggaaaccgng

SEQ ID NO: 10330 - DNA, 701 bp, Triticum aestivum
  Clone ID: PAT_TA_10330
ggttttttttattttacttattccgtgggtcggaagcggggcatgtcccctccttttggctccaaggcccggtcttaccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgacatgttgttgcccatcgaagacatccaagattttgaattatgctttctccaagagtataaggataacaaggtgctgccgcctcaagtccgccaagagggagtgcttcatgctcgctgcaggcatcttctaccaccaggtcctccttctccctatgtgaagccacatatggacaatgagctcttatttatcatctgccaagctggttcacaatcatttatctataaaacaagtctcatggatctgagtccagatctgagttcaatgttaggaatagcgactcctctcaagccacattacattgtacatggagatgatcgtggtccgaggcatttttttctccttgactcaaaactacatgctgtctcattcctaaaagatggcatggatgtgcttaacctggacaccagatgtgagcatttagatttgcaagca

SEQ ID NO: 10331 - DNA, 743 bp, Triticum aestivum
  Clone ID: PAT_TA_10331
aacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtggcagccaagcgttcatagcgacgttgctttttgatccttcgatgtcggctcttcctatcattgtgaaggccaccgttgtcgcagcaaccgaatcgccggcggaagttaactcggcaccggtggcagaagccgtcgaagagtcatcgcctcctgcgaagcccaggcctctttcgccatatgcgaactatccagatctcaaaccgccggcctctccttcgccttcgccgccttagtgatgggttgttttgagaggatcgagcttatcgctggctgtcgtccgtataagaaaccaggtatagagggccattgagctgttcagaaggcaccacgctagagtaccaaggtctcaagcagtacatatatatctccagtgattgattcgttttgcttttgtaattgtggaactactagaagtgtgagtttacgagtctgggtactgccttgacatgtttcacccgctcgtctatgaagaaactgaggccggcgagcttccagttgtgaagcgtactgtcattgttgcaatctgatttttttttctggaaaaaaaaaaaaaaaaaaaaaaaaaaaaaaaaaaaaaaaaaaaaaaaaaaaaaaaaaaaaaaa

SEQ ID NO: 10332 - DNA, 942 bp, Triticum aestivum
  Clone ID: PAT_TA_10332
ggagaggtgtaggataagtgggagccctcacgggcgcaagtgaaataccactacttttaacgttattttacttattccgtgggtcggaagcggggcatgtcccctccttttggctccaaggcccggtcttaccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtggcagccaagcgttcatagcgacgttgctttttgatccttcgatgtcggctcttcctatcattgtgaacctggcgccgtcatccgcggcaagaagggcgcgggaggcatcaccctgaagaagaccgggcaggcgctggtggtcggcatctacgacgagcccatgaccccggggcagtgcaacctggtggtggagaggctgggcgactacctggtagagcagggcatgtagacgacgacgaccacgccacgccgcagcaacaacaatactaccggccaaaagacacagtagatctccacgcgttttttctagccgccgcgcacgcatatgggattgtggttcaatttctctcgcatcctcctctcattaagcctctctccctgtcccggcaactactccgccgattaccacccctcttgattgatccgcgatatttttttccccttgtttcatgatgatgaagccgttcgtttcggctaataattttgaattttttcttctacctatcgttttggtcatttgggttgccgtttgagttgggatccggaacaata

SEQ ID NO: 10333 - DNA, 594 bp, Triticum aestivum
  Clone ID: PAT_TA_10333
gaacctcccaacaaatcccgcagcgcaagtcgaggaggaaccgaagaagaagaagaagatggcgcgtacgaagcagaccgcccgcaagtccaccggcggcaaggccccccgcaagcagctcgccacctccatcgcggcgaggaagtcggccccgaccaccggcggcgtgaagaagccccaccgctacaggcccggcacagtggcgctgagggagatccgcaagtaccagaagagcacggatctgctcatccgcaagctgccgttccagcgcctcgtgcgggagatcgcccaggacttcaagacggatctgcgcttccagagccacgccgtgctcgcgctccaggaggccgccgaggcgtacctcgtcgggctcttcgaggacaccaacctctgcgccatccatgccaagcgcgtcaccatcatgcccaaggacatccagctcgcccgccgcatccgtggggaacgcgcctaaaagcctggatcggagatcctataccatggtgccgttcgttgtaagctagctacgtagttgattcgcttctggtttctagaccctgtttgcttaaagtcccaacttataagtcaaaaaaaaaa

SEQ ID NO: 10334 - DNA, 1180 bp, Triticum aestivum
  unsure (1)..(1180): unsure at all n locations
  Clone ID: PAT_TA_10334
ggatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagccctcacgggcgcaagtgaaataccactacttttaacgttattttacttattccgtgggtcggaagcggggcatgtcccctccttttggctccaaggcccggtcttaccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccatggaagcaaaagaaaatcaagaaccctaactaccagggcaaatggaaggcacctatgattgccaacccagacttcaaggatgatccttacatctatgctttcgacagcctgaagtacatcggaattgagctgtggcaggttaagtcaggaactttgtttgacaacattctcatcactgacgatgctgctttggctaagacatttgctgaagagacctgggccaagcataaggaagctgagaaggctgctttcgacgctgctgaaaagaagaaggaagaggaggatgcttccaaggctggtgaggacgatgatgacttggatgatgaggaagccgatgacgaggacaaggatgacaaggctgggtctgatgcggagtctgatgacgagaagcacgatgagctctagatggatggcgangaaggatgagaggaggccgcctgccttcgcgccgctgccaggatttattagttgtctctcattatgatgttcccttttttgtgatcagaaacttgacaagttactgtgtgtagaagaacaacatcaccgtggggttcttttagcgcttttgtagtnnaatttttaccggaagggaagcttataggcgttaaaccagcaaa

SEQ ID NO: 10335 - DNA, 556 bp, Triticum aestivum
  Clone ID: PAT_TA_10335
gccggccggttcgggctgagtggccgtgagactatcacccgtgttactggtggtatgaaggtcaaggccgaccgtgacgagtcctccccctacgctgccatgttggctgcccaggacgtcgctgcccgctgcaaggagcttggcatcaacgctcttcacatcaagatccgtgccactggtggtaacggtaccaagacccccggtcccggtgcccagtccgctctccgtgcccttgcccgtgctggtatgaagattggccgaattgaggacgttacccctactccttccgactctacccgcagaaagggtggtcgccgtggtcgtcgtctctgagctgcttaccttttggtggcttggattggacaggagtttcgctatctggtttctctgtggcgttgagaatcacgaggagaacggctttttcgcctggtctccagtctacactgcagagcctggtcaggttatgggttaggacgcagtagacagttgaaaattcgcccgaagaaggcctatgaatcatcctgctcgccaaaaaaaaaaaaaaaaaaggccccta

SEQ ID NO: 10336 - DNA, 489 bp, Triticum aestivum
  unsure (1)..(489): unsure at all n locations
  Clone ID: PAT_TA_10336
cacagctccgccgccgcagccggcgcacccgtccatctccccccttaaccgagcagtgtcccagtatccctccagtccccattatgcagaacgaggtgggtgatatggtggacctctatgtcccaaggaagtgctctgccaccaacaggatcataactgccaaggaccatgcctctgtccagatcaacatcgggcatgtggatgcgaatggactgtataatggcagtttcaccacgtttgccctctctggattcgtccgcgcccagggtgatgccgatggttctttggacaggctctggcagcagaagagggctgagatcaagcagtagatgagttccgcgtggcagattntgctaggatggatatttatgataccgcttttacacccttttttgaggattctgntatgggtgtttatgctttgccttagaaggtctaagataaaaccgtggactggccccatggttatggaaccattccttgaagaat

SEQ ID NO: 10337 - DNA, 594 bp, Triticum aestivum
  Clone ID: PAT_TA_10337
acaaaagggtaaaagctcgtttgattctgatttccagtacgaatacgaaccgtgaaagcgtggcctatcgatcctttagatcttcggagtttgaagctagaggtgtcagaaaagttaccacagggaaatggtgcaggacattgtcgtcaattccgtgattggggtcgaaagaggcggttggcacccacgggatggatatccttcaactccaagcatagcagactatttccttctgattctttagtaaatgtgaaacacaaattctaatcgcaccaaagtttttgggtcccaagatatgattgtagctgcatgtgtagccaaaacaccagcagttggaggacagagcagaagatagcaagtctgattctaatttcacttggtcacaggaaatatctgcttactgtggatgtaagaaatttgcttctcttcaaatgtaatgtaatgccgcctagccagggttaaccatctgctgtcaccaacggtgaaacatctgtggacataaattatgacttgtagttctccccccttgttcttttgttggtggtccaaacttacaataagtttgcaggtgtgactcaactcctgctgcatgtg

SEQ ID NO: 10338 - DNA, 576 bp, Triticum aestivum
  Clone ID: PAT_TA_10338
ttttttttttttttttttttaccactgtaatgcagtttactaagtagtaataccaaatctggaaatatcattttgttttcctgtcatgttctccagcgaataccaaccaaaacaacaccatttcgtctatcatcgtcaacataaaagggtgggacaaaaatgtgtcaacacaaaatacacaatggcatctcaatctaatcctgatcaacacctcatccacaaaatgttctactcttggcttattctcggtgtaccaaaaaatccctagcatttgctcgatgaagggcaagatttttcccacggcgcagttaactactcatacaagccagccacacttgcgtcggacaccggctttcaagaacagacgcaaggcaaggcggaaagagcagctttgacgataacaacagcatctcgtccaacgatgtaatcctactcctcggccttcccctccttggcaatctggaagccttcgaccttacatgcaatctcctctactccagccttcggcttaccatttgtatcgaccgcctcctcagcatccgcattagctgggctcagttgccagawccgaatagt

SEQ ID NO: 10339 - DNA, 600 bp, Triticum aestivum
  Clone ID: PAT_TA_10339
acgacatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcctacctcgtgggcctcttcgaggacaccaacctctgcgccatccacgccaagcgcgttaccatcatgcccaaggacatccagctcgcccgccgcattcgtggcgagagggcctaggctgctgctgcaatccatatccatgcgtcgtgtcagatagatctctgttaggctgtgtttcagaatgtgcgtcgtgttaaatccatggtagaaccctgttcctcttgggggtgggtgggatgtgttatgcctaaaactggtgggaccttcttgttgccatcagcaatggacaggaaaatgttgg

SEQ ID NO: 10340 - DNA, 810 bp, Triticum aestivum
  Clone ID: PAT_TA_10340
tgagtacaagggaccatggatccaaaagaaaatcaagaaccctaacttcaagggcaaatggaaggcacctttgatcgacaacccaggtaaactgggcttgcccactgttgtacattcatattaactgctgtacagttatcttttctgctcaactaattcagtgaaacatcaaagctcatatgatcttcttttcctttgttcgtacagagttcaaggatgatccttacatctacgcttttgacagcctgaagcacattggtattgagttgtggcaggttagtgcttcacaagttctgtgaaacatggttagcatagcacattgtgaagcttttgttgggaccactgatattgatttctcctttgaccggcactaggttaaatcaggaactctgtttgacaacatcctgatcactgatgaccccgagtacgccaagaagttcgtggaggagacctggggcaagcacaaggatgtatgccgtcttatcacgagcagtttaagttttgtttcattttcagttttgcttcgttttagatatttgatgtagagagctaagtcaatggctctctgccttgcaggctgagaaggccgcctttgatgaggccaagaagaagaggcttgaggaggtatatatgcaaacatcttctatttgttatactgccttctacgctaaatccagtactaactactctgttttctccttgtcaggaatccgcaaacgctaagaccgaagacaatgacgatgcagctgatgtaagctgcaaatgaatttaattttatcctcaacgtttctaactgcttatatgacgtgt

SEQ ID NO: 10341 - DNA, 412 bp, Triticum aestivum
  Clone ID: PAT_TA_10341
cccatgcgtccgaacgccccgcgacgcgatctggccgccgagcatggcgacaccgctccgcctcgccgcgctcctcctcctcgtcctcgtcgcggccttcgcctccgccgcgcgcgctgatctcgtcatctccagggcggatcggaaggttgatttgacttcgcacatcgtccgcgtcctcacttcgctcaaggttgaaaatgccggctccgagcctgtctctaaagtcttgctggcttttcccaacatccaagcaaaaaacctggcagcgatcagagcattcggcactgagggaaaagtgaagggtctcagtagtattcttccgattgaagttgtttgaccttcctggtgttcccccagaactgaccttcctttcagcattcgtgcacaaacctttggacaaggggaaaga

SEQ ID NO: 10342 - DNA, 962 bp, Triticum aestivum
  unsure (1)..(962): unsure at all n locations
  Clone ID: PAT_TA_10342
gaaaatactagtgggtggggggtctacaagaggaaaaatatgtttcatcacacgtactgctcacatcgacagaatactatgacgaccaacggccctcagcagaacagagctgagccaaacgtacatactgcaacatcagtggccgccgccgatcccgccaccgccacctttgccgatcccgaaaccgaatccgcctccctcgcagcccttcaagggcgcccgcatctccggctccctccacatgaccatccagactgccgtgctcatcgagaccctcaccgccctcggcgccgaggtccgctggtgctcctgcaacatcttctccacccaggaccacgccgccgccgccatcgcccgcgactcggccgccgtcttcgcctggaagggcgagaccctcgaggagtactggtggtgcaccgagcgctgcctcgactggggcgtcggcggcggccccgacctcatcgtcgacgacggcggtgacgccacgctgctcatccacgagggcgtcaaggccgaggaggagttcgagaaatccggcaaggttcccgacccggagtccaccgacaaccccgagttcaagatcgtcctcaccatcatccgcgacgggctcaagaccgacgccagcaagtaccgcaagatgaaggagaggctcgtcggtgtctccgaggagaccaccaccggcgtcaagaggctctaccagatgcaggagtccttacaagcctgcggcttaccggtactagtgtgtccagcatgactagcggctggcctgagcctgagtcggagcagcggcaccaacgggaactctatcaactatcctgtttcccttctattatcttacatgctgtctcttaggcggaggatttgttattatggttatgttttgagccttgtgagggttgggagaggcggcgtttgcttttgcccagaaataatggcattattatngtttaagtnaggaggtg

SEQ ID NO: 10343 - DNA, 668 bp, Triticum aestivum
  unsure (1)..(668): unsure at all n locations
  Clone ID: PAT_TA_10343
ccggcccccccctcgagtttttttttttttttttttttaatctcagaaggattggaggacaatgtatttaaggaaaattgcccagtaacgattcagggcacatactggaactcaaactcaacccctatgatagtaaatgttttgagaacgctgccgccaacntacgacaacntttggagttcgatgcctccaccaaaaacgaatgttggaaaatccaccctctacagaaattattgccttccaacgttaaaaagataaaagttcgccagatccttgaagggcaggactgggaacagacttctcttgttcgtcatcatttcttcccctctaggcaccgcctgagccgtacttcttgccgaagaagaggatctggagctgatcgtagccggagagcacaccagcaccagcaatggcacggaggatgttggcaccagcacccttgaagagagacttggcaccctccttcgccaggatctgctggaaagcatccaaggagctcttgtacttgacagcctctccggaggtcatcatcatccttctgcctggtgccgaattcctgcagcccgggggatccactagttctagagcggccgccaccgcggtggagctccagcttttgttccctttagtagggttaatttcgagcnggngnantnnaaagctngggt

SEQ ID NO: 10344 - DNA, 536 bp, Triticum aestivum
  Clone ID: PAT_TA_10344
gaataaacttggaccataataatctcagtcggattcgaggacaatgtatttaaggaaaattgcccagtaacgattcagggcacatactcggactcaaactcaacccctatgatagtaaatgttttgagaacgctgccgccaacctacgacaacctctggagttcgagagaaaagggaggcggctcgaggtgcgagttggggcttggcccgatcccgggcgctcgccgccggcgctgccggttggagagaaaatgggggaggtgcccgcagctgccgtgtacatactagttgtagttgtcctatttccttagtggagtttggctttattccggaccttggcgtgatgccgatggggattgggtcgccggcgcgagcgagccgtgtgcggtggctactagagtcggttcttaaggtggtggcgatggtaggcttgctgctaccgactggatccactctagtgtccctggtaataagctcgatgcccctgatctagcggaggatcttgctactgtcccctgccttagaggctcatcatg

SEQ ID NO: 10345 - DNA, 466 bp, Triticum aestivum
  Clone ID: PAT_TA_10345
cgtccgcggacgcgtgggcgcccgcccgcccgcaatgcctcccccggtctccggttgatctgacccgtcgcgccaccacccacgacgggtggcttcaaagggagaggtgggcagccagggcggggctttcggcggttgcttgcctttgaggtgaagaaggtgcagaaaggggacaccaaatatggcaaagaaagggaagtggttcagtgctgtcaggagagtgttcagctcctctgatccggaggggaaagaagctaagactgagaaggcagacaagcctaaatcccggaggaaatggccatttggcaagtcaaagcgctttgatccacccacctcgacagtgtcagacatcactccggtagctccatcgccgctgccgctgtctttttctcctacccagccttctcagccacagcccgaggagataaaagatgtcaagccagtcgaaacggagagtgaacaaaac

SEQ ID NO: 10346 - DNA, 465 bp, Triticum aestivum
  Clone ID: PAT_TA_10346
tgtaagctttggcctgaaccctatgttatcacctgtcagaatttcttgatcagctagacctaaacttatctggtctttgttgacaggatgaggaagccgatgacgaggacaaggatgacaaggctgggtctgatgcggagtctgatgacgagaagcacgtaagttgatctcctcactaaatgcatttttgacttataatttgctgttcctgttattgtttcctcacccaccttgccttgcaatttgcttttgcaggatgagctctagatggatggcgaggaaggatgagaggaggccgcctgccttcgcgccgctgccaggatttattagttgtctctcattatgatgttcccttttttgtgatcagaaacttgacaagttactgtgtgtagaagaacaacatcaccgtggggtcttttagcgcttttgtagtccaatttttaccggaagggaacttatagcgtt

SEQ ID NO: 10347 - DNA, 512 bp, Triticum aestivum
  unsure (1)..(512): unsure at all n locations
  Clone ID: PAT_TA_10347
cctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccaagaccgccgtcctcatcgagaccctcaccgcgctcggcgccgacgtccgctggtgctcctgcaacatcttctccacgcaggaccacgccgccgccgccatcgcgcgcgactcggccgccgtgttcgctgnaaagggggaaaccctcgaggagtactggtgggtgcaccgancgctncctcgactggggcgaggcgggcggcccgactcatcgtcganaacgnggngagccacgctgctatcacaaggtta

SEQ ID NO: 10348 - DNA, 499 bp, Triticum aestivum
  Clone ID: PAT_TA_10348
tagcgtggtcgcggccgaggtactgaggaatacattgatgggcaatgctctgggaatttgggagacatactgataagatgcaacaatgtgatgtaccagaagagcacggagctgctcatccgcaagctccccttccagcgcctagtgcgcgagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctaggctgctgcacctgcaatccgtgttaggctgagttcatcggtggaaaatagtggtgtttcagaatgtgcgtcgtgttagatccatgttagatccctgttcctctcatggtgggtggatgtgttatgcctaatctgatggtacctgcccgggcggccgc

SEQ ID NO: 10349 - DNA, 599 bp, Triticum aestivum
  Clone ID: PAT_TA_10349
cgagaatcttattatgattcgctggattgcccacggcattcctagagtcccatgggatggccatgcccgctttgacggtgcctccgtttacaaactcgacaggaatgggaagatctatgagcataaggtacataacattgctacgaccccaccgacaaagtacaaggtcctgtctgtacaagagctagtcagatcacttagctgtccgtccactccaaaaccaacatatttcgaggcttcatctcaatctttgagcacggcgtcgctttattcgaggttggcatggatcagacgcctagcaaatctcagaggagaataggagacaaatttatacagaataaatttgttcttggttgagctgtatggactgcagtgctgcatatgtttgtgagcaagctgatttgggggcgtgcctgctccggttccctgaagtcgccgatctggacattgcaacggtctccaaaacagcaagtctgactactagttttattgcagtattatatctataaatccaggctaaaattatatatgttgtgaaccatatgaagtccagcattattatgtctataaatccagactaaagttatatattgtgaacc

SEQ ID NO: 10350 - DNA, 927 bp, Triticum aestivum
  Clone ID: PAT_TA_10350
ccacgcgtccgcttctctgccgcgctggcggcagcaacagggaaaatccagtccacggtgccaccaatgagaaagagtactggcagcaaccacatcatgaaaaggtcgagggaaagatgctctgatatgtgtcacttaaagggtcgagggaaacggccaggaaccacagcctgctcccagagcgcgaggaggacgtggtgatgcagcgcccagatccacggtggcatcaacacgccgtcgtcgacctgagcctccaccgtcgacatggtcgaggcatggccaacacagctgttgtcgtcgcctgccagccttccttgagctggggcgcaggcgatctactgcaatccaagaccaagaagatggccttcctcgagctgtaacgggacccagcagcggcggcggcggaggggaatggcggctagggggcagcagcctgctggaaatggaggaccgacgccgaggtcctgccgcgcaggatcgtcgagaccagctctgacatgctcctctgcccgctctgggactccaccgcgaagcacgccgacaccaaggtctggcggctccatggaagccgccatcatgttgtccgactaaatgtggagttacttgtgcaagttccaccatcaacaaacacaaagttctgcatgctatcatcgcaagtaaagcagtcaatctgttagggagaaaacaaaggcttgtgtgctcattagttttttttgttctatcatgtgggcaccttatctatctgtaacatgtgacctgtgcaactgcaaaaatgttagacaataaaaaatttgtgtaacacattttcttatacactttgcctatagaaacagtgcatagttattctcttttttgttgccttgtgtaatatatattgtaaaacaaattgtcgtgacctactgaaccttgcacttctgctgtaacaaa

SEQ ID NO: 10351 - DNA, 899 bp, Triticum aestivum
  Clone ID: PAT_TA_10351
gggcggaatagcggggaaagaagaccctgttgagcttgactctagtccgactttgtgaaatgacttgagaggtgtaggataagtgggagccctcacgggcgcaagtgaaataccactacttttaacgttattttacttattccgtgggtcggaagcggggcatgtcccctccttttggctccaaggcccggtcttaccgggccgatccgggcggaagacattgtcaggtggggagtttggctggggcggcacatctgttaaaagataacgcagggtgtcctaagatgagctcaacgagaacagaaatctcgtgtggaacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtggcagccaagcgttcatagcgacgttgctttttgatccttcgatgtcggctcttcctatcattgtgaagcagaatccaccatcgagagcggcgttcaggacatcggcctcagctcgccgagcgtggggcagtggagctcgccggactcgatgaacatccaattcaaccgcggcttcaggggctgcatggagtacccgcgggcgtcccagaagcacagcctgaaggagaagctcatggaggcgcggatggtgagccagaaggtgcagctccgccaggtgctcaagcagaagatctaggtgaagaggtgcaaggctagaagaaataatctcagaaattacttcgccgcttcgattttttcttcctgttgttgtcttagggtcacttgtaagttgtaattgatgtactagtaaagaaccgaaaaatagatcaatcgagtcaagtcgg

SEQ ID NO: 10352 - DNA, 660 bp, Triticum aestivum
  Clone ID: PAT_TA_10352
gggtccatgtcaagatccctgttgggaagagatgtggctttgttcagtatgctaacaggccttctgctgagcaagctctgcaattgctgcaagggaccttggttggtggtcagaatgtgaggctttcatggggacgaagcccttcaaacaaacaaactcagcctcaggaagccagccagtggggtgcaggtgctgctgctggtgctgctggtggttactatgctggatatggacaaggctacgaggcttatggacaagggtatggttatggagcctatgctggttatcccaactaccaacaaccagcagcggcaccgcagccaccgccaccgcaacagtgagccctcctcgtgggtcgtccagacagatgagaacccctgtttgaaggcactgtcaaggctaatgttgtagcacctgtcgatagagagagacggttcctggactccggattttgattgccccatggcaaggtctattgttatgttattatgcactatattatgatcagctgttgtccgtcccgcttgtggtgatcctttggatatgtacttggaaacttagctttgtttcgccgcatgcccttgtctactgttatttaccgttgctatcttctgctgttaaattatatactatttgtaccgtttgcttccaaaaaaaaaa

SEQ ID NO: 10353 - DNA, 775 bp, Triticum aestivum
  Clone ID: PAT_TA_10353
gtggcctggagcacggtgaggcccagctcctcgaatgcctctagcacggcgacgagcaacccggggcagctcttgtcggaagacacgttcacgaggaacccatgccctagggcttccacgctcaccgtggggaaagagttctgcttgtgcgagtgcgtgccttcctcgcagtgggctctcgccattgagcatcccgatcttgcgctagagcccgtcaggcagcctgacggccccccctctatttggctccaaggcccggtcttaccgggccgatccgggcggaagacattgtcaggtggggagtttggctggggcggcacatctgttaaaagataacgcaggtgtcttaagatgagctcaacgagaacagaaatctcgtgtggaacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtggcagccaagcgcgtcaccatcatgcccaaggacatccagctcgcccgccgcatccgcggggagcgcgcctagatcaagcatctgccttggcaacttccatcgccggattgctgcaatgtagtgtagctgtccgttcgtcgcctctggtttcagatcgtgttagcaataggcaataggccacttctattttgttgtaaaaaagtattctggttggttacatagttacaatgactcatttccataaaaaaaaaa

SEQ ID NO: 10354 - DNA, 741 bp, Triticum aestivum
  unsure (1)..(741): unsure at all n locations
  Clone ID: PAT_TA_10354
gcacgaggagttaaacaagaggaggcaaacacaaccagtgatatcagcggtagccaaattacccatgacgaactgtgtcggaagcataacaagccattcgagtatattcatcgcccacgcgaagtaagctcaacccgaaagttcaaaggtgagcttggcatcgaccacttagatgagtttagtcgccacattgtgtggggcaacacagttaagctctacaatcataatgttcttagactgtgaaagatcatccacaacatcaccacgcctgatcgctactatgtgtgccacatgacagaaacatttgcaacagacatcaaaagaatgtactttacggttcccttttctatgggttcccttttcccacacatggatggtgatcagggtgaactgccaatcactattggagatggaactactgctatcacatccagctttatcaaaggtgttgacaaaagggccaccatcactagnnnctggagcgacttcttccatcgggcacacatgaacgaagggcgagtatatgcttttgccttcaaatgcacttccaagggactgtgcctgatcgtctactcaatataagcaagttgcaagagccccttgttatataacttatcattagtatagatgcctactaagacttctatgtttatcatccttttggatcttatgtaatcccttaagaccattctatgcatttaattgttgattatttgctgcttaaaaaaaaaaaaaaaaaaa

SEQ ID NO: 10355 - DNA, 1332 bp, Triticum aestivum
  Clone ID: PAT_TA_10355
cggcacgagggcttaaaagcactatcccatcctgattatttccatacagttttttgtctcactgaatatcgtcttcgagaactgggcaatctttgagtccatgaagagcactcgcacggtcaagcaccatgagatcttcatccgcaacgccgagtgcgttgtgctcttcacagaccttgaagatgaggccagagagatccgccgcctactgggttcgatcggatgccatcgatttcacccaccgccaatgacgacaaggccggtggctttggcattgagcgatatacttcacctcacacgtgaagaaataagatttttgaggattaggattattaatgaaatataatgagcatcttttaccaccaatggcctatgaagtctcaccgtattaagacacatgcatcactgttagtcatccaagcaaaaccacagtcagataaatcagcttaattattctactacttctttcagatgacagctgttaaacaagaggaggtagacacaaccagtgataccagcggtgaccaattaccaatgaagcacaataaggcatacgagtaaattcatcgcccatggaaagcaaactcaatccaaaagttcaaaggcaagaaaatccatggtgagccttgcatccactacttagatgagtttagtcaccacattgtgtgggccaacacagttaagctctacaaccataatgtccgtacactgcgaaagatcatccgcagcaccaccacgcctgataactactatgtgtgccacatgacagaaacatttgcaacacaaggcaaaagaatgtactttagcgttcctttttctaggggttccatttcccacacatggatgctgaccatggtgaactgccaatcactactggagacggaactgccgctgtcacggcccgctttatcaagggtgttcacaaaagggcaaccatcactgaaggctggagcgacttcttccgtcaggcacacatgaacgaagggcaagtatacgctttcgccttcaaatgcacttccaagggactgtgcctgatcgtctactcaatataagcaagttgcaagagccccttgttatataacttagtattagtatagatacctaccaagacttccgggtttatcatccttttggatcttatgtaatcccctaagaccatcctgtgcatttagctatcggttatttgctgcttagactgctatgtggtatgcttttgaaacaaccttgatggaagaaatatatgctttcatctttaagtgcacatccaaagacctttgcatgattgtctatccaatctaaacagatcaaaagaatcgtttttacaaaaaaaaa

SEQ ID NO: 10356 - DNA, 575 bp, Triticum aestivum
  Clone ID: PAT_TA_10356
gccaagatgacagcagttaaacaagaagaagcagacacaaccagtgatatcagcggtagccaaattacccatgtaggtgttctgtttgctattcattaatgcgtgggcgatgaatatacgcaaagcaggttcaatccaaaagttcaaaggcaagaaaatccaactaaagcctggaaagtacattctccgtgacgggactaccgctgtcacaactactttatcaagggtgtttgacaaaagagtcaccattggctggagaacttcttccctcaggcacacatgagcaaagggcaagcatatgctttcaccttcaaatgcacttccaagggactgcgcctgatcgtctactcaatataagcaagttgcaagagccgcttgttatataacttaatgttagtataaatgcctaccaagactttgtgtttatcatccttttagatcttatgtaatcccttaagaccatcttgcgtgtttaactatcggctatttcttgcttagactgttgtgttgtatgcttttaaaacagcaatgataaaagaaatatatgctcactcttccaaaaaaaaaaaaaaaaa

SEQ ID NO: 10357 - DNA, 830 bp, Triticum aestivum
  Clone ID: PAT_TA_10357
agtcggattcgaggacaatgtatttaaggaaaattgcccagtaacgattcagggcacatactcggactcaaactcaacccctatgatagtaaatgttttgagaacgctgccgccaacctacgacaacctctggagttcgatgcctccaccaaaaacgaatgttgggaaaatccaccctctacagaaattattgccttccaacgttaaaaagataaaagttcgccagatcctcgaagggcaggactgggaacagacttctcttgttcgtcatcatttcttcccgtctaggcaccgcctgagccgtacttcttgccgaagaagaggatctggagctgatcatagccggagagcacaccagcaccagcaatggtgcgcccaaagcagtcaccaatacccttgtatggctcagagagcctgccagccttgatcatctcatcctggttctggataagcagcttaacacgctcaataggagctgcagcagtcttggaaactgcagctgacactcctcccatgaggaagtcaatcgcaaagttcttgacacctttcttctcagggggtgcattggcaaacaatggagaagatgacatcattgggacactgatgccaaggttctgagtcatgtagctgcttgtggtgaagcgcctctcataggatggcacagaagggcagatgttgcgagcacgaacaccctcagagaagctggaggcaaggtggaactgtccaccaaacttctgcatgacagacgggtggttagcacggtccgccatctctgacccttcggaaacggaggcgatgggatggggctcttcccggctcggcggctccgc

SEQ ID NO: 10358 - DNA, 306 bp, Triticum aestivum
  Clone ID: PAT_TA_10358
tagcgtggtcgcggccgaggtacacaacattgctacgaacccaccgacaaagtacaaggtcctgtctgttcaagagctagtcagatcacttagctgtccgtccactccaaaaccaacgtatttcgaggcttcatctcaatctttgagcacggcgtcactttattcaaggttggcatggatcagacgcttagcaaatctcagaggaggatagggtgggtcttagcacgatacttacaaaatctacctttttgttgtattgtagtcaccagtcactgatgagtagtacctgcccgggcggccgctcga

SEQ ID NO: 10359 - DNA, 870 bp, Triticum aestivum
  unsure (1)..(870): unsure at all n locations
  Clone ID: PAT_TA_10359
cggcacgagagaaacgcaggtgtcctaagatgagctcaacgagaacagaaatctcgtgtggaacaaaagggtaaaagctcgtttgattctgatttccagtacgaatacgaaccatgttctgcatgtcgtcgcaggcaccacggggagcgtcttggccttcttttgtgtcaccatcgagaggtagcaggaaatgtgcgtcgagaggcacttgaatacgcatgtggattgttttcagcatggtagtctcaaaaaggtggtattctcaaaatacatagaaaatgctttgctatcgaatagggctataaatgcagatttccttgaagatagtatattttataactgtattgccaacgtgctcccatagttttatcaaaggactaatagttctaactgctcatttaattttcagtggcatgcatgggtggttgtagtgtagttttattaatctgcatgcattttctgtgttgatatactatctcaataaataatgaatacgtataatatatgcaagctacattcaattaagttttgatactattcccttgataatttgttacatttgangagttaaggtacaaacgcctgaataaactgaggagcactgtgaaacaattgcaattcgggtagcaaatacacttgatgcgttgttcccttttttgaattgtcanatgtttacaaccactttgttttaccaaatgtcatttgaaatcgtcagcaatattccggatgtgtttgnctttgtctacgtaatccctgtgcgtaatcaaatacaacttgaagcacatatgtanagcagagaggattaatggtaacactcttggcccggataattgacggtcanggcanctgtgcccggtgtcataagagatt

SEQ ID NO: 10360 - DNA, 397 bp, Triticum aestivum
  Clone ID: PAT_TA_10360
tcgagcggccgcccgggcaggttacgaggccttctccaagaacttgttgtagtcctccttgttctcagcaatctcaaagaagagctcaatgcacttcttgacaaggttcttcctgatgaccttgaggatcttgacctcgtcggcctcttcgaggacaccaacctctgcgccatccacgccaagcgcgtcaccatcatgcccaaggacatccagctcgcccgccgcatccgtggcgagagggcctaggccgcgatctgcaatccatgcgtcgtctgttagatccttgttaggaagtgcgtgtgctagtagtgtttcagaatgtgcctgtgttgttcttgtcatggtggatctgttatgcctaatctgatggtacctcggccgcgaccacgctaatcaa

SEQ ID NO: 10361 - DNA, 761 bp, Triticum aestivum
  Clone ID: PAT_TA_10361
ttcggcacgaggtagctatatgcttaacacatgcaagtcgaacgttgttttcggggagctgggcagaaggaaaagaggctcctagctaaagttgtctcgccctgcttcaaaactacagggcgcgcgctacggctttgacctaacggcctccgtttgctggaatcggaatagttgagaacaaagtctgcaagagcgaaatctcggtaccacatggtattcgccgacaagtttgaggtccctgatagagcatctctggtccactcatcgataaagaagcgcctatccttcccagctgcagagaaaccaaatgtcacacccgcagataagctgaaggaaagagcgaggcgccattcggatcctccgaaggtggatcctgcctccctgaaggatgtcaatgttgcctgatatgatcaatgaacgtcaggcgctgccacctatgattgctagatcgccatcttttctgtttttgtattctctagtttagattgctttctctcaaaggttgaaccctccgtgaaactgtatgatctgtccgggttgatttgagacgattctaactgtttgcagacagaggtttttctctgtggattgtggtgtgtgatgctgcagagaaggaaatgtgaagcggtaaaaaaaagtgagagatgattggtgtgtgcgtgactttcagtgtacattatgagttttcttcgagagtatatgtacattattgatttggattactactattattaaccacaatgtaagacatgcggaattac

SEQ ID NO: 10362 - DNA, 1615 bp, Triticum aestivum
  unsure (1)..(1615): unsure at all n locations
  Clone ID: PAT_TA_10362
gacaataccgggcgcattagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagcaccgacctactcgacccttcggccggcatcgcgctcctagccttaattggccgggtcgtgtttccggcatcgttactttgaagaagcttgtggaggaggggaaggtcaagtacattgggttatcggaggcgagcccggacaccatcaggcgtgctcacgccgtgcaccccatctcctccgtgcagatggagtggtctctgtgggctcgcgacatcgagcccgagatcgtgcctctctgcagagagctagggattggaattgttccctacagcccgattgctcgtgggtttttcggtggaaggggagtgacacaacaagtgtctgctgaatctagtctgaaaggccatccacgtttttcggctgaaaacctggagaagaacaagcaactttatctgaaaatagaagaactggccaagaagcaccagtgcagccctgctcagctagctttatcttgggttctgcatcaaggggatgatgtggttccgataccaggtttaatgccatgtccttctcatttcattgatgtcacatagtgttaaacacgtgcaatgatttcttggagttataaatccacataataggtaaaaaaactgaagatcgtcttgcttgcatgtgctttctgatagaagtgaaatgtgtggtttaagaaatcatagtgaagtatacgagatacagagagatattccagctgcaatctagctatctttggcagacaaacatagaatttcatggtaatatgaataccatctttgaaatctgatcttttgctctacagtttgtgccatggtgttaattttgaactggcattaagctgaactgtgaaacattttgatgcctcggaacaatggcctaatttatccacaaaaggacctctttcgctgcttccaagttgcaaacaagtacatcaatggcgaagatcatttttccagtagactagcattgtatcactgacaaatatgctgtacaatttctcagggactactaagataaagaatctagactccaacattgactccttgaaggtgaggctcacggaagatgacctcaaagagatcagcaacgagatacgcgaagaagatgttgcgggtggaaggcaatatacttcatttgcgaaattcacctggaattatgcggatacgccaaagaagtgaaactacaaaagatcatggagacggtgaaacaagcatgccatgctatgtgctagtgtgatgaatggtgctccctgtatcttcatcctgtgaattgtcccgctctgaataagaacatgtgcactgtctccacctgccgtgtagatttatgtgtgcttgtataacagaagactgagaccgtgcttgctatgtttgtggctctctagtcttaccggctttccgtgacagtaattacaccgtngaaaatgtatctgctcaaagagatattca

SEQ ID NO: 10363 - DNA, 527 bp, Triticum aestivum
  Clone ID: PAT_TA_10363
gccggccgggctccagagaactgcactgcactgcacagcgccagcgcgagagaccgaccagaaagtagaaacccccggccggaaggagatgagctactacggccagcagcaggcgcccgtcggcgccccgccgcagcaaggttacccgccgcaggggtatcctccggccgtttacccgccgccacagcagggctacccgccggccggatacggccagcagggctacccgcctcaacagggctacccgccccagcagcagcagcagaacagcgggccttccttcatgcaaggatgcctagccgcgctttgctgctgttgtctcttggacgcctgcttctgagaacagagaccaaagttccatcctcacgcgcgttggaactgatcaattgtgccttgttaccgaaatgctactagcctccatgttttgggccctatcacatttttctaccccttgtttgtaaacttcacattgggattaattattcagttggtttggatgcgaaaaaaaaaaaaaaaaaaggccccta

SEQ ID NO: 10364 - DNA, 938 bp, Triticum aestivum
  Clone ID: PAT_TA_10364
tgctgaaacataagatggattaaccaaacaccaaaccaaactcgagcaccaccacaagaatccccaggaacaaacttattgcaccgacgacgacccatctgacatctagacccctgatcaaccaaccagctagctacatcaaaatttcaaatccaaacatacatattgcgcctagagcttgaggaagacaaactcctcgatcgcggggatctccccgatcttggtcagcgtggccttgctgggctcctcatcaacaccgatcgccatgatagccgtcttgcggggagcgatcctcccgacgctcatgaagctgacgttgacgttctcctcgcccaggacgcttccgaccgacccgatcatgccgggctggtccacctgcctgcacaggatcaggctgccctccatgctcacatccacctcgaacgctccgaccttggtaaggtgagggatgccgtccttcacccgcccctccaccgtgaccaatccagagtcagatatcgcactcgggaatttggaatccacattggctatctgaacctgaatgtactcgagaggtgtctcgggtgagggtgagccatccatcacgattttctcctcgctgacacggatgcccctctgcttcgcggtgaagtcagcgttgaccagattgacgaaaacgtcggagattggctcgatcacacccttggtgatcatcgcacggagaagtctcgtgtcaagatcatcgggagcccttgcagatgcataggtcaccttcacagacttgataccgccaccaccagcaactagctggacagctaggcgcccaagcttttcagcgagcatgacataaggtgcaagctctgacagcacctcagcaggaaccattggtgcattgaccgcagaagctgcaagctcccctttcagagctccagtgacagcttcagctatttcaatagccc

SEQ ID NO: 10365 - DNA, 558 bp, Triticum aestivum
  Clone ID: PAT_TA_10365
gtctcgggttgccggacatctcggaggccaagaagaaggcggtggccgtgccctacgacggggaggacaagaacggtttcttgaagaagcttgcgctgaggtttaaggacccggagaacaccacattgatcatccttgacaagtttgatgggaactctgaactagttgctgagcttgtcacatccaatggctataaaggtgcttttgcggtaaaggatggtgcggaaggacctcggggatggcagagcagtgatcttccgtggactgctcccaagaagggattcagtttggacttcggtgagctatttggggatggttcagaaggtttgcctgtcacaattggtcttgctgcagctactggtttgggattacttgcctacacagagatagaaaccgtgctacagtttctgggttcagctgccattgtccagcttgtggcaagcaagctcgtgtatgccgaggatcgaaagaagaccctgcaacagattgatgatttctttaacaagaagattgcgccaaaagagcttgttgatgaaattaaggaaatcgggcaggctc

SEQ ID NO: 10366 - DNA, 1010 bp, Triticum aestivum
  unsure (1)..(1010): unsure at all n locations
  Clone ID: PAT_TA_10366
tctctgacaacaagctgcccatgtccatatctctcagctcaacgctaaaacaaagaagaaaacgaaaaaaaaaagaggaagtctcaaatctgcctgccgctgagccctggccatggatggccacagcagaaatctaaatctgaacagaggagaagagggcgctggcggtctgtctcttctactgggcagggcgcggcctcttgtagccccctagtccaccacctttgccaaagccgccaccgagacccccaccctttccaatgccaccaccgagtccatggccgatgccgcctccgagcccgcctncatttccaagaccaccaccattgccatacccgccaccggcaccaccaccgagtcctccaccgttgccgatgccgncgccaagacctccgcctttaccgaatccaccgccgatgccgtggcctatccctccaccaagaaccgccacctttgccgatgccgccaccaagacctccacccttaccaaatccaccaccgagtcctccgccttttgctgatgccaccgccaagacctccacccttaccaaatccaccatcgagtcctccgcctttgccaatgccgccgccaagacctttccacccttaccaaaaccaccgccgagtcctccgcctttgccgatgccgccgccaagacctccacccttaccaaaaccaccgccgagtcctccacctttaccgatgccgccgccaagacctccacccttaccaaaaccaccgccgagtccttcgcctttgccgatgccgccgccaagacctccgcctttaccaaaaccaccgccgatgccatggcctattccaccaccaagaccaccacctttaccgatgcctccgccaagacctccacctttaccaaaaccaccgccaaggccgcctttgccaaacccaccaccaagacctccaccgacaccatggccagcgccaccacctagtcctccaccaccaccgtagccgccaccgccaccgagccctcctcgtgccgaattcct

SEQ ID NO: 10367 - DNA, 447 bp, Triticum aestivum
  Clone ID: PAT_TA_10367
cctcaagcgtcaacaccatgctatgccaccagtcaagtcggcacaagtgcttctgccgggaagatctacaagcatcattgctgcagacaagagactgtaagatcagcacactctgcgaggttctgtcatcgttgatgccaaagaacaacaccacacttgaaggtctcatgcccagaagcttggaataacgaagggagaggaggatgcctgtgtcggagcgtgaatggtattttaggcctgtaataaacaatgccttttccatttgcgttgtcttacattcgatatatatcgcccccttaagatgattcgtggagggggcgagcctgatcaaattggggactggttttttgtatttgtttacattgaactgatagtcgtgcttgcgatgcttctttctatgcccaagatcgtcgcctacatgggttttatgctgggatgcaccctttt

SEQ ID NO: 10368 - DNA, 679 bp, Triticum aestivum
  Clone ID: PAT_TA_10368
aggcgatgccctcgcggcgcgatcgcgtgagcacggcacaatgaatcccagagattccggcgacgacagccccggggcgacggcgggttcgtcttcggcggccccggcgcagcagcatcagcggcaatcgctcgagtggaggttcgcgcaggtcttcggcgagcgcgcggcgggcgaggacgtgcaggaagttgacatcatctctgcaatcgagtttgataaatctggtgatcatcttgccaccggagacagaggaggacgtgttgttttatttgagagaacagatgctcgggatgagcacgctaatcggagagaactggagagacaggatgttccaattactagacatcccgagttccgctataaaacggagtttcagagtcatgaacctgagtttgactacctcaaaagtttggagatagaggagaagatcaacaagatcaagtggtgccagacagccaacaatgcactctttctactgtccacaaatgataagacgatcaaatactggaaggtgcaagagaaaaaagtaaaacaagtttcagttatggctttggacacttcccgaactgtaggggatggtaccacaagtcgtgcgagtaccagtacttccgagcctcctcttccaaatggtggatgttcaaaaaagtctgacagcctcaacagtgatctcgcattt

SEQ ID NO: 10369 - DNA, 542 bp, Triticum aestivum
  Clone ID: PAT_TA_10369
gccggccgggtcgggagaactgcactgcactgcacagcgccagcgcgagagaccgaccagaaagtagaaacccccggccggaaggagatgagctactacggccagcagcaaggttacccgccgcaggggtatcctccggccgtttacccgccgccacagcagggctacccgccggccggatacggccagcagggctacccgcctcaacagggctacccgccccagcagcagcagcagaacagcgggccttccttcatgcaaggatgcctagccgcgctttgctgctgttgtctcttggacgcctgcttctgagaacagagaccaaagttccatcctcacgcgcgttggaactgatcaattgtgccttgttaccgaaatgctactagcctccatgttttgggccctatcacatttttctaccccttgtttgtaaacttcacattgggattaattattcagttggtttggatgtgatgactaccttgccaaatgctactaatccatcttttattttctccttgttcgaaaagtaagcagatact

SEQ ID NO: 10370 - DNA, 500 bp, Triticum aestivum
  Clone ID: PAT_TA_10370
tttttttttgacagcgacctccttattaattaatagcatcatgctgaaacataagataagatggattaaccaaaataccaaaccaaactcgacaaccaccacatataaatccccacgaacaagcttattccgcccaacgaccacacaacacctagaccctgaccaaccagctagctacgccaaaattgcacaatcaagcttgcaaatcatatgcgcctagagcttgaggaagacgaactcttcgatcgccgggatctccccgatcttggtcagcgttgccttgctgggctcctcatcaacaccgatcgccatgacagccgtcttgcggggagcgatcctcccgacgctcatgaagctgacgttgacgttctcctcgcccaggacgcttccgaccgacccgatcatgccgggctggtcgacctgcctgcagaggatcaggctgccctccatgctcacgtccaccttgaacgctccgaccttggtaaggtgagggatgccgt

SEQ ID NO: 10371 - DNA, 630 bp, Triticum aestivum
  Clone ID: PAT_TA_10371
gcgcgagagacgaccagaagtagaaacccccggccggaaggagatgagctactacggccagcagcaggcgcccgtcggcgccccgccgcagcaaggttacccgccgcaggggtaccctccggccggctacccgccgccacagcagggctacccgccggccggatacggccagcagggctacccgccccagcagcagcagcagaacagcgggccttccttcatgcaaggatgcctggccgcgctttgctgctgttgtctcttggacgcctgcttctgagaacagagaccaaagttccatcctcacgcgtgttggaactgatcaattgtgccgtgttaccgaaatgctactagcctacatgttttgggccctatcgcatttttctaccccttgtttgtaaacttcacattgggatcaattatttggttggtttggatgtgatgactaccttgctaaatgctaccaatccatctttttattttctccttgtccgaaaagtaaaaggatgctagtaaattacactattgatatgagatttgacgtgtatgcaccttttttgccttagagcatggttgtaagtcagttgttgcctatataatgttgccatatcatttatagccaatctaatatcc

SEQ ID NO: 10372 - DNA, 828 bp, Triticum aestivum
  Clone ID: PAT_TA_10372
gaactggtacggacaaggggaatccgactgtttaattaaacaaagcattgcgatggtcctcgcggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagccctcacgggcgcaagtgaaataccactacttttaacgttattttacttattccgtgggtcggaagcggggcatgtcccctccttttggctccaaggcccggtcttaccgggccgatccgggcggaagacattgtcaggtggggagtttggctggggcggcacatctgtttgctcacaggaagaactcgccgctgtcaagattcagaccgccttcaggggttacttggcaaggagagcactgcgtgcactcagaggacttgttaggctgaagtcgctagttgacggaaatgccgtcaaacgccaaactgcccacaccttgcattgcacacaaacaatggcaagagttcaaacccaaatctactctagaagggtgaagatggaggaggaaaaacaggctcttcaaaggcagctccagttgaagcaccaaagggaacttgagaaaatgaagattgatgaagactggg

SEQ ID NO: 10373 - DNA, 808 bp, Triticum aestivum
  unsure (1)..(808): unsure at all n locations
  Clone ID: PAT_TA_10373
gcacgagggcgcctcgatcgccaccgcaacaagccgccgcagcagccgcgagagaccggtcgaccccgtttccttgccgtagcgccgccggggaaggcgaagatgtcgtggcagacttacgtggacgagcacctgatgtgcgacatcgagggccaccacctcgcctccgccgccatcctcggccacgacgggcaccgtctgggcccagagcgccgacttcccgtcgttcaagccggaggagatgaccaacatcatgaaggacttcgacgagccggggaccctcgccccgaccgggctgctactcggagacgccaagtacatggtcatccagggtgaacctggcgccgtcatccgcggcaagaagggcgcgggaggcatcaccctgaagaagaccgggcaggcgctggtggtcggcatctacgacgagcccatgaccccggggcagtgcaacctggtggtggagaggctgggcgactacctggtagagcagggcatgtagacgacgacggccatcacgccacgccgcagcaacaacaattactaccggccaaaagacacagtagatctccacgcgcacgcatatgggattgtggttcaatttctctcgcatcctcctctaatcctctctccctgtcccggcaactacttcgccgattaccacccctcttgattgatccgcgatatttttttccccttgtttcatgatgatgaagccgttcgtttcggctaataattttgattttttcctgcctatacgtatcgtttttggtacatttgggntgccgtttgagttgtggatccggaacaa

SEQ ID NO: 10374 - DNA, 621 bp, Triticum aestivum
  Clone ID: PAT_TA_10374
atggatccaaaagaaaatcaagaaccctaacttcaagggcaaatggaaggcacctttgatcgacaacccagagttcaaggatgatccttacatctacgcttttgacagcctgaagcacattggtattgagttgtggcaggttaaatcaggaactctgtttgacaacatcctgatcactgatgaccccgagtacgccaagaagttcgtggaggagaccttggggcaagcacaaggatgctgagaaggccgcctttgatgaggccaagaagaagaggcttgaggaggaatccgcaaacactaagaccgaagacaatgacgatgcagctgatgaggatgagggcaaagctgccggtgacagcgatgaggagaacaaggatgcctccggcgatgagaaggtggaggaaattagcaaggatgcttcttcttcttccgacaagaaggacgagctttagagtgtagcaggaaggctctgtatctaacctttttcctcttgagaagaacattttctgtgaaagatgagagaagtaatgcaatctcggctcttgtaatttgttatgtttttgtcggtaataggaaatatagcatagtcatgaatctctctcggtgcctaaaaaaaaaaaa

SEQ ID NO: 10375 - DNA, 1105 bp, Triticum aestivum
  unsure (1)..(1105): unsure at all n locations
  Clone ID: PAT_TA_10375
cctaactttctnaatgttctccggttattccccctcttcttagatctgataatttggcatgggtaattaattattttggtgctcgattagtcgccattgtcggatgatactttagctgcaagccactgttcagcaaatccagggtatctttgaccagtgcttagctgttcatgataagctagagacatcattgcacgatttgtctaggaccggaggcgctaaatcttgcaaagcagctcataaagctgctgatgcacagtttaaggaattagtgaaagagctgaagcggctgttgttatctgtatagtcatcccctcagtcttatcagatatggccaaagctagagggcttggttgcgaaggagagggagatgcaggagaagctcatggcaaggcatgcgaccgtggttgacagctttgagaagaagcagcgtaggcaagaatcctgactatatgcttgaatagaaaatctacagtgtctcagatatttgttggaggccatgactccaatgtcaagtgttcgctccatatggggaagtcgtccatgtcaagatccctgtttggaagagatgtggctaaattactcctgtcactgcatattcaggccttctgctgagcaagctctgcaactgctgcatgggaccttttttttggtggtcagaatgtgagcctttcacggggaagaagccctttgaacaaacaaactcagtatttatggagactatgcccttatgcgagtctttcggccttgctgggttgttttattgttgtgaaggcatcgtcatgggtgattgtagttacattgcctcgttcacacttacatccaccatcaatcagctccatggagaaatgaaacctgtcatcattttgtccgactaagaatggagttacttgtgcaagttacaccatccgcaaacacatgaaaacctgcatgctatcatcgcaagttgagcatttacatgctccaagtcaatctgttagggagaaaacaaaggcttgtgttcctattcgtaattttttgttttatcagtgggcaccttatctatctgtaacatgggcctgtgcaactgcaaaagtattgggcaataaaaattctgtgtaacaca

SEQ ID NO: 10376 - DNA, 612 bp, Triticum aestivum
  Clone ID: PAT_TA_10376
tttttttttttttttttttttttttttcaaccaaaacaacaccatttcgtctatcatcgtcaacataaaagggtgggacaaaaatgtgtcaacacaaaatacacaatggcatctcaatctaatcctgatcaacacctcatccacaaaatgttctactcttggcttattctcggtgtaccaaaaaatccctagcagttgctcgatgaagggcaagatttttcccacggcgcagttaactactcatacaagccagccacacttaagtcggacaccggctttgacgaacagacgcaaggcaaggcggaaagagcagctttgaggataacacaacagcatctcatccaacgatgtaatcctactccccggccttctcctccttggcaatgtggaagccttcgatcttacacgcaatctcctctgctccagccttgggtttaccatttgtatcgaccgcctcctcagcatccacgttaggtgggctcagctgccagatccgaatagtaccatcttccgaccctgaggcgtatgattcgccaccaggtgcaaaccgcacgcagtgaactggaccatgatgccctttgttacaggttatttatcaccggtagaaatcaa

SEQ ID NO: 10377 - DNA, 776 bp, Triticum aestivum
  Clone ID: PAT_TA_10377
tgctcatagagccgatgatgttgattactggcttcttcctcctgtttgttgcatgtattgcctacatgcacactgacatgtcaatctctaagaactctccttcttatctggcaaagctgcaatgggatgaggtgcaagccactgttcagcaaatccagggtatcttcggccagtgcttagctgttcatgataagctagagacatcattgcacgatttgtctaggactggagatgctaaatcttgcaaagcagctcgtaaagcagctgatgcacagttgaaggaattagcgaaagagctgaagccactgtggttatctgtacagtcatcccctcagtcttatcagatatggccaaagctagaggacttggttgcgaaggagaaggagttgcaggagaagctcatggcaaggcatgccaccgtggttgacagcgtcgagaagaagcagcgcgggcaagacatagaaaaccggattgcttcccagcagcagaagatcgctgcgctgaggcaagaggtcgaatctcttctagagtaccttagcgagatatgagcggacccggtctcgttcctatatcattagtgattagactgaaggtcttcgtctgcacttttgtgtagatgttgtgttggtaacccattatcctagttcctgaggctaggttttgaatagaccgtgtataacatgatataagcaccgtaatcattttggaactgattagttttttttgttttgcatcatgataaaaagaaatcatgggggaccgcccccttgggactc

SEQ ID NO: 10378 - DNA, 909 bp, Triticum aestivum
  Clone ID: PAT_TA_10378
gtctgactcgtctccacctctccgccggaagaacccggcgagggccagcgccgtacatatatcccgacctcagcggaaccctacctttgagaaaccccttctccgtcactatccaagctctgcctgcaccgccgccattactactagaggaagcttcaactgttgtgctcttgctctctagctaatagtggttgctatcggtgctactaccgccgccgtccaaaccctagccctgatgccgcagcaggaggtgcccgaccagatcgccgtagggtggttcgcggtggaggcgccggagcgaacggggagtcttcagaggagcggctccaacagccgcctcaacgcgcaggcgccggaattcgtgccgcgggtcgcggcggtggttataccgctctatccaccgtcggcagtgattcttgggttcggggttccttcgcctccacttatccccattattcttgtgtgctccgtgatcctttctgttcattcatatcgttctccctgaccagagaggactgtggtgcgtgacgtaacccactacatgactctctggtcacgctcccctctcactcttcgctatctttcttgcgcaccccctcccacgtgcaatctttcgtgtgacctctcttgtcttcggttcattctcactaatcctctgactcgctcttccatttcctcttcctcctcgctctgccactctttgtccatgtcgtgcctcggccgtcacgtcacgtcttgcttagcccttgctctctcaatgcacttctattctcgtaatgacaaacagtatgttgtcccgctctccgcgtgcatatccacctctcaatttccagcggcaccctgcgacgtatatcacctatcatactcgccgactggctctcgacgtatcccactcatcctctccactct

SEQ ID NO: 10379 - DNA, 388 bp, Triticum aestivum
  Clone ID: PAT_TA_10379
cccacgcgtccgcccacgcgtccgggcgtatctcgtcgggctcttcgaggacaccaacctctgcgccatccacgccaagcgcgtcaccatcatgcccaaggacatccagctggcgcgccgcatccgaggggagcgcgcctagatcaagcatctgccttagcaacttccatcgctggattgcagcaatgtagctgtctgttcgtcgcctctggtttcagatcgtgttggcaataggcgacttttattttgctgtaaaaaaaaattctggttggttacagagttacaacgactcattttcttatttcgtctaaggcttgtgctaaaatgcaaaacaagttactcgttgttttatagcaattctgtaatttcagcgctcaaaaaaaaaaaa

SEQ ID NO: 10380 - DNA, 778 bp, Triticum aestivum
  Clone ID: PAT_TA_10380
cggacgcgtgggcggacgcgtgggcggacgcgtgggtgcctgcctgcgccggacggagccaccccacccaccaaagcgatccgccggaccggcgagcggcgagcggcggagcaagggagagatggcggcgacgggggaggagacggtgcgtgcgtcgcacatcctgatcaagcacgaggggtcccggcgcaaggcgtcctggaaggaccccgagggccgggtcatctccgccaccacgcgcgccgacgccgccgcgcgcctcggcgacctccgcgcccagatcctcgccggccgcggctccttcgccgacctcgccgcgcagcactccgactgctcctccgcccgccgcggcggcgacctaggcacctttgggaggaggcagatgcagaagcccttcgaggacgccacgtatgctctcaaggtgggggagatcagcgacatcatcgacaccgagagcggggttcacatcatcctgcgtaccgcataaggagaaagaagaagcccacgccgtcaccgtcacagcaccctctgatgttatctagcccttttccttcttccagggcctgcggctcttctcattctggcagccccaagcttgaatgaagaaaaatgtcttgtatcgtctcaccattttgctacggccatttgagctggttgataccatcatcacaggtcaatgtttgagcttatgatgtcttgatcgggaaatgtggaaatgtttttttttcttcatttcatctgtgataaatcatttcaaatgaatgttgtatgcaccatg

SEQ ID NO: 10381 - DNA, 734 bp, Triticum aestivum
  Clone ID: PAT_TA_10381
acaggcaggcaggaggagtagccgagtggccaacgactccctcctcctccacctccccccttcgcaccaccggcctccaccgagaccaagcacacgccattcccctcctctcctccgagctccgagagatccccagaccctacgcgcgagttcccatggcagcggcccagctccgcggatcggcggtgccggggacggcggggaggtggccggctccctccggcgccatcctccgcttcgcgccgctcgccacgtccaggctcccggcagcgtcgcttcgtcagaggggagccttcagtggcctttccgctggtgtcgtcagggagcttatcgccttgcagtcattgactacaatgtgcatgaagtcaaaatgtactagcactcccattgatcatgccactgctcctgagcatacagaagatgaagttcccgagccaaccgctgtggtgactgctagtgaagagataaatatagaccaggaagttgctccgccacataagagtgccataatacatgatttctgcctagggatcccttttggtggattattattttccatgggcccttgttggatttctattttggaggagtcctgtaagtcttacttttggcgttgcacctggtcttgctatattgggacttgccgtgcttagtcttaagggttggagggagtggaaagtccagcttgccatttatactggcacaagcagctgttgctgctgctgtagcatgga

SEQ ID NO: 10382 - DNA, 850 bp, Triticum aestivum
  Clone ID: PAT_TA_10382
tcgagttttttttttttttttttacaagatgctcatatattaccatcagttccatcaccaacgtacatgcgcgagaatacgtctccctgagagaacaggagacacaagaaaatactagtggtgagattctacaagggaaaaatatgtttcatcacacgtactgctcacatcgacagaatactatgacgaccaacggccctcagcagaacagagctgagccaaacgtacatactgcaacatcagtggccgccgccgatcccgccaccgccacctttgccgatcccgaaaccgaatccgcctcccttgccaaagcctccgccaaaaccgccgcctccgccgtctccaccgccaaagccgccccctagtccaccacctttgccaaaggccgccaccgagacccccaccctttccaatgccaccaccgagtccatggccgatgccgcctccggagcccgcctccatttccaagaccaccaccattgccatacccgccaccggcaccaccaccgagtcctccaccgttgccgatgccgccgccaagacctccgcctttaccgaatccaccgccgatgccgtggcctatccctccaccaagaccgccacctttgccgatgccgccaccaagacctccacccttaccaaatccaccaccgagtcctccgcctttgctgatgccaccgccaagacctccacccttaccaaatccaccatcgagtcctccgcctttgccaatgccgccgccaagacctccgcctttaccaaaaccaccgccgatgccatggcctattccaccaccaagaccaccacctttaccgatgcctccgccaagacctccacctttaccaaaacc

SEQ ID NO: 10383 - DNA, 931 bp, Triticum aestivum
  unsure (1)..(931): unsure at all n locations
  Clone ID: PAT_TA_10383
tcgtcatctaattaatgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagccctcacgggcgcaagtgaaataccactacttttaacgttattttacttattccgtgggtcggaagcggggcatgtcccctccttttggctccaaggcccggtcttaccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttaaatcttccgggattttgaagctagaggtgtcaagaaaattaccacaagggataactggcttgtgggcaaccaagcgttcatagcgacgttgctttttgatccttcgatgtcggctcttcctatcattgtgacacgcttccaaatcgatatgtcaaagtaccctattttggcaaggcttcaagatgcttacaatgagcatcctgcatttcaagccgcacttcctgcgaaccaaccagatgctcctccatcccagtgaagtaatcaggaccttgatgactgtaagatttttcatgtttgatcgagattctatgatgtaacttcaaagtcagatgttcatgtaagcaaagacccctggatgagcttgacgatgttgctgtaaaagnaataaatgcaatttatcatatgtgctctgtaaaattcnagnatcaataaagagaaggaa

SEQ ID NO: 10384 - DNA, 859 bp, Triticum aestivum
  Clone ID: PAT_TA_10384
gcacacagcggcttcttctccgttggcggcggcggctagggttttaccacctccaaaaccctaatctttccatccaatccaatccgtccgtcgtccatgccggcggcctcctgctagattcgctcacgccggagtttttttcagctagtttgagtgcttggtgtggtgcggcgcggcggagatgacgtccaaccagttcgatctccccggctcccccgacgcagcctccgcccgctcccaccaccccgccgccgtcgccccccgccaccccgccggcatcaacggccatgtcgcaacacccgccacacctcctccgatggcgaccccgccgtcgatggcgcccacgacctccccgaccgtcgccccgacgacatcgcccaccgcgacgccgtcgatgtctccgaccagccccaagacgacctccccgacaagctccccgacttcgtctccctcgctcacgcccgcaggcacgccggtgacgggacagcagcgcctcgagcgcgcgcggcggccgggcgtcggcgggcgctggtggccttggcgagcggcgggcctcgccgtcttcctctgagcagcaggccggtgcatgctgtgtcctccttcccgcgcgtcgctgcagctttcttcttctttcgtgtcgttatttaatttttaccggtggtactactacgatggatcgattcttgatgatgcactacgatgatgcattggttgtccgtcccgtttttccttttgatgatcggcgggtggtggttggttaagtttagtgcatgttccgctctgtactgtacgtgagttaccgctccattttggttatatagagaggattttgtgtataaaaaaaaaaaaaaaaaactcg

SEQ ID NO: 10385 - DNA, 692 bp, Triticum aestivum
  Clone ID: PAT_TA_10385
gggcgcaagtgaaataccactacttttaacgttattttacttattccgtgggtcggaagcaagagctagaaaagctgctgcaagaccaggaagttatgaggacctctctattgcaatggtgctatgcaagctacagtgaggtatttagctcctggatgcatttctctgctgttcgtgtcttcgtagagagtattctgagatatggtctgcctgcacggttcctgtctgttgtcctagcaccatctacaaagagtgagaagaaagtaaggaacatcttggaagggctatgcggcaatgccaacagcagctactggagatccgaagatgacgtgggcatggctgctggcctgggaggcgagacagagtcccacccttatgtctccttcaccataaactttgtctgagcgtgtttgatgtatattattttgtgacaccaattctttcatggtaatgtcggtttcggtttatacttctgtagcagatgatccgcgccgatcaataatgtagtgtttcggagaacctcgaacgtatcctggcacaaagtgggacttctcttttttttgttcagctacgctgttacaactgtttactttttgtgcagtgttgtattaatgggtacattattgtaatttttgagtaacaagaatctaaataataaaatcaaggtgaataagcaaaaaaaaaaaaaaaaa

SEQ ID NO: 10386 - DNA, 464 bp, Triticum aestivum
  Clone ID: PAT_TA_10386
caagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgctgacgaagggggggggaagggaaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaaaaaaaaa

SEQ ID NO: 10387 - DNA, 1086 bp, Triticum aestivum
  Clone ID: PAT_TA_10387
ggcgtcggcggctgcggcggaacctccccggcgatcaccggactcaccccggcaggcaaagcaatgaggaggtacagtccccaataccggagtcccccaaggaggggatatggtggcagaggtagaagtcccccaaggaggggatatggaggacggagggagcagggttcaggaagcctcttggtccgcaacatcccattgagctgcaggccggaggatctacgggttccttttgaaaggtttggtcctgttcgggatgtgtacctgccaaaggattattacaccagggagccccgagggtttgcatttgtggagtttgttgacccttatgatgcctctgatgcacaatatcacttgaaccacacagtattttttggccgagagataactgttgttgttgctgccgagtcacggaaaaggccagatgatatgcgtaatagggctagaatcagggggtattctggtgaacctgaaaggcgtcattcccgttatgggaggtctcgttcccgttcatgttcctactctcctcgctatcggggccgtcctcggtcaaggtcaaggtcaaggtcatactctcctgctccaagacggcgagatgactactctgcttccccgccaagatcacatcacacacagtctcctaggcgtctgccaaaaggacatgaagaagacgagcggagatcctattctcctgctggtagaggtggcggcgagcgtgatgccaatactaatggaaagaggtcaccaccatctgacattgatggatcacctccacgcatccggaggtcacccaggcaatcctcaggatcacccgtggggtcgcgctcaaggtcccctgaagcttctcctgcccgcagcgactgatgaaattggtgcctcccatattgccgcgtctcccacagcggcgcggccatctctagcttcattgtctgagtaaaacccatctgggatgtgttggctagtgttgcggtgcctctttagttagcagatatgactggttggctgttcttttgctgcttggtgttgttgaaccttgtaccatggtagtgttttaatgtgaactgagccacaactgagccacaattg

SEQ ID NO: 10388 - DNA, 1397 bp, Triticum aestivum
  unsure (1)..(1397): unsure at all n locations
  Clone ID: PAT_TA_10388
ttcggcacgaggctctgttgcgcttgcctctgctgtcgctgcggaagccgctgccgtcgctgcccaggccgctgctgaggttgtccgcctcacagcagtccccgcgggcacatcaaggacacctgtttgctcacaccttgcattgcacacaaacaatggcaagagttcaaacccaaatctactctagaagggtgaagatggaggaggaaaaacaggctcttcaaaggcagctccagttgaagcaccaaagggaacttgagaaaatgaagattgatgaagactgggatcatagccatcaatccaaagaacagatcgaggccagcttaatgatgaaacaggaagctgcactaagacgagaaagagcacttgcatatgcattttctcatcagtggaagaattctggtcgaactgtaacaccaacattcacagaccaagggaatcctaattggggctggagctggatggaacgctggatgtcagcaaggccttgggagaaccgagtggtgtcaaacaaggataaagacggtgctctgacaaagaatcccagcactaacgctgctcgaacttttgtgccccgtgctctctcaatccagaggcctgcaacaccaagcaagtcgagccgtccaccaagccggcaatcaccatcaacccccccatcaaagaacccctctgttgcaggtaaattcagaccttcaagcccaagagatagctggttatacagggaggatgacttgaggagcatcacaagcatacgctctgagcgcccaaggaggctgagcacaggtggaggctcgatccaggacgattcgagcctaacaagcaccccagctctccccagctacatgcagtccacaaagtctgcaagagcgaaatctcggtaccacatggtattcgccgacaagtttgaggtccctgatagagcatctctggtccactcatcgataaagaagcgcctatccttcccagctgcagagaaaccaaatgtcacacccgcagataagctgaaggaaagagcgaggcgccattcggatcctccgaaggtggatcctgcctccctgaaggatgtcaatgttgcctgatatgatcaatgaacgtcaggcgctgccccctatgattgctagatcgccatcttttctgtttttgtattctctagtttagattgctttctctcaaaggttgaaccccccgtgaaactgtatgatctgtccgggttgatttgagacgattctaactgtttgcagacaagaggtttttctctgtggattgtggtgtgtgatgctgcagagaaggaaatgtgaagcggtaaaaaaaagtgagagatgattgggtgtgtgcgtgacntttcaatggtacaattatgaagttttccttccangagtaatatgtacaataattgg

SEQ ID NO: 10389 - DNA, 1192 bp, Triticum aestivum
  unsure (1)..(1192): unsure at all n locations
  Clone ID: PAT_TA_10389
cagagctgctgaaatncagggcaacttggaagagctatatgtgatgaacgatggcatatcaggggaagctgcaaaagctctatctgagcttattccttcaactgagaagcttaaggttctccacttccacaacaatatgactggtgatgaaggtgctatgccaattgctgagatggtgaagcgttctccaaacctagagagcttcaggtgctccgcgacaaggataggatctgatggtggagtggcactggctgaggcattagggacatgtactcgtctgaagaaacttgatatcagggacaacttatttggtgtggaggcaggggtagctctcagcaaaacccttccaaagctcagtggcctcgttgagctctatctcagtgacctcaatcttgagaacgagggtacaatagcaatagtgaatgtcctcaaacagtcagcacctcagttggaggtccttgaaatggcaggaaatgaaataaccgccaaagcagccaaagctgtagcagaatgcttgacagcaatgcagtcgctcaagaagctgaccttagctgagaatgagctgaaggatgatggggcagtgacaatcgcaaaatctctggaggaaggccacccaagtctgaaggagctttgacgtgagcacgaatctgtttcagaggtctggagcccggtgctttgctcaagctgtcgcaaacaagccaggtttcgcgctgctgaacatcaattcgaatttcatctccgacgaaggggttgacgaggtgaaggagatcctgaagggaggcaagaactcgctggaggtgcttggcctgctggatgagaacgaccccgagggcgaccctgaagatggcgaggaagaggaggatggggaggacgacgatgacgaggagaaggacggggacgataacggcgacggtggcctgggctcgaagctgcagggcttgaaggtggaggaggactagccatgtctatggactatggtggtggactagcccctatatcttttgctccggttaccttcttaaatgatcactggaggggttaaaaattttcacatgaagagaactcactgtggctcaattgttttgaaccgggtcaagcacaagcagccagttgggcggtttatctgtacttctgtactaacttccgttgaacattttttcttcatgtttttaacaaaaaaaaaaaaaaaaaa

SEQ ID NO: 10390 - DNA, 1054 bp, Triticum aestivum
  Clone ID: PAT_TA_10390
ttgctgctgctagcatgggatgttctgaggtgataaaatgtctatgacagtgtagttgtctgattgtcagtgtggattgctgaatcatgagacacgctgatcgacactgcttgagataccgccaaaagggttatcttctcctgggtactgtttgagagaggagaaaagggaggcgactcgaggtgcgagttggggctcggcccgatcccgggcgctcgccgccggtgctaccggttggagagaagatgggggaggtgcccgcagctgtcgtgtacatactagttgtagttgtgctgtttccttagtggagtttggctttatgccggagcttggcgtggtgccgatggggattgggtcgccggcgcgagcgagccgcatgcggtggctactggagtcggttcttaaggtagtggcgatggagggcttgctactgccgactggatccactctggtgtcccagggaataagctcgatgcccctgatctggcggaggatcttgctgttgtcccctgcctcggaggccatcatggtgatggcgaagaggtggccgacgcttgcaactctggagcttgcaggttgggatgctgcggatcgggctgtggatcatcagcagtggatgatttgttggcgaagcgatggcgcctgctgtggcggtcgatggcctgctctcaccggctcgcctctgtttcttctggccgaagggcggtcattcaaattcctcccggcgatgaagcccaaaggaaggtagctcttttcttccatggagtctatggcgtggtgctatggagctttcgtcggcccaagtggtctcgtccccagtgttggccggaagttttccgtcgaggagcagaataggacccgatcgcgtttcctttcctctgttccgggtccttttcgcaaagtttagggactgtttagtagttccagttttcttttgggtctctgttgtaatatgtgctttcatgtttatccaataaatatctagggccttctgggcccgtgtctgttaaaaaaaagacactgccggagattcaatcatgcatgctccgtactc

SEQ ID NO: 10391 - DNA, 701 bp, Triticum aestivum
  Clone ID: PAT_TA_10391
gcccctccttttggctccaaggcccggtcttaccgggccgatccgggcggaagacattgtcaggtggggagtttggctggggcggcacatgtgttggttcttctgagtgggaggaacttcatgaaggagaaggtgaaaacaagtggtagctttgtgcttagaagatttggtgcgtttgacttcgccaagcctggttccgggaaaggtatgaaaatcgaggacctagatttcaccgaggaagaaatggagatgtatgtggatctccatccaatcacaaacacttcaccgtacacggtggtcgaaacaatgtcgcttgcaaaggctgcagtcctgttcagggcactagggctaagacacctgctggttgtgccaaagaccccagggagatttcctatagttgggattctcaccaggcacgatctgatgccggagcatatccatgggctgttccccaatctccgcaagtcacattgagaagtaaatcagcaggccatacaacattttcttgctgtattgttatttctcatgaaggtgcttcttcattggatcatggaataatcaatctgatatatttattgtaaaaagggctgattccctgatcagcagtcgagtggatttcattttgtcagcctgtgatctttgtgtaacaaaacaatcctctccttgtcagtacatgttctctctttttgcttcaaaaaaaa

SEQ ID NO: 10392 - DNA, 910 bp, Triticum aestivum
  unsure (1)..(910): unsure at all n locations
  Clone ID: PAT_TA_10392
gcaggcaggaggagtaggcgagtggccaacgactccctcctcctccacctccccccttcgcaccacgggtctccaccgagaccaagcacacgccattcccctcctctcccccgagctccgagagatccccagaccctacgcgcgagttcccatggcggcaacccagctccgcggatcggcggtgccggggacggcgaggaggtggcgggctccctccggcgccatcctccgcttcgcgccgctcgccacgtccaggctcccagcagcgtctcttcgtcggaggggagccttcagtggcctttccgccagtgtcaccagggagtcattgactacaatgtgcatgaagtcaaaatgtactagcactcccattgatcatgccactgctcctgagcatacagaagatgaagttcccgagccaaccggctgtggtgactgctagtgaagagataaatatagaccaggaagttgctccgccacataagagtgctataatacatgatttctgcctagggatcccttttggtggattattattttccatgggccttgttggatttctattttggaggagtcctgtaagtcttacttttggcgttgcacctggtcttgctatattgggacttgccgtgcttagtcttaagggttggaggagtggaaagtccagcttgccatttatactgggcacaagcagctgttgctgctgctgtagcatggaagcactgccaggcgtatgccacaacaaagaagctgcttccctgggggctttaatactgcgctcatgtccttgatgatctgcttcaacccgtacgtgttgcttaccggggggaacccacaacaaaagaagaaccacaactctatataatttganctttnactccnatggttttnaaattgtgcnccggnaaatgtt

SEQ ID NO: 10393 - DNA, 863 bp, Triticum aestivum
  Clone ID: PAT_TA_10393
gtggagatcttgttgagctgtacctcagcgacctcaatctcgagaacgagggcaccatagcaatcgtgaatgtcctcaaagagtctgcacctcagctggagatccttgagatggcaggaaatgagattaccgccgaggcggccaaacctttggcggaatgcttgaccgcaatgcagtcgctcaagaagctgaccttggctggatccaagtaggttattgtgtgaagtgccacgtgtccacatggcttcagcggcgcaagatttccagccccggacattctccatcaaactgtggccacctagtgaaagcactcgtctgatgcttgtagagaggatgaccaagaacctgtcctccgagtcaatcttttcccgcaagtatggccttttgggcaaagaagaggcccataagaatgccaaaaggattgaagagatgtgctttgcttctgcagatgagcatttcaaaaaggagcctgatggtgatgggagttctgctgtccagctatatgcaaaagaaacaagcaagctgatgctggaagtcctgaaaaaaggtccagtgacgactgcagaaccagaagcgcctgttattgatacacctattgagcctgctgatactgtgtttgatatatctggtggcaagcgtgctttcattgaggcggacgaagcaaaggaactcctgagtccactaacagaaccaggaaactcatatagcaggatttgcttgagcaacaggagctttggtattggtgctgccaatgttgctgggccaattcttgaatcaataaaatctcagctcaaggaggtagatatctcagattttgtcgccggaagacctgaggatgaagcccttgatgtgatgcggatatt

SEQ ID NO: 10394 - DNA, 604 bp, Triticum aestivum
  Clone ID: PAT_TA_10394
gtcccctccttttggctccaaggcccggtcttaccgggccgatccgggcggaagacattgtcaggtggggagtttggctggggcggcacatctgttaaaagataacgcaggtgtcctaagatgagctcaacgagaacgagcccgaggggaaccctgatgacgaggacgaagaggaggatgatgatgatgaggcaaagtatggggacgataatgggaaggatgctggtctcggctcgaagctgcaggacctgaaggtggaggcggaggaggactaggcccgccactatcttttgctccggtcttgggttctgaaatgtttggtgtaccggctggaatttcgcataaaagagaaggaacacctcgctgtggcccggctcaattgattttgaaccgagccaagcggcctgttgctgtggtctggcggttcggtttatctgtaactttgttggaacttcctttcatgtttttagcaccgtcttggttctgtgggagaacttgcgtggtcaaggtcaagcctggaccctttaaaaatttaaatccgtggaatatttggcatggcatgtgtttgtttgctgtgatatgctgggaacctatctatgctgtg

SEQ ID NO: 10395 - DNA, 922 bp, Triticum aestivum
  Clone ID: PAT_TA_10395
aatattcctggagaagccagccaaggcggcgtactcgaataagaaccctcacaatgagagcgaagctggagatgccagcagctgggagacaataagccatgaagagatgcagggttcaagtggttcacccgacggaagccggtcgtcaatcaacaagatcttcgacgggagcatctcctggacgagcagaaacgatttcgagtacggggagatcgagaagctgaaggatgatctggcggacgcatacctgacgaccatgactcagcccaagaagaaagaatcagccatatcaaagctctggaagtcatctcgcccaaagaacagcgacgtctccaagaaggatgccacggaggcactgaacggcagatcatcgaatgtgcggctgtcggtcgggaccaattccaccatcgagagcggcgttcaggatatcggcctcagctcgccgagcgtggggcagtggagctcgccggactcgatgaacatccaattcaaccgcggcttcaggggctgcatggagtacccgcgggcgtcccagaagcacagcctgaaggagaagctcatggaggcgcggatggtgagccagaaggtgcagctccgccaagtgctcaagcagaagatctagaagcgccagaaacacgaggcgaaaccggtgcaaagcctagaagaaataatcttggaaattacttcgcagcttcatttttttcttgttgttgtcttagggtcacttgtaagttgtaattgatgtactagtaaagaaccgataatagatcaatcaggtcggcctttgtgggccgtgctgcttctgtatcttgccgtagctctggggatatggttgcatttggtaggctgcggggagatccggcatgatgtagtatagacataaacatgcagcaatgttcagacaaagttcacgtccaaaaaa

SEQ ID NO: 10396 - DNA, 859 bp, Triticum aestivum
  Clone ID: PAT_TA_10396
gttgtactcctggaaatactgaggcaaccactttagaagcaagcagaaaccctatgaggcgtcaggttgctaatccaacaaggcctacaagaacgctgacctctttgactcgtgctgtgaggagagggggtgaaaatgcaggagccgatggcaatgggaattctaatgacttctcaacaaagttactccatcttgcgtggcacccaactgagaattccattgcgtgtgctgctggaaatagcttgtacatgtattatgcatagggaatgtgctagagaagattcactgtttttggtttgttcaacgtgaaagcttgggccttgcacatgcaaccaggaaaatggtcgtcaattccgtgattgggggtcgaaagaggcggttggcacccacgagatcaactccaagcatagcagactatttccttgtgattctttagtaaatgtgaaacacaaattctaatcgcaccaaagtttttgggtcccaagatatgattgtagctgcatgtgtagccaaaacaccagcagttggaggacaaagcagaagatagcaaggctgattctaatttcacttggtcacaggaaatatgtgcttacggtggacgcaagaaatttgcttgtcttgaaatgtaatgtaatgccgcgtagccagggttaaccatctgctgtcaccaacggtgaaacatgtgtggacataaaaagtattgacttgtagttctccccccttgttctatatgttggtggtccagacttgcaataagtttgcaactcgtgctgcatgtgatggggctgtgaccctaagttgtatatgctacatttagccatgcaaaactcacaagtaatgatatgaattcctcagtatt

SEQ ID NO: 10397 - DNA, 453 bp, Triticum aestivum
  Clone ID: PAT_TA_10397
aagctcaccgacttcgtctcccactctggcgcccgcaggcacgccggtgacggacagcagcgcctccagcgcgcgcgcggccggcgtcgcggcgctggtggccttggcgagcgcggggcctcgccgtcttcctctgagcagtcgggcggtgcatgctgtgtcctccttcccgcgcgtcgctgctgcttttttcttctttcgtggcgttatttaatttttaccggtggtgctactatggtcgatcgattcttgatgatgtactacgatgatgcattggttgtccgtcccgtcccgtctcgttttccttttgatgatcggcgggtggtggttggttaagtttagtgcatgttctgctctgtactgtacgtgagttactgctccattttggttatatagagaggattttgtgtaaaaaaaaaaaaaaaaactcgagacctcggccgcgaccacgct

SEQ ID NO: 10398 - DNA, 707 bp, Triticum aestivum
  Clone ID: PAT_TA_10398
gccggccgggttcgggactcaaatcttcccaacccccaagcaccagaacctcctcaacctccccgcgcatcgacgacatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctaggctgctgctgcaatccatatccatgcgtcgtgtcagatagatctctgttaggctgtgtttcagaatgtgcgtcgtgttagatccatgttagaaccctgttcctctcgtggtgggtggatgtgttatgcctaatctggtggtaccttcttgttgccatcagcaatggaaatgaaaatgtttgtccctgttctcataaaaaaaaaaaaaaaaaagccccta

SEQ ID NO: 10399 - DNA, 954 bp, Triticum aestivum
  Clone ID: PAT_TA_10399
gaattcactagtgatttcgagcggccgcccgggcaggtgagagaactagtctcgagtttttttttttttttttctgcaaccaacagcctttgtcaccgtcatcatcaacacacaacgatgggccaaaacagtgttaacaccttggcatttgtatggcgaatcctatcgtcgatacattgaaattaagcttaactttctgcaaacaaactaactgctgactcgcttccccctacggtttattccaactctttagatgctctcttaatcttaacagtctactgaagagtgccccatacagaaaaccgctcactcatgacggacaagtccgtccgcccttgggtcggcaaagaagcttcgacgtgatggactcagagggcgacaccgtgagtccaaggggctggctctgacggacggcaatgccccaacaaggctcaaccactgccagtttcggtgacgatgcaatcctcctcctacgcctcggtctgcccctccttggtgatatggaagccttcgatcttacgggcgacgtcatttgccaccgcatttgccaccgcggcggccttaggtttgccgttggcgttgggtgcctccgtgtcatcggcgtttgcagggttcagcggccagatacggatggtgccgtcttctgatcctgatgcatatgattcgccaacaggcgcaaaccggacgcagtggacaggtccatgatgacctttgttgcaggctatttcttcaccagtgaagaaatcatatacatgaacccacatgtcttcccctccagtgatgaacttactcccagactttggttcaagtgaagctgactccacagtgcatgacatatcatagcttttaacagcccaaaatggttcgcatcccaaaatttaacacttgagccatcagctgtagtgatgaacctgccatcctggcttacttctgcactggtgacaggtgccttgg

SEQ ID NO: 10400 - DNA, 962 bp, Triticum aestivum
  Clone ID: PAT_TA_10400
tctgcaggcaattcggcacgaggcacatcacttccccctctcccccctcgcctcgcccctccccgactcgatctccgtcgaccgccgcggcatcaccgcccgcccagccgcccaccccctggggaggacctcctcacccccatcccgatccccgatgcgatgccctcgcggcgtgatcgcgtgagcacggcacaatgaatcccagagattccgacgacgaccgccccggggcggcggcgggttcgtcttcggcggccacggagcagcagcagcagcagcaatcgctcgagtggaggttcgcgcaggtcttcggcgagcgcgcggcgggcgaggacgtgcaggaagttgacatcatctctgcaatcgagtttgataaatctggtgatcatcttgccaccggagacagaggaggacgtgttgttttatttgagagaacagatgttcgggatgagcatgctaatcgaagagaactggagagacaggatgttccaattactagacatcccgagttccgctataaaacggagtttcagagtcatgaacctgagtttgactacctcaaaagtttggaaatagaggagaagatcaacaagatcaagtggtgccagacagccaacaatgcactctttctactgtccacaaatgataagacgatcaaatactggaaggtgcaagagaaaaaagtaaaacaagtttcagttatggctttggacacttcccgaactgtaggggatggtaccactagtcgtgcaagtaccagtacttccgagcctcctcttccaaatggtggatgttcaaaaaagtctgatagcctcaacagtgatctcctatttccacctggaggttacccatcgctgcgtttacctgtggttactagtcaagatgtgaacctttgtgctagatgtcgacgtgtatatgcccatgctcatgattaccatattaattctatttcgaataatagg

SEQ ID NO: 10401 - DNA, 683 bp, Triticum aestivum
  Clone ID: PAT_TA_10401
cccacgcgtccgcggacgcgtgggccggaaccgaaacgagacgcacgccccacgccgactccgccgttcgctcactccctcgccacccttcgccgacgcgggcaagagaagaagcggaaagagagaaagcgtcccccaccccgcctggatcccgcgagcgggcccatgtcccactcgacactgctcgtccggccgccggcgccggcgaatccgtcccttccgcctcgccagtgcgcgcccgtatccgcagcggcggcgacgctacgcacgtctcctgccgcctcctccgtggctcagttctctaggctgcgcaccaagtgcaggtttgccgcccccggtgtcagagaagattactcttctacgccaatcgatgtcgtagcagacgtgaaaacagaaaagattgtagtgttgggaggtagtggatttgttggttctgctatatgcagagctgcggtagctaaaggcattgaggttgtgagcctcagcaggtcaggaagaccatcttactctgatccttgggctgatgaagttacttggctagcaggagatgttttctatgcaagatgggaggacgtgctagtaggggctactgctgttgtgtctacccttggaggatttggtaatgaagaacagatgaaaaggataaatggtgaagcaaataccatagcagtggacgctgcgaa

SEQ ID NO: 10402 - DNA, 1134 bp, Triticum aestivum
  unsure (1)..(1134): unsure at all n locations
  Clone ID: PAT_TA_10402
cattccccttcgcacccccgcggcggcggagccttcccgggcgctcaccggacacgcgcaaaaacactatgaggaggtacagccctccacaccgtagtcccccgaggaggggatatggcggcagccccgcacatcgtagtcccccaaggaggggatatggtggcagccccccgcaccgcagccccccaaggaggggatatggtggcagaggaagaagcccccctaggaggggcggatatggaggacgaaaggagcagggttctggaagtctcttggtccgcaacatcccattaagcgccaggtttggtcctgttagggatgtttaccttccaaaggattattacagcggggagccacgagggtttgcgtttgtggagtttgttgacccttatgatgcctctgaggcccaataccacatgaatcgccaggtattttttggccgggagataactgttgtgcttgctgctgagtcacggaaaaggccagaggatatgcgcactagaactagagtcagggggtactctggaggtcatgaagggcgccgttcctctcattatgggaggtctcgttcccgttcacgctcagcctctccccgccctcgtggcggtggccgtgctcggtcaaggtcataccctcctgctccaagacggcgaagatgactactctgcttccccacggggaagggagtctcatcgcacgaaatctcctgtgcgtcatccaaaagaacatgaggaggacaaaaggagatcctactctccccctggtagagatggtgaccaacgtgatgctgataatgggaggtcgccaccggccgacagtgatggatccccttcacgcccaagggtggccaggccatcctcaggatcgccccctggatcccgctccaggtcccccgacgcttctcccgcccgcagcgactgagaaattggttacattctctgcggtcgccgcatctccatctagctacttccgctccattggttcgagtaaaacctttcgaggtgtgttgtattgcttgttagcggtcacagacgttatgttcccgcttgttgctgttgaatcttaaggcctgtagcatggcgtgtcagtcatatctatgtacatgtgtgttgattgtcaaggaccaaaanaaaa

SEQ ID NO: 10403 - DNA, 603 bp, Triticum aestivum
  unsure (1)..(603): unsure at all n locations
  Clone ID: PAT_TA_10403
attaaccctactaaagggaacaaaagctggagctccaccgcggtggcggccgctctagaactagtggatcccccgggctgcaggaattcggcacgagcagcttctnttnctnctnccgcagcgcctcctcgaatccaagagatcaagtcgctgttgttgtgccactccccctccagccgccgtcatgcagaacgaggtgggtgacatggtggacctctacgtccccaggaagtgctcggccaccaacaggatcatcacggccaaggaccacgcctctgtccagatcaacattggtcacgttgatgagaatggcctctatgatggccgcttcaccacctttgctctctctgggttcgtccgtgctcagggtgatgctgatggctccctggacaggctgtggcagaagaggaaggctgagatcaagcagctctagatgttgctagtagttttacctggaacttgtgtccttcccatgtctacctagctcttggatgtctgtggttggtttcagttgctgctatggaagctaagacttgatgtcacttggcctggtttattgtgaacatgttttgagttgaaaaaaaaaaaaaaaaaaggccccta

SEQ ID NO: 10404 - DNA, 747 bp, Triticum aestivum
  Clone ID: PAT_TA_10404
acagatagtacaagttgaattgctagagattgagctggatgtatatatcatcggagctcatccggtagatcgagagaagagccatgaaactatgcaaagggcgggtcgatcgagaagaaaatgcggggggcacgtaagcagctagctactgatccccttgctccgcgccgcagttggtgatggcctgctgcaccgcccgcctgatgacatcctcatccacactccccgcctggttctctcctccccccacggcctctaggcggaacgtatcggcgcaagacgccgtggcctggagcacggtgaggcccagctcctcgaatgcctctagcacggcgacgagcaacccggggcagctcttgtcggaagacacgttcacgaggaacccatgccctagggcttccacgctcaccgtggggaaagagttctgcttgtgcgagtgcgtgccttcctcgcgtgcgatctcctgattgagcctcgcgatcttctgcttcagccccttgatgtactccgacgcgtccatgactatggatggattgctcagcgcgtgggagtgagtgatggaccgcagaatctgcatcttctcctgtagagcagctgccttcttgcgctccctcgacattatgctcctctctctctctctctgattgtctctgcagttaatcctccacgtactaattctatatatgaaggctcgcttgaaatggagagagagagagagagagagagaaagagtcgacgcggccgcga

SEQ ID NO: 10405 - DNA, 861 bp, Triticum aestivum
  Clone ID: PAT_TA_10405
ctccgtactactgtttccccagagaaaacaaattgggcggaattgggatgcggaaggaggaggcagccatgtcggcagcaacggggaagccgatcctgtacagcaaatggttcagctcctgctcgcaccgggttcggatcgcccttaacctcaaaggtgtggattttgagtacaaagcgaccaacccgatgacagatccagattatgagaaaatcaatcctgttaagtttgtcccagcattagtggatggggattttgttgtttccgactcgttcgccatcattttgtatatggaagacaagtatcctcagtgtcctctcttaccccgagatctgaaaaagaaagctcttaatttgcagattgcaagcatagtgtgttcaagcatccagcctcttcagagccatgctgtcatcggttcgtatcttggcacaatggacaccaatgagagccttcagatggttcaacattatattgacaaaggcttcagagcgattgagacacttctggaaggatgtgacagtaaatatgccaccggagatgaagtccaaatggcagatgtgtttttggcgccccagatccacgctggtgtgacacgcttccaaatcgatatgtcaaagtaccctattttggcaaggcttcaagatgcttacaatgagcatcctgcatttcaagccgcacttcctgcgaaccaaccagatgctcctccatcccagtgaagtaatcaggaccttgatgactgtaagatttttcatgtttgatcgagattctatgatgtaacttcaaagtcagatgttcatgtaagcaaagacccctggatgagcttgacgatgttgctgtaaaagtgaataaatgcaatttatc

SEQ ID NO: 10406 - DNA, 1334 bp, Triticum aestivum
  Clone ID: PAT_TA_10406
ttttggagcaagttaaaggcattcagaatgcatttaaaatcacaaatccaatcacaattgtggctcagttgtggctcggttcacattaaaacactaccatggtacaaggttcaacaccaagcagcgaacgaacagccaaccagtcacatcttctgctaactaaagaggcaccgcaacactagccaacacagcccagatgggttttactcagacaatgtagctaagaggtagagtacatggccacgccgctcctgggaggcgccaattttctcagtcgctgcgggcaggagaagcttcgggggaccttgagcgcgaccccacgggtgatcccgaggactgcctgggtgacctacggggtggtggaggtgatgtcggccggtccgcctcacggcgagcaccgacctactcgacccttcggccggcatcgcgctcctagccttaattggccgggtcgtgtttccggcatcgttactttgaagagaagagagctgctcagaaggctgccgttgaggcatataaacagctattagaagaagcatctgagggcatcgattcaaaaccaggttaccaggatttcgaaagaaaatggggtgctgacccaagatttgtagccttggataaaaaagaaagggaggctcttttcaaggagaaggtgagggctcttgaagagaaagttcaatcagcgcgaaatgctgtcataactgacttcaaatcaatgcttcgagaatgtaaggatataatcccaactagccgttggaccaaagtgaaagaaaatttccggagtgatccaaggtacaaagctgtaaagcacgaagagagagagaatgcttttaatgaatacatagcagaacttaaatcagctgaacgggaagtggagcaagctgcaaaggccaaagtggatgaacaagccaaattaagggagagggaacgcgaaactcgcaaaaggaaagaaagggaagagcaggaaatggagagagtaaaattgaagatccgaagaaaagatgccacgtcttcgtatcaagctttgcttgttgaaactataaaagatccaaaggcatcatggactgaatccaaaccaaaacttgagaaggatccgcaaggtcgtgctgtaaatccggacttaggccaaggtgaggccgagaagttattccgtgaacatgtcaaggacttatatgagcgttgtgtccgtgacttcagggcacttctgtctgaggcaattgccccagaagcagcaactcgaacaacggaaggaggaaagactctggttatctcttggagcgaagcaaaagagcttctaagatcggatccaaggcacctcggccgcgaccacgcta

SEQ ID NO: 10407 - DNA, 831 bp, Triticum aestivum
  Clone ID: PAT_TA_10407
cccacgcgtccgccgcccttttttttttttttttttttttttggacaaagcaatcattccatccgatctggcctgaaagaaagacaccagcgccagtaggccatacaacacacaacacaaacacagatacatactgatacagccacacactgctgcctgcatctttgtttcatctctgacaacaagctgaccatgtccatatctctcagctcaacgctaaaacaaagaagaaaacgaagaaaaagaaaaaaggaagtctcaaatctgcctgccgctgagccctggccatggatggccacagcagaaatctaaatctgaacagaggagaagatggcgctgacggtctgtctcttctactgggcagggcgcggcctcttgtaggcccccttggaggcgtcggaggcagcgggggcggagccgttggtgagggagctggagaaggagcaggagagggcgttgtagaggtcgacgacgcgggctatgttgctgttgagctcgcggatgagggcgacgttgcggctgaggccaccggcctcgagcgactcctggttctgggtgatctcctggatcagaatccggttcttctccaggatcgcctgcacctcggcgaagctccgctgcagcgcctgcaccgccctcccgttcgccgcgccgttgcccatccccccggctcctcctccgttcggaagcacctcccggccgctgctgttctccatcctccctgccccgctcgccctgatctaattctgcgtgcgggaggaagatgaatatcgaggaggggaggggggtcgtcacgcagagaacgagagagctcgtgccgaattcggcacg

SEQ ID NO: 10408 - DNA, 675 bp, Triticum aestivum
  unsure (1)..(675): unsure at all n locations
  Clone ID: PAT_TA_10408
gttctccacctcgcatggcaccctactgagaattccatcgcatgcgctgctgcaaatagcttgtatatgtattacgcgtaggaaattctctagaagaaatttatcgttcttggtttgccgcattgccccccctcaaaggccaggcccttccgcattcaaccagagggacagtgcagggcagtgtcagatactccctcggggccaaaagaggcagccggtgtccaagattgcctggttgctgtgctagcggactgcatcccgttgattcattagtaaatgtgtaaattatatgaaaagttttggtctcgcctcgctctcatcacagctgttgtgtcaccccaaatccgcagtcgaggaaacagatcaaaagatagaaagtcacctttgtgctggttccatggcaaaggacgggaccggatctgtgctgcaaggccttgtctgatttgttttatctctacatgtaattcagcatagacagggctagtcagctgtttagaacttcatttgtctggatgatagacgagtggtactcggtgattgtagctatatttgttctattcattggattgttgaagtaagtcagcaataaaaaaaaagggggggccggtaccaattcgcctatatgatctataccccgctcactggcgtcgtttaaaaannctgganggaaaaacc

SEQ ID NO: 10409 - DNA, 947 bp, Triticum aestivum
  Clone ID: PAT_TA_10409
tgagcccttattaaccctcactaaagggaacaaaagctggagctccaccgcggtggcggccgctctagaactagtggatcccccgggctgcaggaattcggcacgagcttctccgccactatccaagctctgcctgcaccaccgccattactactagaggaagcttcaactgttgtgctcttgctctctagctagtagtggttgctatcggtgctactaccgccgccgtccaaaccctagccctgatgccgcagcaggaggtgcccgaccagatcgccgcagggtggctcgcggtggaggcgccggagcgaacggggagcctccagaggagcggctccaacagccgcctcaacgcgcaggcgccggaattcgtgccgcgggtcgcggcggtggttccaccgccacagccaccgccggcagtgattcgtgtgtttgcggtgccctcgcctccacctcgcgcggctttctttgcggctcccccgcctcccccgtcgttcgagttcttcgcgccggtgagggttggcggtgcatttgtggccgaggagccagagccggagatggagcgcgcgacgccacctgttgctgagcccggcggtggacgggcttactgatgaggtggtgcagaagatcaccaagcaggtggagtactatttcagtgatataaacctggccactacggaacatctgatgagatttattagcaaggatcctcagggatatgtgccaatatcagttattgctggcttcaagaaaataaaagctttagtgcataataacccaatgcttgctgcagctcttcgtacctcgtcaaaacttgttgttagtggtgatggaaaaagagtaaaacgccgacatccatttactgaatctgatatgcaggagttccagtcccgaattgtagtggcagaaaatcttcctggtgatccttcttaccaaaatcttatgag

SEQ ID NO: 10410 - DNA, 792 bp, Triticum aestivum
  Clone ID: PAT_TA_10410
cccacgcgtccgcggacgcgtgggaaaagatctccgctttgccctgcctgcctgcgccggacggagccaccgcacccaccgaagcgaccggaccggcgagcggcggagagatggcgtcgccggcgacgggggaggagacggtgcgggcgtcgcacatcctgatcaagcacgaggggtcccggcgcaaggcgtcgtggaaggaccccgagggccgggtcatctccgccaccacgcgcgccgacgccgccgcccgcctcggcgagctccgcgcccagatcctcgccggccgcgcctccttcgccgacctcgccgcgcagcactccgactgctcctccgcccgccgcggcggcgacctaggcacctttgggaggaggcagatgcagaagcccttcgaggacgccacgtacgctctcaaggtgggggagatcagcaacatcatcgacaccgagagtggggttcacatcatcctgcgcaccgcataaggaggaagaagccccacgccgtcaccgtcacagcaccctctgatgttatctagcccttttccttgttccagggcctgcggctcttctcattctggcagcccgaaacttgaatgaatgaagaaaaattgtcttgtatcgtctcaccattttgctacggccatttgagctgcttgatacatacttacatcacaggtcaatgtttgagcttacgacgtcttgatcaggagatgttctcttttcttcattacatttgtgataaatcatttcaaatgaatgttgtgtgcatcatgaaaaaaaaaaaaaaaaaaaa

SEQ ID NO: 10411 - DNA, 1187 bp, Triticum aestivum
  unsure (1)..(1187): unsure at all n locations
  Clone ID: PAT_TA_10411
tcgcggccgcgtcgacctagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagaccctgttgagcttgactctagtccgactttgtgaaatgacttgagnaggtgtaggataagtgggagccctcacgggcgcaagtgaaataccactacttttaacgttattttacttattccgtgggtcggaagcggggcatgtcccctccttttggctccaaggcccggtcttaccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagatcttcggagtttgaagctagaggtgtcagaaaagttaccacagggataactggcttgtggcagccaagcgttcatagcgacgttgctttttgatccttcgatgtcggctcttcctatcattggttcgagtaaaacctttcgaggtgtgttgtattgcttgttagcggtcacagacgttatgttcccgcttgttgctgttgaatcttaaggcctgtagcatggcgtgtcagtcatatctatgtaccatgtgtgtggattgtcagggacccattttccatgtactttgtttgggaaaaagcttgtgagttgatccaaaaaaaaaa

SEQ ID NO: 10412 - DNA, 886 bp, Triticum aestivum
  Clone ID: PAT_TA_10412
ccgcctccagctcccagcgctcctccggcacccaccacgcctcctcaggcgccacaggccccggccacgccccctccggcgccgcaggctcctgccacccctcctccggctcccaccaccccgccggccacccctccacctgctcccaccaccccgcctccggctcctccgacgcagcctccgcccgcacccaccaccccgccgccgtcgcccccggccaccccgcctccagcgcccgccaccccgccgccatcaccgcccatgtcgccaccacccgccacacctcctccgatggcgaccccgccgtcgatggcgcccacgacctccccgaccgtcgccccgacgacatcgcccacgcgcgacgccgtcgatgtctccgaccagccccaagactacctccccgacaagctcaccgacttcgtctcccacgctggcgcccgcaggcacgccggtgacggacagcagcgcctccagcgcgcgcgcggccggcgtcgcggcgctggtggccttggcgagcgcgggcctcgccgtcttcctctgagcagcaggccggtgcacctgtgtcctccttcccgcgcgtcgctgctgcatttttcttgtttcgtgtcgttatttaatttttaccggtggtactacggtcgatcgattcttgatgatgtactgctacgatgatgcattggttgtccgtcccgtcccgtcccgttttccttttgatgatcggcggggggtggttggttaagtttagtgcatgttctacttctgctctgtactgtacgtgagttaccgctccattttggttatatagagaggattttgtgtatattttcagtgtacgtactccattatcatttccgtgcattcaataaattctccacgcagcttattc

SEQ ID NO: 10413 - DNA, 1197 bp, Triticum aestivum
  Clone ID: PAT_TA_10413
cccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaagctggtgcccgtgtcattgtgaccgagatcgaccccatctgtgccctccaggctctgatggagggcttcaggtccttcccttgggaggacgttgtctcctgaagctgacatcttccgtgaccaccactggcaacaaggatatcatcatgggtgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctgggcaagtatgagaagaaggtgtatgtgctccccaagcaccttgatgagaaggttgctgctctccacttgggcaagcttggtgccaagctgaccaagctcaccaagtctcaagccgactacatcagcgtgccgatcgagggccctacaagcctgcccactaccgggtactaagcacacggcttgcagctcactccgggcgttgtgtgctatgaattcgctacactggcctgtcaattacctttgcatgcatatcattatcatatacgcatcgcgtacaagtttcctaatggtaccctactaggg

SEQ ID NO: 10414 - DNA, 994 bp, Triticum aestivum
  Clone ID: PAT_TA_10414
cgagtggccaacgactccctcttccacctccccccttcgcaccaccggcctccaccgagaccaagcacacgccattcccctcctctcccccgagctccgagagatccccagaccctacggcctacgcgcgagttcccatggcaacggcccagctccgcggatcggcggtgcccgggacggcgaggaggtggccggctccctccggcgccatcctccgcttcgggccgctcgccacgtccaggctcccggcagcgtcgcttcgtcggaggggagccttcagtgacctttccgctagtgtcgtcagggagtcattgactacaatgtgcatgaagtcaaaatgtactagcactcccattgatcatgccactgctcctgagcatacagaagatgaagttcccgagccaacctctgtggtgactggtgaagagataaatatagaccaggaagttgctccgccacataagagtgccataatacatgatttctgcttagggatcccttttggtggattattattttccatgggccttgttggatttctattttggaggagtcctgtaagtcttacttttggcgttgcacctggtcttgctatattgggacttgccgtgcttagtcttaagggttggaggagtggaaagtccagcttgccatttatactggcacaagcagctgttgctgctgctgtagcatggaagcactgccaggcgtatgccacaacaaagaagctgcttccctggggcttttatactgcgctcagtgccttgatgatctgcttctactcgtacgtgttgcttgccggggggaatccaccaccaaagaagaagccagcagctgctatataagttgagcctttaagtcctattgttgttgaagttgtgctctggtaaatgttactgatgataggggttgcgttttattacttttaattgtagaacactgaaaaataataaagttgtgttcttgcgtacagtttaaaatcgtgccgaattcg

SEQ ID NO: 10415 - DNA, 842 bp, Triticum aestivum
  unsure (1)..(842): unsure at all n locations
  Clone ID: PAT_TA_10415
accttcccgccggttacgtgcgcctcgatcgccaccgcaacaagccgcagcagcagcgacagaccgatcgaccccgtttccttgccggagcaccgccggggaaggcgaagatgtcgtggcagacttacgtggacgagcacctgatgtgcgacatcgagggccaccacctcgcctccgccgccatcctcggccacgacggcaccgtctgggcccagagcgccgacttcccgtcgttcaagccggaggagatgaccaacatcatgaaggacttcgacgagccggggaccctcgccccgaccgggctgctactcggagccgccaagtacatggtcatccagggtgaacctggcgccgtcatccgcggcaagaagggcgcgggaggcatcaccctaaagaagaccgggcaggcgctggtggtcggcatctacgacgagcccatgaccccggggcagtgcaacctggtggtggagaggctgggcgactacctggtagagcagggcatgtagacgacgacgaccacgccacgccgcagcaacaacaatactaccggccaaaagacacagtagatctccacgcgttttttctagccgccgcgcacgcatatgggattgtggttcaatttctctcgcatcctcctctcattaagcctctctccctgtcccggcaactactccgccgattaccacccctcttgattgatccgcgatattttttcccccttgtttcatgatgatgaagccgttcgtttcggctaataattttgaattttttcttctacctatcgttttgagtcatttggagttgccgtttgagttgtggnanccggnaacaatatatatatg

SEQ ID NO: 10416 - DNA, 2138 bp, Triticum aestivum
  Clone ID: PAT_TA_10416
acccggcccgcgggagaagcgcgggacgtgtcggtgaggcggctcgcggccggcgtgtggcggctgcggcccccggaggcggtcgtcggcggccacggcggaggcggcggcggcggcggcgagggcagagttcacgtcgggctcgagcatatcccgaggcatctacaagtccagcttcttaaacaagacaccttgggtcatcatcagagtcttaagaatgagatttcaagcccaatttctgttttggagcgaaagagtgaagagcttcacaaggtacagtttcatggttcttcacctatgatacctgttaccaccatggagaaagcaacaaaatgggagcctgagaacatgaaaggaatggaatcacatgatgcctatctgatagccagccaactgaatcttttggatgagcagcaagatgcatcctatgttgctaacctccagttggagctccggcaagcacgtgatcgagtgggtgagctggaaagcgagcgccggtcaactaagaagaaacttgaccacttgttcaagaagcttgccgaggagaaagcagcttggcgcagtagagagcatgagaagatgcgtgctgttcttgaagatatgaaggcaaaccttgatcatgagaagaaaaacaggaggcggctggagctgattaacatgaagctcgttaatgagctgaaggagaccaagatgtcagcaaaccagctggtgcaagagtatgatgaggagaggaagactcgggagctcaccgaggaggtgtgcaacgagctagcaagggaggtggaggaagataaagccgagatcgaggccttgaaacatgacatccagaagctgcgagaggaggtggatgaggagcggaagatgctgcagatggctgaggtgtggcgcgaagaacgggtgcagatgaagcttgtcgacgcaaaactcaccttggatgccaaatacacagaactgagcagactgcagcaggatgttgaggcctttgttgctggatgcagttctgctagaggagacatcacggtagtggaacaagcggagaacattatacatgcaatcaagtcagtcagagcacaggatgttgaattcaggtatgagccaccagcagagtcagaagacatattctcaattttcgaagagctgcgtccaagcgaagagcctgtcattaaggacatcgagcagtgctacaagaacagctccattgtatgtgaatcagagatccaagaggccagcccaatgacagatatattcctggagaagccagccaaggcggcgtactcgaataagaaccctcacaatgagagtgaagctggagatgccagcagctgggagacaataagccatgaagatatgcagggttcaagtggttcacccgacggaagccagtcgtcgatcaacaagatctttgacgggagcatctcctggacgagcagaaacgatttcgagtacggggagatcgagaagctgaaggatgatctggccgacgcatacctgatgaccatgacccagcccaagaagaaagagtcagccatctcaaagctctggaagtcgtctcgcccaaagaacagcgatgtctccaagaaggatgccacggaggcactgaacggcagatcatcgaacgtgcggctgtcggtcgggacccattccaccatcgagagcggcgttcaggacatcggcctcagctcgccgagcgtggggcagtggagctcgccggactcgatgaacatccaattcaaccgcggcttcaggggctgcatggagtacccgcgggcgtcccagaagcacagcctgaaggagaagctcatggaggcgcggatggtgagccagaaggtgcagctccgccaggtgctcaagcagaagatctaggtgaagaggtgcaaggctagaagaaataatctcagaaattacttcgccgcttcgattttttcttcctgttgttgtcttagggtcacttgtaagttgtaattgatgtactagtaaagaaccgaaaaatagatcaatcgagtcaagtcggcctttgtgggccgtgctgcttctgtatcttaccgtggctctggggatatggttctactattttgataggctgcggtgagatccgggcatggtgtaatatagacataaacaggcagcaatgttcagac

SEQ ID NO: 10417 - DNA, 1128 bp, Triticum aestivum
  Clone ID: PAT_TA_10417
attcggcacgagcaatcgcggcgtcggcggctgcggcggaacctcccggcgatcaccggactcaccccggcaggcaaagcaatgaggaggtacagtccccaataccggagtcccccaaggaggggatatggtggcagaggtagaagtcccccgaggaggggatatggaggacggagggagcagggttcaggaagcctcttggtccgcaacatcccattgagctgcaggccggaggatctgcgggttccttttgaaaggtttggtcctgttcgggatgtgtacctaccaaaggattattacaccagggagccccgagggtttgcatttgtggagtttgttgacccttatgacgcctctgatgcacaatatcacttgaaccacacagtattttgtggccgagagataactgttgttgttgcttccgagtcacggaaaaggccagatgatatgcgtaatagggctagaatcagggggtattctggtgaacctgaaaggcgtcattctcgttatgggaggtctcgttcccgttcacgctcctactctcctcgctatcggggccgtcctcggtcaaggtcaaggtcatactctcctgctccaagacggcgagatgactactctgcttccccaccaagatcacatcacacacagtctcctaggcgtctgccaaaggggcatgaagaagacgagcggagatcctattctcctgctggtagaggtggtggtgagcgtgatgctgatactaatggaaagaggtcaccaccatctgacactgaaggatcacctccacgcacccgtaggtcacccaggcaatcctcaggatcacccgtggggtcgcgctcaaggtcccctgaagcttctcctgcccgcagcgactgataaaattggtgcctcccatattgccgcgtctcccacagcggcgcggccatgtactctatctctagcttcattgtctgagtaaaacccatctgggatgtgttggctagtgttgcggtgcctctttagttagcagatatgactggttggctgttcttttgctgcttggtgttgttgaaccttgtaccatggtagtgttttaatgtgaactgagccacaattgtgtttgaatttgtgattttaaatgcattttga

SEQ ID NO: 10418 - DNA, 1285 bp, Triticum aestivum
  unsure (1)..(1285): unsure at all n locations
  Clone ID: PAT_TA_10418
ccgagtcactgttcgctcgtcgctgctcacagctgctcctgcagttccggcaatattcagcacggcgcttccgtctccgcccccgtgacttgctagctcgtcgacggtccttgctgcgccatggaggaaaccccgctgccactgccactgccattggtacctcgcgtcaggctcggcacgcagggcctggaggtgtctaagcttgggttcgggtgcatgggcctgacgggctcctacagcgccccgctcagcgacgacgccggcgcctccgttgtcgcgcacgccttccgccgcggcgtcaccttcttcgacacctccgacttctacggcccccacaccaacgagacgctcctcggcaaggcgctgaagcagctgccgagggagcaggtgcaggtggccaccaagttcgggatccaggagtacgcgtacgacgagggcaggggcgccgtgtgcggccggccggagtacgtgcgcgcctgctgcgaggccagcctgcgccgcctcggagtcgactacatcgacctctactaccagcaccggatcgacaccaccacccccatcgaggacacgatcggtgagctcaaaaaactggtggaggaagggaaggtcangtacatcgggctgtcngaggcgagccccgacaccatccggcgtgctcacgccgtgcattcggtcttcgccgggcagatggagtggtccctgtgggctcgcgacatcgagcccgagattgtgccgctctgcagagaattggggattggaattgttccttacagcccgattggccgtgggttcttcggcggaagaggagtcacggagcaagtgtctgctgaatccaatctgaaaaggcacccacggttttcggcagaaaatctggagaagaacaagcatctctatctgaaaatggaagagctagctaagaagcaccagtgcagccctgctcagctagctttagcttgggtcctgcatcaaggggatgatgttgttcccataccaggaacaaccaggatcaagaacctggactccaacattgactccttaaagataaagctcacagaagatgacctggaagaaattagcagccagatacgtgaagaagatgtagccggtggaaggagttatacttccttggcccataccaactggaaccatgcagacacaccaaagaagtaaaactatgaaaaaaacggtgacatgcgagccatgccatgctatctgctgttgtactgaatggcgctgcctgtaccttgtgaatttttccgtgctaaataatggaaacaatttcttt

SEQ ID NO: 10419 - DNA, 892 bp, Triticum aestivum
  Clone ID: PAT_TA_10419
cttgaaatgcaaacccggaagaactgcaatagcccgcagctgttcgagagaggagaaaagggaggcgactcgaggtgcgagttggggctcagcccattcccgggcgctcgccgccggcgttgccggttggagagaagatgggggaggtgcccgcagctgccgtgtacatactagttgtagttgtgctgtttccttagtggagtttggctttatgccggagcttggcgtgatgccgatggggattgggtcgccggcgcgagcgagtcgcgtgcggtggctactggagtcggttcttaaggtggtggcgatggagggcttgctgctgccgactggatccactctggtgtccctggtaataagctcgatgcccctgatctggcggaggatcttgctgctgtcccctgcctcggaggccatcctggcgatggcgaagaggtggccgacacttgcagctctggagcttgtaggttgggatgctgcggatcgggctgtggaccatcagaagtggatgatttgttggcgaagcgatggcgcctgctgcggcggtcgaaggcctgctctcgccgactcgcctctgtttcttctggccgaagggcggtcattcaaattcctcccggcgatgaagcccaaagggaggcagctgtgttcttccatggagtctatggcgtggtgctatggagctttcgtcggcccaagtggtctcgtccccggtgtcggccggaagttctccgtcgaggagcagaataggacccgatcgcgtttcctttcctctgttccgggtccttttcgcaaagttcagggactgtttagtagttccagttttcttttgggtctctgttgtaatatgtgctttcatgtttatccaaagttcagggcccgtgtctgttcaaaa

SEQ ID NO: 10420 - DNA, 831 bp, Triticum aestivum
  Clone ID: PAT_TA_10420
gttgcggggtctgatgcatcagtgaacgtggctcctcagcaactgcttggacaaggtgctacacaggagggcagctcaaatgtgctttcggttggtctgccgtctgttgtggttcatcaacaggatgaacatcagcctgcgagtggtgtatcaaaggttgatagttcagtacagggacccccacctcaggttggccaggtgaccggtgccaagaagcgcaagcttgggtctgtcaggaggttcaagcaggatgaggcgcagcaggagcaagggcaagttgtcaatggcacaagtgagaagcctggcaatgagaaaactgattccgcacaaggagaaacgggtgataggaccaagggggagggcggtgctaaccgttgcatcactaagatcatcaagccagtgcggtatcatgccaccatgacagatgacgtgcagcaggtttccataacattcagagcactcaggtctgatgggcaggaggttcttgtggatgacaaggaattgaagtctacaaacccgttggtgctgataaactactacgagcagcacctgcgttacagtcccaccgcgtgaaaactgaaaaggatgcatggaaggtattgggttgccgtagcattctttaaccttgtggaatttgcagtgatatagattagcctggttaatgtactagttgtgatgaatgtagtagcaatgtgtgcccttctagttgcgacatattttgttcaatatttgtataatcagggatttatcctaggatggcgttttggtgcccaagtgcatctgcacctgtcaacgaacatcaaattcgaaagaaaaagaaaaaaaaaaaaa

SEQ ID NO: 10421 - DNA, 728 bp, Triticum aestivum
  unsure (1)..(728): unsure at all n locations
  Clone ID: PAT_TA_10421
attcggacgaggcccagcgcgacaccaactccgcctcgacctcccgccgcatctccgacgacatggcccgcaccaagcagacggcgaggaagtccaccggcggcaaggcgccgaggaagcagctggccaccaaggccgcccgcaagtccgccccggccaccggcggcgttaagaagccccaccgcttccgccccggtatcgtcgcgctccgcgagatccgcaagtaccagaagagcaccgagctgctaatccgcaagctccccttccagcgcctcgtccgggagatcgcccaggacttcaagaccgacctccgcttccagtcctccgccgtctccgccctgcaggaggccgccgaggcctacctcgtcgggctgttcgaggacaccaatctgtgcgccatccacgccaagcgcgtcaccatcatgcccaaggacatccagctcgcccgccgcatccgtggcgagagggcctaagctgctcgtcgtgtgttagatccttgttaggctgagttcgtccgtggaagtgtgtgtgctagtggtgtttcagaatatgcctgtgctgttcttgtcatggtggatgtgttgtgcctaatctgatggtaccttcttgttgccatcagcaatggaaatgaaaagtgttggcttcctgttctcaaaaaaaaaaaaaaaaaaactcgagggggggnccggtanccaattcnccctatagngagtcngtattacgcgcgc

SEQ ID NO: 10422 - DNA, 880 bp, Triticum aestivum
  Clone ID: PAT_TA_10422
acacccaccgccggttacgtgcgcctcgatcgccaccgcgacaagccgcagcagcagcgagagagaccgatcgaccccgtttccttgccggagcgccgccggggaaggcgaagatgtcgtggcagacttacgtggacgagcacctgatgtgcgacatcgagggccaccacctcgcctccgccgccatcctcggccacgacggcaccgtctgggcccagagcgccgatttcccgtcgttcaagccggcggagatggccaacatcatgaaggacttcgacgagccggggaccctcgccccgaccgggctgctactcgcagacgccaagtacatggtcatccaaggtgaacctggcgccgtcatccgcggcaagaagggcgcgggaggcatcaccctgaagaagaccgggcaggcgctggtggtcggcatctacgacgagcccatgaccccggggcagtgcaacctggtggtggagaggctgggcgactacctggtagagcagggcatgtagacgacgacgacgaccacgccacgccgccgcagcaccaacaatactaccggccaaaagacacagtagatctccacgcgcacgcatatgggattgtggttcaatttctctcgcatcctcctctaatcctctctccctgtcccggcaactacttaccacccctcttgattcatccgcgatattttttccccttgtttcatgatgatgagccgttcgtttcggctaataattttgatttttctctcctatacgtatcgttttggtcatttgggttgcccgtttgagttgtggatccggaacaatatatatatgtgattgccattggtattttgcaatatacgagaatatttatgtgtaaaaaaaaaaaaaaaaaa

SEQ ID NO: 10423 - DNA, 793 bp, Triticum aestivum
  Clone ID: PAT_TA_10423
gccgctcgagccggccggccgggaataaaaaaaaaaaaaactaccgaattcgttgccttccacttcaagttctccaaaccacagcgagcgcaagccgaatcccagttcgaagtcctcgacaaggagaaggagagattgatggcgcgtacgaagcagaccgcccggaagtccaccggcggcaaggcgccccgcaagcagctggccaccaaggcggcgaggaagtcggcgccgaccacgggcggcgtgaagaagccccaccgctacaggcccggcaccgtggcgctgcgcgagatccgcaagtaccagaagagcacggagctgctcatccgcaagctgccgttccagcgcctggtgcgggagatcgcgcaggacttcaagacggacctcaggttccagagccacgccgtgctggccctccaggaggccgccgaggcgtacctcgtcgggctctttgaggacaccaacctctgcgccatccacgccaagcgcgtcaccatcatgcccaaggacatccagctcgcccgccgcattcgcggggagcgcgcatagatcaagcgtctgcctactcgacttaggccttgtacaatgggaggtgtttagagagatgcttagaaaaataaatcgggtttttctgaagcaccggtacctatttctatagaaatagaaaaataaatcgagtttttttgaagcaccggtgcctatttctacaggaagggtctttcctgtacaaataagcatcggcacttaagaaaagcctcgtttatttctcgaaaaaaaaaaaaaaaaagggcgg

SEQ ID NO: 10424 - DNA, 913 bp, Triticum aestivum
  Clone ID: PAT_TA_10424
gcacgagggcaacattcacgcctgcgctgcgcctccgtcccgtgacttgcctgccttcccctgccgccgcgactgggactgggagagcttcggggcgccatggcgcaaaccccaccgattccccgcgtcagcctcggcacccaaggactggaggtgtccaagctggggttcgggtgcatgggcctcacaggctcctacaactccccggtcgaggacgacgcgggcatcgccgtcatcacgcacgccttcaaccgcggcgtcaccttcttcgacacctccgacgtctacgggccccacgccaacgagatcctcctcggcaaggcgctgaagcagctgccgcgggagcaggtgcaggtggccaccaagtttgggattcagcgggatgcccagggcaagagcaccatctgcggccgcccggagtacgtgcgcgcctgctgcgaggccagcctgcaccgcctcggcgtccaccacatcgacctctactaccagcaccgcatcgacaccaccatccccatcgaggacacgattggtgagctcaagaagcttgtggaggaggggaaggtcaagtacattgggttatcggaggcgagcccggacaccatcaggcgtgctcacgccgtgcaccccatctcctccgtgcagatggagtggtctctgtgggctcgcgacatcgagccccgagatcgtgcctctctgcagagagctagggattgggattgttccctacagcccgatggctctgggtttttcgggggaaggggaggacacaacaggggtttgttgaatcttatctgaaaagccctccccctttttcggttgaaaacccggagaagaccaacaacttttttttgaaatatgagaaacgggccaagaaacaccagtgcaacccttgttaactaagctttatattggg

SEQ ID NO: 10425 - DNA, 1703 bp, Triticum aestivum
  unsure (1)..(1703): unsure at all n locations
  Clone ID: PAT_TA_10425
gcacgaggctcctctccctcctcggcagatccaatccaccaacctcctccatggcgctctccgtggagaagaccgcgtccggccgggagtacaaggtgaaggacctctcccaggccgacttcggccgcctcgagctcgagctcgccgaggtcgagatgcccggcctcatggcctgccgcgccgagttcgggccctcgcagcccttcaagggcgcccggatctccggctccctccacatgaccatccagaccgccgtcctcatcgagaccctcgaggagtactggtggtgcaccgagcgctgcctcgactggggcgccggcggcggccccgacctcatcgtcgacgacggcggcgacgccacgctgctcatccacgagggcgtcaaggccgaggaggagttcgagaagtccggcaaggtccccgacccggagtccaccgacaaccccgagttcaagatcgtgctcaccatcatccgcgacgggctcaagaccgacgcccgcaagtaccgcaagatgaaggagaggctcgtcggcgtctccgaggagaccaccaccggcgtcaagaggctctaccagatgcaggagtctggcaccctcctcttccccgccatcaacgtcaacgactccgtcaccaagagcaagtttgacaacctttatggttgccgccactcgctccctgatggtctaatgagggccactgatgttatgatcgccggcaaggttgctgtggtctgcggttatgggtgatgttggcaagggctgtgccgccgcactcaagcaggctggtgcccgtgttatcgtgacagagattgaccccatatgtgcccttcaggccctaatggagggcatccagatcctcactttggaggacgttgtctctgatgctgacatcttcgtgaccaccactggaaacaaggacatcatcatggtggaccacatgaggaagatgaagaacaatgccattgtctgcaacattggtcactttgacaacgagatcgacatgaacggcctcgagacctaccctggtgtcaagcgcatcaccatcaagcctcagactgaccgttgggtcttccctgagaccaacactggcatcattgttcttgctgagggccgtctgatgaaccttggctgtgccactggccaccccagctttgtcatgtcttgctcattcactaaccaggttattgctcagctggagttgtggaaggagaaggcctccggcaagtatgagaagaaggtgtacgtgctccccaagcacctcgacgagaaggtcgctgccctccacctgggcaagcttggtgcgaggctgaccaagctcaccaaggcccagtctgagtacattagcatcccagttgagggtccctacaagcctgcggcgtaccggtactagtgtgtgtgtccagcatgactagcggctgggcctgagcctgagcggcggcactctgccacggcgacctatgaacctgttttcctttgcattgtctatctagatctaggcatgtgttcacttaggccgaggatttgtcatggttatgtttttagatcggtgagggtgtggtggacggaggtggcgtttgcttttgcccagaaataatggtgttattattttggatttaaatgaggaggtgtgatttgacggatatagtgttgcctttttgattctacatgtctgatgctccctacgccacaatttactanggatgc

SEQ ID NO: 10426 - DNA, 772 bp, Triticum aestivum
  Clone ID: PAT_TA_10426
tttttaaacttgaccataatatcagtcggattggaggacaatgtatttaaggaaaattgcccggtaacgattcagggcacatactcgaactcaaccctatgatagtaaatgttttgagaacgctgccgccaacctacgacaacctctggagttcgatgcctccaccaaaaacgaatgttgggaaaatccaccctctacaataattattgccttccaacgttaaaaagataaaagttcaccagatcctcgaagggtaggactgggaacaaacttctcttgtttcgtcatcatttcgtcccctctaggcaccgcctgagccgtacttcttgccgaagaagaggatctggagctgatcgtagccggagagcacaccagcaccagcaatggcacggaggatgttggcaccagcccccttgaagagggacttggcaccctccttcttcaggatctgctggaaagcatccaaggagctcttgtacttgacagcctctccggaggtcatcatcatccttctgcggacggtgtcaatggggtaagatgcaagacctgcaccattggtgatcaaccaaccaagagcaaagctggcaaagaagttgtcctggagagtgccagtgaggagaactggcttcagagaatcatagagtccaaagtacagaccacggtagacaatgattccaacacaggagatgttgaatccacggtaaagcccagcaataccatctgacttgagagtcttgcggtagacatcaaccaggccatgaatgctttcacc

SEQ ID NO: 10427 - DNA, 1262 bp, Triticum aestivum
  unsure (1)..(1262): unsure at all n locations
  Clone ID: PAT_TA_10427
gataaactctagtgctccgtactactgtttccccagagaaaacagttgggcggaattgggatgcggaaggaggaggcagccatgtcggcagcaacggggaagccgatcctgtacagcaaatggttcagctcctgctcgcaccgggttcggatcgcccttaacctcaaaggtgtggatttcgagtacagagcgaccaacccgatgacagatccagattatgagaaaatcaatcctgttaaatttgtcccagcatttgtggatgggaattttgttgtttctgactcgttcgccatcattttgtatatggaagacaagtatcctcagtgtcctctcttaccccgggatctgaaaaagaaagctcttaatttgcagattgcaagcatagtgtgttcaagcatccagcctcttcagagccatgctgtcattggttcgtatcttggcacaatggacaccaacgagagccttcagatggttcaacattatattgacaaaggcttcagagcgattgagaaacttctggaaggatgtgacagcaaatatgccaccggagatgaggtccaaatggccgatgtgtttttagcgccccagatccacgctggtgtgacacgcttccaaatcgatatgtcaaagtaccctattctggcaaggcttcaagatacttacaatgagcatcctgcatttcaagccgcacttcctgcaaaccaaccagatgctcctccatcccagtgaagtaatcaggacctcgatgactgtaagatttttcatgtttgatcgagattctatgatgtaacttcaaagtcagatgttcgtgtatgcaaagacccccggatgagcttgacgatgttgctgtaaaagtgaataaatgcaatttatcatatgtgctcgtgtaaaattgtagtatcaataaagagaaggaaagaaaggaggcgagtcaagctcaaacattgccctgtggaggaagaggagaaaggggtagcaagtcagccatggcggcggccaagcccatcctgtacggcgcccggatcagctcttgctctcaccgtgtccggatcgctctcaactcaaagtgtggactatgagtataagcagtcaacctccngacaattcanactatgaaaaaataaacccgattaaatacataccaacattggtagatggggactttggtcnaacctatccccccgcnacangttgtaccnggaggataanttcctcaacaccctcccntactaaagatncaaaacaaaggcttgatcttcaat

SEQ ID NO: 10428 - DNA, 736 bp, Triticum aestivum
  Clone ID: PAT_TA_10428
gggtgacaacacttgatgtagtgagagccaatacctttgtgggagaggttcttggacttgaccccagagatgtcaatgttcctgttgttggtgggcatgcaggagttacgatattaccactcctttcacaggtgaatcctccctgctcgtttacctcagaagaaattagttatctcacttctcgcatacagaatggtgggacagaagtagttgaggccaaagcaggagcaggatccgcgactctttccatggcctacgcagcagccaaattcgcggacgcgtgcctgagagggctgcgcggcgacgccgggatagtggagtgctcttacatagcctgtcaggtgacggagctgcccttcttcgcgtccaaggtgcggctgggccggtcgggcgtcgaggaggtcctgccgctcggcccgctgaacgagtttgagagggcggggctggagaaggccaagggcgagctggccgagagcatccacaagggcgtcgcctttgccaacaagtgaagtgaagacaagagaagagaaatctttcgccccagcatagaaatctgagatgcctcttgcttcctgggagcaacggtcgccgtgtcattgtctcatctccctgtaataataaataaacaatgaaagaagtgtatttatacccgtatatacgacgcggacaacccgatgtttacggctgtataattgaataaataaaacacggcagatctgatgattgaaaaaaaaaa

SEQ ID NO: 10429 - DNA, 693 bp, Triticum aestivum
  Clone ID: PAT_TA_10429
cccacgcgtccgcccaagcaccagagcctcctcaacctcccggcgccggcgcatcgacggcatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgggagatccgcaagtaccagaagagcaccgagctgctcatccgcaagctgcccttccagcggctggtgagggagatcgcgcaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcataggctgctgctgcaatccatgtccatgcgccgtgtcagatacgtagatccctgttaggctgagttcatcggtggaaaatccgtagtgtttcagaatgtgcgtcgtgttagatccatgttcctctcatggtgggtggatgtggtatgcctaatctgatggtaccttcttgttgccatcagcaatggaaatgaaaatgttggttccagttctcaaaaaaaaaaaa

SEQ ID NO: 10430 - DNA, 950 bp, Triticum aestivum
  Clone ID: PAT_TA_10430
gataactccgcgcgagttgctcttatatttctcaaaccatttatttacccgggcatgtctagtgcatatccatggcacgcctccacgcaaataacacaatcgccaacatattcacacgcgacacacgtacacacagatgcaatgcacccggccggttcggtggagacggcgtacgtcggcccatcacttgccggcgaaccctgagaagaagcggttgatggcggggaagacctccgggcggtgcgcgctgacgaagcggcggaaggcgtgctggctgtacctctcgccctcctccgcgttctccagcaccgcgctctgccggttgctcttgctcaccctgacgtctgggttgaggaagacgttccgggtgagctggaagacgcacatccccgtcaccagcgacatcgcgccgatcagcgggtaaacatctggcttcaaccaacggcccatgtcgtcgcctggcctagcgttgcgcttcgcgatgatctaaactctggaagacactgctgctatcaccttttcacctgtgctcgtgccgaattcggcacgagctggacggatgacctggttcgaaaaatgtgacacaaccggacccatcaaacaagcttatacgtcagggttgtccggcatccctcaaaccagctcatatttggagtgaatatgatgagatccgggcgtgtccagaagcgcccaccacattggatctgacagatcaaacccacaccaaaacccgccaatttgacctactccaccaaatcgaccgccctcctaatgtgtctgtccttccgctcccacgtccgagtcatcgtcgttgtacaccgttgctgctcgtcaatgccgcttcccacgtccaagccgtcgtacatatcgtcgccaagtaccttgtcccgtatggatgatgcatcgtcatcgtacgtgggggtcagttgcaaggtgctcgtgccgaattc

SEQ ID NO: 10431 - DNA, 1768 bp, Triticum aestivum
  Clone ID: PAT_TA_10431
cgtccggcctcctcccaccactcctctccctcctcggcagatccaatccaccaacctcctgcatggcgctctccgtggagaagaccgcgtccggccgggagtacaaggtgaaggacctctcccaggccgacttcggccgcctcgagctcgagctcgccgaggtcgagatgcccggcctcatggcctgccgcgccgagttcgggccctcgcagcccttcaagggcgcccgcatctccggctccctccacatgaccatccagactgtcgtgctcatcgagaccctcaccgccctcggcgccgaggtccgctggtgctcctgcaacatcttctccacccaggaccacgccgccgccgccatcgcccgcgactcggccgccgtcttcgcctggaagggcgagaccctcgaggagtactggtggtgcaccgagcgctgcctcgactggggcgccggcggcggccccgacctcatcgtcgacgacggcggcgacgccaccctgctcatccacgagggcgtcaaggctgaggaggagttcgagaagtccggcaaggtccccgacccggagtccaccgacaaccccgagttcaagatcgtcctcaccatcatccgcgacgggctcaagaccgacgcccgcaagtaccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgccactcgctccctgatggtcttatgagggctactgatgttatgatcgccggcaaggttgctgtggtctgcggttatggtgatgttggcaagggctgtgctgccgcactcaagcaggctggtgcccgtgtgatcgtgacagagattgaccccatctgtgcccttcaggccctgatggagggcatccagatcctcactttggaggacgttgtctctgatgctgacatcttcgtgaccaccactggaaacaaggacatcatcatggttgaccacatgaggaagatgaagaacaatgccattgtctgcaacattggtcactttgacaacgagatcgacatgaacggcctcgagacctaccctggtgtcaagcgcatcaccatcaagcctcagaccgaccgttgggtcttcccccaaaaccaacactggcttcattgttcttgcttaggggcgtctgatgaaccttggctgtgccactggccaccccagctttgtcatgtcctgctcattcactaaccaggtcattgctcagctggagttgtggaaggagaaggctaccggcaagtacgagaagaaggtgtatgttctccccaagcacctcgacgagaaggtcgcggccctccacctgggcaagctcggtgccaggctgaccaagctcaccaaggcccagtctgagtacattagcatcccagttgagggtccctacaagcctgcggcgtaccggtactagtgtgtgtccagcacgactagcggctggcctgagcctgagcggcggcactctgccacggcgacctatgaactatcctgttttcctttgcatcatctatctagatataggcatgtgttctcttaggtgaaggatttgtcatggttatgtttttagaccggggtgtggtggacggaggtggcgtttgcttttgcccagaaataatggtgttattattttggatttaaatgaggaggtgtgatttgccgga

SEQ ID NO: 10432 - DNA, 1765 bp, Triticum aestivum
  Clone ID: PAT_TA_10432
acaacgatgggcaaaaacagtgtttaacacgattgacatttgtatggcgaaccctatcgtcgatacattaagattaagttttaactttgtacgaacaaactaactgctgactcgctttcccgcttggtttattccaactctttagatgctagtgccccatacagaaacggagagacccaccgtcccgctcacgattgccaagtccgcccgcccttggtcggcaaagaagcttcgacatgatggactcgagaccagggctggctctgacggacggcaatcccccaacaaggcttaaccgctgccaggttcggtgacgatgcaatcctcctcctacgcctccgtctgcccctccttggtgatgtggaagccttcgattttacgggcgacctcatttgccaccgcggcggactttggtttgccgttggcgttgggtgcctcggggtcttcggtgtttgcggggttcagcggccagatccggatggtgccgtcttctgatcctgatgcgtatgattcgccaacaggcgcgaaccggacgcagtggacggggccatgatgacctttgttgcaggctatttcttcaccagtgaagaaatcatatacatgaacccacatatcttcccctccagtgatgaacttactcccagactttggttcaagtgaagctgactccacagtgcatgacatatcatagcttttaacaagcccaaaatggttcgcatcccaaaatttaacacttgacccatcagctgtagtgatgaacctgccgtcctggcttacttctgcactggtgacaggtgccttggtttcaagagtttggacaatttttccacttctcacatcccataacctcactccacccatatcagagcaggaacttagaatagattggtcactgtgaagccaagcaacagttcgtacagaaccaggtgttttgtcaagttctcttggagctgcatctggacgattcatgtcatatatacgcaaaatcttctccacacctccagtgagcaacatgtgtgtatcctcagaaaaggcacatgcacggactatatgcttgtgctcaaacgaatgtagctcatttcctgttagtgcatcccatattttggctgagaagtccgcagaaccggaggcagcacggagagcatttgtgtctagacaagagctccaaactgcacccttatgaccttcaaaagtcccaatccaatctccagtatcaccattacgaagcataggatttgagtccttgctggcgctgatgaggaagtagccgtcgggcgtgacggggctgtagaacaggtcgaccaccggccgcgagtggccgtggcacaccttggagacggccaccttcttcttctccatttctcccggcccccctcccgctcgcttccccgggcggcccggctcgtcgactccggcggcgccctcctccccgacgccctaaccctagccccgatcggagaaaaaaaataccagggggggtcgagggtaaaaaaatcgcgctgcggggcgcgggatcggctgatccggatccctggagcttgatctgtacaggagttttattggataatagaggtagcaatggggtgtgggaggagcgacaccttgacaataccattggcatcaatgtcaaaagtgacctcgatctgtggcatacccctcggggctggtggaataccttcaagctggaattcaccaagaagcttgttatctgtggccatctccctctcaccctgaagcaccttgattccaggtcgacgcggccgcg

SEQ ID NO: 10433 - DNA, 2083 bp, Triticum aestivum
  Clone ID: PAT_TA_10433
gcacgagggcgacgcgatctggccgccgaacatggcgcctccgctccgcctcgccgcgctcctcgtcgtcgttgtcgccgtcttcgcctccgccgcgcgcgccgatctcgtcatctccagggcggatcggaaggttgatttgacttcgcacatcgtccgcgtcctcacttcgctcaaggttgaaaatgctggctcggagcctgtctccaaagtcttactggcttttcccaacatccaagcaaaaaacctggcagcgatcagagcattcggtaccgagggaaaagtgaagggtctcagtagtattcttccgattgaaattgttgagccttctggtgttcccccagaactaaccttcttttcagcatcgttacacaaacctttgacaaaggggaagattcttcacttagatgtcttgactgtatttacacactttctccagccgttcccagaagagatcacccaagccgattcgcagcttgttgtctttcaggatagttctcactatctgtccccttaccctgttaaagtccagacgcttagtatcagattgcctggtggaagggttgaatcatacacaaaatatggaaacacaaaacttgtggattccgagcttaaatatggaccgtatgaagatgttcccccgttttcctacaaccctattattgtgcactttgagaacaacaacccatttgcagttgcaaaggaacttataagggagattgagatatctcactggggcaatgtacagattacagaacattacaacattgttcatggtggtgccagactgaagggcgaattctccaggcttgactaccagtctagaccttatgcaagaggggtttcatcatttaggcatctcattgctagattgcctgcaagggcccactctatttattacagagatgaaatcggtaatatttcaacatcacacttatggagtgattctaagaagacccaactggaaattgaaccgaggtttcccttgtttggtggttggcaaacaacctttaccattggttatggtttaccccttcaagactttgttttcagtgctgatggaaagagatttctcaatatcacatttggttctccaatggaggagattctcattgaaaagctcattgtaaaggtggttctacctgaaggttcaaaggatattgatgtttcagctccatttccaacaaatcaatggcaagaggtgaagtattcacaccttgacattgctggaaggccagttcttgtcttggaaaagcctgatgttattccagagcataatttgcatttccaggtgtactacaaattcaataacatctcgttgctcatagagccgatgatgttgattactggcttcttcctcctgtttgttgcatgtattgcctacatgcacactgacatgtcaatctctaagaactctccttcttatctggcaaagctgcaatgggatgaggtgcaagccactgttcagcaaatccagggtatctttcaccagtgcttagctgttcatgataagctagagacatcattgcacgatttgtctaggtctggagacgctaaatcttgcaaagcagctcgtaaagccgctgatgcacagtttaaggaattagcgaaagagctgaagccgctgttgttatctgtacagtcatcccctcagtcttatcagatatggccaaagctagaggacttggttgcgaaggagagggagatgcaggagaagctcatggcgaggcatgccaccgtggttgacagcgtcgagaagaagcagcgcgggcaagacatagaaaaccggatttcctcccagcagcagaagatcgctgcgctgaggcaagaggtcgaatctcttctagagtaccttagcgagatatgagcgaatccggtctcatcttacatgattagtgattagactgaaggtcatcttctgcactttgtgtagatgttgtgttggtaacccattatcctagttcctgaggctaggtttcctagactctgtaatgtgatataagcgccttaatcattttggaactgattaatttttttgcatcatctaaaaagaaatcatggggaaccacccccttgggactcc

SEQ ID NO: 10434 - DNA, 1349 bp, Triticum aestivum
  unsure (1)..(1349): unsure at all n locations
  Clone ID: PAT_TA_10434
cgtccgcagtcttcttcttcctcctctgccagatccaatccaccaaccttctccatggctctctccgtggagaagacctcgtcgggccgggagtacaaggtgaaggacctctcccaggccgacttcggccgcctcgagcttgagctcgccgaggtcgagatgcccggcctcatggcctgccgcaccgagttcggcccctcgcagcccttcaagggcgcccggatctccggctccctccacatgaccatccagaccgccgtcctcatcgagaccctcaccgccctcggcgccgaggtccgctggtgctcctgcaacatcttctccacccaggaccacgccgccgccgccatcgcccgcgactccgcggccgtcttcgcctggaagggcgagaccctcgaggagtactggtggtgcaccgagcgctgcctcgactggggcgtcgggggcggccccgacctcatcgtcgacgacggcggtgacgccacgttgctcatccacgagggcgtcaaggccgaggaggagttcgagaagtccggcaaggtccccgacccggagtccaccgacaaccccgagttcaagatcgtcctcaccatcatccgcgacgggctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccccgatggtctcatgagggccactgatgttatgatcgccggcaaggttgccgtggtctgcggttatggtgatgttggcaagggctgtgcggccgcactcaagcaggctgggtgcccgtgtgatcgtgacagagattgaccccatctgtgcccttcaggccctgatggagggcatccagatcctcaccttggaggatgttgtctctgaggctgatatctttgtgaccaccaccggaaacaaggacatcatcatggttgaccacatgaggaagatgaagaacaacgccattgtctgcaacattgggtcacttcgacaatgagatcgatatgaacggctttgagactacctggtgtcaaagcgcatcaacatcaagcccagactgaccgctgggtcttcccccaaaacaaagactggcaatcaattgtttcntggtgngggggcntcctgatganccctgggntgtngccaatgggccaacccaacttcctnaatgttctggctcaattcancaaaacaaagttaantgctcaancnttgaggttngtgggaac

SEQ ID NO: 10435 - DNA, 1414 bp, Triticum aestivum
  Clone ID: PAT_TA_10435
accggabgcttctggaggagcctgacgcgcactcgtcgacatcaggccgctcaaggacgcccgggaggtcggctcgccggacatatcggaggccaagaagaaggcggtggtcgtgccctacgacggggaggacaagaatggtttcttaaagaagcttgcgctgaggtttaaggacccggagaacaccacattgatcatccttgacaagtttgatgggaactctgaactagttgctgagcttgtcacatccaatggctacaaaggtgcttttgcggtaaaggatggcgcagaaggacctcggggatggcagagcagtgatcttccctggactgctcccaagaagggattcagtttggactttggtgagctatttggggatggttcagaaggtttgcccgtcacaattggtcttgctgcagctactggtttgggattacttgcctacacagagatagaaaccgtgctacagtttctgggttcaactgcggttatccagcttgtggcaagcaagctcgtatatgccgaggaccgaaagaagaccctgcaacagattgatgacttctttaacaagaagattgcaccaaaggagcttgttgatgaaattaaggaaatcgggcaggctctcctgccttcatctggtgaagctaagagccaaccagcagcagcaacagcggcagcgccagccgctgccacggcaactgctgcaccagtagcagaaccagcagccccagctgctgccacggcaactgctgcaccagtagcagaaccagaagccccagctgcagaagccagcacagagtcgcctcctgataccacaacatcatcgagacccctgtcaccatttgcaaattacccagatctcaaaccaccggccagcccttccccaccagcttcagagggtaaaaccgaggtgaaggccaccgttgtcgcagcaaccgaatcgccggcggaagttaactcggcaccggtagcagaagctgtcgaagaatcatcgcctcctgcgaagcccaggcctctttcgccatatgcgaactatccagatctcaaaccgccggcctctccttcgccttcgccgccttagtgatgagttgttttgagaggatcgagcttatcgctggctgtcgtccgtataagaaaccaggtatagagggccattgagctgttcataaggcaccacgctagagtaccaaggtctcaagcagtacatatatatctccagtgatcgattcgttttgcttttgtaattgtggaactactaggagtgtgagtttacgaagtctgggttctacttgacatgtttcacctgctcgtgtatgaagaaacaaggccggcgagcttccggttgcgaagagtactgtcgttgcaaccagttttttttctggaaactgctctttcctagcaatattggtataag

SEQ ID NO: 10436 - DNA, 1775 bp, Triticum aestivum
  Clone ID: PAT_TA_10436
ctcttcttccttctcctctgcctgccagatccaatccaccaaccttctccatggcgctctccgtggagaagacctcgtcgggccgggagtacaaggtcaaggacctctcccaggccgacttcggccgcctcgagctcgacctcgccgaggtcgagatgcccggcctcatggcctgccgcaccgagttcggcccctcgcagcccttcaagggcgcccgcatctccggctccctccacatgaccatccagaccgccgtgctcatcgagaccctcaccgccctcggcgccgaggtccgctggtgctcctgcaacatcttctccacccaggaccacgccgccgccgccatcgcccgcgactccgccgccgtcttcgcctggaagggcgagaccctcgaggagtactggtggtgcaccgagcgctgcctcgactggggcgccggcggcggccccgacctcatcgtcgacgacggcggcgacgccacgctgctcatccacgagggcgtcaaggccgaggaggagttcgagaagtccggcaaggtccccgacccggagtccaccgacaaccccgagttcaagatcgtgctcaccatcatccgcgacgggctcaagaccgacgcccacaagtaccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggtcgccgtggtctgcggttatggtgatgttggcaagggctgtgccgccgcactcaagcaggctggtgcccgtgtgatcgtgacagagattgaccccatctgtgcccttcaagccctgatggagggtatccagatcctcaccttggaggatgttgtctctgaggctgacatctttgtgaccaccaccggaaacaaggacatcatcatggttgaccacatgaggaagatgaagaacaacgccattgtctgcaacattggtcactttgacaatgagatcgacatgaacggccttgagacctaccctggtgtcaagcgcatcaccatcaagccccagactgaccgctgggtcttccccgagaccaagaccggcatcattgttcttgctgagggtcgtctgatgaaccttggatgtgccactggccaccccagcttcgtcatgtcctgctcattcactaaccaggttattgctcagcttgagttgtggaacgagaaggccaccggcaagtacgagaagaaggtgtacgtcctccccaagcacctcgacgagaaggtcgcggccctccacttgggcaagctcggcgccaggcttaccaagctcaccaagtcccagtctgactacattagcatcccagttgagggaccttacaagcctgcggcctaccggtactagtgtgtccagcgcgactagcggctggcctgagcctgagtccgtgcagcggcaccaacgggaactctatcaactatcctgtttcccttctattatcttacatgctgtctcttaggcggaggatttgttattatggttatgttttgagccgtgtgagggttgggagaggcggcgtttgcttttgcccagaaataatggcattattattggtttaatgtggaggtgtgttttcccagatactgttttgtctcgttaaaacccccccaaccc

SEQ ID NO: 10437 - DNA, 652 bp, Triticum aestivum
  Clone ID: PAT_TA_10437
ccggccgggccgggagattgcacagcgccagcgcgagagaccgaccagaaagtagaaacccccggccggaaggagatgagctactacggccagcagcaggcgcccgtcggcgccccgccgcagcaaggttacccgccgcaggggtaccctccggccggctacccgccgccacagcagggctacccgccggccggatacggccagcagggctacccgccccagcagcagcagcagcagaacagcgggccttccttcatgcaaggatgcctggccgcgctttgctgctgttgtctcttggacgcctgcttctgagaacagagaccaaagttccatcctcacgcgtgttggaactgatcaattgtgccgtgttaccgaaatgctactagcctacatgttttgggccctatcgcatttttctaccccttgtttgtaaacttcacattgggatcaattatttggttggtttggatgtgatgactaccttgctaaatgctaccaatccatctttttattttctccttgtccgaaaagtaaaaggatgctagtaaattacactattgatatgagatttgacgtgtatgcacctttttttgccttagagcatggttgtaagtcagttgttgcctatataatgttgccatatcatttatag

SEQ ID NO: 10438 - DNA, 2158 bp, Triticum aestivum
  Clone ID: PAT_TA_10438
cgtccgcgaccccccacccccaccctgctggtatcttccggcgagccctctccacgctctccggggggccgccccacctgccatcgacgcagccggcctcgctggaagccggcgcccctcgcctcgactccgtcgacgcggccggcgtccctcaagtatagacggtgccgccgtctggatccaagggtgctgtgtgaagtgccacctttccacatggattcaacagcgcaagatttccagccccggacattctccatcaaactgtggccaccgagtgaaagcactcgtctgatgcttatagagaggatgaccaagaacctgtccgccgagtgcatcttctctcgcaagtatggcattttgagcaaagaagaggctcatgagaatgctaagaggatcgaaggggcgtgctttgcttctgcagaggagcatttcaagaaggagcctgatggtgatggtagttctgctgtccagctatacgcaaaagaaacaagcaagctgatgctggaagtcctcaaaaaaggtccggggacgactgcggaaccagaagcacctgttattgatacaccttttgagcctgctgatactgtgtttgatatatctggtggcaagcgtgctttcattgaggcagaagaagcaaaggaacttctgagtccactaacagaaccaggaaactcatatagcaggatttgcttgagcaacaggagctttggtattggtgctgccaatgttgctgggccaattcttgaatcaataaaatctcagctcaaggaggtagatatctcagattttgtcgccggaagacctgaggatgaagcccttgatgtgatgcggatattctccaaagctttagcagggtctgtactgagatacctgaacatctctgacaatgctttgggcgagaagggtgtgagggcattcacagagctgctaaaatcacagggcgacctggaagaactatatgtgatgaacgatggtatatcaggggaagctgctaaggctctgtctgagcttattccttcaactgagaagcttaaggttctccacttccacaacaatatgactggtgatgaaggtgctatgttcattgctgagatggtcaagcgttctccaaatctcgagagttttaggtgctcagcaaccaggataggatctgacggtggagtggcattggccgaggccctggggacatgcactcgtctgaagaagcttgatatcagggacaacttgtttggcgtcgaggcaggggtggctctcagccgaaacccttccaaagcttggagatcttgttgagctgtacctcagcgacctcaatctcgagaacgagggcaccatagcaatcgtgaatgtcctcaaagagtctgcacctcagctggagatccttgagatggcaggaaatgagattaccgccgaggcggccaaacctttggcggaatgcttgaccgcaatgcagtcgctcaagaagctgaccttggctgagaatgagctgaaggatgccggggcggcggcggtcgcgaagtctctgcaagagggccacccagatctgaaggagcttgacgtgagcaccaacctgtttcagaggtctggagcccgctgctttgctcaggcggtcgcaaacaagccaggctttgtgctgctgaacatgaacgcgaactacatcccagacgaagggattgatgaggtgaggaagatcctgaaggcaggcgagaattcggcggacgtgcttggcccgctggacgagaacgagcccgaggggaaccctgatgacgaggacgaagaggaggatgatgatgatgaggcaaagtatggggacgataatgggaaggatgctggtctcggctcgaagctgcaggacctgaaggtggaggcggaggaggactaggcccgccactatcttttgctccggtcttgggttctgaaatgtttggtgtaccggctggaatttcgcataaaagagaaggaacacctcgctgtggcccggctcaattgattttgaaccgagccaagcggcctgttgctgtggtctggcggttcggtttatctgtaactttgttggaacttcctttcatgtttttagcaccgtcttggttctgtgggagaacttgcgtggtcaaggtcaagcctggaccctttaaaaatttaaatccgtggaatatttggc

SEQ ID NO: 10439 - DNA, 1681 bp, Triticum aestivum
  Clone ID: PAT_TA_10439
catacaattgtgcaaacaatgatctgccattccctcctgggggatatgcatcattgcgtttgcctgtggtagttgtacttaacccattttatccaacatctgtagttctgtacattcagcagtaatgcatgtatttaaaataagtacagtatcttttctcatgataagacacttgtaagctttctggcaaattgtatgtaagttgcaattaacaaatctgataagtttcatttacttcgtttgcaggttacaggccaagagttaaaccctgtcgctagatgccggcgtgtatatgcacacgcccatgattaccatatcaattccatttcaaataatagtgatggcgagacattcatatcagcagatgatctgcgaataaatctatggaatttggaaataaacagccagagctttaacattgttgatgtgaagcctacaaacatggaagatctaacagaggtgattacttgtgcggagttccaccccactcattgtaatacactggcctatagtagctcaaagggttctatccggctaatcgatctgcgacaatctgcattgtgtgacaaccattccaagatatttgaggaacatgaagcacccggagcaagatcgttctttacggagataatagcatcaatttcagatgtaaagttttcaagggacggaagatatcttcttagtcgtgattatatgactctcaaactatgggatctaaacatggattcaggccctgtttcaaccttccaggtccatgaacatctaagaccaaggctttgtgatctgtatgagaacgactcaatatttgacaagtttgagtgttgtcttagtggggatggacttcatgttgcaactggctcttatggtaatctattccgtgtttttgcttctactcctggtagcatggaggtgaccactttggaagctagcaggaacccgatgagacgtcagattgcaaacccgaccagacccactcgggggacgctgacctctatgacccgtggtgtgcgaagaggtggggaaaatctaggtgttgatgccaatggaaactcattagacttctcgacgaagttactccacctcgcatggcaccccactgagaattccatcgcatgcgctgctgcaaatagcctgtatatgtattatgcatagaaagttctctagaggaaatttatcgttcttggtttgccgcattgcccccctcaaaaggccaggcccttccgcactcaaccagagggacagtgcagggcagtgtcagatactacctcggagccaaaagaggcagctgatgtccaatattgcctggttgctgtgctagcggactgcatccctgttgattcattagtaaatgtgtaaattatatgaaaagttttggtcttgtcttgctctcatcacagctgttgtgttaccccaaatccgcagtcgagggaacagatcaaaagatagaaagtcacattgtgctggttcccgtgacaaaggacgggactggatctgctctgcaaggccttgtctgatttggttcatttctacatgtaattcagcatagacagggctagtcagctgtttagaacttcaattgtctggatgataggcgagtgatactcggtgattgtagctatatttgttctattcattggattgttgaaataagtcagcagtataagtgtgtttttattttgtt

SEQ ID NO: 10440 - DNA, 2081 bp, Triticum aestivum
  Clone ID: PAT_TA_10440
gagcatagtaaaagaggaatagtatagtccgggggaggtgggctacttcaccaccccttgacccttcttccgctcccctttccatttcttccactcctttccgcccgcccacaatgcctcccccggtctccggttgatctgacccgccgagccaccacgacgggtggcttcagaggaaggtgggcaggcaggcaggccagggctttcggcggttgcttgcctttgaggtgaagaagaaggtgcagaaagggtacaccaattatggcaaagaaagggaagtggtttagtgctgtcaggagagtgttcagctcctctgatccggaggggaaagaagctaagactgagaaggcagacaagcctaaatcccggaggaaatggccatttggcaagtcaaagcgctttgatccgcccacctcgacagtgtcagacatcactccagtagctccatcgccgctgccgctgccgttgccgcctacgcagcctcctcagccacagtccgaggagataaaagatgtcaagccagtcgaaacggagagtgaacaaaacaagcatgcctactctgttgcgcttgcctctgctgtcgctgcggaagccgctgccgtcgctgcccaggccgctgctgaggttgtccgcctcacagcagtccccgcagccacatcaaggccacctgtttgctcacaggaagaactcgccgctgtcaagattcagaccgccttcaggggttatctggcaaggagagcactgcgtgcactgagaggacttgttaggctgaagtcgctagttgatggaaatgctgttaaacgccaaactgcccacaccttgcattgcacacaaacaatggccagagttcaaacccaaatctactctagaagggtgaagatggaggaggaaaaacaggctcttcaaaggcagctccagttgaagcaccaaagggaacttgagaaaatgaagattgatgaagactgggatcatagccatcaatccaaagaacagatcgaggccagcttaatgatgaaacaggaagctgcactaagacgagaaagagcacttgcatatgcattttctcatcagtggaagaattctggtcgaactgtaacaccaacattcacagaccaagggaatcctaattgggggctgggagctggatggaacgctggatgtcagcaaggccttgggagaaccgagtggtgtcaaacaaggataaagacggctctctgacaaagaatcccagcactaacgctgctcgaacttttgtgccccgtgctctctcaatccagaggcctgcaacaccaagcaagtcgagccgtccaccaagccggcaatcaccatcaaccccgccatcaaagaacccctctgttgcaggaaaattcagaccttcaagcccaagagatagctggctatacagggaggatgacctgaggagcatcacaagcatacgctctgagcgcccaaggaggctgagcacaggtggaggctcgatccaggacgattcgagcctaacaagcacaccagctctccccagctacatgcagtccacaaagtctgcaagagcgaaatctcggtaccacatggtattcgccgataagtttgaggtgcctgatagagcatctctggtccactcatcgataaagaagcgcctatccttcccagctgcagagaaaccaaatgtcacacccgcagataagctgaaggaaagagcgaggcgccattcggatcctccaaaggtggatcctgcctccctgaaggatgtccatgttgcctgatatgatcccatcaacgtcaggcgccgtcacctatgattgctagatccatcttttccgtttttgtattctctagtttagattgctttctctcaaggttgaaccctccgtgaaactgtatgatctgtccgggttgatttgagacgattctaactgtttgcagacagaggtttttctctggattgtggtgtgtggtgctgcagagaaggaaatgtgaagcggtaaaaaaaagtgagagatgattggtgtgcgcgtggctttcagtgtacattatgagttttctttgagagtatatgtacattatttgtttggaaaaaaaaa

SEQ ID NO: 10441 - DNA, 906 bp, Triticum aestivum
  Clone ID: PAT_TA_10441
gattcggcacgcgggcggaattgggatgcggaaggaggaggcagccatgtcggcagcaacggggaagccgatcctgtacagcaaatggttcagctcctgctcgcaccgggttcggatcgcccttaacctcaaaggtgtggatttcgagtacagagcgaccaacccgatgacagatccagattatgagaaaatcaatcctgttaagtttgtcccagcattagtggatggggattttgttgtttccgactcgttcgcaatcattttgtatatggaagacaagtaccctcagtgtcctctcttaccccgagatctgaaaaagaaagctcttaatttgcagattgcaagcatagtgtgttcaagcatccagcctcttcagagccatgctgtcattggttcatatcttggcacaatggacaccaatgagagccttcagatggttcaatattatattgacaaaggcttcagagcgattgagaaacttctggaaggatgtgacagcaaatatgccactggagatgaagttcaaatggcggatgtgtttttagcgccccagatccacgctggtgtgacacgcttccaaatcgatatgtcaaagtaccctattttggcaaggcttcaagacgcttacaatgagcatcctgcatttcaagccgcacttcctgcgaaccaaccagatgctcctccatcccagtaaagtaatcaggacctcgatgactgtaagatttttcatgtttgatcgagattctatgatgtaatttcaaagttagatgctcatgtaagcaaagacccctggatgagcttgacgacgttgctgtaaaagtgaataaatgcaatttgtcgtatgtgccagtgtaaaattttagtatcaataaagagaagaaagggaagaagacgtgtcaaaaaaaa

SEQ ID NO: 10442 - DNA, 818 bp, Triticum aestivum
  Clone ID: PAT_TA_10442
tttttttttttttttttgacacatttagaagccattgcctataagattaatagcattttcatcgcaagtgattcaacagcatgaacggcggaaatgatgtgatgtaattgtttcggatcatcaggtgaactacgacatgggtaaatgaatttaagtgttgtgtttacaccgtgatatctgatacactggccatcaaataggcatatacaaatgttgcgctgcagttcaccaaactagacagtaatagtagtaactaacaacaaaaatgtgataacgatgagactccattgttccatcatgttaaggggaaatcttgcatatgcttggttcatctgacattggctcctcccatcagaagatgtgacatgctgtgttcatcagactctccttccatcagaactcacaactcagaatatgtggacgatatcatacgcaaatgtccagaacagcacgaaggacataaggccggccaaaactccttcgaccaaaatcctgctccaactatcaaagtacgtgtggactgagaactttgacttggccaagagtccaatagatgctaccatcattatcagaaagtagaagacgaagcccgtcagacccgtgaacccccagataccagcaacaactccactgatgatcgacaagaatgtccgactgtagaggatggacctgacgttgctggtgaggttctccgcctggatgacggggacatcgtcggaggaggtgccgccggccgccgccatcgccgcgaaagctctctctttgccgggcgagatttgggggcggagagtctggggcggcagcgatcggacggctcc

SEQ ID NO: 10443 - DNA, 775 bp, Triticum aestivum
  Clone ID: PAT_TA_10443
aggcctgcaacaccaagcaagtcgagccgtccaccaagccggcaatcaccatcaaccccgccatcaaagaacccctctgttgcaggaaaattcagaccttcaagcccaagagatagctggctatacagggaggatgacttgaggagcatcacaagcatacgctctgagcgcccaaggaggctgagcacaggtggaggctcgatccaggacgattcgagcctaacaagcaccccagctctccccagctacatgcagtccacaaagtctgcaagagcgaaatctcggtaccacatggtattcgccgacaagtttgaggtccctgatagagcatctctggtccactcatcgataaagaagcgcctatccttcccagctgcagagaaaccaaatgtcacacccgcagataagctgaaggaaagagcgaggcgccattcggatcctccaaaggtggatcctgcctccctgaaggatgtcaatgttgcctgatatgacccgatgaacgtcaggcgctgtcacccatgattgctagatcgccatcttttccgtttttgtattctctagtttagattgctttctctcaaggttgaaccctccgtgaaactgtatgatctgtccgggttgatttgagacaattctaactgtttgcagacagaggtttttctctgtggattgtggtgtgtggtgctgcagagaaggaaatgtgaagcggtaaaaaaaagtgagagatgattggtgtgcgcgtggcattcagtgtacctcggccgcgaccacgcta

SEQ ID NO: 10444 - DNA, 600 bp, Triticum aestivum
  Clone ID: PAT_TA_10444
caatggctcgcacgaagcagacggcgaggaagtcgaccggcgggaaggcgccgaggaagcagctggcgaccaaggcggcgcgcaagtcggccccggccactggcggggtgaagaagccccaccgcttccgccccggcaccgtcgcgctccgtgagatccgcaagtaccagaagagcacggagctgctgatccgcaagctgccgttccagcgcctggtgcgggagatcgcgcaggacttcaagaccgacctccgcttccagagctccgccgtttccgcgctgcaggaggccgccgagtcgtacctcgtcgggctcttcgaggacaccaacctctgcgccatccacgccaagcgcgtcaccatcatgcccaaggacatccagctcgcccgccgcatccgcggggagagggcctaggtagcggtagccgcgtgcgtgcgttatcagagagtcctactgtgatgttccggtttcagagcttggtggtgtagcttaacatgttcctgtccgctctcatcgttgtcttgccatatgtagctcctcgctgcgatgaattatcaatgaagagtgcagttatcatcataaaaaaaaaaaaaaaaaaaaa

SEQ ID NO: 10445 - DNA, 1550 bp, Triticum aestivum
  Clone ID: PAT_TA_10445
cgtccgtcgaaatccagccgaccttcccctgcgccgacgaccccccctcccgctctccctcgccggcgacgaccgaccatggcgacgcggtactggatcgccgccctgcccgtcgccgacgacaacgtcgccgccggcaagacggccctctgggcgcgcctccaggacgccatctcccgccactccttcgacaccccgctctaccgcttcaccgtcccggatctccgccccggcacgctcgactccctgctcgccctcagcgacgacctcgtcaagtccaacatcttcatcgagggcgtgtcgcacaagatccgccggcagatcgaggacctggagcgcgccggaggtgtcgagcccggcaccctcaccgtcgacggcgtccccgtcgacagctacctcaccaggtttgtgtgggacgagggcaagtaccccgtcaacgccccgctcaaggagaccgtcgccagcatccagtcccaggtcgccaagatcgaggacgacatgaaggttagagttgctgaatacggtaatgttaagagccagcttggcacaatcaacaggaagcaaactggaagtttagcagttcgtgacctttccaacctcataaagccagaggatatggtcacttcggaacatctagtgacactcctttctattgtgccaaaatattcccaaaaagactggttatcaagctacgagtcactcgatacgtttgtggttccgagatcgtcaaaaaagctttacgaggacaacgagtatgctctctacactgtaacattatttgccaaggttgttgacaactttaaggtccatgctcgtgagaaaggtttccagatccgtgactttgagtatagtcctgaagcacaggagagtcggaagcaagagctagaaaaactgctgcaagaccaggaagttatgaggacctctctattgcaatggtgctatgcaagctacagtgaggtatttagctcctggatgcatttctctgctgttcgtgtcttcgtagagagtattctgagatatggtctgccagcacggttcctgtctgttgtcctagcaccatctacaaagagcgagaagaaagtaaggaacatcttggaagggctatgtggcaatgccaacagcagctactggagatccgaagacgacgttggcatggctgctggcctgggaggcgagacagagtctcacccttacgtctccttcaccataaactttgtctgagggtgttcgatgtatattattttgtgacaccaattctttcatggtatgtcggtttcggttcatgcttctgtagtagatgagccgcgccgatcaataatgtagtgtttcgaagaacctcgaacgtatcctggcacaaagtgggacttctcttcttttgttctgctacgctgttgcaactgtttactttttgtgcagtgttgtattactgggtacattattgtaattttgagtaaccagaatctataataataaaatcaaggtgaataagctgggtaatataaacatatgttgttcaccggtgtgaatttgtttgacaagtaaaaaaaaaa

SEQ ID NO: 10446 - DNA, 1032 bp, Triticum aestivum
  Clone ID: PAT_TA_10446
attcccactgtccctgtctactatccagcgaaaccacagccaagggaacgggcttggcggaatcagcggggaaagaagaccctgttgagcttgactctagtccgactttgtgaaatgacttgagaggtgtaggataagtgggagccctcacgggcgcaagtgaaataccactacttttaacgttattttacttattccgtgggtcggaagcggggcatgtcccctccttttggctccaaggcccggtcttaccgggccgatccgggcggaagacattgtcaggtggggagtttggctggggcggcacatctgttaaaagataacgcaggtgaagagataaatatagaccaggaagttgctccgccacataagagtgccataatacatgatttctgcttagggatcccttttggtggattattattttccatgggccttgttggatttctattttggaggagtcctgtaagtcttacttttggcgttgcacctggtcttgctatattgggacttgccgtgcttagtcttaagggttggaggagtggaaagtccagcttgccatttatactggcacaagcagctgttgctgctgctgtagcatggaagcactgccaggcgtatgccacaacaaagaagctgcttccctggggcttttatactgcgctcagtgccttgatgatctgcttctactcgtacgtgttgcttgccggggggaatccacccaccaaagaagaagccagcagctgctatataagttgagcctttaagtcctattgttgttgaagttgtgctctggtaaatgttactgatgataggggttgcgttttattacttttaattgtagaacactgaaaaataataaagttgtgttcttgcgtacagtttatttgggtatctttgttacttaatggaagagtcagagcagatacgatttgctctggttctacatgaacttttgttcctgaacatcgcgcttataccttaataaaatgtagctttgttgatcctgaaaaaaaaaaaaaaaaaaaaact

SEQ ID NO: 10447 - DNA, 1614 bp, Triticum aestivum
  Clone ID: PAT_TA_10447
ccttctccatggcgctctccgtggagaagacctcgtcgggccgggagtacaaggtcaaggacctctcccaggccgacttcggccgcctcgagctcgagctcgccgaggtcgagatgcccggcctcatggcctgccgcaccgagttcggcccctcgcagcccttcaagggcgcccggatctccggctccctccacatgaccatccagaccgccgtcctcatcgagaccctcatcgtcgacgacggcggtgacgccacgctgctcatccacgagggcgtcaaggccgaggaggagttcgagaaatccggcaaggttcccgacccggagtccaccgacaaccccgagttcaagatcgtcctcaccatcatccgcgacgggctcaagaccgacgccagcaagtaccgcaagatgaaggagaggctcgtcggtgtctccgaggagaccaccacccggcgtcaagaggctctaccagatgcaggagtccggcaccctcctcttccccgccatcaacgtcaacgactccgtcaccaagagcaagtttgacaacctttacggttgccgccactcgctccctgatggtcttatgagggccactgatgttatgatcgccggcaaggttgctgtggtctgcggttatggtgatgttggcaagggctgtgccgctgcactcaagcaggctggtgcccgtgtgatcgtgacagagattgaccccatctgtgcccttcaggccctgatggagggtatccagatcctcaccttggaggatgttgtctctgatgctgacatctttgtgaccaccactggaaacaaggacatcatcatggtggaccacatgaggaagatgaagaacaatgccattgtctgcaacattggtcactttgacaacgagatcgacatgaacggcctcgagacctaccctggtgtcaagcgcatcaccatcaagcctcagactgaccgttgggtcttccccgagaccaacactggcatcattgttcttgctgagggccgtctgatgaaccttggctgtgccactggccaccccagctttgtcatgtcttgctcattcactaaccaggtcattgctcagctcgagttgtggaaggagaaggccaccggcaagtacgagaagaaggtgtatgttctccccaaacacctcgacgagaaggtcgccgccctccacctgggcaagctcggtgccaggctgaccaagctcaccaaggcccagtctgagtacatcagcatcccagttgagggtccctacaagcctgcggcgtaccggtactagtgtgtgtgtgtccagcacgactagcggctggcctgagcggcggcactctgccacggcgacctatgaacctgttttcctttgcattatctatctagatataggtgtgtgttctcttaggtggaggatttgtcacggttatgtttttagaccggtgagggtgtggtggacggaggtggcgtttgcttttgccccagaaataatggtgttattattttggatttaaatgaggaggtgtgatttgccggaaaaaaaaaaaaaaaaaaaaaaaaaaaaaaaaaaaaagaaaatttgggcagccgctcgcgatctaaaactagtccggacgcgtgg

SEQ ID NO: 10448 - DNA, 667 bp, Triticum aestivum
  Clone ID: PAT_TA_10448
aggcggcagcctctcctcctcctctcctccctcgccgtcgccgtcgccttcgtctccgcctccaaccggcggccgcgccaccagctcgtctcctccgatggcgactgtgccagttaaccccaagccgttcttgcaaaacctaacagggaagatggtcatcgtcaagctgaaatggggcatggagtacaaaggatatcttgtttcagtggactcctacatgaatctgcagctaagtggtactgaggaatacattgatgggcaatgctctggaaatttgggagacatactgataagatgcaacaatgtgatgtatctccgaggtgttccagaggaggacacggacattccagatgcggcctgaagagcacatggactgttcctggttgatgcttgctgttcactgctgaaaaagaacttcctagttcgtctccatttgcgcctactggactgtattacgtacaggcgttgaactcatgttaactctagttctgcatcctggatgaatgaatgattaacttgcatgtttgaaacggatgattgcttattgctgattggtcctgatcctgccgttcgatatgtatgatttgatgtctgaattgcagtgatcgtatgtgtgcaatttgaaccaatatttgctgaaaaaaaaaaaaaaaaaactcgacctcgg

SEQ ID NO: 10449 - DNA, 691 bp, Triticum aestivum
  unsure (1)..(691): unsure at all n locations
  Clone ID: PAT_TA_10449
gccggccgtgccgggcccaatcccccagcaaacaactaccgaagcagcctcccctcccccaccctaccccgcagcaatggcgcgcaccaagcagacggcgaggaagtcgaccggcggcaaggcgccgaggaagcagctggcgaccaaggccgcccgcaagtcggccccggccaccggtggcgtgaagaagccccaccgcttccgccccggcaccgtggcgctgcgtgagatccgcaagtaccagaagagcacggagttgctgatccgcaagctgcccttccagcggctggtgcgtgagatcgcgcaggacttcaagaccgacctccgcttccagagctccgccgtgtccgcgctccaggaggccgccgaggcgtatctcgtcgggctcttcgaggacaccaacctctgcgccatccacgccaagcgcgtcaccatcatgcccaaggacatccagctcgcccgccgcatccgcggggagagggcttgagtagcggtagccgcgtgcgtgcgttgtcagagagtcctactgtgatgttccggtttcagagcttggtggtgtagttaacatgttcctgttcgctcttgtcgttgtcttgccatatgtagctccttgctgcgatgaattatcaatgaagagtgcagttatcatcatctgaatctcaattcagtgttcaaaanaaaaaaggggggg

SEQ ID NO: 10450 - DNA, 664 bp, Triticum aestivum
  Clone ID: PAT_TA_10450
cagcccccaaccaccagagcctcctcctcccctccggcgcatcgacgacatggcccgcaccaagcagacggcgaggaagtcgaccggcggcaaggcgccgaggaagcagctggcgaccaaggccgctcgcaagtccgccccggccaccggcggcgtgaagaagccccaccgcttccgccccggcaccgtggcgctccgcgagatccgcaagtaccagaagagcacggagctgctcatccgcaagctccccttccagcgcctagtgcgcgagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctaggctgctgcacctgcaatccgtgttaggctgagttcatcggtggaaaatagtggtgtttcagaatgtgcgtcgtgttagatccatgttagatccctgttcctctcatggtgggtggatgtgttatgcctaatctgatggtaccttcttgttgccatcagcaatggaaatgaaaaaatgttggttgctgttgtcaaaaaaaaaaaa

SEQ ID NO: 10451 - DNA, 768 bp, Triticum aestivum
  Clone ID: PAT_TA_10451
tctgcctgatagtctttcattgcagtcattcgacagcatgagccacgaacgcgggactaaagcaatgtaatgttttggatcatcaggcgagctacgacatgggtaaatgaatttaagtgtggtgtttacaccgtgatatctgatacactggccatcaaataggcatatacaatgttgcagttcaccaaactagacagtaatagtagtaactaacaacaaaaacggataacgatgagactccattgttccatcatgttaaggggaaatcttgcatatgcttggttcatctgacattagctccttccatcacaagatgcagcatgttgcgttcatcagactctccttccatcagaactcagaaaatgtggacgatatcgtacgcaaatgtccagaacagcacgaaggacataaggccggccaaaaccccttcgactaaaatcctgctccaactatcaaagtacgtgtggactgagaactttgactttgccaagagcccaatagatgctaccatcattatcagaaagtagaagacgaagcccgtcagacccgtgaacccccagataccagcaacaactccactgatgatcgacaagaatgtccgactgtagaggatggacctgacgttgctggtgaggttctccgcctggatgacggggacatcgtcggaggaggtgccgccggccgccgccatcgccgcgaaatctctcttttctccgggcgagatttgggggcggagagtctggcgcggcagcgatcctcgtgccgaat

SEQ ID NO: 10452 - DNA, 760 bp, Triticum aestivum
  Clone ID: PAT_TA_10452
gcgagaacagaaatctcgtgtggaacaaaagggtaaaagctcgtttgattctgatttccagtacgaatacgaaccgtgaaagcgtggcctatcgatcctttagatcttcggagtttgaagctagaggtgtcatgaaaagttaccacagggataactggctctaccctcggatggcaaaagtacgttggatccaagggcaagaccatcggcatcgacaagttcggcgccagcgctcctgccccgaagatctacaaggagtacggcatcaccgcggagagcgtcattgccgcagccaagagcctgtaagatcgcacactcgtcgaggttctgtcatcgttgatggcaaagaacaaacaccacacttgaaggtctcgtgcccagaagcttggaataacggagggagaggaggatgcctgtgtcggagcgtgaatggtattttaggcctgtaataaacaatgccttttccatttgcgttgtcttacattcgatatatatcgcccccttagatgattcgtggagggggcgagcctgatcaaattggggactggttttttgtatttgtttacattgaactgatagtcgtgcttgcgatgcttctttctctccccaagatcgtcgcctccatgggtggttcatgctttgatgcacccttttagtccttgtagtttgctcatcgtccccttctcccatacaaacggtttgatgcatatagtatcatcaattcaataaaaatagagtgtttgccatcaaaaaaaaaaaa

SEQ ID NO: 10453 - DNA, 1005 bp, Triticum aestivum
  Clone ID: PAT_TA_10453
ttttttttttttaaaaaaaattccgtttggtgattttgtatttgcgcacaagccgacagccttcaaattcaaattattatgaaacgcagtccatatagccaacacaccacttattcacgattcaaattatggcaactcttctagagctgctcttatatttccaacacaccatttattcacctgaggcgtgtctaggagcacatatccatggcacgcctccacgctaatgacacaatcacgaaccaacatattcacacgcgatacacgtacacacacatgcaatggacacatcacttggcgctgaacccagagaagaagcggttgatggcggggaagacctccgggcggtgcgcgctgatgaagcggcggaaggcgtgctggctgtacctctcgccctcctcctcgttctccggcaccgcgctctgccggttgctcttgctcaccctgacgtccgggttgaggaagacgttccgggtgagctggaagacgcacatccccgtcaccagcgacatggcgccgatcagcgggtaaacatctggcttcaaccaacggcccatgtcgtcgtcgcctggcctagcgttgcgctctgcgatgatctaaactctgatgaaagacgctgctgctatcttcttttccctcgtgttctctcgtgccgaattcggcacgagcccagtctgactacattagcatcccagttgagggtccttacaagcctgcggcctaccggtactagtgtgtccagcacggctagcggctggcctgagcctgagtcggagcagcggcaccaacgggaactctatcaactatcctgtttcccttctattatcttacatgctgtctcttaggcggaggatttgttattatggttatgttttgagccttgtgagggttgggagaggcggcgtttgcttttgcccagaaataatggcattattattggtttgagtgaggaggtgtgcttttccagatacagttttgtctcgtttaaaaaaaaaaaaaaaaaac

SEQ ID NO: 10454 - DNA, 1381 bp, Triticum aestivum
  Clone ID: PAT_TA_10454
ggccgggttgcagaaaaaaaaaaaaaagcccctcggctttaccccttttctcccgccctcgcaaccacctcccctcccctgtcctgccgagagtctcttctcttctcgtctctcgtcgcctcccgagtctccggcgaccacgccaactagacgaccatggagcaaggcgccgactccgcggcggcgaggcggatggccagggtcgcctcccacctccgcccgcccacctcgcagatggaggaggtggccatcttgaagggctctgattgccgtgcaaaaggtgcggcaccagggttcaaggtcgcagtcctgggtgcatctggtgggattggccagccgctctcgctgctcatgaagatgaaccctcttgtttcggtgctccatttatatgatgttgtcaacacacctggtgtcacagctgacattagccacatgaacaccggtgctgtggtgcgtggcttcttgggtcagtcacaattggaaagtgctcttactggaatggatcttgtgatcattcctgctggcattcctcggaaacctgggatgacaagggatgatttgttcaacatcaatgctgggattgttcggactctttgtgagggaattgcaaaatgctgcccaaatgcgattgtgaatgtgatcagtaaccctgtaaattctaccgttccgatcgctgctgaagtatttaaaaaagctggaacatatgatcctaagcgcctattgggggtgacaacacttgatgtagtgagagccaatacctttgtgggagaggttcttggacttgaccccagagatgtcaatgttcctgttgttggtgggcatgcaggagttacgatattaccactcctttcacaggtgaatcctccctgctcgtttacctcagaagaaattagttatctcacttctcgcatacagaatggtgggacagaagtagttgaggcgaaagcaggagcaggatccgcgactctttccatggcctacgcagcagccaaattcgcggacgcgtgcctgagagggctgcgcggcgacgccgggatagtggagtgctcttacatagcctgtcaggtgacggagctgcccttcttcgcgtccaaggtgcgtctgggccggtcgggcgtcgaggaggtcctgccgctcggcccgctgaacgagtttgagagggcggggctggagaaggccaagggcgagctggccgagagcatccacaagggccaacaagtcaagtgaagagaaatctttcgccccagcatagaaatctgagatgcctcttgcttcctgggagcaacggtcgccgtgtcattgtcttatctccctgtaataataaataaacaatgaaagaagtgtatttatacccgaaaaaaaaaaaaaaaaaaggccccta

SEQ ID NO: 10455 - DNA, 874 bp, Triticum aestivum
  Clone ID: PAT_TA_10455
gcacgagggagagagagagagagagagagagagagagagagagagagagagagagagagagagagagagagagagagagagagagagagagctccctcctcacctcgaacgctccgggaagcagcaaacgcgaggccggccaagatgtcgtggcagacgtacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggttatccagggcgaacctggcgctgtcatccgtggcaagaagggagcaggaggcatcaccatcaagaagaccgggcaggcgctggtggtcggcgcctacgaggagcccatgacccctgggcagtgcaacatggtggtggagaggctcggcgactaccttgtcgaacaaggcatgtaggccacccatcaatataatggcgtccacgatgatcgatcacacgattttcaagattctcttttaaatatctacggaaatatatgtgggcctttttttttcctcttcaagcggctctggcgtccatcactcatgatgaccagttgctctaacaagttccatttgtaatgccttttcggctttccttcttcttcttcttcagtgggtccattattttggttgtcgtatgaattgtgttgacaacaaattttgcgctatgtttctttcgattgtgaacttatagaatcttttattttattttattttatttcggaaaaaaaaaaaaaaaaggccccta

SEQ ID NO: 10456 - DNA, 587 bp, Triticum aestivum
  Clone ID: PAT_TA_10456
gaattcactaagtgatttcgagcggccgcccgggcaggtgatcctcaccttggaggatgttgtctctgaggctgacatctttgtgaccaccaccggaaacaaggacatcatcatggtcgaccacatgaggaagatgaagaacaacgccattgtctgcaacattggtcactttgacaatgagatcgacatgaacggccttgagacctaccctggtgtcaagcgcatcaccatcaagccccagactgaccgttgggtcttccccgagaccaagactggcatcattgttcttgctgagggtcgtctgatgaaccttggatgttgccactggccaccccaagctttgtcatgtcctgctcattcaccaaccaaggttattgctcagcttgagttgtggaacgaaggagggcagtggcaaagtatgagaagaaggtgtacgttctccccaaagcaccttggacgagaaggtcgcgggcctccacttgggcaaagctcggcgccaggctggaccaagctcaccaagtcccagtcctgactacattagcatcccaattgagggtccttacaaagcctgcgggcttaccgggtac

SEQ ID NO: 10457 - DNA, 693 bp, Triticum aestivum
  Clone ID: PAT_TA_10457
aaaaaaacccagctcccaaatcccccaagcaagcaagcaagcagccaccgaagcagcctccgctcccctccccgaccccgaagcaatggcgcgcacgaagcagacggcgaggaagtcgaccggcggcaaggcgccgaggaagcagctagcgaccaaggccgcccgcaagtcggccccggccaccggcggcgtgaagaagccccaccgcttccgccccggcaccgtcgcgctccgtgagatccgcaagtaccagaagagcacggagctgctgatccgcaagctgccgttccagcggctggtgcgggagatcgcgcaggacttcaagatcgacctccgcttccagagctccgccgtgtccgcgctgcaggaggccgccgaggcgtacctcgtcgggctcttcgaggacaccaacctctgcgccatccacgccaagcgcgtcaccatcatgcccaaggacatccagctcgcccgccgcatccgcggggagagggcctgagcggcggtcgccgtgtgcgtgcgttgtcagagagtcgtgctgtgatgttccggtctcagagcttggtggtgtagctaacatgttcctgtccgctctcgtcgttgccttgccatatgtagccccttgctgcgatgaattatcaatgaagagtgcagttatcctcatattaaaaaaaaaaaaaaaaaagccccctagaa

SEQ ID NO: 10458 - DNA, 1668 bp, Triticum aestivum
  Clone ID: PAT_TA_10458
gtttttctgccatgttctccagcgaatatcaaccaaaacaacaccatttcgtctatcatcgtcaacacaaaagggtgggacaaaaatgtgtcaacacaaaatacacaatggcatctcaatctaatcctgatcaacacctcatccacaaaatgttctacccttggcttattttcggtgtaccaaaaaatccctagcatttgctcgatgaagggcaagatttttcccacggcgcagttaactactcatacaagccagccacacttgcgtcggacaccggctttgacgaacagacgcaaggcaagacggaaagagcagctttgaggataacaacagcatctcatccaacgatgtaatcctactccccggccttctcctccttggcaatgtggaagccttcaatcttacacgcaatctcctctgctccagccttgggcttaccatttgtatcgatcgcctcctcagcatccgcgttaggtgggctcagctgccagatccgaatagtaccatcttccgaccctgaggcgtatgattcaccaccaggtgcaaaccggacgcagtgaactggaccatgatgccctttgttacaagttatttcttcaccagtaaggaaatcaaatacatgaacccacatatcttctcctccagcaatgaatttgctgccagactttggttcaagtgaagccgactccacaataaacgacatatcatagcttttaacaagcccaaagtgattagcatcccaaaattttacacttgagccatcagctgtggtgatgaacctgccatcctggcttacttctgcactggtaacaggtcccttggtttcaagagtttggacaattttttcactcctcacatcccataaccttactccacccgtatcagtgcaggaactcagtatagtttggtcattatgaagccaagcaacagttcggacagaaccaggtgatttgtcaagttctttcggagcaacatctggtttgttcaaatcatatacacgcaaaatcttttccatacctccagtaagcaacaggtgggtgtccttagaaaaggcacatgcacggactatatgcttgtgttcaaatgaatgtagttcatcacctgttagtgcatcccatactttagctgaaaagtctgcagaaccagaggcagcacgcagagcatttgtgtcaaggcaacagctccaaacagcacctttatgaccttcgaaagtcccaatccaatctccagtctcaccattacgaagcattggatttgagtccttgctggcgctgatgaggaagtagccgtcgggcgtgacggggctgtagaacaggtcgacgaccggccgcgagtggcccgtggcagacccaggcggcaccgccgccttcttcttctccatctcagccccttccccctctaaccctaaccctatcgatcggctccggcggcgcgcgatcggctcccaaccctagtccctacgaacgaaccaagagaatcgaatcgaagcaagataaattgggggaagtcagatgtgaattgtggcgcggatcggcggcgggagcggatggggatgaggatgatctgggtcagtgggggtagatttgtacgcggatttattatttgttagagcagtgggttcgagcccggaggccggcctaggggccggacgcgtgggcggacgcgtgg

SEQ ID NO: 10459 - DNA, 920 bp, Triticum aestivum
  Clone ID: PAT_TA_10459
tttttttttttgcgaggaataatgtacgtatttaattcatttatcatgtttaatcgatccatgccatatcacagcacttaggaagtcggaaacacacacacacacacatcccgtccaaaattaattacactaggtagcattatcacgcatcgatgccgttacgtacgtgagccttgatcgctatacggccgccggcgacgtggaccgacttgatttggttccaagttacaagcgggacggcatgacgccgaatttgtcggcctcggtgacgacgtggttgcgggtgatgtcggccagcgagttgcagccgctcagcgccatggtcagctcgaactcgtcgcgcagcatcttgagcacgttgctcaccccggcctccccggccaccgccagcgagaacaccaccggccttccgatgaagacgccggcggcgccgagagcgagcgccttgaagacgtcggtgccgcggcgcacaccgccgtccaggaagacggggatctgcccgccagcacccttcacgacctcttccagggcgctgatggtcgccgggacgtagtccagttgccgggcgccgtggttggacacgatgattccggccgcgccgttctcgacggcgagcctgctgtcctctgcggtgatcactcctttcaccaggatcggcatcgtggtgatggactgcagccacttcacatcctgcaccacaaggctacatcttcagttcagagccacggtaactagaacaaatttcatacacgaatggagttagttgtcaagttcaactaagactttctttcttcttggtttaccttccagctcagtgtgcggtcgatctgaccggcgacatatgaagctagtcctgaatcgttagcctggtccattttcccgaggtccaaaccttcaaagttcttgagtgtcaaatttgg

SEQ ID NO: 10460 - DNA, 808 bp, Triticum aestivum
  unsure (1)..(808): unsure at all n locations
  Clone ID: PAT_TA_10460
gccggccgggttgggacaacccaatccgtcgcgatccacttcaagttccccaaatccccaaccccgcagcgcgcgcaggccgaagcccggttcgcagtcgacgagaagcaggagagatcgatggcgcgtacgaagcagaccgcccggaagtctaccggcggcaaggcgcctcgcaagcagctggccaccaaggcggcgaggaagtcggcgccgaccaccggcggcgtgaagaagccccaccgctacaggcccggcacggtggcgctgcgtgagatccgcaagtaccagaagagcacggagctgctcatccgcaagctgccgttccagcgcctggtgcgggagatcgcgcaggacttcaagacggacctccggttccagagccacgccgtgctggcgctccaggaggctgccgaggcgtacctcgtcgggctcttcgaggacaccaacctctgcgccatccacgccaagcgcgtcaccatcatgcccaaggacatccagctcgcccgccgcatccgcggggagcgcgcctagatcaagcatctgccttggcaacttccatcgccggattgctgcaatgtagtgtagctgtccgttcgtcgcctctggtttcagatcgtgttagcaataggcaataggccacttctattttgttgtaaaaaagtattctggttggttacatagttacaatgactcatttccatatttcgtctatatggttggcttgtgctaaaatgcaaacaaatgactcgttgtttcagagcaattctgtaatttcagcgctctgttctttgatcctgttgnnnaaaaa

SEQ ID NO: 10461 - DNA, 826 bp, Triticum aestivum
  Clone ID: PAT_TA_10461
ccgggccgggagtgcaacagaagtccgatcgccactcccccattaaacgcccctcctcaccttgaacgtccaaggaagcagcacacaagtccggccagccaagatgtcgtggcagacttacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggttatccagggtgaacctggggccgtcatccgtggcaagaagggagcaggaggcatcaccatcaagaagaccgggcaggcgctggtggttggcgcctacgaggagcccatgacccctgggcagtgcaacatggtggtggagaggctcggcgactacctcgttgaacaaggcatgtaggccaccccatcaatataacggcgtccacgatgatgatcagatcacacaattttcaagattctcttttaaatatctacggaaatatatgtgggccttttgtttccctcttcaagcggctctggcatccatcgctcatgatgaccagttgccctaacaagtttcatttgtaatgccttttcggctttccttcttcttcagtgggtccattattttggttgtcgtatgaattgtgttgacaacaaattttgtgctacatttctttcgattgtaaacttatagtactttttattttattttgaaaaggcctctttgattgcaaaaaaaaaa

SEQ ID NO: 10462 - DNA, 650 bp, Triticum aestivum
  Clone ID: PAT_TA_10462
gccggccgggttggctccgcagcccatcaccgcgccgccgccgccgccgccgccgccgccgcacccgtccgtctcctccctccgccgagcagcgtcccagtatccctccagtccccattatgcagaacgaggtgggtgatatggtggacctctatgtcccaaggaagtgctctgccacgaacaggatcataactgccaaggaccacgcctctgtccagatcaacatcgggcatgtggatgcgaatggactgtataatggcagtttcaccacgtttgccctctctggattcgtccgtgcccagggtgatgccgatggttctttggacaggctctggcagcagaagagggctgagatcaagcagtagatgagttctgcgaggaagattttgctaggataaatatttataaaaccgcttaaaaccttttttgaggaatctgttatgggtgtttatgctttgcctatgaatggtctatgataaaaccgtggactgcatgcagtgcttatggaaaccttgcttgaagaatcattatatctttgtccatgaatggtctatgtttctcagacgaaacactaaacttggtgtaatatgcttcctggcaatgtacctgaattctgaaatgcatttttgtcgctgctcttaaaaaaaaaa

SEQ ID NO: 10463 - DNA, 1522 bp, Triticum aestivum
  Clone ID: PAT_TA_10463
agctcgaaattaaccctactaaagggaacaaaagctggagctccacccgcggtggcggcccgctctagaactagtggatcccccgggctgcaggaattcggcacgagctcccctgtcctccccagagtctcttctcttctctcgtcgcctccccgagtctccggcaaccacgccagcgcggccatggagcaaggcaccgactccgcggcggcgaggcggatggccagggtcgcctcccacctctgcccgcccacctcgcagatggaggaggtggccatcttgaagggctctaattgccgtgcaaaaggtgcggcaccagggttcaaggtcgcagtcctgggtgcatctggtgggatcggccagccgctctcgctgcttatgaagatgaaccctcttgtttcggtgctccatttgtatgatgttgtcaacacacctgggtgtcacaagctgacattagccacatgaacactgggtgctgtggtgcgtggcttcttgggtcagccacaattggaaagtgctcttactggaatggatcttgtgatcattcctgctggcattcctcggaaacctgggatgacaagggatgatttgttcaacatcaatgctgggattgttcggactctttgcgagggaattgcaaaatgctgcccaaatgcgattgtgaatgtgatcagtaatcctgtaaattctaccgttccgattgctgctgaagtatttaaaaaagctggaacatattatcctaagcgtctattgggggtgacaacacttgatgtagtgagagccaatacctttgtgggagaggttcttggacttgaccccagagatgtcaatgttcctgttgttggtgggcatgcaggagttacgatattaccactcctttcacaggtgaatcctccctgttcgtttacctcagaagaaattagttatctcacttctcgcatacagaatggtgggacagaagtagttgaggcgaaggcaggagcaggatcagcaaccctttccatggcctacgcagcagccaaattcgcggacgcctgcctgagagggctgcgcggcgacgccgggatagtggagtgctcttacatagcctctcaggtgacggagctgcccttcttcgcgtccaaggtgcggctgggccggtccggcgtcgaggaggtcctgccgctcggcccgctgaacgagtttgagagggccgggctggagaaggccaagggcgagctggccgagagcatccacaagggcgtcgctttcgccaacaagtgaagatgggaagaaaatcctagcacgcagctccgtatctttcgccgaaatgctccaaggccagcatagaaatctgagatgccttttgcttcctgcctgctcccgcctgggagcaacagtccccgtgtgatgtgatgtaaatctccctgtcataacaataataataataataaaattgtactgtattttgtaccggtatatacgatgcggactacccgatgtttacgggctggtataataaataaatacctcgtgccgaatt

SEQ ID NO: 10464 - DNA, 1608 bp, Triticum aestivum
  Clone ID: PAT_TA_10464
ggtctcttcagcaaatgtcttagccaaagcagcatcgtcagtgatgagaatgttgtcaaacaaagttcctgacttaacctgccacagctcaattccgatgtacttcaggctgtcgaaagcatagatgtaaggatcatccttgaagtctgggttggcaatcataggtgccttccatttgccctggtagttagggttcttgattttcttttgcttccatgggcccttgtactctgggttggggatggttggggcagtccattcaccatcttcctcatcatcccaatcctcaggcttcttagcatcaggatcggtgacttccttgggaatgtcatcgtagccctctggcttgacgtcctcaggatcgggaatgtactccttgtcatcccagtcctctggcttcttagcttctgggtccttgatttccttgggaggaagaatatcccagtgctcgtagatgcttccagtttgcttctcttcgttgtcaatgagaatgctgtatgtggcatcagggcggatgatcaaagtgtacacatgcgacagctgatcagtctcgcaagaaccatttgatcaagaaggacgtgccttgcgagaccgatcagctgtcgcatgtgtacactttgatcatccgccctgatgccacatacagcattctcattgacaatgaagagaagcaaactggaagcatctacgagcactgggatattcttcctcccaaggaaatcaaggacccagaagctaagaagcctgaagattgggatgatgaggaagatggtgaatggactgccccaaccatccccaacccagagtacaagggcccatggaagcaaaagaaaatcaagaaccctaactaccagggcaaatggaaggcacctatgattgccaacccagacttcaaggatgatccttacatctatgctttcgacagcctgaagtacatcggaattgagctgtggcaggttaagtcaggaactttgtttgacaacattctcatcaccgacgatgctgctttggccaagacatttgccgaagagacctgggccaagcataaggaggctgagaaggctgctttcgatgctgctgaaaagaagaaggaagaggaggatgcttccaaggctggtgaggatgatgatgacttggatgatgaggaagccgatgaggaggacaaggatgacaaggctgggtctgatgcggagtctgatgacgagaagcacgatgagctctagatggatggcgaggaaggatgagaggagtcccccctgccttcgcgcctccgccaggatttattagttgtctctcattatgatgttcccctttttgtgatcagaaacttgacaagttactgtgtgtagaagaacaacatcactgtgggatctttgtagcgcttttgtagtccaatttttaccggaagggaacttatagtcggttaaacaagcaaaaaataatctttcactagtctctctgcatcctttggtacgactgagacgtcaagatggtgcttggtctaacgctttgttgcggcctggcatcatgttcagacttgagagtatgttttgcactatgtaggtgcaccacacgacgatgataagtagcaaacccgattgatgttcc

SEQ ID NO: 10465 - DNA, 1458 bp, Triticum aestivum
  unsure (1)..(1458): unsure at all n locations
  Clone ID: PAT_TA_10465
cgccctcgcaaccacctccgctgtctcttcttctcttccctctcccgtcgcctcccgagtctccggcgaccacgcggaaccgacgcggccatggagcaaggcgccgactccgcggcggcgaggcggatggccagggtcgcctcccacctccgcccgcccacctcgcaggaggaggaggtggccatcttgaagggctctaattgccgtgcaaaaggtgcagcaccagggttcaaggttgcagtcctgggtgcatctggtgggatcggccagcccctctcgctgcttatgaagatgaaccctcttgtttcggtgctccatttgtatgatgttgtcaacacacctggtgttacagctgacattagccatatgaacaccggtgctgtggtgcgtggcttcttgggtcagccacaattggaaagtgctcttactggaatggatcttgtgatcattcctgctggcattcctcggaaacctgggatgacaagggatgatttgttcaacatcaatgctggaattgttcggactctttgcgggggaattgcaaaatgctgcccaaatgcgattgtgaatgtgatcagtaaccctgtaaattccactgttccgattgctgctgaagtatttaaaaaagctggaacatatgatcctaagcgcctattgggggtgacaacacttgatgtagtgagagccaatacctttgtgggagaggttcttggacttgaccccagagatgtcaatgttcctgttgttggtgggcatgcaggagttacaatattaccactcctttcacaggtgaatcctccctgttcgtttacctcagaagaaattagttatctcacttcccgcatacagaatggtgggacagaagtagttgaggcgaaagcaggagcgggatccgcgactctttccatggcctacgcagcagccaggttcgcggacgcgtgcctgagagggctgcgcggcgacgccgggatagtggagtgctcctacatagcctctcaggtgacggagctggccttcttcgcgtccaaggtgcggctgggccgggccggcgtcgaggaggtcctgccgctcggcccgctgaacgagtttgagagggccgggctggagaaggccaagggcgagctcgccgagagcatccgcaagggcgtcgccttcgccaacaagtgagatgaaagatgggaagaaaatacagcacacagctcctccgtatctttcgccggatggaatgctccgaggcccagcatagaaatctgagacgcattttgcttcctgcctgtcagcaacggtccgcctgggagcaacggtcgccgtgtgatgtgatgtaaatctccctgtcatataacagtaataataatgatgataaattgtactgtatttataccggtatatacgatgcggacaacccgatgtttacggccgtactgtattatacactcganaataaaatacgacattaga

SEQ ID NO: 10466 - DNA, 700 bp, Triticum aestivum
  Clone ID: PAT_TA_10466
actacagaatccgtcgccttccacttcaagttccccaacccgcagcgcgcgcaagcagaagcccagttcgaattcccggcggcggaggagagaccgatggcgcgtacgaagcagacggcccggaagtcgaccggcggcaaggcgccccgcaagcagctggccaccaaggcggcgaggaagtcggcgccgaccacgggcggcgtgaagaagccccaccgctacaggcccgggaccgtggcgctgcgtgagatccgcaagtaccagaagagcacggagctgctcatccgcaagctgccgttccagcgcctggtgcgggagatcgcccaggacttcaagacggacctccggttccagagccacgccgtgctggcgctccaggaggccgccgaggcgtacctcgtcgggctcttcgaggacaccaacctctgcgccatccacgccaagcgcgtcaccatcatgcccaaggacatccagctcgcccgccgcatccgcggggagcgcgcatagattgcccaaggaaaagcaatgtagagctgtccgttcgtcgcctctggtttcagatcgtgttagcaataggcaagaggcgacttttattttgttgtagaaaaaactctggttggctacattgttacaatgactcgtttcttatttcgtctatattgttggtttgtgctaaaatgcaaacaaatgcatcattgtt

SEQ ID NO: 10467 - DNA, 1133 bp, Triticum aestivum
  Clone ID: PAT_TA_10467
gggctctccctctcctcctcctctcctcaccccaccaaaacctaagcaagaagggccagaggagctccgaatccaggctcgcatggccaacctcctgcacctcccggacctcgcggcggccagaccgcccgcgcccggcgtcgtgcggaggaggggggcgagggtcgtggcggcggccagggccgggggccgcgtgaagcaggaggaggccggggcggggacggggagggggcgggtgatcagggtcacggaccccgtgcgggacgggaggctgccggtgccggccccgccgccgctcttctccgtgccgatgacgccggcctcggagtcgccggcggcgaccacgcgccgggacaacgacgaggaggagcggcgcaggtactaccttaacctgggctacgccatccgcacgctcagggaggagatacccgacgtcttctacaaggagcccagcttcgatatctacagagatgatatcgtcttcagaaaccctttcaataaattcgagggcattgacaattacagaagtctattctggggattgcgctttactggacgtatcttctttaaagcattatgggttgatatagttagtatatggcagcctgccgagaatcttattatgattcgctggattgcccacgggcattcctagagtcccatgggatggccatgcccgctttgacggtgcctccgtttacaaactcgacaggaatgggaagatctatgagcataaggtacataacattgctacggaccccaccgacaaagtacaaggtcctgtctgtacaagagctagtcagatcacttagctgtccgtccactccaaaaccaacatatttcgaggcttcatctcaatctttgagcacggcgtcgctttattcgaggttggcatggatcagacgcctagcaaatctcagaggagaatagggtgggtcttagcacgatacttacaaaatctacctttttgttgtattgtagtcaccagtcactgatgagtagtactgaatcataactgttgtatatatgtacagagacaaatttatacagaataaatttgttcttggttgagctgtaaaaaaaaaaaaaaaaaactcacctcggccgcgaccacgctaatcactagtgaattc

SEQ ID NO: 10468 - DNA, 848 bp, Triticum aestivum
  Clone ID: PAT_TA_10468
gggggctgccgttcggcgattttgtattttgcgcagaggcctgtcagccttcaaagtattatgaagcgcactccatatagccagcgggtcacgattcaaattatggcttgttcagctcttctagagttgctcttatatttgcccaaaccatttattcacttgaggcatgtctggtacatatccatgggacgcctccacgctaatgacacaatcactaacatatccacacgcgacacacgtacacacagaagcactgcacccggccggccggttcgatggaacccatcatcacttggcgctgaaccctgagaagaagcggttgatggcagggaagacctccgggcggtgcgcgctgacgaagcggcggaaggcgtgctggctgtacctctcgccctcctccgcgttctccagcaccgcgctctgccggttgctcttgctcaccctgacgtctgggttgaggaagacgttccgggtgagctggaagacgcacatccccgtcaccagcgacatcgcgccgatcagcgggtaaacatctggcttcaaccaacggcccatgtcgtcgcctggcctagcgttgcgcttcgcgattgatctaaactctgatgaaagacgctgctctttcctcttccctgccaatggtttgcccattgtatccagagatatatacacatacatacgtgagtgtccagcgaggcgatcgagcaggatcagcaggctgcgacggcgtctcgggagacggatttctgtgggcgaccccgggatctatcgagaaaccatgagcggcctgctgtttttggagctcgctcgtcaaaggttgcccagttcccgtgtcaggtcagcccgcccgc

SEQ ID NO: 10469 - DNA, 2491 bp, Triticum aestivum
  Clone ID: PAT_TA_10469
gccacgtcttcgcctcgagagcctcgactacgaaattgtggagaatgatcttttcaagcaagactggcgatcgagaaagaagaatcagatatttcagtatgttgtcctgaaatgggcattagttcttcttattggcttgttgactgggcttgttggcttcttcaacaaccttgcagtcgagaatattgctggattcaaattggtgctcacaggtgatcttatgctccagaagaggtacttcacagcatttttggcatatggaggctgcaatctagtcttaggagccactgctgcagcactatgcgcttacatagcaccagctgctgctgggtctggcatccctgaagttaaagcatatcttaatggagttgatgcttactctattttagctcccagcacactctttgtgaagatatttggttcaatacttggagtttcaggtggatttgtacttgggaaagaaggtcccatggtgcatacaggggcatgcattgccaacttgcttggtcaggggggatcacgcaagtaccatctcacatggaattggctgaaatatttcaagaatgatagggatagacgagatttgattacatgtggtgcagcagctggagtggcagccgcatttcgtgcacctgttggtggtgtactctttgctctcgaggaagcagcatcatggtggcgaagtgctcttctgtggagaacattctttacaactgctgttgttgcagtagtgttgagggccctgattgagttctgtcgtaaaggaaaatgtggtctctttggtcaaggagggttgattatgtttgatcttagctcgaacgtcccatcatatggtactcaagatctcatcgcgattattattcttggagtaattggtggcgtcttcggaggccttttcaactttctcctggataggattcttcgtgtctacagcattatcaatgagagaggtgctccatcaaagatccttctcaccatcacaatatcgatcatcacttcggcgtgctcctatgggctcccttggcttgctgcgtgctccccatgccctgttggttcgatggaggaatgccccaccattggccgctctggaaattttaagagcttccagtgcccgcctggtcattacaatggtcttgcatcactcttcttcaacacaaatgtctacgccatccgcaatctcttcagccgtggtaccgaaaatgagttccacatgtctagccttttcgtcttcttcatcgccatctactgccttggtctcgtgacgtatggtattgctgtcccttctggtctctttatcccggtaatacttgccggggcaacatatgggcgcatcgtggggacacttctcggtcccatgtctgacatcgaccctggcctctttgcactgctgggtgccgcatctttccttggtggaacaatgagaatgaccgtgtcggtctgcgtgatccttctagagctcacgaatgagctccatatgctccccttggtcatgctcgtcctcctgatatcgaagaccatagccgattgcttcaacaaaggtgtgtatgaccagatcgtggtgatgaaaggcttgccattcatggaggctcatgctgaaccgtacatgaggcacttggtagctagtgatgttgtgtctgggccactcatctccttttcgggtgttgagaaggtgggcaacatcgttcatgcgttaaggatcaccggccacaacgggtttccggtggtccgatgagccgcctgtatcagaagctccggagctggttgggctggtgcttaggtcacatgtgttggttcttctgagtgggaggaacttcatgaaggagaaggtgaaaacaagtggtagctttgtgctcagaagatttggtgcgtttgactttgcaaagcctggttccgggaaaggtatgaaaatcgaggacctagatttcaccgaggaagaaatggagatgtatgtggatctccatccaatcacaaacacttcgccgtacacggtggtcgaaacaatgtcgcttgcaaaggctgcagtcctgttcagggcactagggctaagacacctgctggttgtgccaaagaccccagggagatttcctattgttgggattctcacgaggcacgatctgatgccggagcatatccatgggctgttccccaatctccgcaagtcacactgagaagcaaaatcagcaggccacacaaaattttcttgcagtattgttatttctcatgaaggtgctgcttcattggatcatggaataatcaatctgatatatttattgtaaaaagagctgattccccaatcagcagtcgagtggatttcattttttttttttgcggggggagtggtttcattttggcacctgtgatcttgtgtaacaaaacaacctcccttgtcagtacatgttccccttttgcttcacacatcttctcatatcaccgctgtacttggaccgcaacacctgtcggtagtacaacatcttcatagcgatcctgaaca

SEQ ID NO: 10470 - DNA, 738 bp, Triticum aestivum
  Clone ID: PAT_TA_10470
gccggccgggtcatcagcctggtataaatccaaatccggtcaccgcttgatccctctccgcagcccatcaccgccgccgccgccgcacccgtccgtctcctccctccgccgagcagtgtcccagtatccctccagtccccattatgcagaacgaggtgggtgatatggtggacctctatgtcccaaggaagtgctctgccaccaacaggatcataactgccaaggaccacgcctctgtccagatcaacatcgggcatgtggatgcgaatggactgtataatggcagtttcaccacgtttgccctctctggattcgtccgcgcccagggtgatgccgatggttctttggacaggctctggcagcagaagagggctgagatcaagcagtagatgagttccgtgaggaagattttgctaggatagatatttatgaaaccgctttaaaccttttctcaggaatctgttatgggtgtttatgctttgcctatgaatggtctatgataaaaccgtggactgcacgcagtgcttatggaaaccttgcttgaagaatcattatatctttgtccatgaatggtctatgtttctaagaggaaacaccagacttggtgtaatatgcttcctggcaatgtacctgaattctgaaatgcattttagtcgctgctcttatggctgtcttggattattgtgcttgctttctctaataagttggagaaggggctgtttgctgttaaaaaaaaaa

SEQ ID NO: 10471 - DNA, 835 bp, Triticum aestivum
  Clone ID: PAT_TA_10471
acctcaccacgaactccgatcgccactcccccagagaaatcctcctcacctcgaaacttccgtgaagcagcaaacgcaagtccggccaagatgtcgtggcagacgtacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggtcatccagggtgaacctggcgctgtcatccgtggcaagaagggagcaggaggcatcaccatcaagaagaccgggcaggcgctggtggttggcgcctacgaggagcccatgacccctgggcagtgcaacatggtggtggagaggctcggcgactacctcgttgaacaaggcatgtaggccaccccatcaatataacggcgtccacgacgatcacacaattttcaagattctcttttaaatatctacggaaatatatgtgggcctttttccccctcttcaagcggctctggcatccatcactcatgatgaccagttgctctaacaagttccatttgtaatgccttttcggctttccttcttcttcagtgggtccattattttggttgtctatgaattgtgtcgacaacaaattttgcgctacatttctttcgattgtaaacttatagtacttttttattttattttgaaaatgcctctttgattgcaatggcatcgcatattatagggtggtgtgcaatccctttag

SEQ ID NO: 10472 - DNA, 888 bp, Triticum aestivum
  Clone ID: PAT_TA_10472
tttttttttttctgaaacactacgagcacacacacttcctaacaacgatctaacagacgacgcatggattgcagatcgcggcctaggccctctcgccacggatgcggcgggcgagctggatgtccttgggcatgatggtgacgcgcttggcgtggatggcgcagaggttggtgtcctcgaagaggccgacgaggtaggcctcggcggcctcctgcagcgcggagacggcggaggactggaaatcagaatcaaacgagcttttacccttttgttccacacgagatttctgttctcgttgagctcatcttaggacacctgcgttaacttttaacagatgtgccgccccagccaaactccccacctgacaatgtcttccgcccggatcggcccggtaagaccgggccttggagccaaaaggaggggacatgccccgcttccgacccacggaataagtaaaataacgttaaaagtagtggtatttcacttgcgcccgtgagggctcccacttatcctacacctctcaagtcatttcacaaagtcggactagagtcaagctcaacagggtcttctttccccgctgattccgccaagcccgttcccttggctcttgctgcatggctccaccgcgtttaatttactgctttactagttctactgtttccttaataaattagtttactgctgctgcttcgatcgtacgttgtggccgccgttgttgccacgagagctgtgatcttgtactcctgaggggacctcgtgtactttgtcggaactattgtaatgcatgcttacatctatataaaaaaaaaaaaaaaaaaaaaggaaacgcaaatccggatccgttcctctttctcggaccggccgatggcgtcggcgtcggcgtcggcg

SEQ ID NO: 10473 - DNA, 1742 bp, Triticum aestivum
  Clone ID: PAT_TA_10473
cgcctccccccaccactccccctcctcctttgctagatccaatccaccaacctcctccatggcgctctccgtggagaagaccgcgtccggccgggagtacaaggtgaaggacctctcccaggccgacttcggccgcctcgagctggagctcgccgaggtcgagatgccgggcctcatggcctgccgcgccgagttcgggccctcgcagcccttcaagggcgcccggatctcgggctccctccacatgaccatccagaccgccgtcctcatcgagaccctcaccgcgctcggcgccgaggtccgctggtgctcctgcaacatcttctccacccaggaccacgccgccgccgccatcgcgcgcgactcggggcgccgtcttcgcctggaagggcgagacgctcgaggagtactgggtggtgcaccgagcgctgcctcgactggggcgccggcggcggccccgacctcatcgtcgacgacggcggcgacgccacgctgctcatccacgagggcgtcaaggccgaggaggagttcgagaggtccggcaaggtccccgacccggcttccaccgacaaccccgagttcaagatcgtgctcaccatcatccgcgacgggctcaagaccgacgcccgcaagtaccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgccactcgctccctgatggtcttatgagggctactgatgttatgatcgccggcaaggttgctgtggtctgcggttatggtgatgttggcaagggctgtgccgccgcactcaagcaggctggtgcccgtgtgatcgtgacagagattgaccccatctgtgcccttcaggccctgatggagggcatccagatcctcaccttggaggacgttgtctctgatgctgacatctttgtgaccaccactggaaacaaggacatcatcatggttgaccacatgaggaagatgaagaacaatgccattgtctgcaacattggtcactttgacaacgagatcgacatgaacggcctggagacctaccctggtgtcaagcgcatcaccatcaagcctcagactgaccgttgggtcttccctgagaccaacactggcatcattgttcttgctgagggccgtctgatgaaccttggctgtgccactggccaccccagctttgtcatgtcttgctcattcactaaccaggttattgctcagctggagttgtggaaggagaaggccaccggcaagtatgagaagaaggtgtacgtgctccccaagcacctggatgagaaggtcgccgccctccacctgggcaagctcggtgctaggctgaccaagctcaccaaggcccagtctgagtacatcagcatcccagttgagggtccctacaagcctgcggcgtaccggtactagtgtgtgtgtccagcacgactagcggctggcctgagcctgagcggcggcactctgccacggcgacctatgaacctgttttcctttgcacttgtctatctagatctaggcatgtgttctcttaggccgaggatttgtcayggttatgtttttagaccggtgagggtgttggtggacggaggtggcggtttgcttttgcccagaaataatggkggtaattattttgg

SEQ ID NO: 10474 - DNA, 680 bp, Triticum aestivum
  Clone ID: PAT_TA_10474
gccggccgggttccgaaaaaaaaaaaaaaaaaaaaaaaaaaaaaaaactccgcagcccatcacagctccgccgccgccgcacccgtccatctccccccttaaccgagtgtcccagtatccctccagtccccattatgcagaacgaggtgggtgatatggtggacctctatgtcccaaggaagtgctctgccaccaacaggatcataactgccaaggaccatgcctctgtccagatcaacatcgggcatgtggatgcgaatggactgtataatggcagtttcaccacgtttgccctctctggattcgtccgcgcccagggtgatgctgatggttctttggacaggctctggcagcagaagagggctgagatcaagcagtagatgagttccgcgtggcagattttgctaggatggatatttatgaaaccgctttaaaccttttttgaggaatctgttatgggtgtttatgctttgcctatgaatggtctatgataaaaccgtggactgcacgcagtgcttatggaaaccttacttgaagaatcattatatctttgtccatgaatggtctatgtttctaagaggaaacactagacttggtgtaatatgcttcctggcaatgtgcctgaattcttaaatgcattttagtcgctgctctaaaaaaaaaaaaaaaaaaggccccta

SEQ ID NO: 10475 - DNA, 2364 bp, Triticum aestivum
  Clone ID: PAT_TA_10475
ctcacctcgtctctacccctcgatctccgtcgccgtcttcccccattctcccaggaccgaccatcctccccctcccgatctaccccgccgacgccgccgagatcctcgttccatggtgtcgtgacggcggcggcgctcatggaccccaagtcccccgacgaccgcccggaggcggcggcgccacagccgctagagtggcggttcgcgcaggtcttcggcgagcgcggtgctggcgaggacgtgcaggaagttgacatcatttctgcaatcgagtttgacaaatctggtgatcatcttgccactggtgataggggtggacgcgtagttttgtttgaaagaactgatgccaggggtaatgccagtcggacagagcttgagagacaagattattcggtggcccaggcatcctgagttccgctataaaactgaatttcagagtcatgaacctgagttcgattacctaaagagtttggaaatagaggagaaaatcaacaagatcaagtggggccaaacagccaacaatgctctctttatcttgtctacaaatgacaaaacaatcaagtactggaaggtgcaagacaaaaaagtgaaacggatttcagtaatgaatttggatacttcccagagtgcagacaatgggacaacttctagttcgagtaccagtagctctagaggtcttcctaatggaggatcctcagaaaagtcatacaattgtgcaaacaatgatctgccattccctcctgggggatatgcatcattgcgtttgcctgtggtagttacaggccaagagttaaaccctgtcgctagatgccggcgtgtatatgcacacgcccatgattaccatatcaattccatttcaaataatagtgatggcgagacattcatatcagcagatgatctgcgaattaatctgtggaatttggaaatcaacagtcagagctttaacattgttgatgtgaagcctgcaaacatggaggatctaactgaggtgattacatgtgcggagttccatccaactcactgtaatacactagcctatagtagctcaaagggcgctatcaggcttattgacctgcggcaatcagcactgtgtgacaaccattctaaactatttgaggagcatgaagcacctggatcaaaatccttttttacggagataattgcatccgtttcagatataaagtttgcaagggatggacggcatattcttagtcgtgattatatgactctcaagttatgggatctcaacatggattcaggcccagtagcaactttccaagttcatgaacatttaaggcctaagctttgcgatctatatgaaaacgattcaatctttgacaaatttgaatgttgtttgagtggggatggtcatcgtcttgctactggctcttacagtaatttattccgtgtttttggttgtactcctggaaatactgaggcaaccactttagaagcaagcagaaaccctatgaggcgtcaggttgctaatccaacaaggcctacaagaaccctgacctctttgacccgtgctgtgaggagagggggtgaaaatgcaggagccgatggcaatgggaattctaatgacttctcaacaaagttactccatcttgcgtggcacccaactgagaattccattgcgtgtgctgctgggaatagcttgtacatgtattatgcatagggaatgtgctagagaagattcactgtttttggtttgttcaatgtgaaagcttgggccttgcacatgcaaccagggaaatggtgcaggacattgtcgtcaattccgtgattggggtcgaaagaggcggttggcacccacgggatggatatccttcaactccaagcatagcagactatttccttctgattctttagtaaatgtgaaacacaaattctaatcgcaccaaagtttttgggtcccaagatatgattgtagctgcatgtgtagccaaaacaccagcagttggaggacagagcagaagatagcaaggctgattctaatttcacttggtcacaggaaatatctgcttactgtggatgtaagaaatttgcttctcttcaaatgtaatgtaatgccgcctagccagggttaaccatctgctgtcaccaacggtgaaacatctgtggacataaattatgacttgtagttctccccccttgttctatttgttggtggtccaaacttacaataagtttgcaggtgtgactcaactcctgctgcatgtgatcggctgtgacctataagttgtatatgctacattttgccatgcaaaactcacaactaatgatatgaattcttgagtattcatgtctggcttgtgcaatatatatgcatttttgcaaaaaaaaaaaaaaaaaaaaaaaaac

SEQ ID NO: 10476 - DNA, 1580 bp, Triticum aestivum
  Clone ID: PAT_TA_10476
tcggcacgaggcatcgacctctctgccctcatttcgttttcccccattccccttcgcacccccgcggcggcggagccttcccgggcgctcaccggacacgcgcaacaacactatgaggaggtacagccccccacaccgtagtcccccgaggaggggatatggcggcagccccgctcatcgtagtcccccaaggaggggatatggtggcagccccccgcaccgcagccccccaaggaggggatatggtggcagaggaagaagtccccctaggaggggtggatatggaggacggaaggagcagggttctggaagtctcttggttcgcaacatcccattaagcgccagagcggaggatctccgtgttccttttgaaaggtttggtcctgtcagggatgtttaccttccgaaggattattatagcggggagccacgagggtttgcgtttgtggagtttgttgacccttatgacgcctctgaggcccaataccacatgaatcgccaggttttttttggccgggagataactgttgtgcttgctgctgagtcacggaaaaggccagaggatatgcgcactagaaccagagtcagggggtattctggaggtcatgaagggcgccgttcctctcattatgggaggtctcgttcccgttcacgctccgcctctccccgcccccgtggcggtggccgtgctcggtcaaggtcatactctcctgctccaagacggcgagatgactactctgcttccccacggggaagggagtctcatcgcactaaatctcctgtgcgtcatccaaaagaacatgaagaggacaaaaggagatcctactctccccctggtagagatggtgaccaacgtgatgctgataacgggtatgagaagaggtcgccaccggccgacagtgatggatccccttcacgcccgagggtggccaggccatcctcaggatcgccccccggatcccgctccaggtcccccgacgcttctcccgcccgcagcgactgagaaattggttacatcctctgcggttgccgcatctccatctagctacttccattggttcgagtaaaacccttcgaggtgtgttgtattgcttgttagcggtcacagacgttatgttcccgcttgttgctgttgaaccttaaggcctgtagcatggcgtgtctgtcatatctatgtaccatgtgtgtggagtgtcagggacccattttccatgtactttgtttgggaaaaaggttgtgagttgatccaacactgatgagtgaagcaatcgggccagtgggtggatgaacggctctgcatgcagcagcagctgcagcgcaccctcccttcaatcatggaggccattgcttgggcaccaggtgccatcagagtttactctttaggtggtgatgctcatggtaggcaagcagacgtggtgtggcagcaagcgcatgcatgcgacctatggatcgcttcgggcgtgcagctgccttttgtggttcccagcttttctttgtccctttgacgaacaaaacatatctttcggctaggcgggtgattggaaattggaccatcaatccgttgccccatccatccatta

SEQ ID NO: 10477 - DNA, 1439 bp, Triticum aestivum
  Clone ID: PAT_TA_10477
acgcctgcgcttccgtctcgtgacttgccttcccctgccgctgcggctgcgagcttcggggcgccatggcgcaaacctcacctattccccgcgtcagcctcggcacccaaggactggaggtgatcttccccttgccctctcgcaaccctcgatttatttatgtatcttctgcccggccggtctcgcactgaatcgaatcgaatcgaatcgaatgatccaacaaccaaggtgtccaagctggggttcgggtgcatgggcctcacaggctcctacaactccccggtcgaggacgacgccggcgtcgccgtcatcacgcacgccttcaaccgcggcgtcaccttcttcgacacctccgacgtctacgggccccacgccaacgagatcctcctcggcaaggcgctgaagcagctgccgcgggagcaggtgcaggtggccaccaagtttgggattcagcgggatgcccagggcaagagcaccatctgcggccgcccggagtacgtgcgcgcctgctgcgaggccagcctgcaccgcctcggcgtccaccacatcgacctctactaccagcaccgcatcgacaccaccatccccatcgaggacacgattggtgagctcaagaagcttgtggaggaggggaaggtcaagtacattgggttatcggaggcgagcccggacaccatcaggcgtgctcacgccgtgcaccccatctcctccgtgcagatggagtggtctctgtgggctcgcgacatcgagcccgagatcgtgcctctctgcagagagctagggattggaattgttccctacagcccgattgctcgtgggtttttcggtggaaggggagtgacacaacaagtgtctgctgaatctagtctgaaaggccatccacgtttttcggctgaaaacctggagaagaacaagcaactttatctgaaaatagaagaactggccaagaagcaccagtgcagccctgctcagctagctttatcttgggttctgcatcaaggggatgatgtggttccgataccagggactactaagataaagaatctagactccaacattgactccttgaaggtgaggctcacggaagatgacctcaaagagatcagcaacgagatacgcgaagaagatgttgcgggtggaaggcaatatacttcatttgcgaaattcacctggaattatgcggatacgccaaagaagtgaaactacaaaagatcatggagacggtgaaacaagcatgccatgctatgtgctagtgtgatgaatggtgctccctgtatcttcatcctgtgaattgtcccgctctgaataagaacatgtgcactgtctccacctgccgtgtagatttatgtgtgcttgtataacagaagactgagaccgtgcttgctaaaaaaaaaaaaaaaaacctgcccgggcggccgctcgaaatcactagtgaattc

SEQ ID NO: 10478 - DNA, 1722 bp, Triticum aestivum
  Clone ID: PAT_TA_10478
cgtcgtcgtaatcatagaagagatcgatgggcaaaaacagtgttaacacgattgacatttgtatggcaactgctatcggcgatacataagttttaactttctgcgaacaaactagctgctttctccttggtttattctgactctttagatgctaccttgacagtctacttgaagactaaagagtgccccatacagaaatccaccgtcccgctcacggcagacgagtccgtccacccgcacttggtcggcaaagaagcttcgacatgacggactcgagggcgacaccgtgagaccagagccggctgtgacggacggcaccccccaacaaggcttaaccactgccaggttcggtgacgatgtgatcctccctcctacgcctcggtctgcccctccttggtgatgtggaaaccttcgattttacgggcgacctcgtttgccgcggccaccgcggcagcctttggtttgccattggcggtgggtgcctcggcgtcatcggcatttgcagggttcagtggccagatccgaatggtgccgtcttctgaccctgatgcgtatgactcgccaacaggcgcaaaccggacgcagtggacggggccgtgatgacctttgttgcaggctatttcttcaccagtgaagaaatcatatacatgaacccacatatcttcccctccagtgatgaacttactcccagactttggttcaagtgaagctgactccacagtgcatgacatatcatagcttttaacaagcccaaaatgattcgcatcccaaaatttaacacttgagccatcagctgtagtgatgaacctgccgtcctggcttacttctgcactcgtgacaggtgccttggtttcaagagtttggacaatttttccacttctcacatcccataacctcactccacccatatcagagcaggaacttagaatagattggtcactgtgaagccaagcaacagttcgtacagatccaggtgttttgtcaagttctcttggagctgcatctggacgattcatatcatatatacgcaaaatcttctccacacctccagtgagcaacatgtgtgtatcctcagaaaaggcacatgcgcggactatatgcttgtgctcaaacgaatgtagctcatttcctgttagtgcatcccatattttggctgagaagtccgcagaaccggaggcagcacggagagcatttgtgtcgagacaagagctccaaactgcacctttatgaccttcaaaggtcccaatccaatctccagtatcaccattacgaagcatcggatttgagtccttgctggcgctgatgaggaagtagccgtcgggcgtgacggggctgtagaacaggtcgaccaccggccgcgagtggccgtggcacaccttggacaccgccaccttcttcttctccatttctcctggctccccttccgttcgcctccccgggcagcctggctcgtgtactccggcggcggtggcctgaaatgcggcgccctcctccccgaggccctaaccctagccccgatcggaaaaaaaaataccagggagaatcgagggtaaaaaatcgctcggcgaggcgcgggatcggctgatccggatccctggagtttgatctgtacaggagttttattggatagaggcggcaatggggtgcgggagggagccgagggtgaggctgtgtggctcgcctcgggggtggggggactgggcgaaggagcctcgtgccgaa

SEQ ID NO: 10479 - DNA, 691 bp, Triticum aestivum
  Clone ID: PAT_TA_10479
taccggtccggaattttgggtcgacccacgcgtccgcccacccagcaacatccccaacaccggcgccatggcccgcaccaaacagacggcgaggaagtccaccggcggcaaggcgccgaggaagcagctggcgaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgggagatcgcccaggacttcaagaccgacctccgcttccagtcctccgccgtctccgccctgcaggaggccgccgaggcctacctggtggggctgttcgaggacaccaacctctgcgccatccacgccaagcgcgtcaccatcatgcccaaggacatccagctcgcccgccgcatccgtggcgagagggcctaggccgcgatctgcaatccatgcgtcgtctgttagatccttgttaggaagtgcgtgtgctagtagtgtttcagaatgtgcctgtgttgttcttgtcatggtggatctgttatgcctaatctgatggtaccttcttgttgctatcatctatggaaatgaaaaatgttggcttcctgttctcattcatctgcgtttgaatgcctgttcccaacgtgc

SEQ ID NO: 10480 - DNA, 2104 bp, Triticum aestivum
  Clone ID: PAT_TA_10480
gaggagtttttttttcttttttttgacagcgacctccttattaattaatagcatcatgctgaaacataagataagatggattaaccaaaataccaaaccaaactcgacaaccaccacacccacgaacaagcttattccgccgaacgaccacacaacacctagaccctgaccaaccagctagctacgccaaaattgcacaatcaagtttgcaaatcatatgcgcctagagcttgaggaagacaaactcttcgatcgcagggatctccccgatcttggtcagcgtggccttgctgggctcctcatcgacgcctatcgccatgatagccgtcttgcggggagcgatcctcccgacgctcatgaagctgacgttgacgttctcctcgcccaggacgcttccgaccgacccgatcatgccgggctggtcgacctgcctgcacaggatcaggctgccctccatgctcacgtccacctcgaacgctccgaccttggtaaggtgagggatgccgtccttcacccgcccctccaccgtgaccagtccggagtcgcatatcgcactggggaatttggactccacattggctatctgaacctgaatgtactcgagaggtgtctcgggtgagccatccatcacgattttctcctcgctgacacggatgcccctctgcttcgcggtaaagtcggcgttgaccagattgacgaaaacgtcggagattggttcgatcacacccttggtgatcattgcacggagaagtcttgtgtcaagatcatcgggagcccttgcagatgcataggtcaccttcacagacttgataccgccaccaccggcaacaagctggacagctaggcgcccaagcttttcagcgagcatgacataaggtgcaagctctgaaagcacctcagcgggaaccattggtgcattgaccgccgaagctgcaagctcccctttcagagctccagtgacagcttcagctatttcaatagccactccttcctgtgcttccactgtgctggcaccaagatgtggtgtcacagtaacattctcgtgcagcactaacttgctgtctgctgccggaggctccttagtgaacacatcaagagcagcctgtgcaacaattcctgcatcaagggccctgactagagcatcttcatcaatcacaccaccacgggcaacatttataatccgaacacccttcttcatcttcgcaaaggcttcatcattgagcatcttgtttgttgaaggggtaaggggcatatgcaacgagataaagtcagcagttgtcatagcctcttccatgctcaataggtcaactccaattgcacgagcacgatcagctgaagcatatggatcgtgtgcaatcacgtgcattcctagacctttggcacgtcgtgcgacctctgacccgacctttccaaatccaaggatagcaagagttttgccaacaagagacacaccaacatacttggttcgcgcccatttaccagccttgagcgaggcgtcggcctgggcgacgttccgggccatggcgcagagcagcgcgatgccgtgctcggcggcggcgacggtgttggcggtgggcgcgttgacgacgaggcagccgtgctcggtggcggcggcgagatcgacgttgtcgatcccgacccccgcgcggccgacgacgcggagccggccccccgaggcctcgaagacgtcgcggccgaccttggtccccgagcgcacgatgagcgcgtcgcagagcgagatcttggcgcggagctcctcgggggagaggccgtaggagcagtcgacgttggcgaactcccggagcagcgccagccccgcggcgccgagcttctcggccacgagcaccgtgggcttgccctcgacggccaccgcggccgtcgcgggcggggacgcggtcgacgcggcgggggcggcgggcgcggagacgcagatgcggccgcggctggcgcgggcgagggagagggccgcgcggcgggccggggccgggaggagggcgcggtggtgggtggcggcggcggtggtcggggacggcgccgccatggtgggtggggtttggggttttggggaggggagtgcgggctggctctgggctctgcctcgtgc

SEQ ID NO: 10481 - DNA, 1589 bp, Triticum aestivum
  Clone ID: PAT_TA_10481
cgtccgcccacgcgtccgcccacgcgtccgcggacgcgtgggtccgatcggatcgggggaaaggcttccacgagctctcgtctcgactgccgccgccgcccgcccgagatggcgatccgccgtggctcctcctgcgccgtcctcgccctgctcgcgctcgcctccgtctccgccgtcagcgccgacgtcttcttccaggagaagttcgaagatggctgggaaagccggtgggtcaagtctgagtggaagaaggacgagaacatggccggtgaatggaaccacacatctggaaaatggcacggagatgctgaggacaaaggtatccaaacctcagaggactacaggttctacgccatctcggcggagtaccctgagttcagcaacaaggacaagacactcgtgctgcagttcacggtgaagcatgagcagaagcttgactgcggtggtggttacgtcaagttgcttggaggtgatgttgaccagaagaaattcggtggtgacacaccctacagcattatgtttggaccagatatctgtgggtacagcaccaagaaggttcacactatccttactaaggatggcaagaaccatttgatcaagaaggatgtgccttgcgagactgatcagctgtcacatgtgtacactttgatcatccgccctgatgctacatacagcattctcattgacaacgaagagaagcaaactggaagcatctacgagcactgggatattcttcctcccaaggaaatcaaggacccagaagctaagaagccagaggactgggatgacaaggagtacattcctgatcctgaggacgtcaagccagagggctatgatgacattcccaaggaagtcaccgattctgatgctaagaagcctgaggattggatgatgaggaagatggtgaatggactgcccctaccattccaaacccagaatacaagggaccatggaagcaaaagaaaatcaagaacccgaactaccagggtaaatggaaggcacctatgattgacaatccagagttcaaggatgatccttacatctacgcttttgacagcctgaagcacattggcattgagctgtggcaggttaaatcaggaactctgttcgacaacatcctgatcactgatgaccccgagtacgccaagaagttcgcggaggagacctggggcaagcacaaggatgctgagaaggctgcctttgatgaggccgagaagaagaggcttgaggaggaatctgcaaacgctaagaccgaagacaatgacgatgcagctgatgaggatgagggcaaagctgccggtgccagtgatgaggagaacaaggatgcctccggcgatgagaaggtggaggaaattagcaaggatgcttcttcttcttctgacaagaaggacgagctttagagtgtggcaggcaggctctatatctaaactttttcctcttgaggcagtagaacttcccatccagcaattagaagaacattttctctgaaagttgagagaagaagtaatgcaatctcggctcttgtaatttgttatgtgttttttgtcggtcataggaaatatagcgtagtcatgaatctaaaaaaaaaa

SEQ ID NO: 10482 - DNA, 784 bp, Triticum aestivum
  Clone ID: PAT_TA_10482
gccggccgggttctcacaacccaatccgtcgccttccagttcaagttccccaaccggcagcgcgcgcaagccgaagcccagttagaattcgcgtaggaggaggagagatccgatggcgcgcacgaagcagacggcccggaagtccaccggcggcaaggcgccccgcaagcagctggccaccaaggcggcgaggaagtcggcgccgaccaccggcggcgtgaagaagccccaccgctacaggcctggcacggtggcgctgcgcgagatccgcaagtaccagaagagcacggagctgctcatccgcaagctgccgttccagcgcctggtgcgggagatcgcgcaggacttcaagacggatctccgcttccagagccacgcggtgctggcgctccaggaggccgccgaggcgtatctcgtcgggctcttcgaggacaccaacctctgcgccatccacgccaagcgcgtcaccatcatgcccaagggacatccagctggcgcgccgcatccgaggggagcgcgcctagatcaagcatctgccttagcaacttccatcgctggattgcagcaatgtagctgtctgttcgtcgcctctggtttcagatcgtgttggcaataggcgacttttattttgctgtaaaaaaaaattctggttggttacagagttacaacgactcattttcttatttcgtctaaggcttgtgctaaaatgcaaaacaagttactcgttgttttagagcaattctgtaatttcagcgctctgttcctcctgttaattttgctgtcc

SEQ ID NO: 10483 - DNA, 1652 bp, Triticum aestivum
  Clone ID: PAT_TA_10483
gcgggggcaagggaaggggttccgatcggatcggggaaaagcttccacgagctctcgacgactggtgggtgtgagcgccgccgcacgagatggcgatccgccgtgggccctcctgcgccgtcctcgccctgctcgcgctcgcctccgtcgccgcggtctccgccgacgtcttcttccaggagaagttcgaagatggttgggaaagccggtgggtcaagtctgagtggaagaaggacgagaacatggctggtgaatggaaccacacatctggaaaatggcacggagatgctgaggacaaaggtatccaaacctcagaggactacaggttctacgccatttcggcggagtaccctgagttcagcaacaaggacaagacactcgtgctgcagttcacggtgaagcatgagcagaagcttgactgcggtggtggttacgtcaagttgcttggaggtgatgttgaccagaagaaattcggtggtgacacgccctacagcattatgtttggaccagatatctgtgggtacagcaccaagaaggttcacactatccttaccaaggatggcaagaaccatttgatcaagaaggacgtgccttgcgagactgatcagctgtcgcacgtgtacactttgatcatccgccctgatgctacatacagcattctcattgacaacgaagagaagcaaactggaagcatctacgagcactgggatattcttcctcccaaggaaatcaaggacccagaagctaagaagccagaggactgggatgacaaggagtacattcctgaccctgaggatgtcaagccagagggctacgatgatattcccagggaggtcaccgatcctgatgctaagaagcctgaggattgggatgatgaggaagatggtgaatggactgccccaaccatccccaacccagagtacaagggcccatggaagcaaaagaaaatcaagaaccctaactaccagggcaaatggaaggcacctatgattgccaacccagacttcaaggatgatccttacatctatgctttcaacagcctgaagtacatcggaattgagctgtggcaggttaagtcaggaactttgtttgacaacattctcatcaccgacgatgctgctttggccaagacatttgccgaagagacctgggccaagcataaggaggctgagaaggctgctttcgacgctgctgaaaagaagaaggaagaggaggatgcttccaaggctggtgaggacgatgatgacttggatgatgaggaagccgacgacgaggacaaggatgacaaggctgggtctgatgcggagtctgacgacgagaagcacgatgagctctagatggatggcgaggaaggatttgaggaggccgcctgccttccaggatttattagttgtccctcattatgatgttcccctttttgtgatcagaaacttgacaagttagttactgtgtgtagaagaacaacatcaccgtgggatctttgtagcgcttttgtagtccaatttttaccggaagggaactttatagtcgttaaacgagcaaaaaataaaaaaaaaatcgtgcacttgtctgtctgcaaaaaaaaaaaaaagtaaaggaggtttatccccaccaaaattcaagagttgggaaaaaccaatctgggtttccaa

SEQ ID NO: 10484 - DNA, 1521 bp, Triticum aestivum
  Clone ID: PAT_TA_10484
cgaagctcggagctcggacagccgctcgttccgattacatatagcgggtcactgatctcactggacggttcgctactgactgcctactggcaacattcacgcctgcgctgcgcttccgtcccgtgacttgcctgccttcccctgccgccgcggctgcgagcttcagggcgccatggcgcaaaccccaccgattccccgcgtcagcctcggcacccaagggactggaggtgtccaagctggggttcgggtgcatgggcctcacaggctcctacaactccccggtcgaggacgacgccggcgtcgccgtcatcacgcacgccttccgccgcggcgtcaccttcttcgacacctccgacgtctacggggccccacgccaacgagatcctcctcggcaaggcgctgaagcagctgccgcgggagcaggttcaggtggccaccaagtttgggattcagcgggatgcccagggcaagagcaccatctgcggccgcccggagtacgtgcgcgcctgctgcgaggccagcctgcaccgcctcggcgtcgaccacatcgacctctactaccagcaccgcatcgacaccaccatccccatcgaggacacgattggtgagctcaagaagcttgtggaggaggggaaggtcaagtacattgggttatcggaggctagcccggacaccatccggcgtgctcacgctgtgcaccccatctctgccgtgcagatggagtggtctctgtgggctcgcgacatcgagcccgagatcgtgcctctctgcagggagctagggattggaattgttccctacagcccgattgcccgtgggtttttcggtggaaggggagtgacacaacaagtgtctgctgaatctagtctgaaaggccatccacgtttttcggctgaaaacctgggagaagaacaagcaactctatctgaaaatggaagaactggccaagaagcaccagtgcagccctgctcagctagctttatcctgggttctgcatcaaggggatgatgtggttccgataccagggactactaagatcaagaatctagactccaacattgactccttgaaggtgaggctcacggaagatgacctcaaagagattagcaacgagatacgcgaagaagatgttgccggtgggaggcagtatacttcgtttgcgaaattcacctggaattatgcggatacgccaaagaagtgaaactacaaaagattgtggagacggtgaaacaagcatgccatgctatgtgctcgtgtgatgaatgggtgccccctgtatcttcatcttgtgaattgtcccgtgaataagaacatgtgcactgtctccacctgccgtgtaaatttatgtgtgcctgtataacagaagactgagactgtgctagctatgtttgtggctctctagtcttaccggctttccgtgacagcaattacactgttggaaaatgtatctgctcaaagagatattcagaagcatatcaagacgtttgaaaaaaaaaaaaaaaaaaaaaaaaaaaaaaaaaa

SEQ ID NO: 10485 - DNA, 1576 bp, Triticum aestivum
  Clone ID: PAT_TA_10485
gtgcaacacaattgcattgatcggtgcaccaggcacgtatatatgatgtacagaggagggccacaacttcaactatacagataaactaggaggtgggcccaagacacaatatacacgtacacaatatattcaacatgttcaactagttagtttcttggagatcaacttgttggcggccggtagagtaacttgttcgttggataaatgcaaactcgccttgcacgtaatgtacttaattcattttttcttttgcgaggaataatgtatatgtatttaattcatttatcatgtttgatcgatccatgccatatcacagcactttgaagttgggaacacacacacagatatgtggccgccggcgacgtggacgcacgtgccgacttgatttggttccaagttacaagcgggacggcatgacgccgaatttgtcggcctcggtgacgacgtggttgcgggtgatgtcggccagcgagttgcagccgctgagcgccatggtcagctcgaactcgtcgcgcagcatcttgagcacgttgctcaccccggcctccccggccaccgccagcgagaacaccaccggccttccgatgaagacgccggcggcgccgagagcgagcgccttgaagacgtcggtgccgcggcgcacaccgccgtccaggaagacggggatctgcccgccagcacccttcacgacctcttccagggcgctgatggtcgccgggacgtagtccagttgccgggcgccgtggttggacacgatgattccggccgcgccgttctcgacggcgagcctgctgtcctctgcggtgatcactcctttcaccaggatcggcatcgtggtgatggactgcagccacttcacatccttccagctcagtgtgcggtcgatttggccggcgacatatgaagctagtcctgaatcgttagcctggtccattttcccgaggtccaaaccttcaaagttcttgagtgtcaaatttggtggcaaaacaaatctgttcttgatatcagcttccctgcggccaagtcgcggggtgtccacggtgagcgctatcgccttgaatccagccttttccgctctcctcacaagctgctcgaccaccttcctgtctttgtagacatagagttggaagaaacggatccctggtccggttgaggcaacctcctcaacacttgaagtagcccaggacgacaatgtcattatagtgcctgctgctgatgctgcgcgggcagtcgcatactctccatctgggtgagccatcttctgcatggcagtgggggaaatcatgatgggcattgagagcttgaatcccaggatagttgttgtcatgtcgattttggatacatcgatcagaatgcgcgggcggaacaggatcctggcaaaggcctccctgttctcctggagcgtccactcgtcctcggcaccggaggcatagtagtcatagatcatcttgggaagcttctgcttggcgatggcctggtactctgtgacattggtgatctccatttttcttgtatgaggaggctgtggctgactgtcccctcaaggctgaggggctcgtgccgaattcggcacgag

SEQ ID NO: 10486 - DNA, 1530 bp, Triticum aestivum
  Clone ID: PAT_TA_10486
ctgcacgaggaggagatcgaaatccagccgaccttcccctgcgccgacgaccccccctcccgctccccctcgccggcgacgaccgaccatggcgacgcggtactggatcgccgccctgcccgtcgccgacgacaacgtcgccgccggcaagaccgccctctgggcgcgcctccaggacgccatctcccgccactccttcgacaccccgctctaccgcttcaccgtcccggatctccgccccggcacgctcgactccctgctcgccctcagcgacgacctcgtcaagtccaacatcttcatcgagggcgtctcccacaagatccgccggcagatcgaggacctggagcgcgccggaggggtcgagcccggcaccctcaccgtcgacggcgtccccgtcgacagctacctcaccaggttcgtgtgggacgagggcaagtaccccgtcaacgccccgctcaaggagaccgtcgccagcatccagtcccaggtcgccaagatcgaggacgacatgaaggttagagttgctgaatacggtaatgttaagagccagcttggcgcaatcaacaggaagcaaactggaagtttagcagttcgtgacctttccaacctcataaaaccagaggatatggtcacctcggaacatctagtgacactgctttctattgtgccaaagtattcccaaaaagactggttatcaagctacgagtcacttgatacgtttgtggttccgagatcgtcaaaaaagctttacgaggacaatgagtatgctctctacactgtaacattatttgccaaggttgttgacaactttaaggtccatgctcgtgagaaaggtttccagatccgtgactttgagtatagtcctgaagcacaggagagtcggaagcaagagctagaaaagctgctgcaagaccaggaagttatgaggacctctctattgcaatggtgctatgcaagctacagtgaggtatttagctcctggatgcatttctctgctgttcgcgtcttcgtagagagtattctgagatatggtctgcctgcacggttcctgtctgttgtcctagcaccatctacaaagagcgagaagaaagtaaggaacatcttggaagggctatgcggcaacgccaacagcagctactggagatccgaagacgacgtgggcatggctgctggcctgggaggcgaggcagagtcccacccttacgtctccttcaccataaactttgtctgagggtgttcgatgtatattattttgtgacaccaattctttcatggtaatgtcggtttcggtttatacttctgtagcagatgatccgcgccgatcaataatgtagtgtttcggagaacctcgaacgtatcctggcacaaagtgggacttctcttttttttgttcagctacgctgttacaactgtttactttttgtgcagtgttgtattaatgggtacattattgtaattttgagtaaccagaatctataataataaaatcaaggtgaataagctgggtaatataaacagttatgttgttcc

SEQ ID NO: 10487 - DNA, 1841 bp, Triticum aestivum
  Clone ID: PAT_TA_10487
gacccacgcgtccgcaccactcctctccctcctcggcagatccaatccaccaacctcctctcctccatggcgctctccgtggagaagaccgcgtccggccgggagtacaaggtcaaggacctctcccaggccgacttcggccgcctcgagctcgagctcgccgaggtcgagatgccgggcctcatggcctgccgcgccgagttcgggccctcgcagcccttcaagggcgcccggatctccggctccctccacatgaccatccagaccgccgtgctcatcgagaccctcaccgcgctcggcgccgaggtccgctggtgctcctgcaacatcttctccacgcaggaccacgccgccgccgccatcgcccgcgactcggccgccgtcttcgcctggaagggcgagaccctcgaggagtactggtggtgcaccgagcgctgcctcgactggggcgccggcggcggccccgacctcatcgtcgacgacggcggcgacgccaccctgctcatccacgagggcgtcaaggccgaggaggagttcgagaggtccggcaaggtccccgacccggactccaccgacaaccccgagttcaagatcgtgctcaccatcatccgcgacgggctcaagaccgacgcccgcaagtaccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgctggcaaggttgctgtggtctgcggttatggtgatgttggcaagggctgtgccgctgcactcaagcaggctggtgcccgtgtgatcgtgacagagattgaccccatctgcgcccttcaggccctgatggagggcatccagatcctcactttggaggacgttgtctctgatgctgacatctttgtgaccaccactggaaacaaggacatcatcatggttgaccacatgaggaagatgaagaacaacgccattgtctgcaacattggtcactttgacaacgagatcgacatgaacggcctcgagacctaccctggtgtcaagcgcatcaccatcaagcctcagactgaccgctgggtcttccctgagaccaacactggcatcattgttcttgctgagggtcgtctgatgaaccttggctgtgccactggccaccccagctttgtcatgtcctgctcattcaccaaccaggtcattgctcagctggagttgtggaaggagaaggccaccggcaagtacgagaagaaggtgtacgtgctccccaagcacctcgacgagaaggtcgccgccctccacctgggcaagctgggtgccaggcttaccaagctcaccaaggcccagtctgagtacattagcatcccagtcgatggtccctacaagccggcggcataccggtactagtgtgtctgtccagcacgactagcggctggcctgagcctgagaggcgcacggcgacctatgaactatcctgttttcctttgcattatctatctagatttaggcatgttgtctattaggtggaggatttgtcatggtttgagactggtgagggtgtggtggattgctattgcccagaaataatagtgttattattttggtttaaatgaggaggtgtgttttgtccttctgattctacatgtctgaygctccgtccatggacgtgacaaatyttttgcctccgtttcggaaaaagaatagtccgtgagtggtgtgatgtg

SEQ ID NO: 10488 - DNA, 1742 bp, Triticum aestivum
  Clone ID: PAT_TA_10488
gccccatctcctcccccgtatccctcctctctcccgtccctctccccctctctcctccctagggttcgggtctctcctcccccgtcgccatgatgcagccaccgccgccgtcgcagccgcagccgggcatgggcgcccccatgcccccgcagggcgcgggagggcagccgccgcactggggcgcgatcccgccgccgatgccccactacgcgcagccgcccccgcagcagcagccgccgccgcaggccatgtggggccagccgccgccccaggccgcgccctacggccaggtgcccgccccgcagcagtactacgccgcgccgcaggcccccgccgcccccgcggcctcggacgaggtcaggacgctctggatcggggacctccagtactggatggacgagaactacatctacagctgcttcgccaacaccggggagttccaatctgtgaagcttatccgtgacaagcaaactggacagcttcagggctatggctttgtcgagtttgcaagccatgcaggcgctgagcgagttcttcagacattcaatggtcaaatgatgccaaatgttgagttggcatacagactgaactgggccagtgctggtgaaaagcgtgatgataccccggactatacaatctttgttggggatttggcagctgatgttacagactacatgttacaggagacattcagggtccattacccttcagtaaagggtgcaaaggttgtaactgacaagatgacaatgcgttcaaagggttatgggtttgtgaagtttgggtgaccctacagagcaagctcgtgccatgactgaaatgaatggaatgccctgttcttccagacctatgcgcattggtccagcagcaaatagaaagacaactggggttcaggagagagtaccaattccaaatacaaatactcaaggagctcagtctgacaatgatcctaacaataccaccatatttgttggtggccttgaccccaatgtcactgaagatgccttgaaacaagtgtttgctccatatggggaagttgtccatgtcaagatccctgttgggaagagatgtggctttgttcagtatgctaacaggccttctgctgagcaagctctgcaattgctgcaagggaccttggttggtggtcagaatgtgaggctttcatggggacgaagcccttcaaacaaacaaactcagcctcaggaagccagccagtggggtgcaggtgctgctgctggtgctgctggtggttactatgctggatatggacaaggctacgaggcttatggacaagggtatgcacagcctcaagaccctaacatgtatggttatggagcctatgctggttatcccaactaccaacaaccagcagcggcaccgcagccaccgccaccgcaacagtgagccctcctcgtgggtcgtccagacaacagatgagaacccctgtttgaaggcactgtcaaggctaatgttgtagcacctgtcgatagagagagacggttcctggactccggattttgattgccccatggcaaggtctattgttatgttattatgcactatattatgatcagctgttgtccgtcccgctgtggtgatcctttggatatgtacttggaaacttagctttgtttcgccgcatgcccttgtctactgttatttaccgttgctatcttctgctgttaaattatatactatttgtaccgtttgcttccaaaaaaaaaaaaaaaaaaaaaaaaaaaaaa

SEQ ID NO: 10489 - DNA, 1280 bp, Triticum aestivum
  unsure (1)..(1280): unsure at all n locations
  Clone ID: PAT_TA_10489
ggtctgccctcatttcggtttcccccattccccttcgcacccccgcggcggcggagccttcccgggcgctcaccggacacgcgcaacaacactatgaggaggtacagccccccacaccgtagtcccccgaggaggggatatggcggcagccccgcgcatcgtagtcccccaaggaggggatatggtggcagccccccgcaccgcagccccccaaggaggggatatggtggcagaggaagaagcccccctaggaggggcggatatggaggacgaaaggagcagggttctggaagtctcttggtccgcaacatcccattaagcgccagagcggaggatctccgtgttccttttgaaaggtttggtcctgttagggatgtttaccttccaaaggattattacagcggggagccacgagggtttgcgtttgtggagtttgttgacccttatgatgcctctgaggcccaataccacatgaatcgccaggtattttttggccgggagataactgttgtgcttgctgctgagtcacggaaaaggccagaggatatgcgcactagaactagagtcagggggtactctggaggtcatgaagggcgccgttcctctcattatgggaggtctcgttcccgttcacgctccgcctctccccgccctcgtggcggtggccgtgctcggtcaaggtcatactctcctgctccaagacggcgagatgactactctgcttccccacggggaagggagtctcatcgcacgaaatctcctgtgcgtcatccaaaagaacatgaggaggacaaaaggagatcctactctccccctggtagagatggtgaccaacgtgatgctgataacgggtatgagaagaggtcgccaccggccgacagtgatggatccccttcacgcccgagggtggccaggccatcctcaggatcgccccctggatcccgctccaggtcccccgacgcttctcctgcccgcagcgactgagaaattggttacatcctctgcggtcgccgcatctccatctagctacttccgctccattggttcgagtaaaacccttcgaggtgtgttgtattgcttgttagcggtcacagacgttatgttcccgcttgttgctgttgaaccttaaggcctgtagcatggcgtgtctgtcatatctatgtaccatgtgtgtggagtgtcagggacccattttccatgtactttgtttgggaaaaagcttgtgagttgatccaaannaaaaaaaacaaaaaaaaaaaaaaaaaaaaaaaaaaacccaa

SEQ ID NO: 10490 - DNA, 2362 bp, Triticum aestivum
  Clone ID: PAT_TA_10490
caccccggcctgcccatggggtgcgcgcccatgggccatatcctctacgacgaggtcatgcgctacaaccccaagaacccctactggttcaaccgcgaccgcttcgtcctctccgccggccacggctgcatgctccagtacgccctcctccacctcgccggctacgacgccgtcaaggaagaggacctgaagcagttcaggcagtggggaagctccaccccgggccaccccgagaacttcgagactcctggagttgaagtcaccactggtcctcttggtcagggtatcgcgaatgccgtcgggttggcgcttgctgagaagcacctggccgctcgtttcaacaagcctgacagtgaaatcgttgaccactacacgtactgtattgtgggagatgggtgcaacatggagggtatcttgactgaagcttgctccttggctgggcattggggtcttggcaagctaattgttttctatgatgacaaccacatctccattgacggagacacagagattgcttttacagaggatgtgagtggccgctttgaggctcttgggtggcacacactctgggttaagaatggcaacgatggttatgacgagatccgtaaagccatccaggaagcaaaatcagttaccgacaagcccacaatgatcaaggtgactaccacaatcggttttggatctcccaacaaggccaactcatacgctgtgcacggagctgcattgggcaccagcgaggtcgaagcgaccagggcaaaccttggatggccatatgagccattctttgtgcctgaggatgtcaagagccactggagccgccatattccccaaggtgccgctcttgaggctgactgggatgctaagtttgcacagtacgagcagaagtacccagaagatgccgccaccttgaaaagtatcattacaggagagttgcccgctggctgggccgatgctcttcctcaatacacaaccgagagccctgcagatgccaccaggaatctctcccagcaatgcttgaatgcacttgctaaagttgtgcctggtcttattggaggtagtgctgatcttgcatcctccaacatgacattgcttaagatgtttggcgacttccagaaggatacccctgaggagcgcaatgtccgctttggagtcagggagcacggaatgggcgccatttgcaacggcattgcgctgcacaccccagggctcattccatactgtgcaactttctttgttttcaccgactacatgagaggtgccatgaggatctcagccttgtctgaagctggagttatctatgtcatgacccatgactctattggtctgggagaagatggtccgacccatcaacccattgagcacttggtgagcttccgtgcgatgccaaacatgctgatgttccgtcctgctgatggcaaggagactgccggggcatacaaggtggctgtcctcaacaggaagaggccatctattctggctctctccaggcaaaagcttcctcatctgcctggtacctcaattgagggcgttgcgaagggtggatacactatctctgacaactcgaccgacaacaagcctgacttcatcataatgagcactggttctgaggtagagattgctgtgaaggctgccgaagagttgacgaaggaggggaagactgtccgcgttgtgtcatttgtctgctgggagcttttcgacgagcagtcagatgaatacaaggagagcgtgctccctgaggctgtcaccgcaaggatcagcattgaggctggctctaccctcggatggcaaaagtacgttggatccaagggcaagaccatcggcatccgacaagttcggcgccagcgctcctgccccgaagatctacaaggagtacggcatcaccgcggagagcgtcattgccgcagccaagagcctgtaagatcgcacactcgtcgaggttctgtcatcgttgatggcaaagaacaaacaccacacttgaaggtctcgtgcccagaagcttggaataacggagggagaggaggatgcctgtgtcggagcgtgagtggtatttttaggcctgtaataaacaatgccttttccatttgcgttgtcttacattcgatacatatcgccccccttagatgattcgcggagggggcgagcctgatcaaattggggactggttttttgtatttgtttacattgaactgatagtcgtgcttgcgatgcttctttctctccccaagatcattgtctccatgggtggttcatgctttgatgcacccttttagtccttgtagtttgctcatcttccccttcccacatacaaacggtttgatgcatatagtatcatcagtgcaataaacatagagtgttttccatc

SEQ ID NO: 10491 - DNA, 1626 bp, Triticum aestivum
  unsure (1)..(1626): unsure at all n locations
  Clone ID: PAT_TA_10491
aatttttcttttgcgaggaataatgtacctatttaattcatttatcatgtctgatcgatccatgccatatcacagcactttggaagttggaaacacacacacacacacacacacacgtcccgtccaaaattaattacactacgtagcatatcatgcatccatgcagttagcgtacgtaagccttggatcgatatacggccgccggcgacgtgcgccgacttgatttggttccaagttacaagcgggacggcatgacgccgaatttgtcggcctcggtgacgacgtggttgcgggtgatgtcggccagcgagttgcagccgctgagcgccatggtcagctcgaactcgtcgcgcagcatcttgagcacgttgctcaccccgggcctccccggccaccgccagcgagaacaccaccggccttccgatgaagacaccggcggcgccgagagcgagcgccttgaagacgtcggtgccgcggcgcacaccgccgtccaggaagacggggatctgcccgccagcacccttcacgacctcttccagggcgctgatggtcgccgggacgtagtccagctgccgggcgccgtggttggacacgatgattccggccgcgccgttctccacggcgagcctgctgtcctctgcggtgatcactcctttcaccaggatcggcatcgtggtgatggactgcagccacttcacatccttccagctcagtgtgcggtcgatttgacccggcgacatatgaagctagtcctgaatcgttagcctggtccattttcccgaaggtccaaaccttcaaagttcttgagtgtcaaatttggtggcaaaacaaatctgttcttgatatcagcttccctgcggccaagtcgcggggtgtccacggtgagcgctatcgccttgaatccagccttttccgctctcctcacaagctgctcgaccaccttcctgtccttgtacacatagagttggaagaaacggatccctggtccggttgaggcaacctcctcaacactcgaagtagcccaggacgacaatgtcattatagtgcctgctgctgatgctgcgcgggcagttgcatactctccatctgggtgagccatcttctgcatggcagtgggggaaatcatgataggcattgagagcttgaaccccaggatagttgttgtcatgtcgattttggatacatcgatgagaatgcgcgggcggaacaggatcctggcaaaggcctctctgttctcctggagcgtccactcgtcctcggcgccggaggcgtagtagtcgtagatcatcttgggaagcttctgcttggcgatggcctggtactctgtgacattggtgatctccatttgtctgtgcaaatcaccaccttgtatgaggaggctgtggctgactgtcccctcaaggcttagtggaagaaaggaaggatgcaactaggggttgtggtggggaaggggatggatgcaatataagagatgaggcggcgagtcctcaaggtttctgtgcatgcagacaaacaatacaacggagaataattgagcagttgagggagggagagatggggggttgtatggatgagatgagcaattggaggtgggaagagagggcggctctcntacactgcttcctc

SEQ ID NO: 10492 - DNA, 747 bp, Triticum aestivum
  Clone ID: PAT_TA_10492
gccggccggttttcaaaagagtgcctcttctgttaataatagcgagttatcatttgcacttttgcaaaaaaaaaaaaaaaaaaaaaaaaaaaaaaaaaaaaaaaaaaaaaaaaaaaaaaaaaaaaaaaaaaaaaaaaaaaaaagccgccgccgcaccagcttctcttcctcctcccgcagcgcctcctcgaatccaagagatcaagtcgctgttgttgtgccactccccctccagccgccgtcatgcagaacgaggtgggtgacatggtggacctctacgtccccaggaagtgctcggccaccaacaggatcatcacggccaaggaccacgcctctgtccagatcaacattggtcacgttgatgagaatggcctctatgatggccgcttcaccacctttgctctctctgggttcgtccgtgctcagggtgatgctgatggctccctggacaggctgtggcagaagaggaaggctgagatcaagcagctctagatgttgctagtagttttacctggaacttgtgtccttcccatgtctacctagctcttggatgtctgtggttggtttcagttgctgctatggaagctaagacttgatgtcacttggcctggtttattgtgaacatgttttgagtttaatctgtgttgaatgcttgatatatgtcccttatctcgttgcttattgttatactgatgatttggcccttatctcgttgcttaacaaaaaaaaaaaaaaaaaaggccccta

SEQ ID NO: 10493 - DNA, 808 bp, Triticum aestivum
  Clone ID: PAT_TA_10493
ccactatagggcgaattgggtaccgggccccccctcgaagactaggtttttttttttttttttattaaaggaccctgtatttcgcttgttcatcatctatatatagatgtaagcatgcattacagaattccaacaaaggacacgaggtcccctcaggagtacaagatcacagctctcgtggcaacaacatcggccacaacgtatgatcgaagcagcagcagtaaaactaatttattagggaaacagtagaactagtaaagcagtaaatcaaacggggtggagccatgcagcaaggacggctggcttccacgatttatttcgctctcaccatgcatctgaaatggttccggtctcacgcttaacgcaccttggagcaatcggttccttggctgatggcgtaggggatgttgacgccgcacttgccggggatgccggcgacgaggttgggcttgatgccgcccatgccgctcgcctgctgcttgagacaggtgcaggtggtcttgcggtcggcgggggtggcagcggccgcgttaaggccacgcacgccgctgcagcagccgccgccaggcacactcaccctgcccatggcgtaactgatgcacggggccaggtagctcaccacctggccgcagttcgcaaccgcaccctcggccggcgccggtgccgcagacagcacgagcgccgccaccagcagggccaaggccgccgcggcgtgggcacggcgagctgccatggcagaaactagctagtgtgcttgctctgtgggcttagttggtgtgtgagtgaaggccgagggactgtgagtgag

SEQ ID NO: 10494 - DNA, 682 bp, Triticum aestivum
  Clone ID: PAT_TA_10494
aaactagacagtaatagtagtaactaacaacaaaaacggataacgatgagactccattgttccatcatgttaaggggaaatcaccagcttctcttcgtcctcccgcagcctcatcgaatccaagagatcaagtcgctgtttccagctgccaccatgcagaacgaggtgggtgacatggtggacctctacgtccccaggaagtgctcggccaccaacaggatcatcacggccaaggaccacgcctctgtccagatcaacattggtcatgttgatgagaatggcctctatgatggccgcttcaccacctttgctctctctgggttcgtccgtgctcagggtgatgctgatggctccctcgacaggctgtggcagaagaggaaggctgagatcaagcagctctagatgttgctagtagttttacctggaacttgtttccttcccatgtctacctagctcttggatgtctctggttggtttcagttgctactatggaagctaagacttgatgtcacttggcctggtttcttgtgaacatgtttttgagtttaatctgtgttgaatgcttgatatatgtcccttgtcttgttgcttaatgttatgctgatgatttggcccttattttactagcaaaaaaaaaaaaaaaaaaaaaaaaaaaaaaaaaaaaactcgagactagttctct

SEQ ID NO: 10495 - DNA, 1939 bp, Triticum aestivum
  Clone ID: PAT_TA_10495
gcacgaggcctcttcttcctcctccctcagctgccagatccaatccaccaaccttctccatggcgctctccgtggagaagacctcgtcgggccgggagtacaaggtcaaggacctctcccaggccgacttcggccgcctcgagctcgacctcgccgaggtcgagatgcccggcctcatggcctgccgcaccgagttcgggccctcgcagcccttcaagggcgcccgcatatccggctccctccacatgaccatccagaccgccgtcctcatcgagacccttaccgcgctcggcgccgaggtccgctggtgctcctgcaacatcttctccacccaggaccacgccgccgccgccatcgcccgcgactcggccgccgtcttcgcctggaagggcgagaccctcgaggagtactggtggtgcaccgagcgctgcctcgactggggcgccggcggcggccccgacctcatcgtcgacgacggcggtgacgccacgctgctcatccacgagggcgtcaaggccgaggaggagttcgagaagtccggcaaggtccccgacccggagtccaccgacaaccccgagttcaagatcgtcctcaccatcatccgcgacgggctcaagaccgacgcccacaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggttgccgtggtctgtggttatggtgatgttggcaagggctgtgccgccgcacttaagcaggctggtgcccgtgtgatcgtgacagagattgaccccatctgtgcccttcaggccctgatggagggcatccagatcctcaccttggaggatgttgtctctgaggctgatatctttgtgaccaccaccggaaacaaggacatcatcatggttgaccacatgaggaagatgaagaacaacgccattgtctgcaacattggtcactttgacaacgagattgacatgaacggccttgagacctaccctggtgtcaagcgcatcaccatcaagccccagactgaccgctgggtcttccccgagaccaagaccggcatcattgttcttgctgagggtcgtctgatgaaccttggatgtgccactggccaccccagctttgtcatgtcctgctcattcactaaccaggttattgctcagcttgagttgtggaacgagaaggccaccggcaagtacgagaagaaggtgtacgttctccccaagcacctcgacgagaaggtcgcggccctccacttgggcaagctcggcgccaggctgaccaagctcaccaagtcccagtctgactacattagcatcccagttgagggtccttacaagcctgcggcctaccggtactagtgtgtccagcacggctagcggctggcctgagcctgagtcggagcagcggcaccaacgggaactctatcaactatcctgtttcccttctattatcttacatgctgtctcttaggcggaggatttgttattatggttatgttttgagccttgtgagggttgggagaggcggcgtttgcttttgcccagaaataatggcattattattggtttgagtgaggaggtgtgcttttccagatacagttttgtctcgtttgttctgccatgtctgaaatccttcgcaagctgttgctcatatttgtgcgtgttttgttaatgatcctggtcgtacatgattgtttgtccctgaagttttctttcgaggggtgtacaagtaggcttatgtcacaaaacatgtcatcagaaatttcttttgaattgaattc

SEQ ID NO: 10496 - DNA, 1562 bp, Triticum aestivum
  Clone ID: PAT_TA_10496
cgtccgcggacgcgtgggttccgatcggatcggggtaaaggcttccacgagctctcgtctcgactgccgccgcccgcccgagatggcgatccgccgtgggtcctcctgcgccgtcctcgccctgctcgcgctcgcctccgtcgccgccgtcagcgccgacgtcttcttccaggagaagttcgaagatggttgggaaagccggtgggtcaagtctgagtggaagaaggatgagaacatggctggtgaatggaaccacacatctggaaaatggcacggagatgccgaggacaaaggtatccaaacctcagaggactacaggttctacgccatctcggcggagtaccctgagttcagcaacaaggacaagacactcgtgctgcagttcacggtgaagcatgagcagaagcttgactgcggtggtggttacgtcaagttgcttggaggtgatgttgaccagaagaaattcggtggtgacacaccctacagcattatgtttggaccagatatctgtgggtacagcaccaagaaggttcacactatccttaccaaggatggcaagaaccatttgatcaagaaggacgtgccttgcgagactgatcagctgtcgcatgtgtacactttgatcatccgccctgatgccacatacagcattctcattgacaacgaagagaagcaaactggaagcatctacgagcactgggatattcttcctcccaaggaaatcaaggacccagaagctaagaagccagaggactgggatgacaaggagtacattcccgatcctgaggacgtcaagccagagggctacgatgacattcccaaggaagtcaccgatcctgatgctaagaagcctgaggattgggatgatgaggaagatggtgaatggactgccccaaccatccccaacccagagtacaagggcccatggaagcaaaagaaaatcaagaaccctaactaccagggcaaatggaaggcacctatgattgccaacccagacttcaaggatgatccttacatctatgctttcgacagcctgaagtacatcggaattgagctgtggcaggttaagtcaggaactttgtttgacaacattctcatcactgacgatgctgctttggctaagacatttgctgaagagacctgggccaagcataaggaagctgagaaggctgctttcgacgctgctgaaaagaagaaggaagaggaggatgcttccaaggctggtgaggacgatgatgacttggatgatgaggaagccgatgacgaggacaaggatgacaaggctgggtctgatgcggagtctgatgacgagaagcacgatgagctctagatggatggcgaggaaggatgagaggaggccgcctgccttcgcgccgctgccaggatttattagttgtctctcattatgatgttcccttttttgtgatcagaaacttgacaagttactgtgtgtagaagaacaacatcaccgtggggtcttttagcgcttttgtagtccaatttttaccggaagggaacttatagcgttaaaccagcaaaaaataaaaaatcttgcactagtt

SEQ ID NO: 10497 - DNA, 1600 bp, Triticum aestivum
  Clone ID: PAT_TA_10497
ctacgcgtccgcccacgcgtccgatcggatcggggaaaaggcctccacgagctctcgtctcgactgccgccgccgcccgagatggcgatccgccgtgggccctcctgcgccgccctcgccctgctcgcgctcgcctccgtcgccgcggtctccgccgacgtcttcttccaggagaagttcgaagatggttgggaaagccggtgggtcaagtctgagtggaagaaggatgagaacatggctggtgaatggaaccacacatctggaaaatggcatggagatgctgaggacaaaggtatccaaacctcagaggactacaggttctacgccatctcggcggagtaccctgagttcagcaacaaggacaagacacttgtgctgcagttcacggtgaagcatgagcagaagcttgactgcggtggtggttatgtcaagttgcttggaggtgatgttgaccagaagaaattcggtggcgacacaccatacagcattatgtttggaccagatatctgtgggtacagcaccaagaaggttcacactatccttactaaggatggcaagaaccatttgatcaagaaggacgtgccttgcgagaccgatcagctgtcgcatgtgtacactttgatcatccgccctgatgccacatacagcattctcattgacaatgaagagaagcaaactggaagcatctacgagcactgggatattcttcctcccaaggaaatcaaggacccagaagctaagaagccagaggactgggatgacaaggagtacattcctgatcccgaggacgtcaagccagagggctacgatgacattcccaaggaagtcaccgatcctgatgctaagaagcctgaagattgggatgatgaggaagatggtgaatggactgccccaaccatccccaacccagagtacaagggcccatggaagcaaaagaaaatcaagaaccctaactaccagggcaaatggaaggcacctatgattgccaacccagacttcaaggatgatccttacatctatgctttcgacagcctgaagtacatcggaattgagctgtggcaggttaagtcaggaactttgtttgacaacattctcatcactgacgatgctgccttggccaagacatttgctgaagagacctgggccaagcataaggaggctgagaaggctgcttttgacgcggctgaaaagaagaaggaagaggaggatgcttccaaggctggtgaggacgatgatgacttggatgatgaggatgccgatgatgaggacaaggatgacaaggctgggtctgatgtcgagtctgatgacgagaagcacgatgagctctagatggatggtgaggatgagaggaggccgcctgccttcgcgccggtgccatgatttattagttgtctctcattatgatgttcccctttttgtgatcagaaacttgacaagttactgtgtgtagaagaacaacatcaccgtggggtctttgtagcgcttttgtagtccaatttttaccggaagggaactttatagtcgttaaacgagcaaaaaataaaaaatcttgcactagtcttaaaaaaaaaaaaaaaaaaaaaaaaaaaaaaaggggggg

SEQ ID NO: 10498 - DNA, 2729 bp, Triticum aestivum
  Clone ID: PAT_TA_10498
cggcacgagcatctccgccgtcctccgccacacaccccacaccatggcagcgcactccgtcgccgccgcgcacgccaccatcgcggcccgcgcgggcgccgccccctcctccccggcggccgccccggccgagcgcctgggcttccgcctcagctcgctcgccggccgcgccctccgctcgccgctcccggcgcgccgggccgcggccgccgcctcctcctcccgcaggagcggcagccagcgcgtgcgcgcctccgcggccgtcgagaccgtcgaggccgccgccacgggcgagctgctcgacaagtcggtcaacgcgatccggttcctggccatcgacgccgtcgagaaggccgtgtccggccaccccggcctccccatggggtgcgcgcccatgggccacatcttgtatgacgaggtcatgcgctacaaccccaagaacccctactggttcaaccgcgaccgcttcgtcctctccgccggccacggctgcatgctccagtacgccctcctccacctcgccggctacgacgccgtcaaggaagaggacctgaagcagttcagacagtggggaagctccacccccggccaccctgagaacttcgagactcctggagttgaagtcaccactggtcctcttggccagggtatcgcgaatgccgtcgggttggcgcttgctgagaagcacctggctgctcgtttcaacaagcccgacagtgaaatcgttgaccactacacgtactgtattgtgggagatgggtgcaacatggagggtatcttgactgaagcttgctctttggctgggcattggggtcttggcaagctaattgttttctacgacgacaaccacatctccattgacggagacacggagattgcttttacagaggatgtgagtggccgctttgaggctcttgggtggcacaccctctgggttaagaatggcaacgatggttatgacgagatccgtaaagccattcaggaagcaaaatcagttactgacaagcccacaatgatcaaggtgactaccacaatcggttttggatctcccaacaaggccaactcatacgctgtgcacggagctgcattgggcaccagcgaggtcgaagcaaccagggcaaaccttggatggccatatgagccattctttgtgcccgaggatgtcaagagccactggagccgccatattccccaaggtgccgctcttgaggctgactgggatgctaagtttgcacagtacgagcagaagtacccagaagatgccgccaccttgaaaagcatcatcacaggagagttgcccgctggctgggccgatgctcttcctcaatacaccacagagagcccagcagacgccaccaggaatctctcccagcaatgcttgaatgcacttgctaaagttgtgcctggtcttattggaggcagtgctgatcttgcgtcctccaacatgacattgcttaagatgtttggcgacttccagaaggatacccctgaggagcgcaatgtccgctttggagtcagggagcacggaatgggcgccatttgcaacggcattgcgctgcacaccccagggctcattccatactgtgcaaccttctttgttttcactgactacatgagaggtgccatgaggatctcagccttgtctgaagctggagttatctatgtcatgacccatgactctattggtctgggtgaagacggtccgacccatcaacccattgagcacttggtgagcttccgcgcaatgccaaacatgctgatgttccgtcctgctgatggcaaggagactgccggggcatacaaggtggctgtcctcaacaggaagaggccatctattctggctctctccaggcaaaagcttcctcatctgcctggtacctcaattgagggcgttgcgaagggtggatacaccatctctgacaactcgaccgacaacaagcctgactacatcataatgagcactggttctgaggtagagattgctgtgaaggctgccgaagagttgacgaaggaggggaagaccgtccgtgttgtgtcatttgtttgctgggaactcttcgacgagcagtcagatgagtacaaggagagcgtgctccctgaggccgtcaccgcaaggatcagcattgaggctggctctaccctcggatggcaaaagtatgtcggatccaagggcaagaccatcggcatcgacaagttcggcgccagcgctcccgccccgaagatctacaaggagtacggcatcaccgcggagaacgtcatcgccgcagccaagagcctgtaagatcagcacactcgtcgaggttctgtcatcgttgatgccaaagaacaaacgacaccacacttgaaggtctcgtgcccagaagcttggaataacggagggagaggaggatatgcctgcgtcggagcgtgagtggtatttttaggcctgtaataaacaatgccttttccatttgcgttgtcttacattcgatatatatcgccccccttagatgaattcgcggagggggcgagcctgatcaaattggggactggttttttgtatttgtttacatcgaactgatggtcgtgcttgcgatgcttctttctctccccgagatcgtcgcctccatgggttttatgctttgatgcgcccttttagtccttggtagtttgctcatcttccccttcccccatacaaacggtttgatgcatagtatcatcagtgcaataaacatagagtgttttccatc

SEQ ID NO: 10499 - DNA, 949 bp, Triticum aestivum
  Clone ID: PAT_TA_10499
caagttttttttttttttttttttgacattattaaaggaccctgtatttcgcttgttcatcatatatatatagatgtaagcatgcattacaatagttccgacaaagtacacgaggtcccctcaggagtacaagatcacagctctcgtggcaacaacggcggccacaacgtacgatcgaagcagcagcagcagtaaaactaatttatttattagggaaacagtagaactagtaaagcagtaaattaaacgcggtggagccatgcagcaaggacgaccggcttccacgatttatttcgctctcaccatgcatctgaaatggttctgatctcacgcttaacgcaccttggagcaatcggttctagggctgatggcgtaggggatgttgacgccgcacttgccggggatgccagcgacgaggtcgggcttgatgccgcctatgccgctcgcctgctgcttgaggcaggtgcaggtggctttgcggtcggcgggggtggcagccgccgcgttaaggccacgcacgccgctgcagcagccaccgccaggcgcactcaccctgcccatggcgtaactgatgcacggggccaggtagctcaccacctgcccgcagttcgcaaccgcaccctccgccggcgccggtgccgcagacagcacaagcgccgccaccagcagggccaaggtcgcggcggcgtgggcacggcgagctgccatggcagaaatagctagtagtgtgcttgctccgtgggcttagttggtgtgtgagtggcactgtcaaggctaatgttgtagcacctgtcgatagagagagacggttcctggactccggattttgattgccccatggcaaggtctattgttctgttattatgcactatgttatgatcagctgttgtccgacccgttgtggcgatcctttggatatgtacttggaaacttagctttgtttcgccgc

SEQ ID NO: 10500 - DNA, 1580 bp, Triticum aestivum
  Clone ID: PAT_TA_10500
agcataaacttgaccataatatcagtcggattggaggacaatgtatttaaggaaaattgcccggtaacgattcagggcacatactcgaactcaaactcaaccctatgatagtaaatgttttgagaacgctgccgccaacctacgacaacctctggagttcgatgcctccaccaaaaacgaatgttgggaaaatccaccctctacaataattattgccttccaacgttaaaaagataaaagttcaccagatcctcgaagggtaggactgggaacaaacttctcttgttcgtcatcatttcgtcccctctaggcaccgcctgagccgtacttcttgccgaagaagaggatctggagctgatcatagccggagagcacaccagcaccagcaatggcacggaggatgttggcaccagcccccttgaagagggacttggcaccctccttcttcaggatctgctggaaagcatccaaggagctcttgtacttgacggcctctccggaggtcatcatcatccttctgcggacagtgtcaatggggtaagatgcaagacctgcaccattggtgatcaaccaaccaagagcaaagctggcaaagaagttgtcctggagagtgccagtgaggagaactggcttcagagaatcatagagtccaaagtacagaccacggtagacaatgattccaacacaggagatgttgaatccacggtaaagcccagcaataccatctgacttgagagtcttgcggtagacatcaaccaggccattgaattgcctttcacctccacccttggatgcctttgcgtcattggccagccttgtcctagcatagtcaagggagtacacaaagaacagcgaggaagcaccagcggcaccaccagaagcaaggttgccaccaaaccacttccagtaaccatccttgtccttcttaaagttgaacatcctcttgaagtaatccttgaaagcaaagttcaaagcctgagttgggaagtaacggatgacattagcagtgtttcctctccacaatgagccaaagccttcatccttgatggtgcgcccaaagcagtcaccaatacccttgtatggctcagagagcctgccagccttgatcatctcatcctggttctggataagcagcttaacacgctcaatgggagctgcagcagtcttggaaactgcagctgacactcctcccatgaggaaatcaatcgcaaagttcttgacacctttcttctcagggggtgcattggcaaacattggagaagatgacatgattgggacactgatgccaaggttctgagtcatgtagctgcttgtggtgaagcgcctctcataggatggcacagaagggcagatgttgcgagcacgaacaccctcagagaagctggaggcaaggtggaactgtccaccaaacttctgcatgacagacgggtggttagcacggtccgccatctctgacccttcggaagcggaggcggggcgatgggatggggtggtggctcttcccggctcggcggctccgctccttccggtcttgcggtgagagagacaagcgggtggccaggcgctgcggggcgcggacg

SEQ ID NO: 10501 - DNA, 1400 bp, Triticum aestivum
  Clone ID: PAT_TA_10501
gcggccgcgtcgacaaaggattggctctgaggactgggctcgggggtcccggccccgaacccgtcggctgtcggcggattgctcgagctgctcacgcggcgagagcgggtcgccgcgtgccggccgggggacggaccgggaatcgccccttcgggggctttccccgagcatgaaacagtcgactcagaactggtacggacaaggggaatccgactgtttaattaaaacaaagcattgcgatggtcctcgcggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcgggggaaagaagaccctgttgagcttgactctagtccgactttgtgaaatgacttgagaggtgtaggataagtggggagccctcacgggcgcaagtgaaataccactacttttaacgttattttacttattccgtgggtcggaaaaccagcagtcgcccattcttcaaaatgcctcccaagaagaccgccacccgtgctccccaggagaacatctccctcggaccttccgttcgcgatggcgagctggtcttcggcgttgcccgtatcttcgcctccttcaacgataccttcgtccacgtcaccgatctgagtggccgtgagactatcacccgtgttactggtggtatgaaggtcaaggccgaccgtgacgagtcctccccctacgctgccatgttggctgcccaggacgtcgctgcccgctgcaaggagcttggcatcaacgctcttcacatcaagatccgtgccactggtggtaacggtaccaagacccccggtcccggtgcccagtccgctctccgtgcccttgcccgtgctggtatgaagattggccgaattgaggacgttacccctactccttccgactctacccgcagaaagggtggtcgccgtggtcgtcgtctctgagctgcttaccttttggtggcttggattggacaggagtttcgctatctggtttctctgtggcgttgagaatcacgaggagaacggctttttcgcctggtctccagtctacactgcagagcctggtcaggttatgggttaggacgcagtagacagttgaaaattcgcccgaagaaggcctatgaatcatcctgctcgtcaaacttttttccttgatgtgacatcttatagcttcacggttaacgttccacgatgaaatgaaataaaagcaataaagtgcatatcaagcaacgatatctagtatt

SEQ ID NO: 10502 - DNA, 2069 bp, Triticum aestivum
  Clone ID: PAT_TA_10502
cccacgcgtccgcctcccatcactcttcttcttcctcctctgccagatccaatccaccaaccttctccatggcgctctccgtggagaagacctcgtcgggccgggagtacaaggtcaaggacctctcccaggccgacttcgggcgcctcgagctcgagctcgccgaggtcgagatgcccggcctcatggcctgccgcaccgagttcggtccctcgcagcccttcaagggcgcccggatctccggctccctccacatgaccatccagaccgccgtcctcatcgagaccctcaccgccctcggcgccgaggtccgctggtgctcctgcaacatcttctccacccaggaccacgccgccgccgccatcgcccgcgactccgccgccgtcttcgcctggaagggcgagaccctcgaggagtactggtggtgcaccgagcgctgcctcgactggggcgccggcggcggccccgacctcatcgtcgacgacggcggtgacgccacgctgctcatccacgagggcgtcaaggccgaggaggagttcgagaaatccggcaaggttcccgacccggagtccaccgacaaccccgagttcaagatcgtcctcaccatcatccgcgacgggctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggtcgccgtggtctgcggttacggtgatgttggcaagggctgtgccgccgcactcaagcaggctggtgcccgtgtgatcgtgacagagattgaccccatctgtgcccttcaggccctgatggagggtatccagatcctcaccttggaggatgttgtctctgaggctgacatctttgtgaccaccaccggaaacaaggacatcatcatggtcgaccacatgaggaagatgaagaacaacgccattgtctgcaacattggtcacttcgacaatgagatcgatatgaacggccttgagacctaccctggtgtcaagcgcatcaccatcaagccccagactgaccgctgggtcttccccgagaccaagactggcatcattgttcttgctgagggtcgtctgatgaaccttggatgtgccactggccaccccagctttgtcatgtcctgctcattcaccaaccaggttattgctcagcttgagttgtggaacgagaaggccagtggcaagtatgagaagaaggtgtacgttctccccaagcacctcgacgagaaggtcgcggccctccacttgggcaagctcggcgccaggctgaccaagctcaccaagtcccagtctgactacattagcatcccaattgagggtccttacaagcctgcggcctaccggtactagtgtgtccagcatgactagcggctggcctgagcctgagtcggagcagcggcaccaacgggaactctgccacggcgacgtatcaactatcctgtttcccttccattatctatcttattacatgctgtctcttaggcggaggatttgttattatggttatgttttgagccttgtgagggttgggagaggcggcgtttgcttttgcccagaaataatggcattattattggtttaagtgaggaggtgtgcttttccagatacagttttgtctcgtttgttctaccatgcctgaaatccttagcaagctgtagctcatattttgtgtggttccttaatgactattgccgtagatgcttgtttatccctgaagtttcatcacagcgtcatgtcacaaaaaagtttctttcaaatatgaattcagtggtgtattttgttggttaaatcatatgtaaaaaaactagtgtatttaattggttaagctgaatataaaaaaatatgtggctcgaccacctgcccgggcggccgctcgaaatcactagtgaattc

SEQ ID NO: 10503 - DNA, 2681 bp, Triticum aestivum
  Clone ID: PAT_TA_10503
taaagggaacaaaagctggagctccaccgcggtggcggccgctctagaactagtggatcccccgggctgcaggaattcggcaccagagttttttttttttttttttttttaaacttggaccataataatctcagtcggattcgaggacaatgtatttaaggaaaattgcccagtaacgattcagggcacatactcggactcaaactcaacccctatgatagtaaatgttttgagaacgctgccgccaacctacgacaacctctggagttcgatgcctccaccaaaaacgaatgttgggaaaatccaccctctacagaaattattgccttccaacgttaaaaagataaaagttcgccagatcctcgaagggcaggactgggaacagacttctcttgttcgtcatcatttcttcccgtctaggcaccgcctgagccgtacttcttgccgaagaagaggatctggagctgatcatagccggagagcacaccagcaccagcaatggctcggaggatgttggcaccagcacccttgaagagggacttggcaccctccttcgccaggatctgctggaaagcatccaaggagctcttgtacttgacagcctctccagaggtcatcatcatccttctgcggacggtgtcaatggggtaagatgcaagacctgcaccgttggtgatcaaccaaccaagagcaaagctggcaaagaagttgtcctggagagtgccagtgaggagaactggcttcagagagtcatacagtccaaagtacagaccacggtagacaatgattccaacacaggagatgttgaatccacggtaaagcccagcaataccatctgacttgagagtcttgcggtagacatcaaccaggccattgaactgcctctcacctccacccttggatgcctttgcgtcattggccagccttgtcctagcatagtcaagggagtacacgaagaacagcgaggaagcaccagctgcaccaccagaagcaaggttgccaccgaaccacttccagtaaccatccttgtccttcttgaagttgaacatcctcttgaagtaatccttgaatgcaaagttcaaagcctgagttgggaagtaacggatgacgttagcagtgtttcctctccacagtgagccaaagccttcatccttgatggtgcgcccaaagcagtcaccaatacccttgtatggctcagagagcctgccagccttgatcatctcatcctggttctggataagcagcttaacacgctcaataggagctgcagcagtcttggaaactgcagctgacactcctcccatgaggaagtcaatcgcaaagttcttgacacctttcttctcagggggtgcattggcaaacaatggagaagatgacatcattgggacactgatgccaaggttctgagtcatgtagctgcttgtggtgaagcgcctctcataggatggcacagaagggcagatgttgcgagcacgaacaccctcagagaagctggaggcaaggtggaactgtccaccaaacttctgcatgacagacgggtggttagcacggtccgccatctctgacccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtggagaggaaacactgctaacgtcatccgttacttcccaactcaggctttgaactttgcattcaaggattacttcaagaggatgttcaacttcaagaaggacaacttctttgccagctttgctcttggttggttgatcaccaacggtgccggtcttgcatcttaccccattgacaccgtccgcagaaggatgatgatgacctccggagaggctgtcaagtacaagagctccttggatgctttccagcagatcctggcgaaggagggtgccaagtctctcttcaagggtgctggtgccaacatcctccgtgccattgctggtgctggtgtgctctccggctacgatcagctccagatcctcttcttcggcaagaagtacggctcaggcggtgcctagaggggaagaaatgatgacgaacaagagaagtctgttcccagtcctgcccttcaaggatctggcgaacttttatctttttaacgttggaaggcaataatttctgtagagggtggattttcccaacattcgtttttggtggaggcatcgaactccagaggttgtcgtaggttggcggcagcgttctcaaaacatttactatcataggggttgagtttgagttcgagtatgtgccctgaatcgttactgggcaattttccttaaatacattgtcctccaatcctactgagattattatggtccaagtttatgctgttggtcttcaccaaaaaaaaaaaaaagggcgaccgaaaacgatctagaaacggacgagtgggagaacgcgtgggtcgacc

SEQ ID NO: 10504 - DNA, 239 bp, Triticum aestivum
  Clone ID: PAT_TA_10504
ggtacaagcagatgcacgccggtgggctgctgctcccggagctcaagaactgagcctcgcctatgcgagaaaaaaacctgtgttcagccccattggttggttgattgtatcgctgattggaagtgcttgctcccattgatctcccatgcgtgtatgggaacgggtaggcacgtagatgatgatttgctggaggtgaatgaagagataaaatgaaaagaactgatgtggtaaaaaaaaaa

SEQ ID NO: 10505 - DNA, 607 bp, Triticum aestivum
  Clone ID: PAT_TA_10505
ccctccctccacgcacaacactcttaagctctctgcaaatccgcagccaccgctcgcttgccatcggcgatcggaagcggtacggctcgcgaaaggcagctcgcactgctccgccggagtgctgtgcgggcatggccacgggagccgagatcttccggccactcgcggtcgccggcgacgtcgtggaggcgccggcgttgctgatcgccacaggcaaggatcagctcgtggatccggtgatctggggcgacgaggagcggatgaagagggagctcatggcgtgggccaaggccgtcgcgtccatggcgctcaacggctccgccgactcgtcgtcgcccctttccatgggccgacgacagagaagccagggagcgagccgcctccagcttactgcttagtacgacgtggttagttttgcatgcgttccctgtcgacctggctgtgcctgaacctgaatgatgccattgatgtgttaccattgtttgcgatggtgtatttttgcccgggggcgttaaattgttgcccactcctctgaatacagcgtgtacatgtataatagacaagtttttttagaggagaatgagatcagtgcttatgaaaaaaaaaa

SEQ ID NO: 10506 - DNA, 1299 bp, Triticum aestivum
  Clone ID: PAT_TA_10506
ccgcccgcccggtcccgcattctcagcaacgaccgtcgacctcgtgacggcgccggccagccaggttccatagcgacgcggtggcgccgttcgccggagtagcgcgcctcgacaagaggccgcgcgctgctccttcgaacggcgctgagcccagcgcagaaggcggggtgtcgtcttcctccgtaagtacggcacatcggtgtcaacttcccgtgcgtcgtcccgagagaccacgacatcctggtcctcgtgcggcgtcggcccgcgggatccccgtcgtgtcgcgccttcgccgccccatcggtttctccgtgaaatcttgagttcatcaactgaaggagatgtctgtggttaggttacaaggcggcagtccagagcatttgggcagtggtttcgttgcttactgcaacggatgttcatgtctagtaatgacatcttaccatgttgttaaatcagccttcattaatggtcttatgattacggttatctttcctggtggacaaccgcgctttcaagccgatgtacaaaatttatccgagccgccagatcttgctacccctccggtttgctgaaatatctacctgtttgaacctctgctgttcgctgaaatatctaccaatcctgatttatttccatggcgggtttatttgcatggatattacaatggtaaacgtggacaacttatcagaccttcgacattacctggccaaattgacggtatgtacgtaaatcaagaaactggtgttcatatgctttatgcaaattacaccagtaaccctggaatgtctggtggaccaattattatgggaggtagagtcttggagtcaacaaaggggctgaggcaggaacgagacttgctgtttcagtcctgggtgtacaccatgctagaggattggactgactgatcgaaagcaattgctgagatgcttgtcaatcttgcaacgccaagtattaaagccttggattaaatatcaatcacttggagtgcatgtttgatactacgctgctggagcctcggggtggagtgaaagatggtttattgcttccgtacattgagccagagtttattttgctgcctgtctgtgtcccgtcggttatttgggtcgttgtccgagtgcgatgtgtgttttgcttctccgtgcggttgcttctgacgttcttcgtgtctcgtgtgtcttcttccagtctggcgtcgcattggtttttggtacctgccgaggcggagtcacataggttatttgtgccctgtagagtaaggaattatcttaatgtgtggggctcctgtctttaaaaaaaaaa

SEQ ID NO: 10507 - DNA, 1233 bp, Triticum aestivum
  Clone ID: PAT_TA_10507
attcggcacgaggtctaaagctagtatactgccctcccttgcattgagcggttgagccttcccttccaattctcccagctgaaatggaaagctcctacagttcagccatgccgatggagaccgacacgatgtcgcagttcctcggaggcgaccaccactgcttcgcctacgagcagcaggacgagtccatggaggcaatggcggccatgttcttgcctgccctcgacaccgactccaactcctcctctagctgcctcaactacgaggtgtctccacaatgctggccacagcctcagcctcagcccggccacagttccagcgtcaccagtttccttgatccgggccacggctacgagagctttgagttcccggttatggaccccttcccgcattccgaattccagtcccattgcaccgacatcccctacctcggcggcggcggcgaggatctgagtcctctagacagcaactgtgcaccagccgcaggtgaagaagcagcgaatgatcatatacctgtgactaacaagaggaagtccagagctgccaccacggcatcaaagaaggccaaaaaggctggcaaaaaggatttcaccagcaacgacatcgaaggcgacgacacctatgtcatcgatcctcaaagctccagcagctgcacctcagaagatggggatctggatggcaacaccaagtcgagctccaagaagacaggcaccagagccagccgtggagcagcaactgatcctcagagcctctatgcaaggaaaaggagagagaggatcaatgaaagattgaaaaccctgcagaacttggttcccaatggaacaaaggttgacatcagtacaatgctagaggaagcagtggagtatgttaagtttatgcagcttcagattaagttgttgagctccgacgacatgtggatgtacgcacccctcgcttacaatgggattaacgtcagcagtcttgagatgcacatcgctgctctgcaaaaataaataccactctggagatgtggcgctagctaacactgaactgcatagggattaattgattctggtccttatatatagttccaatcattatacatgtataatgtaactacactttgttttacttcatacttttcttggcatttcctgggagttatacaaagaagtaatcataatcatgtaaatgatcaaaggtcacaatgatatgattggcttcacatttcagatcaaaaaaaaaaaaaaaaaa

SEQ ID NO: 10508 - DNA, 303 bp, Triticum aestivum
  Clone ID: PAT_TA_10508
gcaactcgctgctgctgcaggagctcttgcagcggcggcgatcccggcgtgcacctcaagctctccgccaagtccgccaagaaagacaagcagaagcacgccgccggccccgacaagagcgacaaagctgctggaaagaaattagcaccggctcaggggcatgccggccacttgcatcggcgctagatgtaactatgtagtaccatctgagccgccaagatgtaactacatgaaaataagagcagccatccacgatgtactagtctaccaacatatactctatgccattggtgaaaaaaaaaa

SEQ ID NO: 10509 - DNA, 785 bp, Triticum aestivum
  Clone ID: PAT_TA_10509
accgccgccagccccgccctccgtggccctccccgccactcccctcgccggctgcgcagccacccggccgccagctcggcccccccccagcatcccgccgcccccgccgaccgccagcttcgccccctgcgaccctccccttgcccatctcgggcgggcctcccgcctcccgcgactctcgctgctcgccagcaaggcccccctcgcccttgccgctatcgactcacgctgcagttcacgccacgtgccgccctcctttgttgcaatgtcatcccgcagcccgtccaccaggcaaccatgcgcccaggaaaaggtccccaggggcccacgctgccatcggcagaagaaggtaaaggccccacgaacggccgtcgcgaactacgaccctcaaagggagcgcttcaaacagcgctcgaggccgggagagcacgggcgggttgcgcacacccccccttcggcaagccagcacgtcagccccttgaaggaaattccttatcaccactcttcttgatcttgaagactcaaaagaagctgtttacagcacccttgatgcatggatcgcctttgagcaggactttccactcgcctcattaaagcaagcaattgtagctcttgaaaaggaggaacaatggcatagaattgccaagtattgcatattataatttattttatttttattgaatttatcttttatacagtatgaattaaatttctgccactacaaacctaggtaataaaatggatgttgagcaaagggcaaggaaatccatcagaacatacgagca

SEQ ID NO: 10510 - DNA, 1831 bp, Triticum aestivum
  Clone ID: PAT_TA_10510
cctcgtgcccatcgacaactcacaagcaacgccgatcgacactcgatcgagaatcgaccatggaaggtggtgagcgcgatcgtcaaggtggtgcaggcgatagtgaaggcggcggagacggcccgggagaacagtgagaggtgccttgacctcgccaaccgcgcgcgcatcatcggcaacatcctcctcctcgactcctccacggccagcacgagcagcagcgccaacggctacacagcgaggctgagaacgcccccgctggagatgctgaaggacgtgctccaagaagcccttgagcttgtcgagtccccgctcccgcgcggcgtcgccccgcagcccggcggcctccgcgcgggccgcccgacgccccccacgtgcggcccggccgccgccaggttccccgacggcgtcgacatcgtcgccgccgcggtccgctccgccgcccgggcccgccacgccgccgctggctcccgcgcccccgccgcctcccccgccccggcgccccccctcccccgcgtgcagctccccccgacctcgtcgcctccgcccccgctgttccaggcccccccgtccctgccgcagcgcccgggctgcctgctggcatcgctgcggccgtcccagccggcgccgtcctcgctgccggcgcccccgcgcttgccgcagcgcccgagcttgccgctacccccgtgcctgcggctcccgtccttgcagccggcgccgtgcttgaagtcaacgacgtcgctgttgcaggagcaccaaagctttgccgcaacgcccgagcttacggctgccatcgttgcagcagaagcagagctcgcagtctacgacgtcaccgttgcaggagcaccaaagcttgccgcaacgcccgagcttacggctgccatcgttgcagcagaagcagagctttgaaatctgcgacgtcgcagttgcaggaacaccaaagcttgccgcaacgcccgagcttacggctgccatcgttgcagcagaagcagagcttgaagtctgcgacatcgctgttgcaggagcaccaaagcttgccgcaacgcccgagcttacatctggcatcgttgcagcagaagcagagcttccagtccgaggaatcgccgtcccagcagcaacggagctcgcagtccacgatgccaccattacagcagcagcagagcttgcggcaacgcccgagcttacggctggcaccatcgcaacagaaccagagctttcagcccagggagttgtcgtcccagcagcaacggagctcaccgtccacaacaccgccgttacaggagcaccagaacttgctgcaatgcccgagcatacggctgtcaccatcgcagcagtatcagcatcaaaggctccagtcgggggagtcaaccgtcgcagcagcaatagaactcgcagtccgcagtacgatcgccgcagtagcgccggagtttgtggcggcaacacccggactctcagcctgcaagcttgcatcagcagcagacctcgcagcccgcagccccgcactaccaccgtcacaacaacatcaacacttgatccctcgccatggcggaacgcggattttcgctgttgccgttgcgacgacggtggaagtgcgggctgcgaagtgtgaactctggtgtgctgatgcaagctcgcgagccgagagatgaggtgttgcttatttggcaagcggacaaggtagtacaatacaatacaataatatagctgtccatggacccatgatgtcctgtcgagcaaatggcacaaaaccaccactttgaaggggaggtttgccaaaaacactacgctacacttttgttgcaaacaacaccacgtcttctgcaatcatttt

SEQ ID NO: 10511 - DNA, 1218 bp, Triticum aestivum
  Clone ID: PAT_TA_10511
ctgccattttcctccgttcgctcatctcctccgcctcgccaccgtccttcctcctctcttccctccctcatccctcatctcgtgtcggctcgaaagtcgaaaccctagaccaaccaccctcccctcgtacgtaggaacagggacagagatgtatgcggaccagatctccaccggccgcaagcgctccatccatgaccgccttgacgccgacctcccctccgaccgcggcggcgcggacgccgccggccgggctcgtaacgcgctgtccaagaggcaacgacaaactgatgataaatggaagcatgatctttaccgggatgatgaatcagcttcaagatcagttgatccacgggatttgcgattcaagcttcagaagaaaagctctcagcaagggtttgctggccaaaagggttccggggtacgtgatctacgtgagatgttatctggaacaatgcatgcacaaccatcaaatgttgaccctcaaaagaggaaaccggtgtcagaggttgtgaaagtcacaaggcgtgaaaatgttgatgaaaggcctgtacgcctaagtaagaaagtatcaaaaccatcaacatccaagaagacttctcagccaaaggctgaaagtccactcgacagttttctgaaatcactaggacttgagaagtattctattaccttccaggcggaggaggttgacatggcggccctacgtcacatgactgaaagtgatctcaaggcgttgggcatcccgatgggtcctaggaagaagattacccttgccttggaatccagagcgtagggcaatgtccctggagtacaatgtagaaaagcagggagatgtggtaggtttttgctcatctgcaaatttggcatatcttggaaagcagtggtacaggtacaacaatgcggtgtctcttgtaatggcatgttgctgtaagattattagactgctgttgtttatctggtctgcatgctttcctggccagaccagctgatttaactgatgaggtatccgtgctgttgaagctgcggtgatgttctcgctgtatactattattacgccttttttttcattggaaactggcactattagagtcatagagttgagattctccaattagtatttcaagtgttgcgttgctcagtgtaaaggttttaaatttcatctgttttcttgctcaaaaaaaaaaaaaaaaaaaaaaaaaaaaaaaaaaaaaaactcgagac

SEQ ID NO: 10512 - DNA, 709 bp, Triticum aestivum
  unsure (1)..(709): unsure at all n locations
  Clone ID: PAT_TA_10512
gaaacttacccggnacattgcttattttgtacgaccactacccatggacctaaatgcttttctatgcaaggaaaaccagctgaggggaatgtttgagtacgctagaaggtgcaccttcaaagatcatcttcaaaagcacaagcaaaccgaagagagtacagaccacaacaccgacaataaccttctagtagcccaaactctcgcatcgaaagtactcagcaacgccaatgttcacccacgggcaatggatatgccggtgaccttcagcatcgacgacgcctccggcttgtgctggcgattcagcagcgagatcctgagcacttcgtacccctgcctgatcactgtcgtggcggacgggcacacctcggaaccactggatctcaccgtcaaggtgaactccgaagacacggcgttcggcctgaacctcctgaacagagttgtggcgatcatagagtgaaggggcacttttgagttctgcaagtttggttcaaatgctacttttgtggttactgtaaatcattgtacattatagtgaatgccgaggattagagtgacctgacagattgttgtacatctttttaccaccttgtattctttttctcattgttagattgatctttttgttaacctgatggcgcattgcggcgtgctgctggattgtaatgttgagtaatgtcatgatattgctggggagcaataaattccagag

SEQ ID NO: 10513 - DNA, 1304 bp, Triticum aestivum
  Clone ID: PAT_TA_10513
aggcggcgcgacgcccccccgccgctcctggcgcggcaccccgcccggctcctggacctgtttggactcatgggtgcatacgccgctgggagctgcaggagggtgaggacgtctgcctacgtcctggcgctggtcgtcggggtctcggcgtacattgctgtgctcgtcgtggcatccatcggcatagcgggccgactgagaagcgcaatggactggctgacggagcaagtgacacggtgcttctccgtgcatgatatgtagaagaactttgtagaattgtagggtggcctgccctggtcccatggaccttgtttgtagacaaactgtaattgttttaggacttttgttctctgtgtagtttctgaacttccgttgggatcccaaatgtggtaggaccttgttttttcatcctaattgtttaggacttttgttctgctttgtaatttctgagcttcctttatcaagaaaaaaataagaattgccgagcgttggcctcccgctgctcgccgcgctcgctgccgccgtcacgtaccaggccgcgatgagcccgccgggcggcctctggggcgacgtcgtctcgaccggccacaccgccggcgatccggttctcgcgagcaactacccccgccggtacaaggccttcttctactgcaacgccacgtccttcatggcgtccctggtgatcatggtcctcctgctgatcaagagggtgagcgacaccccgccggcgctcttggcgctgcacgccgccatgatcctggacctgtttggcctcatgggtgcgtacgccgctgggagctgcaggagggtgaggacgtcggcctacatcctggcgctggtcgtcggggtctcggcgtacattgctgtgctcgtcgtggcatccatcggcatagcggggcgactgagaagcgcaatggactggctgacggagcaagtgacgcggtgcttctccgtgcatgatatgtaggagaactttgtagaattgcagggtggcctgctctggccccacggaccttgtttgtaggcttctcgcgccggtgtcggcgcggcgtctggctggcggccgttggctcagctagcggtagcgagcggccggtcagaaaaggaaaattcttgtcccccattcttagaaaggaaggcctcgtaaattccgttggctcgataggccaaccactagaccctgtttgtggtggggtgcgctttggtccctgatttttcatgccctttcttccatgtccgacctgacacacgggtgtggtccctttgctgccatagctttgattcctttttgcaaaaaaaaaaaa

SEQ ID NO: 10514 - DNA, 1557 bp, Triticum aestivum
  Clone ID: PAT_TA_10514
tcgcggccgcgtcgacctggaatcgctcctcccttttcttcttcccccttttccgccccccttttcccagctccttgcacagccaacaagtccggatcgatcagcccgagccccctgcgactccgcccccgtgccgtctcaccgtccgccgcctcagtcccgcccccgcccccgcctcgcgcgcccgtcgccggtcccgctcttcctcgccgccgggacgccgcgctcctgctgtctaccccccaccccgtcccagcctctatcccgccgttgggttttgagggagagcggaaggggccgaggaaggggttagggctggagcagggagcgcgcaggcggcgacatgtcgggggaggacgtccgcaaggtctctcgccaggacatacagctcgtccagaatctcatcgagcgctgtctccagctgtatatgaaccagaaagaagtgattgataccctctcccttgaggccaagatagaaccgagctttactgaacttgtttggcaaaaacttgaggaagagaaccgtgaattttttaaggcatactatttgaggctgatgcttaagaatcaaataacggccttcaacaagcttcttgaggatcagttccagcttatgaacaaagactattcttcagggatcccttctatgcctcctactaatggctccaactccacaacattgaagcaaaactcgtgctttttaccagagtctggtcccatatctgcaatgccaaatggtgcgatgcgcaacggaagttcaggtggtttagtaaatggaacatcatctggtgatcagtcaatttatggtggtaaaaacattcacggtcctcatagtggtatggatgcttcaaccagcgtgctaccagcccagaatgcatctgctctgctttatggtgcagataataatggtacaacaataaagacagagtcaagctattcgagcaacgctgattttgctttctgtgggaacgctttccttgaatcatgccaatcaattggcgatgcctcgggtggttcttttagcagctcagagttgaacgggcaaccactgaatgatgcacttctggatatggagtcatcgtcatttggcttcttgagccagattccccggaatttcagtttttcagacttaacagaggggttcaaccaaaatacagaagtattggagaattatggcaggtcaccatttctatcttctgagccaaataacttctcagattctacaggtggagaacatacaggctgagcagctacccgccgttttgtacatattcatggagaacttgagcacctttcatgctagccttttcccttgtcagtcccgatgtcttgtaatgtagagtgtgtgttaagttgtaacttgatcaaaagatgcagcagatctggcccccggtcgcttgccgaaggtattgtagttgtgccctgccttgtacattggtgttgtgctgtaagatcagcattagtagctgtgatattaaatttgctgggttaaggggttatgttcttgtctggcatgtacaacagaagtttattaattttaagtgagagtttaattcg

SEQ ID NO: 10515 - DNA, 810 bp, Triticum aestivum
  Clone ID: PAT_TA_10515
ccctcatcccctcgccgcgcgggcccccctccccccctccgccgccagcgaaggctggccgagcgcccgtccatcgtggggccccgcgccccccggcgccgcgcgccccgtccccccggaccacctctccccccccccccctcgcttccccgcctgaggagcagggagcaaccccaaagccaccatgtcactgcccatggaggtccatctctcgatccattcaccgcagccgcgaaccctgttcgatctggtgctggaatgtgtgaggcatgaactgcagcgcatgtgtccccgttgaccctccgccacgccaacgcgggcccagcctccaccgacgcctccctctggcccagatccacagcgccccgagggaggcacagatctcaacgatggccaatgtatgcggcggccggggatgcacggtggggagagatggtttggagggtggcgcgcggcgactggggacgcacgctggggatagatggtggaggagggtggcacgcgcctcgcccaggcctccttccacgccgcagcggcggagtccaagcgctcatcatgaggacgcacgggcgaggaggatttggcgagctccggcgccgattccgttggttccggcgagctccggcgccgattcgtttggctccggcgagctccggcgccgattcgtttggctccggcgagctcatccccctcctacagagggtgttttttaaatcgttggcccggcatttttttaacactgcacacaatgtaatgagctagtatagctagcaactatagactaatggttatttgctttcgagaggagac

SEQ ID NO: 10516 - DNA, 956 bp, Triticum aestivum
  Clone ID: PAT_TA_10516
cggccttcgtgcacatcctcccggaggccttcgagcggctcggctcgccgtgcctcgtcgacgggccgtggcagaagttcccgttcgccggattcgtcgccatgctcgcggccatcgccaccctcatcgtcgacaccattgccacgggatacttccagcgcgcgcacgccaagaatacatccgcggccgtcgggtacgtggaggcctccgactccgagcaggcgcacggtgggcactcccacggcgtgtccgccgtcatcgtgtcgtcattctccgacgacggcgcgaagctcatccgtcaccgcgtcatctcgcaggtgctggagctggggatcatagtgcactcggtgatcatcggcatgtctttgggtgcatctgagaatgccagcacgatcaaaccactcgtggtggcgctaacttttcatcaattcttcgaagggatagggctgggaggatgcatcgttcaggctaggtttcgcctcaagtctgtcttgatgatggcactcttcttctcactcacgctgccagttggtgtcgtgatcggcatcgggatatcctctgcttacgacgagaatagccctagggccctaatcgtggaagggctcctcagcgctgccgccgccggaattctgaactacatggcgctcgtcgaccttctagcggaagacttcatgaatcctagggtgcagaacaacggaaggttgcaggtcatcattaacatctccttgctggttgggacggctctcatgtccatgcttgctgtatgggcatgagaaatcctcctcggctaaaaataataaattcgttttgaacttttttatgaggcgaggatttctctttttgtttctttttgagaggttttctgatctgtttcttgattgcttgtaaaagatgtgcatatatacatcaaacttcacggtgacatatacatgtacatttgctcggtattacaagtt

SEQ ID NO: 10517 - DNA, 1480 bp, Triticum aestivum
  Clone ID: PAT_TA_10517
gaggaattcggacgagggtcggattcccggacgagaactcgttcggcgccctgcatgcggttagaaggggatcaccgtggtgtacgcggccgggaacgacggacctaggccgcagacccttgagaacacttcaccgtgggtcatcaccgtggcagcgagcaaggttgatcggtcatttccgacggcgatcacactaggaaacaaccagcatatactgggtcagtccctcaactaccacgtggtgaactcatcggccgggagcagccgtttcacaggccttgtgtcagacgaatgtaccatagcatctcttaatgccactgccaaggacgtgaaagggaaaatcctgctctgttctcccttgccagatgatccattggcgatcgccccagggatcactttcaacaacgcgttacaatatgtccggaatggcgggggatctggacttattttcgctcaatatacaacagaccttttaggtgtttgccaaggcatagccctgcgtcatcgtggaccttgacactggtaagaagatcaaaaaatacatccttggcacaagctctcccatggccggcaccgggctggcacgcaccgttatcgggaaagagatatccgcaccaaaagtggcctccttctcctctagaggtccatcacctgattaccccgaaattatcaagcctgacatagctgcaccgggagccaacatcttggcagcagtgggaaattcctacgtatttatgtctggaacgtcaatggcaaccccacacgtagctggcatcgtcgcactgttgaaagctcagcacccagattggtctcctgcggcgattaaatcagccatcataacctccgcccatgtaaccgacgagcgtggcatgccgatactggcagaagggctgcctcgaaaaatcgctgacccattcgactacggcggcgggaacatcaatcctggcggcgcggccgatcccggtctggtctatgacatcgatccccgcgactacaacaaattcttcgggtgcaccatcatcaggagggcaaacgtgagttgtgatgcgacaacgttaccggcatatcacctgaacctgccctccatcgcgatccctgagctgaggcatccaatcaccgtgtggaggacagtgacaaacgtcggcgaggtcaactccgtgtaccacgcagaagtccaaagcccagctggagtcaagatggagattgagccgccggtgctcgtgttcaacgccatgaacaaagttcatacgtttaaggtgaaattgtcgcctatgtggaagctgcaaggggactacaccttcggcagcattacgtggcataaggaacagaaggctgtgaggattcctgttgcagcccgaattacaattcaggacttttatgcagatgttgcataaataactcgaggtgcaacttaagtacacgaaattctgctcttgatttgtactataatgaataacaacagtaaatggatataaattct

SEQ ID NO: 10518 - DNA, 576 bp, Triticum aestivum
  unsure (1)..(576): unsure at all n locations
  Clone ID: PAT_TA_10518
gtggaagctgcacacggtgtccgccgccacggacaggaacggcaaggtcgtcctccggatcaagaagatgaacttggtcatgcaggccttctccaacgccaaagaatgcgtggtggaggacgtccggccgtgcgcgccggagaaggcgagccgggaggaggacgcgacgtacccggtggaggtgaggacgagcaggggcaaggtggagctccgcgccgacgactacgccgtgtacaagaggtgggtcaccaccgtgacgcacatgctcacctcctccaccgccatcaccatgcgcaattaaccatcgatcgatcccgccactgccgaccgatcgaatccaatccactgacgtacgtgcgcgaccggaagtaacaaaggggtcgtacgtgtacatgtgttcgatttcagatctcacgcttctggttttaatcccctcccagattgatgtgtaactaaatttagcctcttgatgtggtgactttgtcaatttcaaaatttgttggctcgggcccttaagaggtgcttcacggaatagagtgtggatgggtanctatctctacttctaaaaaaaaaaaa

SEQ ID NO: 10519 - DNA, 846 bp, Triticum aestivum
  unsure (1)..(846): unsure at all n locations
  Clone ID: PAT_TA_10519
ggccgacgacgcgtccctcatgtccgccgtcatcaccggcctcgtcaacgtcttcgccaccttcgtgtccatcgtgaccgtggaccggctgggccggcgcaagctcttcctgcagggcggcacccagatgctggcctgccagatcgtggtgggcagcctgattggcgccaagttcgggttcaccggcgtggccgacatccccaaggggtacgcggccgttcgtggtgttcttcatctgcgcgtacgtggccgggttcgcgtggtcctggggcccgctggggtggctcgtccccagcgagatcttcccgctggagatcaggtcggcggggcagagcatcacggtgtcgatgaacatgctgtgcaccttcatcatcgcgcaggcgttcctccccatgctctgccgcttcaagttcatgctcttcttcttcttcggcgcgtgggtggtcgtcatgaccctcttcgtcgcctacttcctgccggagaccaagaacgtgcccatcgaggagatggtgcttcgtgtggaaggcgcactggtactggggccgcttcatccgcgacgaggacgtgcacgtcggcggcgcagacgtcgagatgcgctccaacggcaaggtccaggctgccaagctcccgtgacgtcgaaacgtcgtcgctggccaataagctgttaccatccgaggccgatcgaggacttttttgagtcctcgtctgatttttcatttgtcttcttctgtattataattgccatactacctaggatgatgacgaacaatcagtgcgtcacnaatcattcccagtttccttttctttttatgaagtttgggctcctttgtgcccggatatatactc

SEQ ID NO: 10520 - DNA, 543 bp, Triticum aestivum
  Clone ID: PAT_TA_10520
gaggaaaaagtctcgctcgagatctagatcgagggctctgtcgccgggaggcgccggcgccggcgcctagggtgagccaacggcgttcgcgaaggcaacgtggtgaggcgccgacggcgttgaccacgacaggggttaggcgcgacgacgacggcgattcgctcctgacctcgacggcgactcgctcatggccgcgacgacgactttgaccggcagtcctgacctgaccgggacggcgaatcgctccttctcctccaagctgcctcctctgctccacaaagggaacagtgttgctgatcatttctggctgaattccgagaaatccttgatttcttctggccatacatatatcatgtcagcctaccatatcctttattgtgacaaaatattctggatatgtgcattattatccacaatagacttgtgttgagaacaagaagttcttggagctatcatttttgcattcaaaatcataattcatgggaacctgctgctgtctagaacttccattcctatttgaagatgtttatattaaaaaaaaaa

SEQ ID NO: 10521 - DNA, 789 bp, Triticum aestivum
  Clone ID: PAT_TA_10521
gggagtccaagcagctgcaggcaccgcaggcccaggcggcgagcgagtgcgcggtgtgcctcagcgagttccaggagggggagaggctccggctgctgccgccctgcctccacctcttccacatcgactgcatcgacgcctggctccacgccaccgccaactgcccgctctgcaggaccgccatctccggctccgcctgccagccccagccccacgttatgcttaaccaaatcgacatcgtcaacgtcctccaagccgaccacgtagtcatcgacatcgcctcgccgtcccggggagaaacgagcaacgtcgctggcgtacctgcgacgatagtgagcatgggagacgagcgcattgacccgaggagggacgagttgttggacgtgcagcagccgatgagaaggtcgttgtccatggactcctgcaacgacaagcacttgtacctcgccctgcagaaggtcctgcgccaccaccactctcactctgcttctctcggggaggaccgcaagggggagagcagcacccccgccgccgcagccagcagccgggcagcagggaggttgcggcgatccttcctctccttcagccacagccggagctccagaagtgccatcttgccaatctgaaactattgttcgtggtactaaactgtacatttcttgtagctagactagatgatgaactccactcgagtaatacgacttcatttctttgttttctgttttcatgatcgcttgttcagctttatgttgcactctaatcgatggtgttgaggaagtaaaaaaaaaa

SEQ ID NO: 10522 - DNA, 213 bp, Triticum aestivum
  Clone ID: PAT_TA_10522
gaagatactaaaaaagcgcttgaagagcagtacgggggcgaggaagagttgcctcaagttaaccctggtttcaataacaccccatttaagttcacaaagtattcaaatgcctacatgcttgtatatattcgtgagagtgacaaggagaaaataatgtgtaatgttgatgagaaggacattgctgagcatttgaggataaggttaaaaaaaaaa

SEQ ID NO: 10523 - DNA, 707 bp, Triticum aestivum
  unsure (1)..(707): unsure at all n locations
  Clone ID: PAT_TA_10523
ggcgcgcgcgtacaacactcggctagacctcactagcttgttgatcagtattggtccaatggtgaagagtgttagcttcctcgtcgcggtgcttaccatggccgtctcccttcactcgacgcatgcggtctctgccgcattattcaatcccaaagccattgctcagcaccttcctaaggtggatggctggaccaaagaaaacctcaagtcgatgaaaaagctgaaggaaattgtagatgcagccaaagacggtgtcgagaaaggcattaagtttcatgataaggacgcgcaaggccgcagcatccagtactccagggtcaccggcataatagtcggcgatcacaagcttgaggacggccagcacggtgtgatcctgatcgtcacggcctttcctttcccgttcctcaacgagaaggcgttcgggctactcaaggatgagttcagtacggccaaggagctccaccgtcaattcggcccgctgtgcacgacggacctgtacccgccggtcacgctggtctacgccgacgacggtgccgagaagaagcaggagtgcccctggcacaagcagagcgacgggtccatgtgcttgggcatcctcacgttccagaaatagctagcatcgctttgccagctgccaagctccatgtgctatctttattatcacaattattgnatcgttcaccagtagcatacatacattaataaag

SEQ ID NO: 10524 - DNA, 522 bp, Triticum aestivum
  unsure (1)..(522): unsure at all n locations
  Clone ID: PAT_TA_10524
gcatctcctctttccttccgttcaatcttgaccgccgcagatagatagaaaccttccctctcctctccctctgcaaccccgagctagctcctgcattcgatctcctcagccgcgcaatcgcaatctgcaccgggaaccgaccgacctcattagacaacgcccatctgcgccgtgcaacgacgtgctcgttctacataatggcgccgccaccgactccgactccgacctacgaccctattcttgttatcattgtcgattctgatggaggcatcaggatcatctgtattcaaagcgaggccacgcaatagcagcagttatggaagcattctatgcgacgctgctacacaaagttgcacccgagaccgatataatcatgcgtgacagcagccatgcttgaactgggcaaatggccggaggggtatctgcctaaaatcaaggccaagaccaagacaaacctctcccgtgcgcaagaaattacatgtaaaattnaacgggtgtttctgtactcatgtttgcggcata

SEQ ID NO: 10525 - DNA, 618 bp, Triticum aestivum
  Clone ID: PAT_TA_10525
gatacacacaaacacaacgaagatggcttccggcggccaaacgaagatggttgccgttggcatgctgctggtcatcctgttcgccgcggtggctcacgccgtcctagtgccgccggtgccgccgcaccaccaagcctgcatccacacgacgggcgaggttcccgccgccagtgactgcatctgctccaagaactgcgcatgcgccggaaagtgcatcttagcaggcggcacgggcgaccatgtcaaggcctgcttcatcgattgtgtgctcaagaacgactgcaggtgcaacgataactgcttcgcccaccagcccccggtgcccatcatcctagcagagcaccaaaagtgaggcctctgacgaccttgtcacgtctgcgtccacgcctgcttcccaatcagtttggtccatgctacgtacgtactttgtcaccgtaatttttggtaaatctcccgtgcttgcatctactttgggtaccggtcgcctgtctccgtgtattgctgaaaaataaaatgtcgtctcatttgtatccatgttactccgacgcgtgacaatatttgtatttggctacaattatattaaatatatatattgggtttgtatctttaaaaaaaaaa

SEQ ID NO: 10526 - DNA, 682 bp, Triticum aestivum
  Clone ID: PAT_TA_10526
aagcaactgcaaaggcaacagcctttctccgccgaatcgccggacccacgcgcgcgagctcgccctggtatggtggctatccgcggccggcagcagcaccagcaccttcgccgctcccccctcccctgaccggccttggctcggccaggcgcgagattcggaggaggagcggcggcggccgccatgtgggggtccagggcccaggatggggtggagatgcagcagcggcggacgaccaacaggatctttcccgatgagaggcaagatcaatccaagatgccgtttcaagccggacgggtcgacaggttcgctgccaacaggatagacccaaagaccctcgagaagctcaaattgatgaacgagggcaacgtgccgtggcacagtcgcatcctggaccccagaagcagcgtgctgctgacatggaacagggtgtacctggtggcctgtctcttcgccctcttcatcgaccctttcttctactacctgccatttgtcagagtcatggacaaaaccaataatttctcatgtgttgctgaggaccaaagattgcgaaatactatgaccgttctgcggacactcgctgacttgttttatgtgctcaacattgcgatcaagttccataccgcatatgtagacccaaagtccagagtccttgggaagggagagcttattgtggatctaa

SEQ ID NO: 10527 - DNA, 608 bp, Triticum aestivum
  unsure (1)..(608): unsure at all n locations
  Clone ID: PAT_TA_10527
ccgtccgcccacgcgtcgggcctgattcattcctgctcgggagtaaaaaaacggcgcagggctcatggagatggaaggaaaccaaatccagacctcacccatggggtccgcgccgtcgaggtcgtccccccggcagtggagctggggctcggccctcgccggcgccgtcaccacggcggcggcggcgggcgtgctggtctgcaggccgagggacccgagcttcgagctcatctccatgaacctgtcctccttccacttccggccgccggcggcgctggacatcggcctcaccctcaccgtccacgccaccaaccccaacgtggtgcccgtgcgctacggcgcctccaacgtctccatcctctacgggggcacgctcctgggcaccgcgcgcctcgacgccgggcaacaacccgccacatcgtgccgcctgcttcacccccgggnccggctcgacgccatggagctcgcgcacangccggcgcatcctcgccgacaacgcgcgccggcacatgganctggacgccgtcnggagatnccnggcgaaggcaacgtnctgctcgggtccgccgctntcgtncgnatcgacagcanatcgtcgtcnacccttt

SEQ ID NO: 10528 - DNA, 877 bp, Triticum aestivum
  Clone ID: PAT_TA_10528
gctgttcacactgctgactgctccaccctcgagcgatccgtccgtccgccgccgccaccttcttccctcccctcccgccatggcggccgccaggtggtccccggccgccttcctcgcactcctcctcctcctgctcccgttcgcgcccagcccagcacgcgccgcgacgccggggaagtccccgtcgtcctcgtccaccgccgtgttccagctccagggtgccgtctatcccatcgggcattatcatgtcaccatgaatattggggacccggccaagccttacttcctggacgtcgacaccggcagcgacctcagctggctgcaatgcgacgccccctgccaaagctgcaacaaggtgccacacccatggtacaagccaacaaagaacaagattgttccctgtgcagcttcgctctgcactagtttgagccctaacaagaaatgcgccgtaccacagcaatgtgattaccagatcaagtacacggacaaggcaacttcactcggcgtgctcatcgctgacaacttcacactgtccctgaggaattcatccactgtccgtgccaactgcacctttggctgtggatatgatcagcaagtgggaaagaatgccgcactgcaggcggcgacggaccgcttgcttgcgcttgggaaaggatcagttagcctgctctcgcagctcaagcagcaagggattaccgagaatgttcttggccattgcttcagcacgaatggaggaggcttcctcttcttcggggatgatatcgtacccaccctcgcgtgtaactttgggttcccatggctcgtaccacatatgggaattactactcacctggctcaggaacactgtacttcgaccgacgctcgctaggggtgaagc

SEQ ID NO: 10529 - DNA, 181 bp, Triticum aestivum
  Clone ID: PAT_TA_10529
gcggccgtgaacggcggaggccatttctagctcggttgcgccggacgtcgcggcgcatgaagctttggttgcattgctgcatgcgtgattgagctcatgtatttggagccttgagtgagaatttgttgtgatttatcctatatattattcaataatgaaacattgtttaacaaaaaaaaaa

SEQ ID NO: 10530 - DNA, 725 bp, Triticum aestivum
  unsure (1)..(725): unsure at all n locations
  Clone ID: PAT_TA_10530
gtaanctcccctcagtcgccnctttgtanttggttcgagnatgaactcgagttangtggacaaggaccatcacaccaacttggtgatcggggacccgggctacattgaccccgtgtacgtgaaaaccgggctgctcaccaagaagagcgatgtgtatagcttcagtatcatcctgctggagctcgttacccgtaagaaggcgatttacaatggaaatgaaagccttcccatggattatatcaaggcttccatggaagggacagcgaggcagatgtttgataaagacattgtggcaaatagcgaggagcatatggagtgcctcgaggaggttggcaagatcgcgctgcagtgtctcaatgagaacaacgtgaatgacaggcccaccatgcgtgaagtcgtggacagacttaaagcgtgtaagagccagtggttggactgtcattggaagaaaaatgaggtgatgtaatattgtacataggtagttggtggccttatgcgatctagggcatcaccttttataagatgagagtttaagattacggatttgctaattctcgtctagacgagatttagttatgtcacatctatgttctccaccgtaccactcaattaaggtgctgtaattttcatgcaaactgttgatcgctctttttttttgctgctgaaatgagctggcattaattaagtaatgttattaaactcaaaaaaaaaaaaaaaaaactcga

SEQ ID NO: 10531 - DNA, 1280 bp, Triticum aestivum
  unsure (1)..(1280): unsure at all n locations
  Clone ID: PAT_TA_10531
attcggcacgaggctgagctcgaagcaatgacttcaaaggactctatgggtacaaggtttttgtatccatatccctgatacttggggatggtatttataacctcgtcaaaatcatttattctacaatcaaggaaacaatgaatgcacgatcaaaccaaggaaggcttccccttgtttgggttcaggaaggtgataaaatttccaaattaccagccaaggaaaagctgctaaatgaggtgtttgtaaaagacaatatccctccttggttggcagcatctgcttatgtgggccttgcagcaatttcaactgcaattgtaccgataatgttctcacagctcaagtggtaccttgtcctctctgcctatgttgttgctcctctactcgccttctgcaactcatacgacaccggcctaacaaactggagccttgcatccacatatggaaagattggtctttttcatttttgcctcatgggttggccatcgtggtggtgtgattgcaggcttagcagcgtgcggtgttatggtgtccatagtatccacagctggagatctcatgcaggacatcaagactgggtacctgaccctctcttcgccaaggtctatgtttgtgtcacagttgattggaactgcccttggttgtgtcattgctcccctcaccttttggctttactgggcggccttcgatattggaaatncctgatggcatgttcaaagctnccatatgctgctatctaccgtgagatgtcaatcatgggtgtcgagggattctcagtgctgccgcaacattgcctagcaatctgctttgtcttcttctttgcagccatagcattcaacctcctgcgagacgtcaccccgaaaagcatgtccaaattcatcccactcccgatggccatggctgttccattttacattggggcatactttgcgattgacatgtttgttgggactgtcatcttgtttgtctgggagagggtgaaccgtaaggagtccgaggactttgcaggtgcggttgcttctggtttgatatgtggtgatggtatgtggagtgccccttctgcgatgctgtccatcatgaggatcgatccaccaatgtgcatgtacatcaagccatcccttacatacggctgaaaatagaggaaatttattcattttatgtgatagtaccacaagagagcagaatcacgttgtgtacatagtttacacttgtgtaatttagacctccagaatatagcaagtatgtaatgtgtctcaccccttctataaaaaaaggctttgttt

SEQ ID NO: 10532 - DNA, 850 bp, Triticum aestivum
  unsure (1)..(850): unsure at all n locations
  Clone ID: PAT_TA_10532
ggcaccgtggcatttggtctctttcggccgcctcccccttctccaattcccaccccccaagcgacgaactcccgccgccgccggccgctcccacggcgagctagctcgcccgaagcgccgtgcctcgctggatccgagaccgcacgggcttccggatctcggttcgccgcgcttggagctgagaatggtcgaggggaaaagtgttcaagttgacgtcgagaaaggacttaatcaaatgcctaatgatagcaattcaactagccctgcaactatgcagaagatgaaacctgatatggatgattctgggagaagaactgaatcaccaactccagagaagcctgagtctggaagggaggagattgttgtcagctcattggcaactaatttactttcagagaggtacaaggacagattagctgagaagctgttgggaaatgaggatgaaacagacgatgaagatgataatgaatttgctttgcctgatggcagccaatctccagtttcaaatgaacttcttgagaaacacaagaatttgcttactcctttcaaaccggatgggagagttctataaggttgctgcgccctgaggaagaagatgactacatttaccaacattgcaacccaggtggaagtacccactaaggagaaattcttgtactcncatttggcccaaattgaacatttatcccngaagcatccanataataggtaccctggctgntnaanaaagccatgcatttagctgacatgggaatacactctgaagacctgtggatgtngtaanctcaaagctcaaccattcaattgtgaggnttccnaaacnttagctctggatncncnaagggatcat

SEQ ID NO: 10533 - DNA, 760 bp, Triticum aestivum
  unsure (1)..(760): unsure at all n locations
  Clone ID: PAT_TA_10533
tcggcacgagggcccaaccttaggcgtgtcccacacccgtgaggccgtcacccatccgcccaaccttgacacaattcaaaattttaatccaatcgggcaggcgcagccacatcgccgagaaccaccatgctccccgtccccgtccccgcacgaccgcgccggatctgccgatttcttcacgcttgaccaatgaatcttggtgcggagtcattcatggatcccttgttcagcttttgttcctagccaacttttcccgagagcgtcccagatctgggatagctagaggaggattctcctacctcaagccaagatggggaggaatttggtgctacagattcaagatctcaagttcctgacgccacgccagattttccaatgtcccattgacaacacccacaaagagagccctcatctgaatcgcagcgcactccatctccgtggcctaaaagagcaagtacttctgaacctttacttgacctgaccgcagtaccacattaccagaaaggcgaagtgctttggagaaggccatgataaattacgataggaagtctgagttcatcgttaagccgaagtgtatcaagtgcagcattccaggccacaaaaacttagtgcctttctattgtgaagttctctccgtgttggagttcactcgctttgaattgctcgatggtctgcttatacattttttttggatgtcactaattggatttccttattagaatattaacatttacgtagtgcgcacttananaccagattg

SEQ ID NO: 10534 - DNA, 612 bp, Triticum aestivum
  Clone ID: PAT_TA_10534
tctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaatacccgacgcacatggtggtctgcgaggaacagcctagcaactgcccgaccatgtaactgccggagaacgattttgacatactttagttttgtcggcaactatacttgcatacatgtactacttataataacagtttataataaaattgattggaggaaga

SEQ ID NO: 10535 - DNA, 749 bp, Triticum aestivum
  unsure (1)..(749): unsure at all n locations
  Clone ID: PAT_TA_10535
ggtcatggcatcttccaagnagtagtcttgcattgttcaccctggccatggccatggccgtggtagccaatgtctcgtcgcagaacaccccgcaggactacatcaacctgcacaatcgcgcccgtgcagcggacggcgtcggccctgtggtgtggaacaacaacgtggccaagttcgcacaggactacgcggcggagcgccgcgccgactgccggctggtgcactccggtgggcggttcggggagaacatctactgggggtcctcgcagcggatgaccgcagccaacgcggtgaacagttgggtatctgagaagcagaactaccatcgcggcagcaatacctgcgacacgggcaaggtttgcgggcactacacacaggtggtgtggcgcaggtcgacccgcatcggttgcgcccgcgtgatctgtgataggaaccggggcgtcttcatcatctgcagctacgatcccccgggcaacgtccgaggccggggccctttcctcgccaagtagtacgtgtgtttgtgtgtgatttgtggtatcgtgcttatgtgtgcgtgtgtgtgtgttttataaagcgaaaaaactgtagtgtctttcgaatatttacgtctacatatgttatacgcaaataagcacagtcaccggcctgcatgtgtccatgccccggctctgtggtgcatgtaaatgtagtcgtcccccgcccgggcgcgtccgtccacattttttgttttggtcgttttaaaaaaaaaa

SEQ ID NO: 10536 - DNA, 1237 bp, Triticum aestivum
  unsure (1)..(1237): unsure at all n locations
  Clone ID: PAT_TA_10536
ccacgcgtccggnnnaagattggcaatgaattctatggaaccaagttgattgcatttccatgtctgtcagaacttgaatttgatgatatgccacaatgggttgagtggaccaaagaagagagcgtgaccaatgtttttcccaagctccgtaagctgagtcttttgaactgtcccaaattggttaaagtgcctcctttctctcagtccataaggaaggtcactatccgaaacacagggtttgcttcacacatgaagctatccttctcatcatcatcgagagcttgcagtgttgcactagagacatgttgtaccaccatccttacaataggcttgctgcaccggcaacaggtggaagcagttgcagttttgactctgcggcgctgccaaggtgtaaattttgaggaccttcnnncgcttgcctcactcaagaagctgcatatatcccatctagacataacagatgagcagctgggtacttgtttgcgaggtttacggtctctgacctctctggagatagacaactgcagcaacataacatctcttccacatgtggagtcggcgcgcggattaacgacgttgcacattcgacagtgctccaagttgtcctctctgcattccttgccgagttttgcagcactggaaagcatgtcgatcgacaattgctccaagctcaccttagagtctttccctgccgacttcagcagcctcagttctctgagaaaattgaacataatgtgctgcacggggctggagtcgctgccaagcggtttcccatcttcactgcaagttcttgatctgattgggggcaagccagcgctgttgaaccagctgcagctcaaggacgggccagaatgggataaaatagctcatatcccgattaaacggatccattgaccagaggctcgttgtgttggtgcgtccgatgccgttatcattccagttcgtcgccgttcgatgccggatctaacgcgatgtgtgcatttcagattccatagtcaatgtctgccatttgtgcgtgaaattctactgtactccctccgtaaagaaatataagagcatttagatcactatttagttatctaaacgctcttacatttctttatagagggagtagtatgcaagatgagagatacctgatggatctgtatcccttctgtatgtatgtaatgtgtgtgaaattctagtatactcgtacgttctgtatgtaattaatgtgccctgtgctgaagtacatttt

SEQ ID NO: 10537 - DNA, 1181 bp, Triticum aestivum
  Clone ID: PAT_TA_10537
aaaacacgttagacgaacacgctggccggccgctgcgccccgccgccgctcgccgccgccgccgccgaagccaccccggccgcctccatgaaaggccgcagcagccaccgcgggaccgctcccacctccgccgccgcctcgacttccagcaagcgcgaccccgtagacgagcccgtctcagactccgaggaatcgggcgacgaggagcaggatgtctcctcgtcgtcggggtcggggtcggagtcggagtcggagaacgaccaagttagcggagcgggagaggaagctggagcgcgtgctcgccgacgtgcccttcggcgagctgcagcgcgcgcgtgccgacgggtcgctcgcggcgcggggtgcttctgctgccgccgccgcccagaagaaggctcgcagggaagagcaggaagaggcccatggagattagcacgaatgtgcggccgcctagactcagggaggtgatccaggttcccaagaaggtggtaagggatccaagatttgaacctgtatatggagctgttgataaagaagggttcagggaaaagatacaatttcttattcgatcatgatctccctgcagaaaaagagaaactccaaaagtcgattaagaaattgaaggatcctaatgccattgaagaagcgaagaatcaaatcacctggattgataagcagttgaggtctaatcctcagaagaacgttgaatcagaaattctgcgtggacatattaagaaagagagggaagcagcaaaggccggaaaacgaccatattatctgaagaaatctgaaattcgtgaaaggaagttgatggacaagtacaatgagctcaaggagacgggaaagcttgattcctttatggagaagcgacgcaagaagaatgcatccaaagatcatcgcttcatgccataccgaagggatggcggcgcggcgtaacaatgcccctacagccgcttttggggtgattctggctagcctatcctctgctcacagagttgttgtagcagcgctctctactatcctgttgttgccctagtgtcccagatatttatcagcaaccgcgagttgaagctaacccatggaccatatatttattgttgagctctggttgctggcagcaacaagcaattgtaaacccaaaccatggagataatattttgtttcatctactgcttcaattg

SEQ ID NO: 10538 - DNA, 514 bp, Triticum aestivum
  Clone ID: PAT_TA_10538
gaacagcaccctgaagccattccatggatggatctcatcagctgcttacagggtagcattgggtctcattccggaaagagagatctttattcagctgctgatggggaactgccaggatcctgaggattttggaggagatgtcatgatcttggtctccattgtacagcctctgctagaagagatcaatgccattttggtcaaacaccagctggacaggctcaaatccacctgaaaaacaaggatggccaatcacctgatgattgtacatatctactactgtactgcacaagctaattaacctaccttgcgttgtaaaatgaagattaaggacttctttgttggtgggtttttttaagcaactgctggtggttggttccagactccctttttgttaagctgtcacagatgtctttgctgtatgtctttgtgcccttgtagttttagtgggttggatgtatcgagaacttatttacctgaaacaaaatgcatctcctgtttctctttaaaaaaaaaa

SEQ ID NO: 10539 - DNA, 1061 bp, Triticum aestivum
  unsure (1)..(1061): unsure at all n locations
  Clone ID: PAT_TA_10539
ttcggcacgaggctggggccggggccaaggnaggaggggctggagatcgcaaagctcgggatctcgtccgagatcgtcgacaagctctccgccaagggcatcaccaagctgttccccatccagagagctgtccttgagccagcaatgcaaggcaaggatatggttggccgtgccaaaacggggacagggaaaactttggcattcggaatccccataatggatgcaattattcgccataacgcagctaacaaacctggaatacatcccctggcgatatgtttggcaccaacacgggaacttgcaaaacaagttgagaaagaatttgttgattcttcccggctggagacactctgtgtatatggaggcactccaattcagcaacaaatgagagttcttagccagggcgttgatgtagttgttgggacacctggacgggtaattgatctgctaaatagacgtgctctgaatttgtcaagtgtccagtttgttgttctcgatgaggcagaccagatgctgtcagtgggttttgaggggccgcccgggcgcgtataaaaaaaagcttgtacaaaagtcaaaccttgatgttctccgcaacaatgccaccctggatacgcaagctgatgcagaaatacctcaaagatcctgtcatagtcgatcttgtgggtgaagatgaccagaagctagcagaagggattagtctgttgtctattgctacagagaatcatgcaaaacctgctgtccttggacaattgattcaggaccatgctaaaggtggcaagtgcattgtatttacgcaaacaaaaagggatgctgatcggttgtcatacactatgggtcgaagtgtccagtgtcaggctcttcatggagatattacacaacaacaaagagagaggacacttcaaggatttcgtgaagggcgctttaatactttgattgccactgatgttgctgctcgtggtttggatattccaaatgttgatctggtgatacactatgaattgccaaacaattcagagatattcgttcacaggtctggccgtacctcggccgcgaccacgcta

SEQ ID NO: 10540 - DNA, 940 bp, Triticum aestivum
  Clone ID: PAT_TA_10540
gcacgagggccacgcaacaggacgcggcctcgtgctccggcgcggccggcgccggtggatttagcggcggcggcttgcgtccggtagtgcaggtagcgccgccagctttcgccgcggagacgatggcgccggcgctcatgaggctggcgctggcgctggcggtggcggtggtcgggtgctgcgccgcccggcagcccggcggccgcgtcgacctgtggccaatgcccgcgtccgtgagccgcggcgccaggacgctctacgtcgccagggacctcaagctgtcgacggccgggagcgggtacagggacgggaaggccatcctggccgacgccttcaggaggatggtggccgtcatccagctcgaccacgccatcaacggcagctaccacggcctgcccgtgctcgccggcgtcaatgtggccgtccgttccccggacgacgagctcaagttcggggtggatgaatcgtacaagctgaccgtgcctgcaaccgggaatccgatatatgcccgaattgaggcccaaacagtgttcggagcgcttcatgctttagagacactcagtcaattgtgttacttcgattttgttttgagtgtaactggactacattgggctccttggactatcgtggacaagcccagatttccttatcgtgggcttcttattggataccgcaaggcattatcttcctgtcccagtaatcaaaagtgtaatccgattcaaatggtctacagtaagttgaatgtccttcattgggcacatccgtgggatgagcagtcatttcctccttgaaataccttcatacccaaaattatcaaatggtgcatacccttattcaagaaaaatatacaatcaatggatgcaaccgacattgtacaatatgctgaaaaaaggaggtgtaaatgccttggctgagattgatgttcctggccatgctggct

SEQ ID NO: 10541 - DNA, 1182 bp, Triticum aestivum
  Clone ID: PAT_TA_10541
atcggctccggggctgggccgagcgggacccacaaagtcacctgccgctaggcttggggagggtggtggggggatgctgctgcggaaaggggtcgtctagcgggcctggctgtggacaagcccgcagcgagggccgggtggggggcggtgcaaatgcgggggggagcggcgttggtggtgggacagctgaaagggtcgcggaagggcaaaggtggcggccttggtgtagggctagatgggggtccacgcagtggggtaggacctggtcccggggctggtggtgggcgaaacgactgcattgccccttggggggcaggataggagatgggtctcggggtggagattggtttcctgtattgcgagaggcatgacggggtgaaggacagcgcccgtggactatgattggcgaagcggggcagaggtgggcggaactaaatgcctttttgtggattcaaatttaactactacaactgttgcggaagatgtgcgtggctaggcaaatggagaatgttgtgaatcagtggctcctgcgcaggcttttcttggacaagcgtctaactgctctaatgctggaggcaggggtaacggtggtggaggcggtatcaacggaaatggaggtggtgccggcgctggcgctggacaggccggcagcgacgacacttctggaggctttgcaaatggaggaggaagcggcaacggtggtggcgcaattggaggtggcgctgaaggtcctagcgttggggttggatctggtgctgggtctggcgccggtcagaccggtagcactggctcttatggcgatggatatgccacgggaatgggcggtggcatgggtggcggcaccggtgagagccagaatggcggaactggcagcggtggaggtagtggatccggatcaggtagtggaggatacaactaaactaccctttattgaacaagcaagaacgggaccttcacatgtattttaatttccatcattttactagtatttcaatcaaaggacatgtggcatgcactaaggggacaaaatagcatttcgtgaattagcatttaagtcctacaactgttcaggcgggcttgtgccaatagacgtattaataataatgtgaaggagtacctcctttgtaattttctctatttcaatagtcaaattgattgattccgccttccaaaaaaaaaaaa

SEQ ID NO: 10542 - DNA, 1090 bp, Triticum aestivum
  unsure (1)..(1090): unsure at all n locations
  Clone ID: PAT_TA_10542
attcggcacgagggtttgagcgagcagagtatatcgcgggttgacggcattaagcaaaaatgggagccgtgcatggtgtgtgctacggaatggtcggcgacaacctgcccccgcggagcgacgtcgtgcaactgtacaagtcccggaatatccacgccatgcgcatctacaacccggaccaggaggctcttgcagccctccgcggaagtggcatctccctcctccgccctggccgtcggcccggccggccccatcccctcccccgccacccggaacgtgcaccatgctgggtccggagcaacgtccaggcctactacccggacgtcctcatccggtacatcgccgttggcaacgaggtccccgccggcgacacgggcgtcatcctccccgccatgcagaacgtgcacaatgccctggcgtccgccaacctctccagcagcatcaaggtgtcaagcggcggtgaggttcgacgtgatcaccaactccttcccgccctccagcggcgtgttcagggacccttctcgcggcgcgccggtcgggcgcttccgggaccgcaccagcgccccctgcctctccgacgcgatggtcgactccatctacgccgcgctggagaaggccggcacgccgaacgtcagagtggtggtgtcggagagcgggtggccgtcggcgggtgggttcggggcatcggtggacaacgcgcggagctacaaccagggcctcattgaccacatccgcaacggcacgccgaaacggtcaggggcaatcgagacgtacatattcgccatgttcaacgagaacaagaagccaggggatgaggtcgagaggaacttcgggctcttcttccccaacaagcaacctgtctacccgaccaccttccccaattaataagccgaaagtcaacgtctatgtacgtagctggcctgtcatgcatccatgcgttgccacttgttgaataaaaatagatgcgtgcttgtgacaatgtagcctatgaacgaatcttccttgagaataaatttattttttatttttaaaaaaggaaaataacaaaacactcgtgcatgctttgccagtnaaataaaaatagnatgtg

SEQ ID NO: 10543 - DNA, 1055 bp, Triticum aestivum
  Clone ID: PAT_TA_10543
gcgctgctccgtcagcacctcggcgacaccaagctggacggggctctgacccatgtggtcatcccggcattcgatatcgcgtacctgcaacccaccatcttctccagcttccagttggagaaccagcccgccaagaacgcgctcctgtcggacatcgccatcggcacctccgccgcacctaccttcttcccggcgcactacttcgagaccaacgatggcaagggcggcacgagggccttcaacctcatcgacggcgccgtggccgccaacaaccctactctattggcgatgaaccaggtggcggagcacatggtcctcgccgggcagcagccggcgggcaagtcatacatagtcatctccatcggctgtgggacatcatcgctcccaaaactcaagtacagcgccaaggatgccgccaagtggggcgtcttgagctggctcatcaaggacggctccgtccccatcctcgacatgttcaacgccggcagcgccgacatggtcgacttccacctctccgtcctctccgccgtcctcggctcctcccaccagtacctgcgcatccagtatgataaactgagcgggagcgccggctcgatcgacgactgctccaaggccaacttggataagttggtgaagattggtgaagagctgctcagcgagaaggtgtccggggtggacctggagaccggccggaatgtggaggtgcccggcgggggcaccaacgcggaggagctagccaagtatgcaaggcagctctccgacgagcggcgcagacgccgcaacaattaatatctgcctgctcgaaccaaactagcaattgcatgctagttaatgtgtgtgtttaagttcacttttacgttcagtttgggagttcaatctatttgatttatgtcgtcgtttgtaaattctatggtgctgttgtaatagtcttgtgcaaaaatcattggcacaaataatatctattatgatattaatatgtggtttatgtgacgtggaaatgatatcatgttaactatggtgctgttgtaatagatttgttttcactcgtcccctat

SEQ ID NO: 10544 - DNA, 1489 bp, Triticum aestivum
  unsure (1)..(1489): unsure at all n locations
  Clone ID: PAT_TA_10544
atggcgtcgtcccgtcgggttcttcttgtggcgctgctagtgtcaatggcagcaggtgttgcaatgggcaggccggtgagaagcgacttgggtctgggtttaggtggtgggctaggcatagggcttgatcttgggctcggtggatcgggttcgggccaggggtcgggttacagtgcttggtcgggtcagaacggtggctctcacaccgcgtccggtcgtgggtcgggcacgggctccggttacgggtatggctcgggctctgctaatgggggctcagctttcggttgcggttcgggtacgtcgtcttgctcgggttcgggttnttggctctggctccgtaggcttggacacatcgataaatgtcggtgttggtgtcagcgtcggctcgaatggtggggcgaacggtggtccggactgtaacacgggtaccgggtcgaactatggttccggagcgggcttgggttcgggctctgggtccgggtccgggtcaggtggaggttcatattcctcacgtgggcgtgagtcatctggtattgggtcgggttctggtgtatcgtccggggttggcggcgggtcgaatgtcgggccaagtggtgggtgcttatcttgtggttccggcactggtggtgttgttggtggctcctcgtcgaattcaaattcgaattcgggcactggttcaggctccaactcgtatggtgggtcgaatgccggttcttactcgaatactgcagctgggtccggctcaagcgtaggctcgggatatgattcctctggctcaggttcaggttcaggttcatcttctgggtcaggtgcggcttcatttggtggatcacgtgtcggtttcggactccgactctggctctacgtcgggtgcaaactcagggtcgaattctggtgcaatcggtgcatcaggtagtggatcaaactccatgtcaagtgcaagctcgggtgcgttcggtgcatcaggcggtggatcaaactccatgtcgggttcggggtcaagctctaactccggctctatgtcgggtgcaaactcggatgctggttcgagctctggtgcgttcggtgcatccggtagtggatcaaactccatgtctagttcaggttccggctcaagctcagcatccgactcgagctcagggtctactggattcggttccagcacgggcgccggttctagctcgagcgcctggtccggcgccggctccggctcgaaccccggctcattctccggagcaggatcctccagctggtccagctcgacgtccggctcaacctcgggcgcagggttcggtcccgggggacggccggggttcggcgtgggcggaggaggaacaggctacggcgcgggttacgggtccggtggcgggtctggctggggcaagcaccactgaaaactgatcctcgtcgagtgaacgagtgatcgttcacgtgcactttttaaggccttcatcacgcgtgatatttttcgtttgtttcggttgggtgg

SEQ ID NO: 10545 - DNA, 601 bp, Triticum aestivum
  unsure (1)..(601): unsure at all n locations
  Clone ID: PAT_TA_10545
gggtgcgatgacggttgcctcgacaccctctccacctcccttggagcctgcatgtgtggagagtggtggtccaggaacgtctggcaggtgctcgcttgagccctttggaggtgtggttcctatggctgatgaaattgttgtggccggagtgttggtgcctaaccccggggtccttttagccaccaagatttgtgaattcctcgccaatttggactctgaaaattctgggaagacgattggatgcctcttggaggaaaaatctctgagggagaagcacaagaagggtggctctaactctagatccggcgccctcaaagggaaaccttgcagaagcaaaagcaagaaggatgacactacacgggaggcgcaaatgactccatgatggatggttctcggctttctgagttgcaggtgtgggcttggtcgtgtgtggtttttgttgatgtgtcttcgtcgagttgcagcgagttgattgattttcttttcttttgcgatactgagacccatatgttgcgggttgcagtagtagtgtgttgggtgcttccgtccagggctcctcggtttgggagagttcacatgggatcgggtcggctttnagcag

SEQ ID NO: 10546 - DNA, 791 bp, Triticum aestivum
  unsure (1)..(791): unsure at all n locations
  Clone ID: PAT_TA_10546
gggcgtgcactccggnngagcacggtcatgagccgcttctaagcatggacgagatcatagacgagtgtaagaccttcttcttcgctggacacgacactagctcacacatgctttcatggaccatgttgttgttgagcacacatccagaatgggagcagaagctcagggaggaggtggtgagagagtgcggcaatgaggttcccaccggtgacgtgctcaacaaactgaagctagtcaacatgttccttctagaaactcttaggttatactctcctttgtcgaccattcagagaaaggcaggtttggatcttgaggtcggtggcatcacagtgcccaaaggcacggtcctgaccatccccattgcgtcgatacaccgtgacaaggaggtatggggagaggatgcccatgagttcaatcctctcaggtttgaaaacggagtgacacgggcagcaaatcatcctaatgcattcttgtctttctccgatgggccaaggtcgtgcattgggcagaactttgcgatgatcgaggccaagattgtgatcgtcatgattcttcagaggttctccttcttcctatcccctaagtatgtccatgcccccatggacgtgatcacactacgatcaaagtttggtcttcccatggttctcaagagcctagagatgtagaggccgtgtattgtgttgagtataacacaagtttctgtatttgtttgtctagggtatagtttatgttgtatattagatatatttgtgtaaccgttgtcagatctgttgggctcaaaatcccccanc

SEQ ID NO: 10547 - DNA, 2003 bp, Triticum aestivum
  Clone ID: PAT_TA_10547
gttgactgacggggagcagactccagattcttcatcaagcaacaaacattcaagcctcattaaaccagacactgcactttcaaataacatgacacctccacctggtgttcggttgcaccacagagctgtggtagtggctgcggaaactggaggtgccttaggtggcatggtcagacagctttcgattgaccagtttgaaaacgaaggaagaagggtcagctatggcacacctgagaatgcaactgctgcaaggaagttgcttgaccgccagatgtccattaatagtattcctaaaaaggtgattgcatctttcggcacgaggcgcggctggaagcctcccgtgcgaaggcagttcttcttggactgcaatgagattgcagatctgtgtgatagtgctgagagaatattttcaagtgaaccaagtgttttgcaacttaaagctcccattaaaatatttggtgatttacatggtcaatttggtgaccttatgcgattgtttgatgagtatggttctccttcaacggctggagacatcgcgtacattgattatcttttcttgggtgattatgtggatcgtgggcagcacagtttagaaactatgtcccttcttcttgctttgaaggttgaatatccgcaaaacgtacatttaattcgtggaaatcatgaggccgctgacattaacgctttatttggcttccgaatagagtgtatagagcgaatgggcgaaagagatggcatctggacatggcatcgtatgaataggctatttaactggcttcctttggctgcactcatagaaaagaaaattatctgtatgcatggtggcatcggtcgctcaatcaaccatgtagaacagatcgagaatcttcaaagaccaattaccatggaagcaggctcggttgtcctcatggatcttctatggtctgatccaacagaaaatgacagcgttgaaggattaagaccaaatgctcgggggcctggtcttgttacatttgggcctgatcgtgttatggagttctgtaacaacaacgaccttcaattaattgtacgagcacatgagtgcgtgatggatggctttgagcgctttgctcaaggccacctgatcactcttttctcagcaacaaattatggcggtactgcaaacaatgctggtgcaatcttagttttgggtagagatcttgtagttgttccaaaactaattcatcctttgcctcctgcaatcacatcacctgagacctcaccagatcagatcgaagatacatggatgcaggagctgaatgcaaacaggccagcaactccaaccaggggccgtccccaagcagcggcaaatgatcgaggtgctcttgcctggatatagtagcttcatcagacattggttgatatgatccatctgaagtctcactcagcggaatcttgccccttctctgcacaagaaaatgatttatgtttgagagactggttttagcccacagccatgccaaaatagaatcatctacaagaaagtggaagttactacaaagatgaggaatataacttcatctaggtcagcgctaattacgagctctccaagctgtttccctagcatgagaagtatggcatatcaactcagaggttctctgaagagccgctgaggcttcacttgtatatacccagcttgccggtggatataatggggttgtatgtgttttttttgcttccaattggaatggcaaaaggaaatagtgttattgtactaggtattctttctgttcccttttgggggtgggggttctagggttttgattttgcaaaggtgttgttgagttgccacagggactggatcgtggtctagtcgtgtataatagctctgcctgctacttttgtccggcatgcccactgtaatttcagcctgccgctgatgtgtacaatttttgtctttaaagttttggccgttgagcagaggtcgtggttttttttcaaaaaaaaaaaaaaaaaaaaaaaaagtcgacgcggccgcgaattcg

SEQ ID NO: 10548 - DNA, 744 bp, Triticum aestivum
  unsure (1)..(744): unsure at all n locations
  Clone ID: PAT_TA_10548
gtgccaaggcaccttcgtgctcgtctacaccgtcttctccgccactgattccaagcgcaacgctcgtgactcccacgtcccggtgttggcgcctctgccgatcgggttcgcggtgttcatggtgcacctggccaccatcccgatcaccgggacggggatcaacccggcgaggagtctcggcgccgccgtcatctacaacggcgacaaagcctggagcgatcagtggatcttctgggtggggccgttcatcggcgcggcgatcgcagcgctctaccaccacgaccatcctccgcgccagcgccaggggctatggctccttccgtagcaacgcctagctagctcgcccacccatccgaaccaaaattggcatctttctccttaactttttcagtccactgtgaactctgcagtgtgcccggagcaacgaaagtgaagtgtccttgtgtgtttgtgcgtccgattgaagcattgtaacttggctgtgtactttttgggtcaaaggtaacaatcaataattcagatgggagaaccaagtgatgagaaagaaaatcacttgttgattgatttttttggaaaagtcaccccttttcgctttaaggcaaacaaccacctcccttctttgttcgctatgaaaagaccccttcccctggccggccggggcccctctcccaattgaccgtncaccccccttcggctcaattcgtcccaacaanggcctggnctttttncccccantnggggntt

SEQ ID NO: 10549 - DNA, 771 bp, Triticum aestivum
  Clone ID: PAT_TA_10549
tcgatacgcatgggctaatgagcatccatatgcctgcttattataattctatcatcagaggtgtctccacagttatggtctcctactctagttggaatggggagaaaatgcatgcaaaccatttccttatcaccgattttctcaagaacaagctcaaatttaggggttttgtgattacagactatgaaggcatcgatcagatcacctctcctccgggcgtaaactattcttattcagttgaggctggaattggtgccggtattgacatggtgatggttccttttgcctacacagaattcatcgatgatctgacgtaccaagttaagaacaacattatccccatgagcagaatcgacgatgctgtctacagaattcttcgggtcaagttcaccatgggtctctttggcaacccttcccccgatccgagccgcgccggtgaacttggggcgcatgaacgccgcgaagttgcccgtgaagctgtcaggaaatccctggtgttgctgaagaacggaaaatctgcctccactccgttgctgcctctcccgaagaaggccggtaagatcctcgtcgccggcagccacgccgacaacctgggcaaccaatgtggggggtggacgatcacatggcaaggagagcctggcaataacaacactgcaggcacgacgatcctctcggcgatcaagtccacggtcgaccccggcacgaaggtggtctacgccgaggacccggacagcagcgccgtggatgccggcgagtacgactacaccggct

SEQ ID NO: 10550 - DNA, 746 bp, Triticum aestivum
  unsure (1)..(746): unsure at all n locations
  Clone ID: PAT_TA_10550
ggccggttctcctttcctctcctccttcgactccctccgccgccgccgccgccgccgacacgtacgggccagggtccaacccccgaagccagggctagccgaggcctgtctgagcaacggttttccgcactgctgcttatccgctgacgaagaactcccaccagccccaaatcccagcggaagatgcaggccaagaagctgacgctcctgcagacggtggctgccgccggagtcttctcagccgtctccttctggtacggcttcatgtttgggagggagtctgcgcggcgcgagcttggcggcatcatcgacgaccttcgcagcggctccacggccacctctgccgcgccctcccccgactcccacgctcaccccaaaccatagtgcgatcctgctctaaggaggtgggtattagaagagttgccaaacagttctggtaaaaaagaaacattttcagatgaagtctaagcaattagtagacctatgtttagcaggtttccttttgtgcttttcttacgcaaacaaattatgttacagtgtgatttggtcatcaattcttccactgtataacaatggtgtacattcgctctcctggcgcacctaagctggaaagtggcagtggataatccgaaatatccgatatccgtatgcgggaaaatgactatccgtatctgaaatatctgcacccgaattaaaatgtaaatgaaggtatccggatcattttattacaaatacnaanacaaata

SEQ ID NO: 10551 - DNA, 942 bp, Triticum aestivum
  Clone ID: PAT_TA_10551
ccacgcgtccgattcatgtgacctgaccgccgttaacacattctctcctctcttctctctgagtctgaccgcccccttcccacaagcacagccgcattggtggcgcgattgcggtcgggatcgccgccggccatggccgacccgtacggcgacggccgggcgctgaggaaccatcagccgccggcgcagcagcagcagcagcagcggcccaggctgaagccggcgctggagatggaggacctcatcagcctgctccacggctccgatcccgtccgcatcgagctcacccgcctcgagaacgacctccactacaaggagaaggagctcggcgacgcgcaggcggagatcaaggccctgcgcctctccgagcgggcgcgcgagaaggccgtcgaggatcttaccgaagaactggcaaaggtggatgggaagctcaagctcacagagtctctcctggaaagcaagaaccttgaagccaagaagatcaacgacgagaagaaagcggcgcttgctgcccagtttgcagccgaggctacgctgcggagggttcatgcagcgcacaaggacgatgacatgccccccatcgaggccatccttgcgccgctggaggccgagctgaaactagcccgtcaagagattgcaaaactacaagatgacaacagggcattggaccgtcttacaaaatccaaggaagctgctctgctggaagcagagaggacagttcagatagcattagcgaaagcttccttggtggatgatttacaaaacaaaaaccaagaattgatgaaacagatcgagatatgtcaggaagagaacaaaatcttggacagaatgcaccgccagaaggttgctgaggtcgaaaagcttactcagactgtcagagagctagaagaagctgttcttgctggtggtgccgccgcaaatgctgtgagggactatcagcgg

SEQ ID NO: 10552 - DNA, 908 bp, Triticum aestivum
  Clone ID: PAT_TA_10552
ccccgggtgccgtgccatggggagcgggcaccgccggcgtccgctgggggacactcctcgctctggctctacatcgcagctcatgcaggtgcagctgcgtagctgtttcgtacatacagtctggagtacggtttgctgaaacaacaataaggccggccacgaagcgtatgatggtacagattatgacacctgttgtactatcgctgtgtacattattactgaacaaacattccacggattaaacgatcaacatcgggtcatggccgggtgaggcccccctggatccaaggaacttccggaaaactatcagcagaatccttggcgtgcaatactccattcccgactacgtcagggtgtcctccgactgcagacgcctcctgtcccaaatattcactgccgatccttcaaagaggatcacgatcgctgagatcaagaagctgccgtggtacctgaagagcctgcccaaggagatcgcggagagggacagggccaacttcaaggagcccgagacggagacggggaccgcggcggcggcggcgcagcccgtggaggagatcatgcggatcatccaggaggccaaggcccccggcgaaatgtccaagtcgtcggccgacgcggcgctgctcgccgagctggccgagctgcagagtgacgacgaggaggaggggccgggagccgagggggagacctactgactggactctgcatcgcagttcatacggtctgtctggagtacggtttgctgaaacaataataaggccacgaagcgtatgatacagattatgacacctgttctactatcgctgtgtacattattactgaacaacattgcaccgattttttaacttccaagaataaaagatggtggggatatacaaaaaaaaaaaaaaaaaaaaaaaaaaaaaaaa

SEQ ID NO: 10553 - DNA, 498 bp, Triticum aestivum
  Clone ID: PAT_TA_10553
gagaacatcagcagcgtggaggtggaggcggcgctgtacggccacccggcggtgcaggaggcggcggtggtcgccatgccgcacccacactggggcgagacgccgtgcgccttcgtcgcgctgaagaaggagttcgactccggcgccggcgaggtgagcgaggaggagctggtggccttctgccggagtaagatagcgcacttcatggtgccgaggaaggtggtgttcgtccacgagctgcccaagaacgccacgggcaaggtgcagaagctcgcgctgcgcgagagggcgcgcgggctcaggcccagagattccgacaagaagaagcccgaccccacccggcccgccacgatgaccgcattgtccagactttgacttcttggctgctgacgtggcctgaagtaacagcgctcggcctcccgtgaataagtaaactgaagataatatgttggttctctttttttagcaaatatgttggttatttattgaaaaaaaaaa

SEQ ID NO: 10554 - DNA, 1443 bp, Triticum aestivum
  Clone ID: PAT_TA_10554
gcggccgcccctgcacgtgaggcggtcacgagcgaggcgtcgttttcgacgcatgcggctcggcactcctatcggctccggtcttatcctctccgccgccaggaccatgtcttcgccgagggggttatcccgcagtgcgacctgggggtctctgccccccatccacccgatgcttatcatcgcctgcacgcccgcggcggccccagagtacaactattcactagctccttctgggaggtaccaactccaggtgtcgagccgcgggacggtctgtgatctcaccccgacacagcgccagaccgccgggagggtggcttggactctgaccaaaggactgaccaggtcggtagacggtaaacctgctacctaccagtggaagaaaccaagaccatgaagtcgattgtaccacacaatgcttccaatgtaataatagaaagcgatcggaaacttaagccaaaggagccagatggactgctggaagttctcaaagaccaatgcctctacaggcatggaggttggtggtcctatgatttctgctattatggaaaaatacgacaggttcatgtaagagaatgagaaggttatccaagactatgttctaggtgaaatatgaccctgatgcaaccgatgcttaccaatgacaatcacacctccgatctctgctgttgaggatcatgtcgcaagatacttctaagaggtatcatgcccatgtgtacacaaatgggactgtgtgtgatctcacagatataccgcggtacacagaggttaggtttgtttgttctgagcccactgtactgatcagttcgataaaggagatatcttcctgcaagtatgttttaactgtccaaagcccaatgctctgcaagaacccgttgtttcagcaggaaaaacgcaccttcttcatccactgcaatgagtcgcttcccgaagcagaagctgagcccgccgaggacgacgactctctcccaaaagaagctcagatgtccatcgttccaaaccccgacgaattgcataactacgcagcttacgctacctgattgcccgccaatcacggtgcccccagctgatgaaagataccgttattttggaggttcaacagcaagttggcaacatagtataactatcccctggcttggttctgtctgacgccaactagtggttacagggtgctctttgagcagatatccattaccgaaacaggttgagattgccttagaggaagattaagggcaaaccaagagtgtcctgctgtactgtagtggtatataatttagtaaagggggtatttgagattcagtggcaggctttagacacatcaccaacaattttcctcttgaaatgttcataaaaacagtgcagtgatcttgagaggttgtgcttgctaaaaaaaaaaaaaaaaaactcacctgcccgggcggccgctcgaaatcacttagtgaattc

SEQ ID NO: 10555 - DNA, 829 bp, Triticum aestivum
  Clone ID: PAT_TA_10555
gagggtctcttgctctctctctttgccttcttgctcggcctcctcctcgcagcagcagcagcctctcagcttctctcgttgcattattcgacggacgccgactgctgaggagatcctccgcgcgagggagaaatgtctgcgaacgagggagacctgacgatgagggtgatcgccatgggcggcgatgccgccgcggagaggagggctgccgaggagaagctctgcgagtacaccctcgacggctccgtggacatcaaggggcggccggcggtgaagggcaagtccggaggatggctcgccggaggccttattctcgggaaccagggcctgccgccgttcgcctgccgcggcgcggccgggatcccccccctcctcctgccgagggtggcgccgcagcgccgccgccccccgcccgacaacctggccgagcggaccggcaccgcctgcttggtctccctcgccggcgccctccgcaccgtcccccgctggggcccctacgagtcctgcgccggctcccacgcctggtgcgtccgcgggcccggcctgctgtcgcgcccctcgcccccatacctcctcgggcccgccggccccggcgcggagctctccccccgcgcctcgcaccccccctccggcgcccggatctgcggcttcgcgctctacatgatcgccttcggcaacggcggctaccagcccaacatcgccacctttggggccgaccagttcgacgaggaggaccccgccgaggcgcactccaaggtctccttcttcagctacttctacctggcgctcaacctcggctcgctcttctccaacaccttcctcagctacc

SEQ ID NO: 10556 - DNA, 645 bp, Triticum aestivum
  unsure (1)..(645): unsure at all n locations
  Clone ID: PAT_TA_10556
tggggtgctactacggggtcggcatcccggtcgggtacatgatcgccttcccgctgcgccgcgggattcaggggatgtggggcggcatgctcaccggggtgggcctgcagacggtgatcctgatcgcgatcaccatgcgcaccaactggaacaaggaggcaagcgaggcgagctccaggatacggcagtggggtggtggcggtggtgcatcgtccaggatcccggacagcttctagcgcctctgcctgtttcttggtggccaaccgaattatttaaatcatgtgcgtgttaggcgagctataaccaaaactggtcccgtgggcagtccctcttgtcccgtttgtgttttcttgtcgacaacacgcaacaccgcaaggtccttgcgccgtgttatgaatgaagacggaaaaggaaaaggttccaggaaaaaaaaaaaaaaaaaaatgcctgactgcctggtttgcttatagtctggtgtggtttggtttggccttctccttttctttttggaagctccatcagtgtggtttgcaatgagtttgttctgaccatgtagtacgtcgtgtgacagtgtgcccagctgcttctggctcgtccgagcttgacggttgagaaattccaagactacgcggcgcnggntcgcca

SEQ ID NO: 10557 - DNA, 728 bp, Triticum aestivum
  Clone ID: PAT_TA_10557
tcggcacgaggcgatggagtactcgccaaagctagcggcggcactgctcttagctctcgcgtccgccatgatcgtcaccgcccagaacggggccgatgacatgctgaacgcccacaatgaagtgcgcgccgccgtcggtgtggggccagtgacgtgggaccccatagtggcggcgtacgcgcagtcgtacgcggagaagcgccgcgccgactgccagctactactctctccggaggtgcgcccatacggagagaacctttttcgggccgctggggccgaatggaatgcggtggacgcagtgatttattgggcgtccgggaagcagtactacgaccacgccaccaacacctgctccgcacctacgggtgagtcgtgcatgggatacctacagttggtgtggagggacaccaagaccatcggctgcggcgctgtcctctgtgacggcaacgctggcgtgtttgtcatctgcagctacagcccgccccccgtgctcgggcagattccatactaggctacgtaccaagtatatatgcatgcggctatgcatgcatgcacgtagcaccatgttgcttaaataagtaagggatactcctagggctgggcactaattctcggtcgattgatgtcaccgatatgtgtgtgtgtgtgtgtgtgtggccagaatccctcctcccttcactcctgtatcgttccgggctttgttgttattgtatttgtcccgcaagttg

SEQ ID NO: 10558 - DNA, 1242 bp, Triticum aestivum
  Clone ID: PAT_TA_10558
cccacgcgtccagggatcgtcttctccctcttctctccccctgtcctccacctgcgaacccggcggcgtcatctgctaaccctcgccaggacggcggcgctccgtgccacttctcgacgacttttttggaatcaggcaaagatgacgagcaagcaggagccctggacacgactttcccacagtaagaagttaccaggatgggtagcgtacaatccaaggaccatgaggcctccaccattgagcggcgacaccaagcaaatgaagattctatcctggaatgtcaatgggctgagaaatattgtacagtcaggaggtttctcttctgcattggctcagagggagaattttgatgtgttgtgtcttcaagagacacatttgaaggagggtgatgttaaagatttcatgaacctgataccagggtatgagtataattattggtcatgcagtgtcgcgaggcttgactattcagggactggagtaatttcacgggtaaaaccaatctctgtccaatatggaattggcatagctgaacatgatcaggagggcagggttattactttggagtttgagaacttttacttggtgaatgcttatgtcccaaattctggccgtggtttacgtagactggtttacagggttgatagctgggatccatcttttgccgactttgtagaaaaactggaaagtttcaagccagtaattgtttgtggtgatctcaactgtgctcgtcagagtattgacattcacaatcctccagccaaaactgaagatgcaggtttcaccgaagaagagagggaatcattccagataaactttgatatgagaggcttcgttgataccttcagaaagcagcatcccaaggctgtgggttacaccttctggggtgaaaatcagcggcgtaacaacaaaggttggcggttggattactttcttgcgtcaggatccatcatcgacagggttcatgattcgtacatcctcccggacgtgacatccagtgaccacagtccaattggccttgtgctgaagctctaggcaaccctcagttgttgctgggggaatgcttcgtcaggctgaaacgtttgcatagtcagtttttcgtggattttgtacttaaaagcgatctatctagagtaatctgtcaatgttctgcggagatcttgcgtatctgttatcttaccatgtcactagaatacatgtgctcattaaacttctgcaatgaatgaatgaattccaaaccggagc

SEQ ID NO: 10559 - DNA, 564 bp, Triticum aestivum
  Clone ID: PAT_TA_10559
tcccactcgcgctcctctccttcgctcttgcagtcgtcgccgcgctcctgtcctcctctgctcgccctgctccccatactcggccccacacccgtctaggcgtctcctcctcctccccaccccattggcggtcggcagtaggagcgcagctcgctgccgcccccttggaagaggtccggctgcctgccccaccaccacccaccagcaggagacccccgccacccctccatcgcgttcatcggaggagcgtcgtcatccattcacacagctgctccgcccgaaggcgtcaccatcgacgggaagactcggtgtcgtcgctgtcatgctcgcgtgcacccgtcaggaggactgcggcccttctctctcgctgctggcgggtgaccggcgcatccaggtcccagagtggccctctccggctctcaactcggggagccgctgctatgagcgccggatgccctcgagatggtcggagttgtagcgcctccaattccggctccatctccacccttacagatggtttacgtcttaactgtctacaacaaaagggataagcagcactgcatc

SEQ ID NO: 10560 - DNA, 1099 bp, Triticum aestivum
  unsure (1)..(1099): unsure at all n locations
  Clone ID: PAT_TA_10560
ctcgtgccgaattcggcacgagccgaagcagaagcctgcccacgttgctcggcgactcggcgctttccctttttcccctcgagcgccggcgccggcgccggcgtgcggccggaaacctccgttgctccccgcttcgacgttttcctattcagcgctgcacggccgcctgccgtgcttcttctggtatggctggcttaggcgacgccgccaaggaatacatcgctggatccgctgcaggcgtcgcccaggtggtcgtcggccaccctttcgacaccgtgaaggtcaaattgcaagctcacaacaccacggctcacggaaaggtctacaagaatgcattccactgcactagtaggatactggttgaggaaggaataagagggttgtataaaaggcgcgtcatcctcatttattgggtatagcacttgaaagctcccttttttttggcacatatgcacaagccaaacaattactacagggaaaatctgaggattgtaagccgcggctaaaggtaattattccttctgctgcctgcagtggagccctgatcagctgcatccttgctccaactgagctgaccaagtgcagaatgcaagttcaagggaaggatgtgatgtatgcgacccagtactccagccctctagattgcgctgtgaaaacactgcagcgtgaaggggttaggggtatatttcgtggtggtttagcaacattgtacagagaggcaattggcaatgctgtcttcttctgcacttatgagtacagccgatattggatgcacaactatatagattctcggcaattttctagcaacagtggcttagttgtggcaaaagatatcgggataggaattatgagtggtggccttagtgggatggctttctggacagctaccctgccaatggatgttgccaaaacgattattcagacagatcataaccctcagtcgagccgaaatccgtttcgggttttaaacatggtctataggagagctggtctggctggatgttatgctggtcttgggccaacactagcaagagcattccctgccaatgcagcagcgattgttgcctgggagtacagtgctaagattnctggtataagg

SEQ ID NO: 10561 - DNA, 586 bp, Triticum aestivum
  unsure (1)..(586): unsure at all n locations
  Clone ID: PAT_TA_10561
gaattcttgtnaatcgtaaggcnggcccccaaaaaacggagttgggttggttggnttttcggcttggtttggttgggagttggaatcccggaaaaacaaagggaacgaaaggtgattgggctgcgggcnggggaaccaccgagggaggtaggacagttgggctnaggcgggcgggcaggcaaagttcttcccggatgccccccccctcgggcttttgcagcgcccagggaaaangccacgtcaggtgtgcttccttatccttggagcataactgtccagggatcccaatcattccctttttagcgtctggtcatatggcccctgcctttatcctgggcattttttttttttttaaaagggcccccaaccaaccaatccttttttttcctttttccccacgctacgctgtactccgtagccatttgcttttgacattgccacagtggaatgtgcctctgctgtcgctgttgctcttgttgtaaacgtttgtttgaatctgaccgaaacgacgatggccaatgaccttgctcccgtgaaaaaaaaaaaaaaaaaaaaaaaaaaaaaaaaaaaaaaaaaaagggcggcc

SEQ ID NO: 10562 - DNA, 511 bp, Triticum aestivum
  Clone ID: PAT_TA_10562
gagccccttcacctcagctacctcgccggagaagaagaattactagaagagaagcagatcttgtcatgggcgagcaagctacaaaggttccccaaaagaaggcgaaggcactgtcaagtagtacgcagttgacgaagacagcggcatctaggaggaagtcgctgctgcctcagaagaagcagatgaaacagacgactccgtctaagaaaaattagcctcgaaaaggatgacaacagtcgcgcgttgatcgacgaccccaggccaggatgatgttaagtgtgtttctgttgagtaggtcagtttgtgttacaaataacttcatttgtaaacttgattcgatccgatcactcctgtagaatccgtagcttgtttgtctatagggcagaagcgtgctggttcacggttcggccaaatgaagtccttttttttccttgtgttgttttatgagtcgtgtgcgaggttattgttgggaagttgaataaaaagaaagagttagaaaagaaaaaaaaaa

SEQ ID NO: 10563 - DNA, 1262 bp, Triticum aestivum
  Clone ID: PAT_TA_10563
gaacgacgcaagtgacggagcgcgttcccccgggcacggggagagccccggcaacggtgtcatggccaggcgcagagctccggggtaagggacaggggggacgtgctgctgcagttcgccagcgctcccggtcgcggggacgaacacgactgaccggacatgacgggttgcactttccaaatgtagactgccgtctcaaagagcccctccgatgctaccccgtcgcccctctccttgtaccccgcctatcaaggggtgccacctccatccacggatacgacatccccgccggcgcgcgggtgctaggcagggtctcgtatatgggccacgacccggagttgtggaaagcagcgggaggagttgatgccaggaacgccttctcggttggctacctcgacgtgcaggggcacggttatgagcgccttccattccggggcggggcgtaggatgtgccccggggcatgcacgccggttcaaggtgatccatgtaagccttgggggacttcctggcgcggtccagacgtgcagggagccggacggcgggtagctcagcatgggtgagttcgccgtagagtcgatgccgagggcccaacctacgagttgccttctttggggccgggttcccgggtaagtcctccggggaatcgtctttggttgaaagatgatcccacggatgcctagcgaacttcttagcacttgtttctcgtggtggctcctttgatggcctggagctgatcatgggaggacatcttcgggctgtcctactgccacgcaagttcccgcttggaggctgtcatggagcccaagctcccagctcaactctacgttgaggcatgaatatttgatacatgtgtgctctacgtgtgttgagtaattattactacttctgttgtattattttttatataatctttttcaagtattgtatggtctgcggtgtaactaaagtgatcgagatgtgcaaggaagggtgtaaaaaaatgttgggtaatggctaatttaataagtgaaataatgggattttatcctgccctcgtgtgttgagtaattattactacttgtgatgtttttttttttgttttttttctagtattatatatttgatacatgtgtgccctcgtgtgttgagtaattattattacttgtgttgttatattatgcatcgtagatctgtaaagaaaagtgtaaaagatggtcgacaattgctaatttagcaagtgaaataatggaaattttcctctttaaagacgtctccctcgtgc

SEQ ID NO: 10564 - DNA, 1079 bp, Triticum aestivum
  unsure (1)..(1079): unsure at all n locations
  Clone ID: PAT_TA_10564
gcctagcgatcacgccatgtacatctgctcctcctcctcctcgtcttgctccccttcgccacggccgacgcccaccccgccgcttcctgcagcaacgccacctgcggcggccagagcatcgcctacccgttctggctcgctaactccggccccaactgcggctacccgggcctcggcgtctcctgcaacgacaacgccccgatcctcgacgtccagttccaccagtacagggtcctgcgcatcgactacgccaaccggaccgtctccctcgccgacgtggacgcctggaacacgacctgcccgcggctcagcttcaccctctccgtcgacccccgctcatcgctgcagctcacgccctccaactccaggctcaccctcctctacagctgcaaggccggcgtctcccggccctccgccgtgaaactcgacggctgcccggaacagagcatggcctggtacgtgctccctgatgacgaccgggtcatgggcaaagcgcacgcgtacgggtgcgaggaggcggtgacgacgccggtgctgatgagcccgcatcgtccggcaaacccgtcgctccgtgcggtgctcagcggtggcttcgagatgcgttacgatgatcggtccgagcggtgcggcgcacgcgagcaatccggcggacggtgccgatacgggcgcatcgaggagcacggcgggacgggcttctcatgcgtctgcgacgatggcgctaacaagctccggtgcggggatgcactctccttacgcttgaagaaacaaaatttgtataaaatagcaagcacatcgagggtagttttgatattgtttgcatgtttgttggtctacaagaaatataattctgcagtttcggggagtcgtcttccgttctcctttcatgagcctgttgaggtttccttgagcctcttgacaagtcacaccggatctggctcatctagaggtgatgcagagttaccacgtgacggcggtgatcttctccaatgatattttggcttgtaggcttcgtaaatggataatttggcccctaattnngtttggtgtaaanacaagnattagagggaataatgtttaca

SEQ ID NO: 10565 - DNA, 1076 bp, Triticum aestivum
  unsure (1)..(1076): unsure at all n locations
  Clone ID: PAT_TA_10565
gcacgaggattgattggaatggtaggatgagagtaattatgggagtagcatactgcatgcaatacatgcatgagctcaaccctntgtataacacacccntggcctacagtcaagtgccatattattatccgaggatggagctgcaaagatagccgacatgagtgtttggcaagaagtaatttccaaagaaaagatgcccaagaatgacgacgccagtgagcaccatgagccaatacgtgctgatccagctgggaatgtatgtagttttggtctactcatgctggaaatcatgtcaggaaagcctccagattctgaacacgagggctctcttgcgaacttagctatggagtgcattaaggatgaccggagtatatcctgtttgcttgaccctaccttgacgactcacaaagaaaacgatctagatatcatttgcgagttgattgaggactgcatccagagcgatccgaaaaagagaccaagtatgagagaggtcaccactaaattgcgagaagtgctagcgatttcaccagaggcagcaacgccgaggttatctccgctttggtgggcagagcttgagatactttcagttgaatcctaggaagaaacatgttgatatggtatggttcttgcagcaacactgaggtcctgtgcgtaccgccgccccgtcctcgccatctttgttgcgaagtttctgcttttctggcgatttcggtgtataggcgtggtacctcctcccccgcctcgtaaaatgaaaatttccgggttattctaatttcttctcgagttttctctgtatggtgaatgtacatggtgatggtgtgaaattgtgaatgtagaatgattcaggtcatcctagagtggattgtaatcaggaaatgcgtgattgtgtaatgtaccatggggtttacagaaatattctttattttttttaaaggaagagacagcaattggtatggtgaatggaccatccagtcctctttaaaacaananaaaaaaaaaaaaaaacnaaaaaaaaaaaaantccnaggggggnacaaaaacaaanccccnnggggggnccgggncanaaatccccc

SEQ ID NO: 10566 - DNA, 999 bp, Triticum aestivum
  unsure (1)..(999): unsure at all n locations
  Clone ID: PAT_TA_10566
cgtccgcccacgcgtccgcccacgcgtccgcttggcaccggggcagccagccatggctctccgtcttcaccacctacccctcctcctcctcctcctcctcgtgctatccaccgactccgccacccaccgcgcctccgcctgctccgccccccccgccccccaccccccccccccccctccgcatccaccacccccggctctacgccgccgccgtcgaggcgtcccaccccgagctctacaacgacggccgctacgtcgtccacggcctccacggcttcctgcgcccgctcacgcactcctgcttcgacggcccgcaccaccatcacctcaccggccgctccgccgcatcctccgcggccaccgctgcctccgtgctgcgcatcatgatccgcgacgccatggcgcgactccgcgacgggggctacggcttcgtggcgctggccatgcgcgtcaagttcgccgagctcgacaagttggccaacctgacgctcttcgcgctcgacgacccggccatcttcgtcgggggaggccccgactacgtctcggcggtgcgcttccacatcgtccccaaccaccgcctcacgcgcggagaccgccaccgcctccgcccgcgcccaccaccaccaccaccccgccgggcggcacccggccaccgcccacttccaccccgtccctagcgccgcgccctccatgcaccaaaaccacctccacgcggacacccagtccctgctctccgccgtcgacgtcgaccccgtcctcgccgacgcgcaggccacggacgcgacggaggcccgtcccgctccgctcgtgccgccccaggccgaagcggcatcaccgcctcccacgctcgtcctcccggtgccggatctcgcggaggcgacgccgcagccgcaggcggaggggtccgcgccgacgacgcccggtgcagccacgacaacgacgaccagcacgcctctnccgctccctgccacgggggcgacgaccgcgagcccgcctccg

SEQ ID NO: 10567 - DNA, 719 bp, Triticum aestivum
  Clone ID: PAT_TA_10567
tcggcacgaggccgcgcgaggcatcgattggaatggcgctcgcaagggtttcatcttcttcccgcctcctcctactcccctccaccaccaccacctcctccctgctccattccttactgcgccccttctctacctcctccgtctcggctcgtcgcctctctcacccaagaagcctccccatcgatgccagtctctcccaagcttctcccctccttcctactgcgagggaggagggggaggtggcgggagccccgaggtccacctccaggcggccgtggaagcctacgtgcttgtactacacccagggaagatgcaccatgatggatgatgctttgcatcttgagaagttcaatcataatttgtcggtggacctaccagtgaatgcttcagctgcagataaagtgaagcctcagaaactggattattttttagttcttgatttggagggaaaggttgaaattcttgaattcccagttgtaatgattgacgcccacagcatggagttcatcgattcatttcacagatttgtacgcccaactgcaatgagtgagcaacgaatagaagaatatatagaagggaaatatggaaagtttggagttgaccgtgtatggcatgacactgctgtccctttcgaggaagttcttcgagagtttgaagactggattggaggtcacaaattgtggaaacagaaacaaggagaatccctcaacagtgctgca

SEQ ID NO: 10568 - DNA, 1024 bp, Triticum aestivum
  Clone ID: PAT_TA_10568
tcgcgggccgcgtcgacctctcctccctctctcacacgcacgcacagagaagtgaccatgaggaagtccagctgcggccatgtgatcggagtgcctgtgacctccaaggcgtacgccttagaggaggcgacaaccaggggcgccggggcggccaagaaggacggcgatcgcctcgccgtctcgttgacgcacccgagcccctacgcgtccttcggctacaaacacagtagcaagggtcaggtgatccattgggtgaacaagctgggcagacgggcgcagggcttcagagaccacgtgaccctggggccgaagctgtcggagacggtgaaggggaagctcagcctgggcgcgaggatcctgcaggccggcgggatcgagcgcgtgttccggaaggccttcacggccgagaagggcgagcggctggtgaaggcgctgcagtgctacctctacaccaccggcggccccatcgccggcatgctcttcgtctccaccaagcggatcgccttccgcagcgaccggcccgtcaccgtcacctcccccaggggcgacgtggcgcgcgtctcctacaaggtggtcgtcccgctcaagcggatcgacaaggtgcggcccagcgagaacgtcgaccggccggaggagaagtacatccacgtcgccaccgtcgacggcttcgagttctggttcatgggcttcgtcagctaccagaggtcctgcaagtacatgcagcaggtcatcggcggcgtcgcggagctgcaatgactagccgggcggcgcggtccgccggaggaagacgtacgcgaggcccgccgtttgttccgtcggcacgatgagaagtggagttgtgggctgctgctgctgcgccatcttttgctgtagagcagtagtagtagccctggctggaattgctcgatcttatttcggatcggagcaacttggatccttccgcgtacgatttgggttggcttatgtttttccaagcgattgcttaatttgtactaggatggcaaagaaattaaccgtgctgcgt

SEQ ID NO: 10569 - DNA, 1016 bp, Triticum aestivum
  Clone ID: PAT_TA_10569
cgtgcgcccacgcgttcgcaggcacagggcagggggctctcacttggtccggtgtccttcaccccggcagcgctagctagtacgtgcatgcaagtgcccttccaagcgcgcgcctccaaaccaccctatctccacctccacctccacacccacattaggttggtttcgcgtacacgttccgtgtcactagctgggtagcttcaacgtactccaaagtgcagcggtggtgtgcggagttagcttgaagatgagcaggaacaatggcaaggggccgaagctggacctgaggctgagcttctcgcggtcacgcggcggcggcggcggcggcggcggagggggtccatcggctgcgccgccgggaggcagcaactcgccgaggaggatgtcttcgtcgtcttcttcctcggcatccccgccgagctcgtgcgtgtcgtcggaggggagcccggaggctggcgggggcagtggtggctcggcgatgatcctcgcgggctgcccccggtgcatgatgtacgtgatgctgtcgcgggaggaccccaagtgccccaagtgccacagcactgtgctcctcgacttcaacgacgtcggcgccgaccaccgcaacccagggttcggctccggcaaggtcggcaagggcaagcgcggctgaaccgcccggccgggcttcttcgatctagatgcttagccgtcgtgtcgtcgatcgcctagctgcgatcgaccgtcctctttcgtttctcatcaatcgtgtgcgtgcgtgttcgttggtgttggtgtgtgcgtgcgtgcgagttgggtcaagaagaaaggaattattccgtagacccgtcccttccatggactagctagtgggacgccggggtgcccatggaacgggtctaggtaataatttcatctgttgtgtgagtcgtgactgcgtgcgtttgtagtacggggcagtactggcaaggattaagattttgtctctgaggttttatagaaggcagtaatgcgcttgtctcgccccgtcctttggaaaa

SEQ ID NO: 10570 - DNA, 620 bp, Triticum aestivum
  Clone ID: PAT_TA_10570
caagatggcgactgagaagaaaataatcagtcttactgtcaaggttggtttggtgctgtttgcagtatgcattctcgcgccggtttcgctcatggtgttgctcaggcacgcggttcctctgcagacattgaggttgctgttttcagctggttcagcatctttggtggcttgggaagaagtaaagatgtactctgcaaacaaaggagcgtttctgtgtgagtgtgacatgtcgagcctaagatcagatgtatgcgagctgaagggcgatgtccgggtaatcccctcaaacatcaccatcattgccctcctccacccctctgtctctgagagtcgccggtcatggaggatgaagccgcacgcgaggaagaacgatggccacgcgctcgccagcgtcacagaggtgttggtgtcggtcaccccttcatcacctcacgttccggaatgcaaggccgagagtgccgcccccgcggtggtcttctcagtgggcgcctatgcaggcaacatgttccatgacttcaccgacgtactcatcccgctcttcatcaccgccagccggttccgcagcgacgtgcacctccttgtcagcgacgccccgccgtggtggcttgacaagtaccgaa

SEQ ID NO: 10571 - DNA, 1737 bp, Triticum aestivum
  Clone ID: PAT_TA_10571
ccactgtatttggaatgggcacctgacaatattttatctcctacctcaacaaccatggaagaagacgaaacaaataccgctggtgagaggattattacaaaagctattgtagatcaaacaaaggaaggagttagtgctgaagagattgatcctgatagagtggagtcccgatctgtatttgtcaagaatttgaatttcaagactacagatgaatcgttaaagcagcatttcagtacaaaattgaagaccgggagccttaaaagtgcaacggtgaaaaaacatattaagaaaggcaagaatgtttcaatgggatttggcttcgctgagtttgattcggttgaaactgcaaccagtgtgtgcaaggatctacagggaacggtcttggatgggcatgctctgatcttacaactatgccatgggagaaaggatggtcaaactgcgaagaaaaatgagaaggacaagagctcaaccaaactgcttgtgcgaaatgtagcgtttgaagcaactgaaaaggacctgaggcaattattcagtccatttggccagatcaaaaccctgaggctgcccatgaagtttggaagtcacagaggtttcgcgtttgtcgaattcgtgacgaagcaagaggcacagaacgctcttcaagcccttgcaagcacccatctctatggccgacatctggtgattgagcgagccaaagagggagagaccctcgaagaattgcgagcaagaactgccgctcagtttgtggacgaacagagcggtttccagcggatgtccaagaagaggaaacagactagtctggtggacgaaggctctgttaagttctcaaggatagtagaatgataatctcctggaggtaacaccaggcggcaaatttttgaccatgtagtatatgatagcatcactcatctaagccgagcctcttctaccttctcttgtttctttcgggttgtccaagcatttgtttttatcatgccgtgtcgtgttggtgctggggaaaaggagaatgcagcggctcgtatgtggaaaatggaaaacagtgcgcccaaaaaaggcatttacaagaagtcaaaatgatccagttcgagacacattgatgccacaaaatcagaaaatggcctggtgttctgcttgttcagctctataacaaatctgtaccagcagcagctattcttgtccagcctgcagtgaacatctttatctcaaattttgtacagcaatgtgcagattcatagctgctatgtgcaaaccgtattatgttttccgtatcgagatctatctggcacagttgtctacaaaggcaacaagtaggaaaatgcaagagctcctgcctctgtcctgtcaggtaaagctataagcaacctctttcatgtgcgccacatggtattcaccatttgtttgaattctaccttgaaatcttacagctgcctggctatctatgctgcttccacggcctcctccctcagcggccggttctcgccgctgctgctctggctctccagaggcatgtactgcgacatgatcgccgccacctccgagtccatgtaccgcctgagcctgtacttgtagaaggcgaacccggcgagcccggcgccggccacgcgcgcccgcgcccgccccgccaccagccaccccctttatcactgagcggtcatttaggggccttagctggtgatccgggctgtttccctctcgacgatgaagcttatcccccatcgtctcactggccgaccttga

SEQ ID NO: 10572 - DNA, 628 bp, Triticum aestivum
  Clone ID: PAT_TA_10572
aggaattcggcacgaggcaagttcgtgtcggcgctgccggaagggtacaagacgtgcgtcggggagcgcggggtgcagctgtcgggagggcagcggcagcggatcgccatcgcgcgagcgctggtgaagcaggcggccatcatgctgctggacgaggcgacgagtgccctggacgccgagtcggagcggtgcgtgcaggaggcgctggaccgggccgggtcagggtcagggcgaacgaccatcgtggtggcgcaccggctggccacggtgcggaacgcgcacaccatcgcggtgatcgacgacggcaaggtggtggagcaagggccccccccgcatctgctcaaccatcaccccgacggatgctacgcgcggatgctgcagttccagcgcctcacgccccacacccttgccgtgcccggaccctctgcatccaacgtttgatacatcttcccttccatgcacggttccactttaggatcttcttttcttctaaaaaatttgttgctggcgggaggagggtggtcacgattgacaagccgtatgtgctgccaatgccatgatccgtattcatccacttgtccgcggaccgcataggctcggcccctcatgtgtcggtccacgtgacggt

SEQ ID NO: 10573 - DNA, 668 bp, Triticum aestivum
  Clone ID: PAT_TA_10573
tcagaaggaattactaggactgcttcgcgtccgcaggttcagaacccgtgtctcctctagctcaatcacctagagcagatccacctaaggttttgcgttcgtctacagccatatcagcatcaggactgagtatgctagctggaactacatcaatacctaaaagggctgtgatcaaccgggcaacttcgatgaaggaaggagtgcctacccctgaggcgccaaaggacacttcaagcacagcagcaaccctcaagagacctgtttcgagttcgagccggttcggtttcctgcggggtttcgccagctgagggacaggcgaacgaagatgatatactacatatggcactgccttgctgtggtttgtgccaaaagacagacgacatcccagtaaccttttttttttacttgtaacatttatctatctatccatctagctagatatgcagggcaggtaagttagtagaaaaacatggcagccggcaaagtaaggggaatttgctttgccagacaaatttttgtagaaagcaaaatatgtatggcggagatacgaggggtggtgatatgatggcaagatatgcgttaagtacactgtcattgtacactgtcatttactcgcatggttaattttggtgaagcaaggatgaatgtatacgaggtttctgatctcg

SEQ ID NO: 10574 - DNA, 780 bp, Triticum aestivum
  Clone ID: PAT_TA_10574
attcggcacgaggctgggctgcgtccccgtcgttggccgcaaccccagccagacacccagcggcaaggccgttgtcagctacgccttcaacggcaacaacccgtggatgcctccgcccacggcgccaccggctggcccggcatggaacaacacggctatcagggtggagcagagcagggccagcttcgcgcccccacgcttcgtagagcccatgccggcgagggccgaccgcacgctgctcctcctcaacacccagaaccggatcgatggccacatcaagtggaccatcaatggcgtgtccctcatgttcccggccacgccgtacctcgtggcgatgaagcgcggcatgaaagacgcgtacgagcagcgccccccgcccgacatgtacgaccacatgagccacgacatctccgcgccggcgccgacgaacgggaccgtgggcagcccggtgtaccggctggcgctcggctccgtggtggacgtggtgctgcagaactccaacgcgctcaacaacaagagcgagacgcacccgtggcatctccatgggcacgacttctgggtgctcggccacggcgaaggtaagttcaacccggccgcggacgcctggaggctgctcaacgtgagggacccgatcatgaagaacacggtgccgctgcacccggatgggtggacggcggtgcggttccgggcggacaaccccggggtgtggctgttccactgtcacgtggaggcgcatgtgttcatgggcatgggtgtggtcttcgaggagggcgtcgagag

SEQ ID NO: 10575 - DNA, 1182 bp, Triticum aestivum
  unsure (1)..(1182): unsure at all n locations
  Clone ID: PAT_TA_10575
ccgccccggcgccgccctgggccacgaccgcctggcttcgagctctcggctgggggctccgcgtgtgcagggggttgccccatccggcgtggctccgcgcgagccccccccgtgcgtccgggcgtgggggtcgcggcgggcgcgggggcgggcgcggggcgtcccgggagtgcgggcgcggtgggcggtccggatcccgccggggctcgggacaccgtgagcgctgtcaagggtggtagcattaatggaggaagcggtagtggtggaggcagtggatccggatcgggaggtggcggggacaacttggtggctccgggtcgggcttgcgatcccgcgatcgcaccggctgtgctgtgtgtcgccccgcttctgccccttggcgccgtgggtgtcccggcgcgcacggtaggggtgggcctgggcgccgcgggagaaataaatagcacttcctagattagcctttagctcctactgccggcgaggctggcggtgccagtggcctttctagggctcccgcgccggccccccgtggtggcggttcctgcctctctggccctggcgcctgtgccctcggtggtggtggcggtaacaatggaaatggaggtggtgccggtgctggtgcgggacaggccggcaatgatgacacttctgggggctttgcgaatggaggaggaagcggcaatggtggtggcgcaaccggaggtggcgccgaaggtccaagcgttggagttgggtctggcgttgggtctggcacgggacaaaccggtagtactggctcaaatggcacaggctacgccaccggcatgggtggcggcatgggtggcggcaatggtggtagcactaatggaggaaccggtagcggtggaggaagtggatccggatctggtgggggcggttaccattaaattacacttttcttgagcaagctagaaccgaatctcaacatatatttatatttttatcattttattaagtatttttgcgtgaaaggagacatggcatgcacgaaagggatgatccttggtgtcactaagagaaataaatagcacttcttagattagcctttagctcctactgccgtctagactagcttgcgccaatagacataatagtaatgtgatggagtacctccccggaccattctctccgaaggcccaatcacctacccttaataanaaaaca

SEQ ID NO: 10576 - DNA, 1005 bp, Triticum aestivum
  Clone ID: PAT_TA_10576
ctcctccgctccgtccgtcctctgctgccaagcaaccgccccagctccggcaagcaacccagctcagcccaaagagaaggagcgagatggaggtggagatgcagcttgacgacgacgtcttcttcgcggagctcagcaagcggatttcgctcctcatcaccgacgacgacgaggccgacttcgccgcctcgcagttccccgccgccgtccacctcccaccgggtttctccatgtccatggcgccccatgtgccgtcgatgttggcgccaccggcctacacgctgttccaccacgccgccagctacgggcgccaaccacagcgccggcgacgccgggagaacgtggcagcagcagcaacctcagcagcagcagcagcagtgcggcagcaagggcaccggcgtcttcatcccccggtccacgcccggctccgcgcaccccaagaggaagggcaggaactggagcggctccaaggccgccgcgcacaaggccaaggcccaggcccaggccgacgccggcgtcacagcgggcgcgcctactaaaaggcgtacctgaaaatctgctctaaaaatgcactctaaaaatcaaaaaatggccgactaattaagtagctccagagaggcagtgctgggttctcaaatggggattggattaattaaattaaattaatatgcttaattgtgtactactactactactactgttatatggtaaataagccattgttgctcccagggttagttaaatgtgtaatgtgagccctagggatgcacgcaggggagggaccgggggcacaccacaccgataataagcagttgagcacgtagtgttttagggtactactgtacctcctgcccccacaatggaatggaattgtatgtatagtaaagctggcgcgcatgtggcggtgccgtggctccctcggctgatttttgtaatctctattctattcttttttcttctgtaagattaatgtactgctgctccgttaaagaaaatgcaacgagg

SEQ ID NO: 10577 - DNA, 846 bp, Triticum aestivum
  unsure (1)..(846): unsure at all n locations
  Clone ID: PAT_TA_10577
ggccgcttgtacgtgtatctcttgctagnatctctcttacacgccaacgataatggccgcagcagctgcaggcttagtttgggcgaccttgctcatgtgtgctgcgctcggcgccggggtcgagaatccattctttcctcctggttccgagccagagccggtgaggatatactcccaggagaatgccgcgctgaacgtggccgaacgcgacggcaacgttgtcctcgcgtacggcgactgctcggaccttagacagaaatggttcattgtgacgtccccccacccctccgcaccgtttgagttgccgccgcctttcgtgctgcagaatgcgcagacgtttcaggtcatcatcatcccatcaggcagtggacagaaggtgcgcctgtcgtctgaaccgcctatcaacccactggactggctgtcgtggtcgcgagcagcactcgagcagcgatggacgccggagaagtccacacgtgctgaccacttttaccaactgtcggttaccaagagcgacccagctcttaccctcaacggcctgttgggcaacgtacatgacggaacggaggtcggcatctatcatgcatcaccagattcagggaacgccatatggcagatgacttcatacccactctgcgcccgctgatgagttagaaggccactgcgttgtgcttatgtgtttgctgaagaataaattttacattgttctttcccttattcaatttcctcattcgtcaaatttgcgattgtttgaaaaattgtactacgtttttgttggtnccagtaccagtgtaagcacaactgnagttcgtctataatattattatttaagaaaaaaaaaaaaaaaaa

SEQ ID NO: 10578 - DNA, 430 bp, Triticum aestivum
  Clone ID: PAT_TA_10578
gtcgatgtcgaggtaaaacgaaggaacctacactatcatcaatgctgaagaagaaagttaccgcaaaagataggatttcagggaggcttctaaatggtcgtgctagggacgcaacaataagagaagcttctaatactgaggatatgacctacagggaagcattcccaaatcagtggcagtgaaagcaccctgagtaggtctttcttcataattaacagttttgttttgctgtgctgttgcatgcttgaagtgcttgaagtacgcggggcactgaagctgcttcgaacccgtgcatggaaaatttcagaaaggaaagtcgtagaccatttgtattggcagtcggattgagaatccaaatcagaacaacgcgacagtaaataagcactcgattttgtgaacatgccaagcagtttgtccttgttgcccgacg

SEQ ID NO: 10579 - DNA, 995 bp, Triticum aestivum
  Clone ID: PAT_TA_10579
aacgttcaccattctgtttataaagaagagccagttgagatcctaccatgtcatgcacctctgaagaaggaggtctttgccagagaagggatctcaagatatgcccttttcatgggcccatcatcccacgtgatgcaagaggaaatccaattggcaaaattggtggcagctctgatgcgggaggcgatccgcttgagcaaaaagtagacattcgtgaggcaggaggaaatccaattaacacaaatggaggcattgatagtgaatatacacatgaagcgggtcaggagccctctacttcaatgatgacaagcataaataatgacaccttcgacatggctcgtagtaaagatactccaaatcagttggcgatgcaagcgaataagcacgctcggatgtgaacatgccaagccgtttgtcctggttgccgaccgtccgcacatgatcatccacgcatctctggagctctgcggcaagcatccgatacttcaacgccccactcacaggcagcatatggcaggcgttggataacactgggtcgtcgtggccgacgtcgacctaaaacgaaggaacctacactatcatcaatgctgaagaagaaagttaccgcaaaagataggattgcagggaggcttctaaatggtcatgctagggacgcaacaataagagaagcttctaatactgaggatatgacctacagggaagcattcccaaatcagtggcagtgaaagcaccctgggtaggtctttcttcataattaacagtttcgttttgctgtgctgttgtatggtgaggtgtggctgatattcccttgcacgcttgaagtgcttgaagtacgcgggacgctgaagctgcttccaacctgtgcatggaaaatttcagaaagggaagttgtagaccatttgtactggcagtccgattgagaatccaaatcagaacaacccacagttaacaagcactcgattttgtgaacatgcaagcagtttgtccttgccccg

SEQ ID NO: 10580 - DNA, 727 bp, Triticum aestivum
  unsure (1)..(727): unsure at all n locations
  Clone ID: PAT_TA_10580
cgtccgggctacaagtctctcctccagcgctgccgccgctgctggtgctaggcgtgcctcgtcacgggtctaggccccccgcgcgcccattcccccgcccttttgtcacgcgcaagccgtgcccacttgcgccacatcaaggcttgcacgggcgaaaaaccccatcccatctccggtgccagaaggcgcggccctctgttggtgggtcctgccgcggccatgagccaccggatgatgatgaatccggtgaaggtggagggcgatgggcgggccggcggcggaggcgcgccgaggccgatggacgggctgggcgacgccgggcccacgccgttcctcgccaagacctacgacatggtggacgaccccgccaccgacgccgtcgtctcctggagcgccaccaacaacagcttcgtcgtctgggacccgcacctcttcgccaccgtgctgctgccgaggtacttcaagcacggcaacttctccagcttcgtccgacagctcaacacctatggctttagaaaggtggatcctgacaggtgggaatttgcaaatgagggattttgcgagggcagaggcaccttctcagaaatattaagcgccggaaacctaacatgggttctaagaataacaatctcttngttctacttgagnggggaactttggacatgatgtggagatagatatttgaaaagagacaggcancttttggnggntgaaatngtgaaactaa

SEQ ID NO: 10581 - DNA, 508 bp, Triticum aestivum
  Clone ID: PAT_TA_10581
gaaaacaaacaccacatgccacctcacctcacctaccttgcacaagcgaagcaagaagaaggaggaggaggaggaggaggaggaggaggaggaggaggggaggaggcgtcatggacaagtcaggtccaaaggttccaggtacaacggttccccctaacaggccaacgcaaccgtcaaccaataagccgggggcacaacgaaggaatcttaagaaggggcgtaaccgtaggataaacgtgaggctgactcagaaaaagagatgatggctaagaagaagcagccgcagcctaagaaataagaagtggcctcaaaagtggtgagagcagccgcgttctcatccatgttgtctggcaatgatgaagtcaattgtgtctctgtcttgtacgtcagtttatgttgtgttatctaaattagtaacctcagtatgtaaatcataagtgtgcttgttcacgtggtggccaagtatagtttcttcttacatgtgttgttgagtcgtgcatcatgttgt

SEQ ID NO: 10582 - DNA, 518 bp, Triticum aestivum
  Clone ID: PAT_TA_10582
accggtccggaatttccgggtcgacccacgcgtccgcccacgcgtccgcgccatggcctcctcttaccttgcgatcctagtgctgctcttgctgcgcttctccggccgcgcggtcgccgtctcctccagctacatcgcaaggaccaccgagcagcagatcatcgccaccgtcgcgccggccgccttcgccgacgccgatgacggcggccagagcgcagcgcagcctttcctcgcgtccccctccgggtcgttcgccgcgtacctccgccgcgccgccgtgggcgatggcggtagcggggacgtgtgctacgtcgaggtcgtccagcagcaggggggcggcggcgggaccagcagcgtgtgggagtcggactgcacgccggtgggcggcgccgaaacctgcgacctggacttctcgcccgtggggctcgagctgttcgccggcgggcactcgctgggggacaccgctgtcgactcctaccccggtaatgctcagtcttgacggcgcccggcgacatgag

SEQ ID NO: 10583 - DNA, 1519 bp, Triticum aestivum
  Clone ID: PAT_TA_10583
ggaaactggccaggaattcaccttcacaattaagagggggcctcgcgcccggacatgtgttagtgttaactatgatgactttgttaatgatgtagaagccggtgacatgctccttgtggatggaggaatgatgtcatttctggtcaaatcaaaaaccgaagattctgtaaaatgtgaagttattgatggaggtgaattaaaatccaggcgtcacctgaatgtccgtggcaagagcgcaaccttgccatcaatcaccgataaggactgggatgatattaagtttggggtggaaaatcaggttgactactatgctgtttctttcgtcaaagatgctcaagttgtgcatgaattgaaggattatctcagaagcgtcgaatgcggatatacacgtaattgtgaaaattgaaagtgcagattctattccaaacttacattcaatcattacagcatctgatggggctatggttgccaggggtgatttgggggctgaacttcctatcgaggaggtaccattgctgcaggaagaaattattagaatgtgcagaagcatgggaaaagctgtcattgtcgccactaatatgctggaaagcatgatcgttcatccaactccaacccgtgcagaagtttcagacattgctatagctgttcgggaaggtgctgatgcagttatgctttctggggaaactgcacatggaaaatttcccttgaaagctgtcaaggtcatgcatactgttgcactaagaactgaagcaactattattggcggggaaacaccgtctaaccttggtcaggtgttcaagaaccacatgagcgaaatgtttgcctaccattcaacaatgatgtccaatacacttggtacatcaattgtggttttcacaaggacgggatttatgtctatcctacttagccattaccgcccatctggcaccatatttgccttcacagatcaggagatagttagacaacgattggctttgtaccaaggtgtatgtccagttcacatggaattttctgattgtgctgagaagacatttggtgatgctttatcttacttgctgaagcatggtatggtgaaggaaggtgaggaggttgcactcgttcagagtggcagacaacccatctggaggtcgcagtccaccccacaatattcaggttaggaaggtttgatgaggaatgcccatttgcacgaccagtaaccgaggtatttgctgtgattggggcaaacacaaaaggtccggttatgatgccatgccggcattactggccttgagccatgagcttgatagcatgtgtactacgtatatttgttgtttgagagcgagtgttgtgattctattctctcttgctgtttactactcttgtgtgtaaaatgattcagaccaatcatttcctccatctgtttttagctgtagcttgggagtgctgtagggttctttattttgtaaaacaatttatgtattaatacattacaaagatttgttcgacaggaaccaagaaaaaaaaagtgttagcctttaat

SEQ ID NO: 10584 - DNA, 712 bp, Triticum aestivum
  unsure (1)..(712): unsure at all n locations
  Clone ID: PAT_TA_10584
gaggaattcggcacgaggtgacactcgacggcaacacggaggtgatgatccggaaccttgtcgcctacgagtcgtcggcggcgtccggcccgctggtgctcacccggtacacggagctgatgaacggcatcatcgacaccgacaccgacgtggcccttctgcggcagcgtggcgtggtgctgaaccgcctgaagagcgacggcgaggtgacgaagctgtggaacagcatgagcaggtcgacgcggctgacgaaggtgccggcggtggacagggcggtggaggagatgaaccggtactacgacgggcggtggcgcgtgaagacgaagcggttcatgcggaggccttctgctccgtctacacatgctcccgatggttcggcgccgtcaccgtcacggcggcgtcgggggaatgataacccgttgaaaattgaattatggatgggtgatctgcatctgcatgcgtgcctttctggattcggctacgtgacataattggcatgcatgtgtttggtttggcattggtattttccgagagtggatgtgcattttttgtttgatttttgggttctggttgatgcaagtgagattgtttatagctctatatgaatgccattggtttgtaaacatactaactatgattattttccattaaaattaccgagagcggcatatgcatgtaagcattncaatataaattgtcaagcacctcaaaa

SEQ ID NO: 10585 - DNA, 1339 bp, Triticum aestivum
  unsure (1)..(1339): unsure at all n locations
  Clone ID: PAT_TA_10585
gaattcagcgagtgcccgagcggcggcgcggtgcgggcgcaggccctctgggtccttcggcccgagcggccagcaggacatgtctgtccatggcccatgcaacgcctcaacgaccatatgccttcgggcccggcgaggccggtggacatggtgatcgactactaccagcacgacttcgagttcgccgagcccccccgcgtgaccagcctgcagaacacgcagccgctgccgacgttcagcaacttcggcgacgacgtctagttcgtggccgtccccctgtggcaccagttcgagcagcagtaccccgggtccaacgtcctgctggtgacggtcaccgacgacgagtcgaggcggatcgagcagcagtccgacaaccagaccatggcggacgccgtggcggtgctcaggaagatgttccccaaggaggacgtgccggacgccaccgacatcctcgtgcccagctggtggtccaaccggttcttcaagggctccttctccaactggcccatcggcgtcaaccgctacgaatatgacctcatccgggcgcccgttgggagggtttactccacgggcgtccacacgagcgaaaagtacaacgggcatgtccgcggggcgtaccttgcaggtattgattctgctgacatcctgatcaactgtgccaagaagaagatgtgcaaatatgatgtcaagggaaagcatgactaatctcaagattaatcgcggagtcaccagctaaaacagcaagaagtaacgggttgaaaccgagtcagtgcactgcattattccggtgttcatctgtgtcgggtcattggtccgtgccgttcggcccaccccgttcctcgtcccttcggtggtggtttccaaccggttcttcaagggctcattctccaactggtcccatcggcgtcaaccgctacgaatatgacctcatccgggctccagttgggagggtttacttcacgggcgagcacacgagcgaaaaatacaacggatatgtccacggagcgtatcttgcaggtatcgactctgctgacatcctcatcaactgtgccaagaagaagatgtgcaaatacaatgtcaaggggaagcatgactaatctcaaggttaatcacggagtcaccagctgaaacaccagaattgacaggtcgaaatgagccagaactggattatttgggtgttcatctgcgttggatcattgttcaacgcttttcctgggacaatccatattttttttctctcatttaattatttgtggagcttctacgaaacaggagttgccactaatgtgtattgcccacttgttgtacaatcacatttattaaaatattgnggaagcaa

SEQ ID NO: 10586 - DNA, 686 bp, Triticum aestivum
  Clone ID: PAT_TA_10586
ggctcgaaaaaaaatccccaatcctaaaggcaagcccatctccctctagcttgccaatgacgacgggggtgtagatcctgtacctagatcggcgaccttggccactgtaggcaccgttccatctccgccccaacgaatctaggtcgtctcgccggcggcggtcgccggtcgggctgcccgggcggacctcttctgtgctgcgctgcgacactgggcgagcaaatctccaggtagcccgcctacccccatgcctagctcggacatctgctgatggcaaagaacagacctcgggtcttcaggaatgcaggacctctggagacccctgccacatgtgatcgaatgtagatgaaaagagcgtaaaaactaatagaatggagtaccatttctgggaataaatgatcattcaatggcacataaaacttgatgagcaagaagcacgagcaccggaggcaagcgctacaacttttctattctctgcattcaagatagcacaacactagaaatgtccatgccatgttatgtattgcatgtctcttgtgtatcttctgctgctccagattgataatgtactcgacattagtgagtgagatggtccagactctagagtgacatgtactcaaatatttgtgcctgagatggtttcacatgtactcagatctttatgcctgggagggtctaattaacta

SEQ ID NO: 10587 - DNA, 789 bp, Triticum aestivum
  Clone ID: PAT_TA_10587
cgtccgcccacgcgtccgcaaccactcatgctggccaagtggccatgtaggtgcctgactgcctgtaccttcgcattgaatggattaggagagatcgtgcaccaagcaggcagtgctccagtccccagcatcacactcctcgcagacctgctagtgctcgcccgatggctcgcgtcctgcgcacctccctcgtcgcgccctcgccggccggcgccgcgctccacgagcgctctctgccgctcacctacctggacgcgctgtggctccacgccacgcccgtcgagcgcgtcttcttctaccccgacgccaccagcgacgtcctctccaacctcacggactccctgtccaatgcgctcgccgcattttaccctcttgccggccgcctccgcctcacccccggcgcgcacaaccgctacgagctccactgccagccgggcgacggcgtcaccttcaccgtcgccgagtaccaccacgtcggcttcgacgagcttgccacggacgaacctacggaggttgccaagatcgtgccgcttgtgccgccgctgcccgaaggcggcgcggtgctcgctgtgcaggccaccgtgctgcgcggcggcctcgctatcggcgtgaccgttcaccacgccgcgtgcgacggggtgtcctcgacgcacttcctccgcacctgggcctgggctgcggcagcctgcagcggagcgagcgcgcctgtgccgcccttcgtcgaccgctccatcatccgcgcacgagacgacctgtacgacgctttcacagcgcccaggctgtccagca

SEQ ID NO: 10588 - DNA, 286 bp, Triticum aestivum
  unsure (1)..(286): unsure at all n locations
  Clone ID: PAT_TA_10588
ggcatgccggagatcacggagcagcagctgcactggtgcgaggagaagatgggccggctccgtgtcgacccgcagcagggcaccatggagcgagacccctcacccctcttcttccccgcgcactgagatctcatcagaacctccatagatccatccatggacactctttgactgtaaccctacttttccttttgtttatttcgttcaccttatcttccctttctctttttattgttgtagcgacaaaagaaaagnataaagctgtagtgtttgcgtaaaaaaaaaa

SEQ ID NO: 10589 - DNA, 1866 bp, Triticum aestivum
  unsure (1)..(1866): unsure at all n locations
  Clone ID: PAT_TA_10589
cgacttcgaagatgccgctgatctggggatccccgggtcggcttcccccggctctgccgaccccgacattcttgtcctggagaccccgggcttcaccgcctcccgcccggccgggccttccagcgtcccaatcgggactccgccgtcgttcgttccgtgctcactcgccccacagtcccgtggtgctgctgttcctaatacgccggttctcccccccgcgttcgactttgatgctgctgatgatttggggatccctgggccggctttccccggatctaccggccccaacgctgagacacgtttcttccccaacccgcgtttggatgtggcaggcccctccacttttcgaggaccttcttccccgatatctttggatagtgatgatgagctggatgactttgggtacaaagagccatcgggcaatttgattttaccctgtgaagagtccatgcgggaagaggagagaaacgacaacacagaagaaggaaagacaacgcaggaaaagaggagactaataaaggaagggaaagcgaaaatggttgaagaaaagaaacgacagcgggaggaaaataagctcatgaaagaagctattaaagctcaaaaggcagagcagaagaaatatgcaaaagaaaaagacgagtgggaatcaggaaaacatgctttaaaatctattgtggctgagatcgactcaacaatcattgaaactggctcagttggaggtacccttctaacaaggtttgcggagaagggccttaagtatcgagttcaggctaatccaatcaagggatcgattttgtggaagatggaggttcctcaaattggccaggacccagcttcagtggcagaagtaccgtatattctatttgtgcttcaagctgaggaattctgcgatcttatcagcagtgggttcttctgggatcatgttcgccttgttcaagatcgctatccaacgttcactgtttgctttgtcactaataaattgatgaactacataaataaatgcgagcgggctcagtataggaatgcacccaattttaatagctggaaacgcccaccagtggaagaggttttatgcaagttagcaacacaccatgttaaagttcactcaaggcaatgcgcagatgaagctgaagtagccgagcatgttgttggcttgacatctagtcttgcaaattgcagattcaggaaaccactgtcatggttatctgtccatgctaatggtgcagtgatccctaaaaatttcattgataaagatctggctaagaaagatacctggatgaaggctctaatagctatccctaaagtccagccaaggtttgccctggcaatctggaagaagtacagtaccatgagatcccttctgaaagtatatatggattccactaaaactgttcgcgagaaggagcttctgctgcaggacctgatgtgcgaggaccgcgtaggcgaggaaagccgaaggctgggaccagtatgctctagaagggtttacaggactctcatggcagaagacggagcagtggaagcggatgctgctgccgagtaataaccctaacggtagatcgtgtgatcccttcggacctgccaggctagtgcatatgtattgggtgttgcaccaccaagctaaaacttaaaactccacgcagctagtattgtaatgaagccattacgtgctgtgctgcacggtggcgcttatcatgttccgcgagacttgtacgaaagcggaactagaaggatcgtatgcttaggggatcgacgaatggaatgctatgctaatatatatgtaatgtaagataagccagtcgtgtgttgtgaagttgtgtgtaggtattctggatagaaggacattgtnactacagtcaggagctc

SEQ ID NO: 10590 - DNA, 1099 bp, Triticum aestivum
  Clone ID: PAT_TA_10590
gccagctcaagcttgaagacgccactaagccacacccacctgcatcgcgctgcccgcctcgcctcgcgcacccggccgctcactttcgctcccattggtgctccccctcctgggcgccttcctcgccttggtgctcgccatggtgcccttcctcagccgccgcctccaccaccgccgcccgtggacccccccgccgggccccaagcgccggcccctcacccgcaacctcaccctcaccgcgccgctcccccgccgcgctctccccacgcggtcccggacgtacaaccccctcctcgtgcacctcccgttcggctcctcccccgtcgtcggcggctccgatggcgatgatcaacatcttcctcctcgacgtcccaacgacggggctgtcccaccgccccagcccaagcaccgccagccggtcaaggtacacctacctacaactacagcgacatcacctggtcccccaacggcgccaactgggcgccaggcccgcaacgatgtgcctcaccgacctcttcaagcgccaagcggctcgagtcgtacgagtacatccgccacgggaggaggtgctcgccctcctcggcgacctgtaccgcggccggcgccggcgccggctcgcgtggtggtgctcaaggactacctgtccacggtgagcctgaacgtgatcacgcgcatggtgatgggcaagaagtacctggagaaggaggtgaaggacgaggcaggggcggtgatcacgacgcccgaggagttcaagtggatgatcgacgagctgttcctgctcaacggcgtgctcaacatcggcgactccatcccgtggctggactggatggacctgcaggggtacatcaagaggatgaagaagctgagcaagatgttcgaccggttcctcgagcacgtcgtggacgagcacagcgaccgccgccgacgcgagggggagagcttcgtcgccaaggacatggtggacgtgctgctccagttagccggagaccccgatcttgaggtgcagatcgaccgggatagcgtcaaggctttcattcaggtaagcccgtgcaacttccccgtattcagtaaaagaattcgagtacaaggagctttcaga

SEQ ID NO: 10591 - DNA, 612 bp, Triticum aestivum
  Clone ID: PAT_TA_10591
aggaattcggcacgaactccgagccggcgtggctcgggttcgagagggggtgggggccgagggaggagtacgacataggccgcgagatcaaccgtgcggcgaggatcctgccgcgcgccatcaaggagcggctggctcagctagtgaacaagctgctggtcggggaaggccccacggggcccaagatgaagggcagctggagaaacgacgagagggatccctgaaacgtttccgctcattgcatgcgccgggaccgttctctaaccgtcgtcgtccgatcgatattatgcgttgatctgacggtcagagaccatgccctctcgctaggactatctcaaaaaacccaatgattacgtacaaaagaaaatcagcagtgtaatttgttcttgggtagatgtgttctactgtacattcgtgcaatgtgttgtcatctgttgtttcttttttcgtaacaggtgttttaattatgtgtgtgttgtgttgactgcgccgggattctttggttgtagttattctttattcatattactccctttgtttcttgttagtctgcatataaaatttgtctgaagtcaagctttataaagtttgagcaatatttcaaaaaaaaaa

SEQ ID NO: 10592 - DNA, 738 bp, Triticum aestivum
  Clone ID: PAT_TA_10592
gcgggggggagcgacgcgtccgcacctccctccgcgccgccgcctctccacagatccccctctcgcgcctgttcgctgctcccaggagccatggctgccccgagcaggagctcgccgccggtttagcagcgctccggcctcctccacgtcgcccacaagaacccccgcgccatcccggttccattcagacgccagggcgcactcaaggactccatccacaacgtccacttcttcctctcggacagtagatcgcgccaagttcgtcgacctgctgccgacgcctcccctccgttcccggccacgtattcttgtcctagggtaaggagacaaattgaagaggagaaggagcggggcagcaagcagctaggttaacttttacccagcgttgaagatgaacgctcgtcaggtcttgactcgaaccacacttaagaatcacagaaagggtgttctatgcatagtgatacataagaaggatgattcccgcaaaaagaagaagaaggaggaggagacattagccgccagcggtttcatcgttagggctgctcgagggaacagaagagctcttgtgatgacatgtaatcatgtcgctgcatattttgtccctcctggggacaagctaggcattagagcacctgggttagaccaggagctcgagtgtgaaatactctaccaggataccaacaaagacctagcgattatcgctgtgtttggaatgcaaaaaaaaaaaaaaaaaaaaaa

SEQ ID NO: 10593 - DNA, 552 bp, Triticum aestivum
  Clone ID: PAT_TA_10593
gcacaggactagccaagcttcttttcaggatcctcagtagtccatggagcgcaagcaggagcaggagaagagcttcgaggaagaagcagccatggccatggaggcctcctcctcggcgctacggtcgctgctgcaccgcatggcccaacgatgcgccggctacctgggcctcgcggcgcccctagcatccgactactcccagtcccttggcgctggcggcgatcacctgaaacccaccggcgctgcagatggcgtggtggtgcggccggaggaggagttcacggtcgtccaggtgcagtcgagatcgatggcgtttcagagcaaccgcaaaatagatcaaggagtcggcggacgtggtgggatcaaatattgattaaccaacacgtacagctccattgtagatttcccctgatgtgcctctacctcccgtgatgatcgatgtttgggtctgaatgacccaacaggtagtatatatatctaccgaataatttctactgctgttaccttggttttatatacggtataaaagttgccttttatttaaaaaaaaaa

SEQ ID NO: 10594 - DNA, 647 bp, Triticum aestivum
  Clone ID: PAT_TA_10594
gggctaactctgcatttgcaacaacaaacgagtacggcattttctctatagagctcccgtcccggctccacgctacaccaagcctggagaatgcatgctcagtcaaggtgctggagcttccgccggactccgcgtgccgtgtcggcggcagtcacgtgtcctctcacggcctccggctatcttcatcggacggcagcgtccggacctacacagcaggggtcatacggctgcagcacgacggcacaccagccaataagtgcgtgcaggaagaggacacgagtgataggagatgaacgatggtcagttcggatcttcgtttgagttcatgtttctcatggttcttcgagggaacgtaaagatcaagtggaggcgctgcacgctttcgcctcccgtatagcattggtgaagcacatacatgtagattataggtgtgtttgatagacagccactctggtatggctattctctcctgagacatgatgataaaagcaagtttgtgtatatacaactgtgatgatgtgtttaatagcatgttctcatatgttgagacatgctaagctgagatcttgtatgatgacgattgacgtgtgtatctactgagatatgctgagccgaggctttgtttggtaagattttatgaactatga

SEQ ID NO: 10595 - DNA, 332 bp, Triticum aestivum
  Clone ID: PAT_TA_10595
gatctggagctcccctccccgctcgattgagtaggttggtggtcaggcggccggtgctctcccacccagctgcatcgccgcagctcacgctcgagggtattggagtgttgcctgctcatttttattagttcttttttctagtttatgtataatatctcttggtaggctccttagggtttcgttcaatgtaatatatatatttagcttagttgatgtgatttattgtatttcttccgtatttgagtctttatacattttgtaaattgcacttctatggcagtgttgtcagttgatcagtacatgccttcaggtatttgtttacaaaaaaaaaa

SEQ ID NO: 10596 - DNA, 1947 bp, Triticum aestivum
  Clone ID: PAT_TA_10596
cgcgcgcccttccgctcggccgcgcccacaaaccccatttttagggtttgtcgccgccgtccgcccagctcccccctcttctaccacctcctcgaagcatccaaacccccagccgttttaagccaatctcctcccatcgagagcgaggcatcctgcggcgcatcggcacattcggttgagtggcagacatgtcttcgttttggggcgcggaggtgaagccagagaagccctacacgcacacccacagcccgcgccgcggccgcctgcgcctcacccaggcgactctgggggccgaggttggcaaggtggagaaggggaagacgaacttggtgcagctgcactgcactgttaagaacaaggagcctgtgtatctctgcgccctgattccggggcagtcggtgacttgccacctggacctcgagttcgaggagaagttcgtgacgttctcggtgcttgggtcgaggagcgtccacttggctggatactatgttggtgatgcgtacgaggacatcggtgacagtgatactggtagtgagtcacttcaaggctccgatgatgatttcttggcatctgatgacgatgatgtggtcattccagtatcccatggccagatgaacacagacagcgaagatgattcagactatgacgaggactatgattcagaggatgatgaggatttgatctacaaccagggtagaggcaagagttcagttgtcattgaggagattcaagaggatgagaagcctgttgatgataattctcgacttcagcttgctgttaggaccccacctgctgaatccgtggaaagtgaagatgaagatggctttcctgtttctgaatcaaagaagagttctaaaggtagttccaagaaggctaagaatctaaataatgggactagtactgaagacaggaaaaggaaaagtgatgctattaatgatcctcacaagtcgtcaggggaggttaatgctgaaaatgatgtggtttcaaagaaaaagaaaaaggacaagctgtggacagtgagaaggtaaacgatgaagaaaaggaggtgaagctagcttcctcagctgacaccgttgcagccaaacagaagaaaaagaaaagcaagaagcaaagtgcttctgaaggtgacactgatgagcaagctgataagaaaaccataacagacaatgatgaggagcctagcaaacagggggccaagaaaaagaagaacaagaagaaaacaaaggagaacaatggaagtgagaaccaggcacagactgatgttatgaattcagctagcaaggagcagacatcacccaaagcacggacttatggcaatggtttgattgttcagacggtggcgttgggcaaaccagatggtaaaaaagctacccctgggaaaaaggtttttgtcacgtacactggcaagttgaagaatggcaagatttttgactctaaggttggcccgaacccttttccgtttatgcgcggtgtttgacaggtcattaaaggctgggacattcgcgtcaacgggaagcgcattggggacaaaagaaagcttacaattccaccatctatgggctatggaaaccagaaggccggggaaataccgccgaactcaactcttctgtttgatgtggagctaatgaacgtacagtgaggaggtgaccggttaccaaaagggacgaggacaaactgagacggttgcgcaaatccaagaaacaccattttcctccgtcatcgccatagcttcagtcaacaacatcctacagtcgtcttcatgtaccttgtttttccatcagctctacatgtcagacgaagccatctgggctttttgtgggggcgtaacattggcctgggctgcaactgagcttgtcactctgatgattttgtggcccgttttgacattcttccgggatcgccctgttaggctggtttgggaggcacaattttgaaaaaaaaaaaaaa

SEQ ID NO: 10597 - DNA, 1019 bp, Triticum aestivum
  unsure (1)..(1019): unsure at all n locations
  Clone ID: PAT_TA_10597
gcgccgcgttccgggcgatctacagggttttctacgcggataggctggtgtggaagctgatcgtgaaggctacgggggctcccgggcatgggtcgaagttgttcgatggggccgccgtggagaatctgatggattgcattgagaccgtggctggatacagggaggcacagttcgagaaggtgaagtccggcaagtacggtcccggagaggtggtgtccgtgaatcctggctgtacatgaatgccggcacgccgagccccacgggctttgtgatgaatatgcaaccttcagaagcagaggtgggttttgatctccgccttcctccaaccgaagatattgaacagatcgaaagaagaataagagaagaatgggcaccagctcataaaaacttgacttaccagctgatgaagaaaggaccagtgagcgatgtgacaggacgccccttacttacaccagccaatgagtcaaacccatggtggtctgtgtttgaacaggctattatctcttcaggtggaaaactagcaaagcccgagatcttatcttcaaccacggacgcccgattcgttaggcagatgggtgttccagcccttggcattttcacccaattgataaatactccaattttgcttcacgatcataatgagtttctggaggataaagtgttcctgaggggcatcgaagtgtaccaacatcttattagagcgctgagctcccttcaaaggctgattcgaaacaagcacataaattgtaccattattgtatttccatccccatgtaagttaattgtagcgaagataactcagatggccgtgatgccacaactgtcatgctccaaagccacagctcagctcgggcggcctgtccagagtctgctgaaacttttcggggccgtccgtaacctgctggccgtgttccccccgggctctttagctcgtcgggtacctgcgtcctttcagcccgcatatcccttcctgggttgttaaagaccccttaaaaaaactccangggggggccggtacc

SEQ ID NO: 10598 - DNA, 987 bp, Triticum aestivum
  unsure (1)..(987): unsure at all n locations
  Clone ID: PAT_TA_10598
cgtccgccaccgtgccctatatctgccgccgtgctgtaccttagcgtcaccggcggtgcctcgagcctgccggccgacgccgacgccccacgccccccatccccaccgccacccccacccccggctccgaacgcccccgcctctcacgcgtcgccgcgatcgccgttcccgttctccctcatcagcaacatcgggtccctgctgtctccgccccgtccgcagtctttgggcattggttttgggatttaatgagctgcaaacccttggagacttccttgtagccaatacagatatctgtactcgattacaacaaggaacagctggagtgtatagctgatgtctggcccacctgttttttctgtgttgcagggtggcaatacaacccacagcataaaagggcaacaaatctcaatgattgggaatggtcattcttttcagccaggggtgtgtgtcatggacccttcgtctttcttcccaggtatttatgctgagaagcaaagcagttttgcagagcgtgccaatatgatacagttaaataacttcatggcagacaattcttcgcctgctggaaaccgctgccagagacttgggtgtaatgaacttgttgaaggccagacaccgttctgcaaaagccaccgtttaggccaacaatgccagatgattggctgccctcagatcccaccaaatggcgtagctttgtgcatgtcgcatggtggaggccatcctggttccagtgcagtaccactcactgaatctgaaggttcaatgaagtatgaaggagatggtcaatttagagtgatggaaaatgctatcggtagcacagtcatacctaattctgatggtgaagttgtgatgtgcaagtacgaaggatgtagcnnacgatcccagggaaatactgtgtattgcaaggtccacagtggtggttcaannncctgtatggttcannnttgtannanggnnncacatggnnncactcctatgtgcatt

SEQ ID NO: 10599 - DNA, 519 bp, Triticum aestivum
  Clone ID: PAT_TA_10599
gctccactcttgccgccgtccctcttgctatcctcaacatgtcttccatcgggctcagctacgcaccagggcttccgtggcgtgaggctccgcgcaggtgcacctgcggcagcggggacgccgcggcaggctccgcgatgggcagatcgctgcccggacgacgagggaagcagaggcggtgttccgcggatgaagaggtcaagaaggtggcttgtatcgcatggaacgccgggagggtgcattccatgggggtcttccccggcggctgcggcgccaaagggtgggcactgatgaagctggacggccatggagtactattttgcttgggactgctcgtccgtcgttgtgcttgtcccaaatttgtattattgtgatcatatgtatcttgtattctttcttgtatcgttaccgacgaatcgctccaattcttgggtttgccctttctagacccaaaatagcgtggtcaggttatattcttgtccgttcaggaaataaagcttgtgtgtgtcatgattaata

SEQ ID NO: 10600 - DNA, 681 bp, Triticum aestivum
  Clone ID: PAT_TA_10600
aggaattcggcacgaggagagttcggtagtgcggttattacctgaactgcgccagcctgctgctcctgctctgcgtcctcctcctcgccgcgctcgggcgccccttcgccgccgctgcacgcagagaaccaacaatggcggccaccggcgaccaaggagatggtgctcaggccaagctggcctggatggaagtggcgcccgcagagggtctaaaggagagggtgatcacgaggaaggaggagagtacagactctaaccgtttcaggagcacaaagttttctttggatgccaagaatccgttcgacggccgggtgcccttcaccgccgattaccacaccgtgcgcaggcacccgccctcgcacaactaggcggagctgacctcagtgtacgtacgtactactactggctagctaagctggttggttgcctggaaatacagttagcttatagagtaacagtaactactaagctgtataacattttctcatcctctctgttctctctattctttggcccttctacgtagtgccactagtatgttactcgtctccccttgtggccttgtcagctatggatttgctgacgttttgttagtactggccacgtccctagtaacgatatcctatactactattactgcatttgctattttttcttacagtgtaccgcataagctgttaa

SEQ ID NO: 10601 - DNA, 540 bp, Triticum aestivum
  Clone ID: PAT_TA_10601
cacccccgggtgtggaggaagaacccgttcggccacatcagaagcaacaggtgcatcaccgagcagagcggcggcggcggcggccgcgccgggcaccggaggtccttctccagcgtcgtcgtccggtactccgcgtcgagcaagacgtcccccgcgccggcgcctccgtcgtcgtcgtcgtgctcatcgacgtcctcctcgtccaagtcctccacctcgtcgtcggtccggtgctcgagcgactccgacggcgcggggacgggggcgccggcgctgaggaggagcagcagcgcgagctcggaggcggagaaccccatccaggggctcatcgcctactgcaagaagtcccagcagctggcctcggtgcggaagagcgccagcgacgccgggttccggttcctgtcgtcgtcggcggcgtccaaggtcgccgcggagtccgagggccacgacgagctcatcgagatctgcagcggatgatcgtcgccactgtcggtgccgtgatgaacgttgaatgtgtacaatggtgtatgaaatgatgca

SEQ ID NO: 10602 - DNA, 769 bp, Triticum aestivum
  Clone ID: PAT_TA_10602
gaggaattcggcacgaggcgaaaccgcttactttctcctctccctctgctgtttaattgatcctccattcctcctacctgcctcggcgccaacagaccatcgcagggaggaacggaatcccatctccccctgccgctgctttttgttgccatggacggcggctaccgctccaagtcgtacgccagcggccgcatgcagatcgagccctatacaggcggcgcgcggccggacttccggtccttgtcctacggcggcggcggggcgtcgtaccagtaccagtacgagtacggcgccggagcagggcaggtgacgacggtggtggaggaggaggtgaagaggagcaagtctaagcggcggtggctggcgctgggtgacccggacatggagcggaagcggcgggtggcggcgtacaaggcctacgccatggagggcaaggtgaagggatccttccgcaagagcttcagatggatcaaggaccgctatctgcacctcgtctacggcgtgtcctagctactagcagtagcgcaggcaaggaacagcacagagcagatcgatcgagctgcaagaaacaaatttctcctttgttgtttatactctacttgtttgtgatgcttgatcaaggtcagtaaagataggtaaacatattcctctgcttttttcttcttcttcttccatgatgtcaatgactgtcgtgtaagttgtatgtatctgaaagaagttttgcagttcaattcttcaacgaatcaatcgacaaagtgggtggtttgca

SEQ ID NO: 10603 - DNA, 827 bp, Triticum aestivum
  unsure (1)..(827): unsure at all n locations
  Clone ID: PAT_TA_10603
ctgcccgccgggcatgatggagttcggctggagcagctcggtggcaggaaagccgctgagaacgatgagccgcaacagcagcaggcaggagtctcccgctaaacctgtccagaacagcagaaggcacatgatcaagggtcacatggcttccgtggcgcaccggcgaatgccggtcccccgccattcccccaggggtgctcccccgacgccgcgcggccgcacccggccaggctggttttggctggagaggttcagggatgcatgggagtcttgctcccacaagaaggcggtcgtcgcagccgtcttcaccctcgtctggaacgtctcctccacggtggcccgtgtctgggctgtgttcatgctggtggtggcgatgaagtgctaccagcagcgcctgatggagttcggctggagcagctcggtggaggagcccgctgagaacgatgagccgcaacagcagcaggaggagtctcccgctaaacctgcccagacagagaaggcacacgatcaagggtcacatggcttcgtggcggcgcggcaccggcgaatgccggtctccggcgacttcgccagggagaggctgagggcgagaggcggcatccagccaaggtgttagtttgtgtacaccggaccttgttgtgtgggtgttctcgtaatgttgatgaattcggtagtggcaaaagcaataataagatcgaccatgaaatagcaatcacatctatggatcgtgatatagtatgatgaaacagtaggtttttagggaaccaccaaacattnctagtcatttgtttcatgcgtgcgctacaggcaagggagnccgatgcagc

SEQ ID NO: 10604 - DNA, 340 bp, Triticum aestivum
  Clone ID: PAT_TA_10604
cagacgcgtgcttgcgcttgtgtcggtgttgctccggctcgcactagtgcgggtggatctgaaagatggtgaggtgtccgtcgatcctctcttctgttctgctttggtccttgcaccatttctctatggattttcttggttattgcggttttatgtgtaaaagaaacaggttgtcttttgtatcggctgttgttcatggatcaaccagatgtgcagcaagcatgatcatgtaaatacatactaatattttctcatgtaaatgtatgattcgaacttgtattggttgaacaaagatgcacttgatgagctttgcatcagaattattgggttagtcagattg

SEQ ID NO: 10605 - DNA, 642 bp, Triticum aestivum
  Clone ID: PAT_TA_10605
gaacctcatctcacaagctatagctagtagctgtagctgccatggccaaggatctcgccttcgtcctcctcgtccttgccgcgctagccgccttctcgtcggcgaccaagctgacaatccacaacctctgcccgcacccggtctggccgctcgtcacccccaacgccggcctcccctccatctccgacaacgccgcgcgcctcgacaccaacgcgattctctccctcaccttcccgtccaccttctgggcaggtcgcgtcgcggcccgcaccggctgcgacgacggcacgtcgccgccgcgcgggtgcttcacgggcgacgcgccgccgtccaccgtcgcgcagatcacggtccacgacagcgggaacctggacctcgccgcgtacagcgtcaagcctcgtaaacgggttcaacgtgccgatggtgttgagtccgcacgccggcggtgggcagtgtccggcgctcggctgcgccgtggacctcaactgcaactgccctcccggacaaccgggccgccgaaggcaccgcgtgccgcgggcccgcggggtacttcaagaaccgttgcccgctcaccaggacgacgccgaccgacgtggagcccgtgccgcagagctgccgcgcgcccggggagctcaagatcgt

SEQ ID NO: 10606 - DNA, 624 bp, Triticum aestivum
  Clone ID: PAT_TA_10606
gtggagttcggccccggggtgtgctgcctgttctggtcgttgcgttcccgacgggagcccctttctagtccgcggctgtgcgtgtgtcccagtcgggcgatggtgttgaagtctgctgttgtggagggcgccggcgcggatgggctgctggtcgcgcttgccccatccgtcgtcgtgttggctggtcttaccccgcgcctgtgggatacttctcacccgggtttttacccgccactggtcccgccctgcgcccaggcggctacctggaccttctgtttggatttcgcggacaccccacgctgcgtgccttcactcgctgcctgtgatgggctcgcccgccgctcgttggtgccagcattttgtaggcctagccgtcggctcagtcggctcgtacgtccgacattctccggctgtcggcccttgcccggacccgcgtcgcgtctatggggcagaccggggttctgcgtactactccggacctccgtttcttcctgcctccgggggggccctgcgctcatgcgtctgcctcgcgtttctcttacgatatcttgaatactgcaagcagcgtggattcacaagctgttatatatgggcttgcccacctttgaaaggtgaagattacat

SEQ ID NO: 10607 - DNA, 596 bp, Triticum aestivum
  unsure (1)..(596): unsure at all n locations
  Clone ID: PAT_TA_10607
gatcgacccgaaccgcgccctggccccgggcctggtctacgaagccgggccgggggactacatcaatctcatgtgcgccatgaactacacgacggcgcagatcaagaccgtgacacagtcgtcggcccctgtggactgcgtcggtgcgtcgttggatctcaactacccgtccttcatcgcgtactttgacacgaccggagagaagacgttcgccaggaccgtgaccaatgtgggggatgggccagcgaggtacaacgccacggtggagggactggatggactaaaggtgagcgtcttgccgaataggctggtgtttggcgggaagcatgagaaacagagatacacggtcgtgattcaggtgcgggaggagctaatgcccgaggtagtgctgcatggatcattgacgtgggtggacgacaacggcaagtacacggtgaggagccccattgtggtgacgacgacgtctgtgctataggatatgtgcacatgtcagtatatgtacttacatcaatttgaaacaattgtcgatggaggaagacttccccctggacagcattgttgtagnatgattgnaagaagccatcaaaccttttgag

SEQ ID NO: 10608 - DNA, 670 bp, Triticum aestivum
  unsure (1)..(670): unsure at all n locations
  Clone ID: PAT_TA_10608
gaggaattcggcacgaggccactctcctggagtgcatgcagccgtggtggtggctggcccagggtagcaacccactgtcggtgaggaaccataagatccctgtgccagcagcctcggatctggcccgattcgtacgtccacggcctccgcgacctgcgaatgccccctggtccggcctagatcccgcgccgcttcgtctgttcgtgttgaccccgaggaggcgtccaacgcctcgtcccgcggcccacctgcctcggctaggcctgcgacggcggcggtggcgacggggctgctgcggttggggcaacaaccctgtgccgtggtggtggagctctccggtggatggctgaagggacggctcggttgctcgccagatctggcgggcgttgattggagttgagatggtgcgtcgcgttcgtgatggtgcgttgcgttcgtcggccaactacggctgcatatgggactcctggcggcaggcctgtggccgaggcacgggaggtgatcctggcgcagctgaggcctgctgtgtgtcgtatctggcacaaaaggtaaattatttgatggaagaaagattctcaacacagctacggagtacatgttatggaagaaatcgagctaggtgcttttttttganaaaaagagatgcaggccggcaatgtacaaaactgag

SEQ ID NO: 10609 - DNA, 536 bp, Triticum aestivum
  Clone ID: PAT_TA_10609
aggaatccgcacgtcgttcccagcttgcaggagctgacataggtagctagcccctgaagaggtggatcatggcaaagcgtaacgagctgtctctcttggtgctcgtggccatggccgttgtcgtcttcctctccgtgcaggtgaagtcggaggtggctgccggcagctacaccacagagatgcaggaagctgtgaggaatgaagtgaaggccttccccgacctccgtcccggccttatccggctcttgttccacgactgctttgtcaatggttgcgatggatccgtgctgctggagacctcgcgcatcaacggcaccgatgggaagacggagatgacgtcggccttcaacggcggcctccgtggcttagaggtgatccagaacatcaagaagaacctcgggaccaaatacaacatcacctgcaccgacgccgtcatctacgcggcgcgcgaggcggtctacctgctgagcaagggcaaaatcgcctacaacgtcaccggaccgggccgcatggacggcgtcatctccagatcagag

SEQ ID NO: 10610 - DNA, 595 bp, Triticum aestivum
  Clone ID: PAT_TA_10610
cgtccgcccacgcgtccgcccacgcgtccgctgcacgcccgtcccccatctccctcttcccccctcggcgaaaccctagcatccatccggcgcggcatggcggacggcgagggcggcgccgacggcctggcggagaggctcgcgggggcggagatcgccgcggacggcggcgccggcggcggcgaggaggagccgaggctctcgaagaacgcccagaagaaagaggagaagaggaggaagcaggaggagcagcgccggctcaaggaggaggagaagaagaacaaggcggctgcggcggcggcttcgtccagtggagcgccccagcaggcggctgcggcggccgatgatgaggacatggatcctactcaatactacgagaacaggctcaggacccttgacgcactcaaggccgggggtgccaacccctatccgcataagtttctagctagcatctctgtgcctggatacattgagaaatacaagggccttaatgagggggagaagcttgctgatgttacagagtggctagcaaggaggatcatgaacaagagaacatcatcttccaagctcttattttatgatccttatggggatg

SEQ ID NO: 10611 - DNA, 2321 bp, Triticum aestivum
  Clone ID: PAT_TA_10611
gaaacccgttatcgtccacctccccctcatcgaaaccttagaaacgaagcggcgctccccacctggcctcgaagaaagcttggagctctttgtggagaggctcgtggtggggtagatctcctcggagtggagcggtcgtggtgtgaaatggcagccggtggagcagcagctagagcattggtaacacaggattaggaaaccgaagatgaagcactagataagtggtgcagccaagaagtatagggcggcactggctggggggtggagtggacggagtcgatggcagtggcaaggaggcgaagagatccccagaacgactcagcagttctccatgacccggccatgaatcgactttaatatcggcgtgggaagctatcaatagctggatgattctttgccgagccttgctatccggattggtataggacaatacaagggggtttaggataaagatacatttgcatggattagatagtttctagaagggaaaagcttgcacgcgtgaccatagtcgtataagatatgattgtaagatcgagatcatgatcgcaacaggtttcatttaatgatttatgcggtgatgacgcaaatgtacaactcagaattgtttaccccaacttcggatgtgaatgtaactgatccctttggtttatgttgaatggccggagagagcgagaggtgcccgttcatcttatgctcccggaaagggcatttgctctgacctcggcgtcttcccacgccccggcggtgggctctcgcctgggcggcgcctgcgccccgggccccagggaatgtgtaggaatatcgagaaagtatgtattgagggaccaggaaactcgttatcgtcaacgataccttgatcttatggtaaaccatgaagtgagacatatcttcaagacccgatccaaaattgtctcgtttattcgaaggtttcttgatgggcttgattttttggaggtggaggcgccaatgatgaacatgattgccggtggagccgctgcaagggccttttgtcacacaccataatgatctaaacatgaagctttatatgcgtattgcacctgagctttatcttaaggagttggttgttggtggattggaccgtgtctatgaaattgggaagcagttcaggaatgaagggattgatttaacacacaatcctgaattcacaacagttgagttttatatggcgtacgcagattacaatgacttgatggagcttactgaagccatgatatctggtatggttaaggagctgactggtgggtataagataaaatatcatgccaatggagttgataatccaccgatagagattgatttcacgcctccctttagaaggatagacatgattgaaggattggaggctatggccaaactggagataccaaaagatatatcgagtgatgaaacaaacaagtatctgatagatgcatgtgccaagtatgatgttaaatgtccacctccccagacaacaacacggctgcttgacaagctagtgggccatttcttggaggaaacatgtgtgaacccaacatttattatcaaccacccagagataatgagtccattggcaaagtggcataggtcccgacctgggttgacagaaaggtttgagctctttgttaacaaacacgaggtgtgcaatgcctacactgagttgaacgatcctgttgtgcaaaggcaacggtttgaggaacaactaaaggatcgtcaatctggtgatgatgaagctatggctttggacgaaacattctgcactgccctcgagtatggactgcctccgacaggtggttggggtttgggaattgatcgccttacaatgatgctgacagattcccagaacatcaaggaagttctcctgttcccggccatgaagccccaagagtagctgtttgcaaacccatcaacagaagtaattttgttttgctgcgctgaggctggaggattatgacatgacaatacaaggagttttaactgtgctggacaaaacatgtgtagcagcactggaggtataagctacttttgcgtggaagggttgttgaaaatttgaactccggttagggaggagcagtgaggcatatgaagcaagaatcagaaggagccaaagtgtgctacatgtttgcttgttttctttttgaaaattcaaaatttagtgcttggtattgctatacactttcttggatctccgtgtaacacttgccttgcgtcttatttgtatggaccactagaggtagaggtgcctcttcctcttatgcttgtagccagggtatttgttttgaaagatgggtaggatggaaggtcccagaaattggcattcg

SEQ ID NO: 10612 - DNA, 563 bp, Triticum aestivum
  unsure (1)..(563): unsure at all n locations
  Clone ID: PAT_TA_10612
aggaattcggacgaggcgacggggaggacgtctaatctcaatagcaccttgctgctgctatcgctgctgctgcttacctgcttcttccagcaggccagcggccatggcggcgtcgaccacggtgacggcgatgaggacgacgaagatggccaccacggcgacgcgggcgtccgcggtggcgggctccggtccaggggcctcatcgccgtgaaggtgtggtgcctggtgatcctgctggtgttcaccttcctgggcggcgtgtccccctacttctaccgctggaacgaggccttcctgctcctcggcacccagttcgccgccggcatcttcctcggcaccgcggctcatgcacttcctcgccggctccacctccaccttcaacgccctcacnccacaagnccccctaccccttctccttcatgcctcgcctgccgccgggcttcctcctcaccaatgctcaagcgacgtcgccatcgtcgccgtcgccaacaggcagagggtcaaccaggcggcgcccatccagaaagacgcggaggaggagggcgagtcaacgtcggcggggc

SEQ ID NO: 10613 - DNA, 503 bp, Triticum aestivum
  Clone ID: PAT_TA_10613
cacgccaagcccaagccgaaccgacccgcccccctaaaatcccaatcccttctccgtgcccaccgcttcctcaacgaacgaacgaatccaatccccctcgcccacgcatctcgccccgccccccctttcccctcccccgcaagcaacgacgggcagagagcggcgcggggatcgccggcggcgatgaggtcgacggactcgtcgcggttcgtgcaggagctggtgctgtacgcggcgagcgcggcgctcagctgcctcgtcctcttcgccggactccgccagctcgaccccaaccgcgagtcctccaagaaggcgctccagcacaagaaggagatcgccaagcgcctcgggaggcccttcatttccaccaccccctacgaggatgggattggctgcgacgtcatcaaccccgacgagaacgacgtcgagttcgagtccgtcggcgggctcgacgaagtcaagcaagcgctctacgagctcggtattctggccctgcgccggcc

SEQ ID NO: 10614 - DNA, 1620 bp, Triticum aestivum
  unsure (1)..(1620): unsure at all n locations
  Clone ID: PAT_TA_10614
cccacgcgtcccatccctctttccatccccacgaaaggccccccaagcacgagcccaaccgcccaagccccctcgcccccgcatcccgtcccgccctgccccccctccccggccccaccaaccgcaacccccgcgcgcacgaggccggcccggcgaccgacgtccggaccgccggaggcggccgacggactcgacggcgccgtccgcgcggggcgtggaggtgcacgggctcgtcgcgggcctcggccggcgctgagttctctccccgcctccgccggcgcgcgcccaaccgcgccctctccgaagtactcccccaagccgacccaagccgagagccatacgcccaggcgccccagcacaccccgcagctcccccagcgcctccgcggccccctctgcgcccgacccccccacccggctcgggttccccgccgcgtccccgtccccggccggcctcacggcgggctagcagccgtcctccgcccccgcgacgccgcccctgcgccgctccgagctcttcgccttcgccaagcgccgcagcccgcagaacgccgtgccccgctacgccccgcccaggaccggcaaggccatgctggccacacccagcgcgaagcagtcaggcgccggctgccacaacgtcaggatctccaatctcatgaacccgtggttcggcgacgcccagaaagctcgtgtctgccgtatttagtctcgccaacaagctccagcccgccattatcttcatcgacgaggttgatagtttcttgggacagcgccggaacacagaccatgaagctttgactgaatatgaagacagagttcatgtctctttgggacggtttcaccaccgatccagaatgctcgtgtgatggtgcttgctgctacaaacagaccttctgagctagatgaggccatcctcaggcgcttcacgcagatatttgaaattggggttcctgctcgcagtgaaagaagcaagatacttgaggttatattgaagggagaaaatatcgagtctaacattgattatgattacattgccagtttgtgtgagggctttactgggtcagacatcctagaactgtgcaagcaggctgcattctatcctatcagggagattttgaacagcgagaaagatgggacaagagcaaatagtccaagacccttgaggcaatcggacctggagaaagctttgtcaacatctagaaagggaaagaaggccgcaagcagtgcggcgtcaggtctccagtcgcctgagtggatccggccgtcggatcctgaagatgaccaggtacagagcgcaatctttgagatatctaagctgatgtctccgaatagtccagaacagtcaatccggaaccgcaagaccatcttcaccttaatcctaaaaacagaagttttccctttgctaaatntccngaaaatccccaantggagtaagcctggattacctaacctaatcaacatatgttattggttccgcccgttaacgtcctngggccncccccggtttttaaatttaattgcaactggnaaaccccgcactgatttttggattccancntccgtgtttgggaaatgcaattcaaaattctggggganactggccgttancctgtaatttctt

SEQ ID NO: 10615 - DNA, 931 bp, Triticum aestivum
  unsure (1)..(931): unsure at all n locations
  Clone ID: PAT_TA_10615
cttccgcccgacccgccttccggctactactgccgcttcctctagcgtctcacattccattaccccagtgggtcggcccctcctacctcgctgcttcggccgcttcctcagctggctcgctccgccttccgcccttacctccccgcacgatcgcgcccgggctgggtcgcgctgcttcgcgcggccggcccgccatcggcccccacctccccacgcgcgctcgaccgagcagaatctagctgctgcgagctgccggcctgcaatggggcaccagcaccagatgttcgaagacccgttcgcgagcagcatatcgtcgctggaggcggacatcttctccgtcgccgccggccaccaccatccgcagtggccgggcctcgaccacgacgtcccgttgggcgccggctgccaacaacggcacatcgtccggcggctacggctcccccggtggcggcgacggctcgggctcccaccgcaagatcagccacaacgcgtacgagcgcgaccgccgcaagcagctcaacgagctctactccgacctccgctccctcctccccgacaccgatcacacgaagaagctgagcattccgatcacggtgtcgcgggtgctcaagtacatcccggagctgcagaagcaggtggacggcctggagaagaagaaggaggagctgacgcgcgccaactgcaaccccggcgggcggccctggagggggacccgggccgcgtgcgccgccgcctgccgcgtcgacaggganattatggtccaagtcaacctggtgagcacatggccggantntgcccatttcaaatgcatcaaagtgctggaaaacaanngctccggtcataactctcantttcggcttccaaaacagactntatatcccacttnanaagaaccaacggagatnncaaggatgcccggatttttaaaaat

SEQ ID NO: 10616 - DNA, 646 bp, Triticum aestivum
  Clone ID: PAT_TA_10616
ggcggcgattttgtttgcgtccgcggacgctgcgcaaaaaaatcaatgttccttctgggtcaaggccagtggagctgttgaggaggaatgagccacacatgttgcgtgaacctcaccaagtagggtcaagggctccaatgaagcagtgtattcaagtgctcaagaatgcagaggttgatgatgttgttacaataaacaggtcatgggttttattatgcatcgctcttgtgctatctcctgggactggcaacatggtacccctagagtatattgcgagcttggtggacatggacaagatcgatgatttcgcatgggatgagcacttcttggctactgcgttgaaggaggttaagaagtaccaacggaagagggaggaagggaggagtggcttttggatcggcggttgtctgccaatgtttgcgataatttatatggactttgttgatgtgcctcggtcgttggtttctcagcataggattaactactctctcccaaggcatgcttcgtatgcaacaacgatttcaagttggtagaagaaattgacaagaacaagctcagcctcgataagattgaatttggaaaacagaatgtaagagctcatttttattgtaagcagattccagagcacttgataccaatatatgag

SEQ ID NO: 10617 - DNA, 687 bp, Triticum aestivum
  unsure (1)..(687): unsure at all n locations
  Clone ID: PAT_TA_10617
ggtctgacatgcgtgcgagtcgacgggttctgaaacctgggatgcgcaatggaagcagatctgctgggaggcagaagtttgtcgtgactcctgaggcgctgaccgtgtggcgcaccagcgtggatgtctcagacttagaggaggaggagaagcaggtggacttaaagagggaggaggcccgtctgaggacggccaagacaatcaagaaagtgacaaacttctacgatggcgttgtgctggcccgtctgcagaatgtctatgacaagctgctgctgggtggagtccccggaacatgccggaggatcaagttcaggatcgangctgcgggagctcttggaggtctgcaagacccatgcatcctacaaggagcatggccgcgcatacgcgttgtcgtccgagtcttcacacggctggcagcgtttcgctgggaggggtggtgacatcgatgcaatgcgtctgttcgcaacgccacgaatgaacaagtacctggagcaggccaggaagttccacaaagaaccgcggatgccagtgccgtcagcggatgacgatgtcgaggaggagatcactgatgatcctatggtcaatgtcggcagtagggacataaacaaactatgaacagtatagagatcgagtatatgatcatgcatatgtgagttgtaacttgtaaggccaattatagggccgatt

SEQ ID NO: 10618 - DNA, 708 bp, Triticum aestivum
  Clone ID: PAT_TA_10618
cgtggaggccatcgtagcgtggtccgggcggaccccgacccagacgcccccttctcccccttctcgtccccgcgtctctccggcggccagcgaccctctccggcgatgacggttccccgtaagcaagcgaaaatggtggagcttgaaaaagaagaggaccccttggtccacgacgaacccatgctggatgacgatgataccgacgaggactatgtggagtcagaggatgatgattcagaggaggaattgcaggctgaaccttcaaagaaggccgtgtacaacaaggaggggctccttgagaagctcgaggacatcgcctggccggagaatgtggactggatgcacaagctcaccgtcgaccatgaccagggggagaaggtcgatgtgaacgatgatcttacccgcgagctcgctttctacacccaggctttggatggcacgaggcaggcctttgagaagttgcagtccaaggaaggtccggttcctcaaggccgggagattactacgcggagatggtcaagactgacactcacatgcacaagatcaaggggaacctcctgtttgagaagaagaagattgaggaggctgaggagaggaagaaggcgcgcgagtcaaagaaacgatcgaaggaggtgcaggcagagaagctcaaggagagggccaagggagaagaaggagagtatcgagtcggtcaagaagtggaggaag

SEQ ID NO: 10619 - DNA, 747 bp, Triticum aestivum
  Clone ID: PAT_TA_10619
gacactcctcagccacaacctacgctctgaaggcactggcaaggctaaaagacacatggaagtacctgcagggagagatgctgtgcccagtcaatccagacacactatctaagacgatctatgcctgctgcaggttgcataacatagtcatagaaatggaggatgatgcagccatgctgagcgccaagcagaggaatcgctctaaggaagtgcgacagctagcaaatgaggacgctgtcagggcgagggatatgctgtcgcaatacttcttggccagcaggtcatccgaactgggagaggagggtgatgaagcagttgtatcaggctcaggaggtgaaaagaagaaacaggaagcgcagacaggagcagcagatgaagagataacagtatgaactaggtgaaagagggagctacatcctgctggatgtgattggagcttttaaatgcacgaacacagagcagccctggtgaaagggaagcctattttgatgctgcatcatgaactgaagctcaacattctttctaagttatgcccatctattgtatgtgtcaaagacaagtgatgtcatgtagtctgtacttggtggatgggcagtaagcttttgtatgtctgtaaaaacgaattaaacgatcaagtagaaacacattcgatcttagcagaacttcagtagtagcaaaacagagtctgtctgtttctttcttattatctgggcttgtggttggaggtgtgagaaaatgtagtaaaga

SEQ ID NO: 10620 - DNA, 888 bp, Triticum aestivum
  unsure (1)..(888): unsure at all n locations
  Clone ID: PAT_TA_10620
gaaaacaccttcccgtgacaaaaaacctttccgtggcaaaattactccccctcctctcgtccgactgcggcagcgggcaccgactccgaccttcgccgccgccgccttgcccgtctcttcatcggagccggcctcccggaataggtagattgattcgcgcgtgctagatccaggccacgtcgtcatcaagaggctgactgtctctcgactagtagggtttgaaagggcagagcagcaggggcagattcggcaatggaaaaccaccacgactccctcgccgacgggcggtgcgtcgacggcccggcccttgtggaccgaaattcgccaccggctgtcccgggattccatactgaggcacgagggaggcgcggacgcgagccgcggaggccaaggccgccctaaacggggatcactgggagtgggacgacgacggtgcatatgccgtcatcgatccggcctccttgaaggccatggtggccatggagacgccgaaggtgggcgagacgagggagcagggctgcgcggtgtgcctcgagggtttcgtggccggcggcaagaagctgaggacgatgccctgttcccactccttccaccagagatgcatcttcgacttgctcctccgtagccgattctgcccggtctgccgttccgagatgccccctaggtccgccgacgtgtcggagccggagccggtggcttagaaagccgctactacatctgaacaagttggcagcaactgaactgaagaatgtccatcgattgagtgagtcactcttcttgcagccgtccctgttttatgttcatctgaatatctgattaccggtcacaagcggtgtaattttgttcgaaatactctcctcaatttcatcaaacnaccacttcgatcaa

SEQ ID NO: 10621 - DNA, 1393 bp, Triticum aestivum
  Clone ID: PAT_TA_10621
tgaatcggataggaatgaaaagattctgatccttacttaatcctctggataatccagtcctacccaccgccgccgttttggcgcttaatctcactctggaagaacagcacgcgctcctcgatccaagggggagccatggagttggccgggtcccgcccccgcccccccgccgccccggccccgccgcctccggccgccggctgatctccgccggctcgcctcgcctcgatacagatcttgttcccggccccccctgggtacctatctggccggggctttgccgtcactggctgtgtgccctcggcccgcccttcgccgaccgggtgcatgcgccccgcggttcctcagccactttctcgcgcgccatcggagacgaggcgctccgctgcttgctgccagggccatggagctcctctgtgaggcgccggctcagcgccggctgtctgtgtctctgtggctcggcactctcgttccgtcttatattgttgcgctggccggccctcctggtgcaggcttggcctcgctggcctcccaagtggttcgacgcgtcaatatgcgttggtctcagaagcacgcaaaagatggtgcaccgaattcaaatgaagacattgcgacaatgcttcccatggatggtttccacctttatcgatcccagcttgatgcaatggaggatccaaaagaagcacatgcaagaagaggagcaccatggacattcaacccagcactttttctgaaatgcctacagaccctaaaggaagaggggtcagtttatgctccatcatttgatcatggtgttggcgacccagtcgagaaagacatatttgttaagccgcagcacaaaatagtgatcgtcgaagggaattatttattactggaagaagatgtttggagggaaattagagacatgttcgatgagaaatggttcattgacattgacatcgatgtctccatgcaaagagtgctccagaggcatattggcacagggaaagagccagatgtggcagcatggcggatttcgtacaatgaccggccgaatgctgagcttatcatggagtcaaaaagggctgcagatcttgtaatcagatcggtggactactcaagctagaccccatgtttctgatggcaattttgattttcggtttcgttcgttgcccggccgcgtgctgggctcatcgtggaggccagctggccggctcctcccgtggtcagttcgctcgtcgactcaggcttgccccctgcttctggtgcccgtggtgtttctccgtaattgtcgcccccctagggtcttgtctgtactttcattttgtctgctggctgtctccatccgtggtgatttagcacatagaataaggtatgcccccatcaatttgttctcgaggaagaactcaataaa

SEQ ID NO: 10622 - DNA, 546 bp, Triticum aestivum
  unsure (1)..(546): unsure at all n locations
  Clone ID: PAT_TA_10622
tttcctcgtagcgcttaagcaaggagccatagaccaatgtctcatacttgtatgctttacttcgaagcccaccaacaccatgccaaatttcaggacaaccatgccagtgttatgaggaaagaagaagcagcagtaggagcaaagcatgttgaagccaacaaaaaacaagtcaaatttcaggacagccatgccaatgatatcaagatagatgatgtgagtaaggatgtggatacagtggctttgggacttcatcaaccgtaagcacacgtcctgggcactccagaagagcacaaccatgtatccagcttcctaagtgcaccagggttgcttagtccatggtactatctgctcatgctttgtccagtatgaaagttagaataagaggtgatgcttggaggtaacctaaatattccgaagtagtggtactacctactatggtgttgttacttgcaataccaatagaagtgaagtgaatatgttgtacgttattggaacaccgagccttcctcctatatatgaagtccgtnatnccanaaaaaaaaaaaa

SEQ ID NO: 10623 - DNA, 565 bp, Triticum aestivum
  unsure (1)..(565): unsure at all n locations
  Clone ID: PAT_TA_10623
gcagctctgcacccgtctagccaacgtctgctgcacgtagtcaacatgtcttccatagggttcagctatgcccaggtacacgtgaagcaagagagactgaggaggaggatcagcgacggcgagaaggccgcggctacgaggacgatgagcaaagccatggctggagaaatggaaggcggacgaggaagaagggttctatgggtccccgccggctgcggcgccactggctgcgcgtcgaccgcgcgggccggccatgcggttcgcttctgccccggtagcccttccctcggctcccttgttccaggtaccgggcttggtgtgatcttgtcccctgatcctcgcgccctcccgttgtctgggcccaattctttcctttgggggatcatgttacctgtcccccgtgagtaaacaaagtttgtgtggggttcctgattgtncnatacgtattgtttaagacattatgatgtnatagntcnaatgggggcacacagatcccgggcctgacgtggaatacaataacaacgggagcaaattgaacctccaattgcctgctaaaaaaaaaaaa

SEQ ID NO: 10624 - DNA, 557 bp, Triticum aestivum
  Clone ID: PAT_TA_10624
tcggcacgagggcacggtgtacgaggcgcgattggggggcgagcgtgcggcggcgaagaagcccgtgttgtccacttccgacgacctcgataagttccattaccagctccagcttctatgtgagatggatcatccagggttggcgaaactcattgcagcacatgcacgtcctccaaattacttgatgttcttcgaatattttgagcctccaaacttagcagacaagatacatgttgaggagtggagcccttctatccagcaagtgatcacgattgccagctatctaggtcccagtttgttacagttatagttttccttgagtttgtgtttaacatatattacctccgtcccaaaaatctaagacaagtaatttgggacagagggagtattatgttttcagctgttagaataaagtgtatatcttggagttttatgcagaaccagttttttagaagcttgcttacctgcaattatactttttgtacatagctgtaaacgatcacatgtatctgttttcttgaatatattttgtacacatcttttttataaaaaaaaaa

SEQ ID NO: 10625 - DNA, 866 bp, Triticum aestivum
  Clone ID: PAT_TA_10625
ctcgtgccgaattcggcacgaggttggcttttaaagttgtggtccagatagctcttgaccttgccaggggattaagctatcttcactcgaagaaaattgtgcaccgtgatgtgaagactgaaaacatgcttcttgacaaaacaaggactgtaaaaatcgcagattttggtgttgctcgccatgaggctgcaaaccccagtgatatgacaggcgaaacaggcacccttggctacatggcgcctgaggttctcaacggcaacgcttacaacaggaaatgtgacgtctacagctatgggatctgcttatgggaggtctactgctgcgacatgccgtacgcggacctgagcttctcggaggtcacgtccgctgttgtttgtcagaacctgaggccggagatcccgcggtgctgcccgagcgcctttgcgaacgtgatgaagcggtgctgggacgcgaaccccgacaagcggccggagatggcggaggtggtgacgatgctggacgcgatcgacacgtccaagggcgggggcatgatccccgtggaccaggcgaggggcatcgggtgcctctcctgcctaaggccgcgcaggggcccctgacggatggatcacacggcgaggtggaggtagtgcctctctgcaatgttcagactgagcgctggatctcgcgttagttaattgcgtttgctttagttttaaggtacgcaagccggttgatgaagcttagctagtgtgcctgtgacccttggtttggcaagcagcccatctgatgtaaattcctgtgtctactaccccttgctgtttatctaagaaagaaccggctcgctcgtttatctatcagtctatgcttttctgtgctgaaaaaaaaaa

SEQ ID NO: 10626 - DNA, 1562 bp, Triticum aestivum
  Clone ID: PAT_TA_10626
ggctagctctgcctaactcgttcatcgatcctatctgagcttggctaatctcttcgattccacctgtaatttatggcgcggtcgtcgtctcctctcgtcaacaaggcttcgcccaccgagcagccccgcctgctctgcactcgccgttcttcaaagcgtgtcaccgctttgagcccggaggcgctccttgatgccacccttgccggcgtcgagcagcaggatgacgccggtgtcatcgctgccgccacggctctgaagcgagatgctactctctcagatgagaccctggcggttcacgctggggagaagatggggaagaacggagccatggacacagactcgatcgcgacacctattgtgagcggcacgacacactggttcaagagctcgggcgacctcgtcgcattcaaggaaggccggcgccacggcttcgagtacggccgctacggcaaccccactgtgaaggtcctagaggacaagatcagtgccctggagagggccgagtcgacgcttgtcacgtcctcgggcatgaacgccatcgtcgccacgctgcttgcgctcgtaccgcccggcgccggccacgtggtgaccacgactgagtgctacagcgaggcgcgcgccttcatccgcgacaagctctccaagatgggcatcaaggtgacattcgtcgagctgaacgacatggacacgctcaaggccgttcttgaccagggcgacgtgacactcttctacactgactgtccgacgaacccccacctcaagtgcatcgacattaagctcgtcgcggagctgtgtcaccgcaaaggggctctggtgtgcatcgacagcaccctcgcctcgcccatcaatcagaagccgctcaccctcggggccgacatcgtcgtgcactctgccacaaagtacattgccggccatcacgacgtcattgcaggatgcatcagtggctcggatgcgctcatctctaggatacgtgcgtggcatcacgacctcggcggcgccattagtccggacgcagcctacatgatcatacgcggcctcaagacgatggcgcttcgcgtggaaacacaaaaccacactgcattgcgcatggcgcgcttgctcgagaaccatcccaagatcgagcgagtgtactaccctggtctcctaagcagcccgtggcacgacattgccaagagccagatgactggttttggaggagtcatcagcttcgaggtagcctcagacctgcatggtgtcatgaggttcgtcgacgccctcgagatacccttcatcgcgacgtccctcggcgggtgcgaaagcctcgtgcagcagccggcagtcatgtccttctggggtcagagtgacgaggaaaaggcgaagaatgggatcaaggacaacttggtgcggttcagcttcgggattgagaagtttgaggatcttagggatgacattatccaagccctggagaagatttaggacacttcctgagcaaattagcaatgtagaaacccttctgtacatctgataggtagtcaatttccgctaaactccaacagagatgtaatggtaggattctttatttc

SEQ ID NO: 10627 - DNA, 374 bp, Triticum aestivum
  Clone ID: PAT_TA_10627
atagtcttgagatactgcatcgagtgtcaaatggaagcagcagatgaggagaggccactgctgaaccgccaccgccggcctgcactgtcacagggcggcagctcacgtggcacaggccacggctcggccggcatccacaggacagcccgctctcaagcagagcactggcaactggagagcatgcttcttcattctaggcgccgaattcagcgaatgcatgtgcttcttcgccgtcgccaagaacttggtcacctaccttacgacggtgctccatgagagcaacgtcgacgctgcgaggaacgtgtcgacttggatcggcagctgcttcctcacgccgggcatcggagccttcttggccgactcttactggggaa

SEQ ID NO: 10628 - DNA, 686 bp, Triticum aestivum
  Clone ID: PAT_TA_10628
aaaagtttcgtgaggacttgcataataaagtgaaattacaaatacagggcgccggtagaattgaaacacacaccgacacacgacacacaccgacgcatgaggtgtgggagccactgcatgaacagcagccccacttattcagcactcggaagctaagcacgcagagaaaatcacgcacaggcgagcacgagaccaggcccacgtcccagcctctctcactatggaacacacgtaacgtaagcacacgcacggccggcggcgaggccggccaccgcacgtcaacggtgatctagccgaagtggtggtgcttcttctcgccgctggcctccttggcctccttgtggtcctgcttcttctcgtggtgctcgtggaagacgaagccgccggcgccgacggctgcagcggcggccacctcctcctcgatcttgtgcttgtgcgcgtgctccttgtgcttgtggtgcttctcctccttggtgatccgctcgtactccccctcgttgccggtggcggtcaccaccgtctcggtcgagtacccgtacgtgtcgacgccgccgtcagcggcgggctggaagtcctcgccctccttgtggtggaacaggtggtggtggtgcttctcctccgccatggccgccggctgatcgattagctagctagcacttgtgtgtgtatgcgaccctcgtgccgaa

SEQ ID NO: 10629 - DNA, 1021 bp, Triticum aestivum
  unsure (1)..(1021): unsure at all n locations
  Clone ID: PAT_TA_10629
gctcgccttcctctcagcgcgcacgccggtttcgcggtttcttgcagcctataaatccagccggagcacccagctctgcccatcccatctcacacaccgctactcattttcttacctgacacacttcagtactgctgtccgctgctgctagctaccgtagttcacttccttcggatctcgtgccaccagtctcttgctggcgaagatgtctacggtgacccgcgcctacctcgaccagaggctcgccgctgccaagcgctgctccagagagccaaggccacggccgtcgccaccgtcgtcgccgccacagtccccaccctggcgagcgtgaggatgctgccgtgggccaaggcgaacctcaacccgaccgggcaggcgctcatcatctccaccgtcgccgggatggcctacttcatcgtcgccgacaagaccatcctcttcatggccaggaagcactccttcgacgacgcagcacctcaagaacaactccttccactaaaaaaaattacgctataatagctccattaatagtgcgtaataaaccgtgtccgccggtcggcctgtacatgtctgctgattcaactaggggaggcgttcaggcgaggcttgcagacagtgagtggtctactgcgcttctctgcgagcaagcacttatctgatcaagtaatcatcatgtatccaaccagtaattttgaattcataatgacttgtattttgtactggccacttgatcgttggtctcaagctcggctgcacttcacgatctactgagcggaaggcgggacaggaagcgggtggttgtgcgccgtcaggctgttgaccatgaaggccttgtcttcttccacggctgaacgccctccaatggtggaggagtggccatgggtagtggtggaagtcggtggctgcagtccggcagcagatccncctcctcccctggtgccgaacgtgttgggntcgncgaggctnaagccagaggtgagcaggggggtctcgaacagcagcatcaccaggtccttgacag

SEQ ID NO: 10630 - DNA, 477 bp, Triticum aestivum
  Clone ID: PAT_TA_10630
cacgcgatgttggtgttaacagctttgtgctatttccaaaggttcctgatggattaaagacgcaaactggagatgaggcatataatgataatggtttagtgccgcgaacaatccatctgctcaaggataagtaccctgacattgttatctacactgatgttgctttggatccgtattcttctgatggtcatgatggcattgtgagggaagatggagtcatcatgaacgatgaaacagtccatcagctgtgcaagcaggcagtttcccaggctcgagctggtgctgatgttgtcagtcctagtgacatgatggatggtcgtgttggagcaattcgggctgctttagatgcggagggtttccatgatgtctccatcatgtcctacactgccaagtatgctagttcattttatggtccattccgtgaagctttggattcaaatccacgatttggggacaagaagacttatcagatgaacc

SEQ ID NO: 10631 - DNA, 265 bp, Triticum aestivum
  Clone ID: PAT_TA_10631
ttcggcacgagggttggtgtcatcaagggcgtggagaagaaggaccccaccggtgccaaggttaccaaggctgccatcaaaaagacttgacactaaaacttctgctagataactcgatggcagacgttttagtgtcaagtcttttttggagaatcttagtgtatgttaagtgttattcctgggcgttgttgcactttgactcctgcacctgtgtgcgagctatgatgtgtcgtttaaatactctatttcgattccaaaaaaaaaa

SEQ ID NO: 10632 - DNA, 844 bp, Triticum aestivum
  Clone ID: PAT_TA_10632
ggttcgagggtgacaacatgattgagaggtccccaaccttgactggtacaagggccccacccttcttgaggccctggaccagatcaatgagcccaagaggccctccgacaagcccctgcgtcttccccttcaggacgtctacaagattggtggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaatgtcggcttcaacgtcaagaacgtggccgtcaaggatctcaagcgtggatacgtcgcttccaactccaaggacgaccctgccaaggaggctgtcaagttcgctgagatccagaccaagattgaccggcggtctggcaaggagattgaggcggcgcccaagttcctgaagaacggtgatgccgggttcgtcaagatgatccccaccaagcccatggtggtggaaacctttgcccagtaccctcccctgggccggtttgctgtgcgcgacatgaggcagacggttgccgtgggcgttatcaaggccgtggagaagaaggatccgaccggcgccaaggtgaccaaggctgcggccaagaagaaatgagatggtgtcaggttctttactgcatctatggtggtggtggcggtggcggtatttggtggtggtgatagttgttctagtcgttttgagaacttgttaagcttcggttatttgtgtcgagcagtgttggaactgcttattgctctggtcattgtatcgttcggttgtgttggggaactatgt

SEQ ID NO: 10633 - DNA, 617 bp, Triticum aestivum
  Clone ID: PAT_TA_10633
tcggcacgaggggcgggagtaactatgactctcttaaggtagccaaatgcctcgtcatctaattagtgacgcgcatgaatggattaacgagattcccactgtccctgtctactatccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtgtctgccatcgagttatctagcagaagttttagtgtcaagtcttttttggagaatcttagtgtatgttaagtgttcctgggcgttattgcactttgactcctgcaccctgtgtgcgagctatgatgtgtcgtttaaatactctatttcgattccattattgtgctcttatcccattaaaaaaaaaa

SEQ ID NO: 10634 - DNA, 599 bp, Triticum aestivum
  Clone ID: PAT_TA_10634
gccggccgggttcgggatctcatctcaacaccactactcatcttgcctcacacacttcactgctagctactagttcatttgcttgcgttctcgtgccaccaacctcgatcgccaagatgtctacggtgagctgcgcctacctcgaccagaggctcgctgccgccaaccgctgctccgaagaggctgccatggccggagccaaggccgcggctgtcgccaccatcgccgccgcagtccccaccctggcgagcgtgaggatgctgccgtgggcgagggcgcacctgaacccgaccgggcaggccctgatcatctccaccgtcgccgggatggcctacttcatcgtcgctgacaagaccatcctctccatggccaggaagcactccttccaggatgcgccggagcacctcaagaacacctccttccactagttagatccattattagtaatcccagtaaaccttgtgcgccaaagtgcatagcgtacagtgatcagcaagggaggtcagggatgctcctggatagtcttgtactgcgagtgcaatttctcatttcataatataattttcatcatacaaaaaaaaaaaaaaaaaaggccccta

SEQ ID NO: 10635 - DNA, 584 bp, Triticum aestivum
  Clone ID: PAT_TA_10635
gtgacaaattatatatgttccttgatatatatatagcactatcaagtcccaactttctcaacagtacattattggtactagttcagtgtactctgctttttatacccctgatgatgcaagagagaaacagagccaccaatcaaacatgacaacttcacacaaatttattcttagtgctggctactcggccgttggtcccaagctcggctgcacttcatgatctagtgaccggacggcgagacaggaagcaggcggtcgtgcgcccgcaggctgttgatcatgaaggccttgtcttcttccacggctgaaggccttccagtcccgtcgtatcctccagtggtggaggagtgggcatgggtagtaatggaagtcggtggccgcagtccggcggcagatcctcctcctcccctggtgccgccgatgtagggctgggcatggccgccgaccacgagctggctgcagacgagcgccagaaggaccagagctgggaatgccttggacgccatctctcttggtttctttactttgctcggctgctctgctcttctatgtgtctgtggtgtgtgttcccaaacccggccggc

SEQ ID NO: 10636 - DNA, 536 bp, Triticum aestivum
  Clone ID: PAT_TA_10636
cccaaaagtttcgtgaggacttgcataataaagtgaaattacaaatacagggcgccggtagaattgaaacacacaccgacacacgacacacaccgacgcatgaggtgtgggagccactgcatgaacagcagccccacttattcagcactcggaagctaagcacgcagagaaaatcacgcacaggcgagcacgagaccaggcccacgtcccagcctctctcactatggaacacacgtaacgtaagcacacgcacggccggcggcgaggccggccaccgcacgtcaacggtgatctagccgaagtggtggtgcttcttctccttggtgatccgctcgtactccccctcgttgccggtggcggtcaccaccgtctcggtcgagtacccgtacgtgtcgacgccgccgtcagcggcgggctggaagtcctcgccctccttgtggtggaacaggtggtggtggtgcttctcctccgccatggccgccggctgatcgattagctagctagcacttgtgtgtgtatgcgaccctcgtgccgaa

SEQ ID NO: 10637 - DNA, 535 bp, Triticum aestivum
  Clone ID: PAT_TA_10637
ctttacttgtaacaatttacaatttatgagtttagctcttacaatttgcaatttgcatggactttggaatactccaagccttgttcaccttgttaaaccacccgtggaatcctgagctccagccttgttcaccttgacatgtccactgatactgcacaatacatcacgctgttcatgcacgcccacaggctacgacttcctatgcctcgtatttgcagatgttctcgaatcccatgtactcatgccgctcgatcttgtggatcgtgttggagatgccgactccgcctagagagagcgcgctgatgaagatcatgaaggacagtatgaagacgatgatcgacgcccgccctagcagatcaattagcttcctcacaaccctctggccgacgatcgcagcgaaaaatgccaggatggtcaagtagacagcatatggcacagggaaccggttcaggaggtagtactctacgacggacatggaagatgagaacatcatcgcgaaggtggcggtggcacttgcgacttgcggagggacgcc

SEQ ID NO: 10638 - DNA, 754 bp, Triticum aestivum
  Clone ID: PAT_TA_10638
gcttactgtactaccggttcatttccttgcgatctcgcgccaccaagctctgctcctgcgaagatgtgtaccgtaacccgagcccacctcgaccaaaggctcgccgccgccaagcgctgctccagaggtaaccaacaaacgatatcatgccccgccggtcctccaggacggttcagggcacattgcagctttgtgtactgtctgtgctgaaacttgctagtcggtaacatgcacgccattgttgatacgtaactgcagaggcagccattgcgggagccaaggcggccgccgtcgccaccgttgcaaccgcagtccccaccgtaagtacacgtttctcagccggcaccgctatcttgcaagcatccccaagatccaacaatcatgcatctcaccgtcttcttcctccgtgcctttctctgcagctggcgagcgtgaggatgctgccgtgggcgagggcgcacctcaaccccaccgggcaggcgctcatcatctccaccgtcgccgggatggcctacttcatcgtcgccgacaagaccatcgtatcaatggccaggaagcactcctacgaggacgcgccggagcacctcaagaacacctccttccactaattagcctattgtagatccattagtatagtgcgtaataaaccgtgttctgctgaagcctgaaagatggtataatgttcagcgagagggtataattattctgatgaatgtatgtaataatgtggccatgttctccatcttgtcatctt

SEQ ID NO: 10639 - DNA, 773 bp, Triticum aestivum
  Clone ID: PAT_TA_10639
cgcacccctctcggacggctggtgttcaagaccgacgacatggttcaggtggtggaagcccccgacatcgtcaggaacaaggtctccttctccatctttggcctcgatggcgcggtgtctctgacaggttaaccacatgttggttcttcactcatggggtgtagacactgcatattgtccagagtagaagttcaggctggctgtgagcactgtgtggttgccacaaaaatacagatatataagattgcgggtaatgtgccagtgatcttttgattccgtggtgtcatgcaggcaagctgaatgtattggacagtaagtggattcaggtcatatttgagcccccggaactgaaggtaggctccttgggtttccgatatggtggcgagagtgaggtcaagctggaaatcacctatgtcgatgagaagatcaggctcgggaaaggatcccgaggctcgcttttcgtcttcctgagacaagattagaagggtaggttgcatattttgcatgtgctcgacgccacaagggatatcggccatatgggcgtctacgcaactgcttgcagatgtaaattcagagataaagcccacaaagtagttttttatgatattcatttctaccttaagcagattgccttgttgtgagcgaaaatgtttgcggtactcatgctgatcttgtttctggatgtacttatgataatactggggtttgagcaggacgatattagtttgagaatttgatattctggctaactgttaaaaaaaaaaaaaaaaaaa

SEQ ID NO: 10640 - DNA, 783 bp, Triticum aestivum
  unsure (1)..(783): unsure at all n locations
  Clone ID: PAT_TA_10640
ccgccgtcgcctcctcctctcccgcctgcgtcgcatcgccaccgccttcgccatggggagacgacctgctaggtgctaccgccagataaaaaacaagccataccccaagtcaaggtactgtcgtggtgtacctgacccgaagatcaggatctatgatgttgggatgaagaagaagggagtggatgagttcccctcctgcgtccacctggtcagctgggaaaaggagaatgtctctagcgaggctcttgaggctgcccgtattgcttgcaacaagtacatgacgaanaatgctggaaaggatgcgttccacctgagggtcagggtccatccataccatgtccttcgtatcaacaagatgctttcatgtgccggngctgataggctccagactggaatgaggngtgcttttgggaagcctctgggtacctgtgctcgtgtggacattggccaagtactcctatctgtgcgctgcaaggagagcaatgctgntcatgctgatgaagccctccgccgtgccaaggtcaagttccctggccgtcaaaagatcattcgcagaaggaaggggggctttaccaaggtcaacagggctggatacatcaagtacaagaagggggggagaattcggcctggagggggcaaaggttagcttgttgggggccatgggccccatggtaaccgcgcccttggcagggcaatcctggtttgggggcatttaaaccatgcccagaccatttcctttgttagaatgaacccaaggagttttgtttttgttttaaccagata

SEQ ID NO: 10641 - DNA, 424 bp, Triticum aestivum
  Clone ID: PAT_TA_10641
gtatcatttcactgctaatactagctcactttcttcggatctcgctcgttccaccaagctactagtccctcgaagatgtcgatggtgacccgtgcctacctcgaccagaggcttgccgccgccaagcgctgctccagagaggctgccgtggcgggagccaaggccgcggccgtcgccaccgtcgctgccgcagtccccaccgtaagtaaccgttcagttcttcagttccagagttcatagcacatatctcatgattgcgtaatcatcatgtatccagccagtaatcttgaattagtaataacttgcatttgtacagatcagattcacctgccatcacccatcttacattttcatgtttgtggttatcatttgtcatgtggccagtggcagatcctgcacaagacccaaataactctgcattctt

SEQ ID NO: 10642 - DNA, 848 bp, Triticum aestivum
  unsure (1)..(848): unsure at all n locations
  Clone ID: PAT_TA_10642
ccgaggtcatcatcatgaaccaccctggccagatcagcaacggctatgccccggtgctggactgccacacgtcccacattgctgtcaagttcgctgagatccagaccaagattgaccggcggtctggcaaggagattgaggcggcgcccaagttcctgaagaacggtgatgccgggttcgtcaagatgatccccaccaagcccatggtggtggaaacctttgcccagtaccctcccctgggccggtttgctgtgcgcgacatgaggcagacggttgccgtgggcgttatcaaggccgtggagaaaaaagatccgaccggcgccaaggtgaccaaggctgcggccaagaagaaatgagatggtgtcaggttctttactgcatctatggtggtggtggcggtggcggtttttggtgggggggcttggtgtatctggctgtttgtggacccnnnaaggcttcggattcttgattcgagtcgtttcaggattcgactttcagtttttttctttatgtgctatcgatttcgtttcggcttttctatatccaattttgaaattctgatttcatattccgtattggtatttttgatatcgatttctttattcgtacatttgaatccgcttttcgtcaattcttactgcatatatggtattattgtaatttgttcatcgttgtatctcggattatgtcaattcgtatttctttatttccgttttccggaatttggaaatttggaacaagtcattccgacatttttctttctcgtgttctcagtaatttcgcttctctccgtattgtcgcatgattcttaaataattgttacatctgagtattgtacgatgtttgcg

SEQ ID NO: 10643 - DNA, 653 bp, Triticum aestivum
  unsure (1)..(653): unsure at all n locations
  Clone ID: PAT_TA_10643
ctcacacactactactacggatctcagccaggagtactcgagttcactagctagctactagttcacttccttcggcaccaagctctctccggcgaagatgtccacggtgacccgctcctacctcgaccagaggctcgccgccgcccagcgctgctccaaagaggctgccatggcgggagccaaggccgcggccgtcgccaccgtcgctgccgcagtccccaccctggcgagcgtgaagatgctgccgtgggcgagggcgcacctcaaccccaccgggcaggcgctcatcatctccaccgtcgccgggatggcctacttcatcgtcgccgacaagaccatcctctccatggccaggaagcactcgtacgagacggcgccagagcacctcaagaacacatccttccactaattagacactggattagccagtgccaataaagtgtgtacgcaggcccgtacgtgtcttctgaaacatatagtaatataatggtgagcgaggcgatggttgtgtgccgaaaggtggtgtataaccttttctgcaagcaggcactaattatctgatgatttatgaaggaagacctccataataatgtggccatgtnccccatcgtactagtatctttccaaagggtatggattcattaccaacctta

SEQ ID NO: 10644 - DNA, 840 bp, Triticum aestivum
  unsure (1)..(840): unsure at all n locations
  Clone ID: PAT_TA_10644
tgaggccacatcgtcttctcctcatcttcttctccatcttccatccatcagataggccatggcttccaccgtccccttctccccggccaaggtccagatgctccaggcgaccaactgccacgggcacgccccgttcggcagctctttcgccgtcccaagaaccgggccaaagcagcgttccctggccgtcagggtcagcagcgagcaggaggcggccgccgccgtcagggcgccgtcggggaggagcatcgaggagtgcgaggccgacgccgtcgccggaaaattccccgcccccgctgcgtttgtcagaccaaaggccccagacggcacgcctgagatcaggcctcttgacatgccaaagcgccctcgtcgcaaccgcaggtcgccagctcttagggctgcattccaggagacaaccatctcgcctgcaaatttggtgctcccattgttcatccacgaaggggaagaggatgctccaattggcgctatgcccgggtgctttaggctttgatggcaacatgggcttcttgatgagtgtataanggacgtgattgtgtgttaacannnttgtgctctttccaaaggtccagatgcattgaagtcttcgacaggaattgaagcatacaatgaccatggttggtttccacgtacaattccgccgctcaaggtaagttccctgatatcaatggctaccacgggtgttgctttgggcccctattcatcttgatgggcaatatggctctctgaggggaagattggttattttttaccgatgaaaccgtgtttttatgatggccaacaaggcgcgtttcacagcaccctccttggtccccatatatt

SEQ ID NO: 10645 - DNA, 483 bp, Triticum aestivum
  unsure (1)..(483): unsure at all n locations
  Clone ID: PAT_TA_10645
tggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgttgagaagaaggacccaaccggggccaaggtgaccaaggctgccatcaagaagaagtaattccacaattggatatccaaatcactgtttcaagacaccaagcatttttaagtattgggctgattttgttaaagggattgttccgtactggggtatattttactgttcaactgttaagcgctgcatacgtgcccttgggtggtgctgtccttgtgcctttacatactgtccctaatgtaactttgggtgaaacctggatgttatgaactgggttgtgncttttaatactaacttgttcatttacctgtgtaaaaaaaaaaaa

SEQ ID NO: 10646 - DNA, 622 bp, Triticum aestivum
  Clone ID: PAT_TA_10646
ggcgccggtagaattgaaaacacaccgacacacgacacacaccgacgcatgaggtgtgggagccactgatgaacagcagccccacttattcagcactcggaagctaagcacgcagagaaaatcacgcacaggcgagcacgagaccaggcccacgtcccagcctctctcactatggaacacacgtaacgtaagcacacgcacggccggcggcgaggccggccaccgcacgtcaacggtgatctagccgaagtggtggtgcttcttctcgtggtgctcgtggaagacgaagccgccggcgccgacggctgcagcggcggccacctcctcctcgatcttgtgcttgtgcgcgtgctccgggtccttcttcgcctcgtgcttctcgtagagggcgaaggctccggcggcggcggcgcccatctcgccgaggtgctccttgtgcttgtggtgcttctcctccttggtgatccgctcgtactccccctcgttgccggtggcggtcaccaccgtctcggtcgagtacccgtacgtgtcgacgccgccgtcagcggcgggctggaagtcctcgccctccttgtggtggaacaggtggtggtggtgcttctcctccgccatggccgccggc

SEQ ID NO: 10647 - DNA, 586 bp, Triticum aestivum
  unsure (1)..(586): unsure at all n locations
  Clone ID: PAT_TA_10647
atcagctaggagtactcgagttcactagctaccagttcgcttccttccttcggcaccagactctctcccacgaagatgcctacggtgacccgtgcctacctcgaccagaggctcgccgtcgccaaccgctgctccaaagaggctgccatggctggagccaaggccgcggccgtcgccaccgtcgctgccgcagtccccactctggcgagcgtgaggatgctgccgtgggcgagagcgcacctgaaccccaccgggcaggccctcatcatctccaccgtcgccgggatggcctacttcatcgtggccgacaagaccatcctctccatggccaggaagcactccttccagaacgcgccggaccacctcaagaacacctccttccactgattaggcagtagatcctgtagtataatgtctgctgaatccaccatgggtagtgcgcaataaacttcacgccgacccgtacggccgtacttgtctgctgaatatacatatatattcangagagagcaggcatcaataggcttggctcatcctnnagcactatcgtgtaatncagtaccagcatattctgantaagaaacag

SEQ ID NO: 10648 - DNA, 603 bp, Triticum aestivum
  Clone ID: PAT_TA_10648
cgcttgctcaaggacaagttccctgatattgttatctacacagacgtcgcgttagacccttattcatctgatggtcatgatggtattgtgagggaagatggtgtaattatgaatgatgaaacagtttatcagttgtgcaaacaggctgtttcacaggctcgtgccggtgctgatgttgtcagccctagtgacatgatggatggccggattggagcacttcgctctgctctggacgccgagggcttccatgatgtctccattatgtcctacaccgcaaagtatgccagttcattttatggccctttccgagaagctttagattcaaatccaagatttgggagataagaagactaccaagatgaacccagctaactacagagaagccctcatagaaaccgcagcggatgaggcagaaggagctgacattctgcttgtgaaaccaggattaccttacttggatatcatccgacttcttcgggataattcagccctaccgattgctgcttaccaggtctccggcgagtactcgatgatcaaagctgccggtgcgctgggcatggacgacgagcagaaggtgatgatggagacactcatgtgcctccg

SEQ ID NO: 10649 - DNA, 1036 bp, Triticum aestivum
  Clone ID: PAT_TA_10649
atttacaaggactttggaatactccaagccttgttcaccttgttaaaccacccgatggaatcctgagctccaagcctttggtcaccttgacatttccaaagtccagtgtactgcacaatacatcactctgttcatgcacgcctgcaggctgtggcatcctacgcgtcatatttgcagatgttctcgaatcccatgtactcatgccgtgcgaacttgtggatcgtgttggagatgccgactccgcctagagagagtgcgctgatgaagatcatgaaggacaatatgaagacgatgatcgacgcccgccctagcagatcaattagcttcctcacaaccctctggccaatgatcgcagcgaaaaacgccaggatggtcaagtagacagcatatggcacagggaaccggttcaggaggtagtactctacgacggacatggaagatgagaacatcatcgcgaaggtggctgtagcacttgcgacttgcggaggaacaccgagctccaggaagagaggccccatgatggagcccccaccaacgccaagcagaccggcgacgacaccagcagtgacgcccaagaagcagtataccaatagctgatgagctctcaggctgttatgctcgttcttctttgatgatatcaccctcctcccctgcaccaaacctactgcttcgtacatggccaccccaacagacacagggatctggagtaagttcagaacccagtaccagatggagcaagttgccatgtagttcttagtgacttgaagcgcaaggaatgctacccaaacgaaggcaagaaggccaacctccttccagtaaacattcttccaaatggataccgcttcgtctgatggggtttcattttgatcatcatctgacagaatttcagactgagatgcggcgtcaagtcctgcagacagcggcatgtacacctgttcttcgtttgtttgctgtgattgttttgctgtctccgttatgattatcgtctctttcttccatgtttctacagccttcagaaaagctttggtcctcgtgc

SEQ ID NO: 10650 - DNA, 613 bp, Triticum aestivum
  Clone ID: PAT_TA_10650
ttttttttttttattcattttgatgacaagtatttttcggacggagggagtacatggctagctcctcgtcctggaagcatcaagcaacagccagccagccagccaacccatctcatctcactctttttactgagccgtttcagcacaagaccacggcgaagatgtcgtcgacggccaccgtcacacgcgcccacctcgagaacaagctcgccctcgccaaacgctgctccagagaggcgacgttcgccggagcaaaggcggcggccatcgctactagctcctccgtccgggaattgctgattttcacgcacgttggtctggtttccataactgaaatgttaatcgtgcagctggcgagcgtgaggatgctgccgtgggctaaggcgaatctgaaccccaccggccaggccctcgtcatctgcaccgtcgccggcatggcctacttcgtcgccgctgacaagaccgtcctgtcgctggcgaggaggcactcatacgagaccgcccccgaccacctcaaggacacctccttccatggcggcgccgccgcagctcgtccccgtccgcggtccgccggcattcctcaggccttgagctagcttccggctaatgtatg

SEQ ID NO: 10651 - DNA, 671 bp, Triticum aestivum
  Clone ID: PAT_TA_10651
agctcgaaattaaccctactaaagggaacaaaagctggagctccaccgcggtggcggccgctctagaactagtggatcccccgggctgcaggaattcggcacgagctcactactactgctgatacttcactgctactaccagttcacttccttgggacctcggccaacatgtcgacggtgacccgcgcctacctcgaccagaggctcgccgccgccaaccgctgctccagagaggctgccatggccggagccaaggccgcggcagtcgccgccgtcgctgccgcagtccccaccctagcgagcgtgaggatgctgccgtgggcgagggcgcacctgaacccgaccgggcaggcgctcatcatctccaccgtcgccgggatggcctacttcatcgtcgccgacaagaccatcctctccatggccagaaagcactccttcgaggacgcgccggaccacctcaagaacacctccttcaactaattaggctataatctgcacgccggcctggaagtatctgctggaagatactagtataatgttcaagcacttattcgagatcaggcgagccttgcagacagtcagtggtgtagtattgcgcttcgctgcgtgcaacttatctgatgaagtaatcatcatgtatccagccaggtaatcttgaattaataatgact

SEQ ID NO: 10652 - DNA, 625 bp, Triticum aestivum
  unsure (1)..(625): unsure at all n locations
  Clone ID: PAT_TA_10652
cccccccctcgtgccgaattcggcacgagagcatttagacttgatagcatacggacaccaaaatttaagcacgcatcgcgttacagcantaggcgatgaaatattcaggaaacataagactcaaggtttcagtttaaacgacaaacgggacacatctaagtgagttcgactctcgataggtaggtaaaagagcagagcaatcgcaagcaacctctctcgtgccgaattcggcacgagctcgtgccgaattcggcacgaggtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggcgccaaggttaccaaggctgccatcaagaagaaataggcgcgctatcttgcagaaggattttgttcacggtcattgcttttgttgcttcagactcttatcccgagcgagcaatgatctgtctgtcgtttaattactgtatttctattcctgcttcggctaaactcctgtgcccctgagactgatttgttgtgaaatgcaagttattagattgcaccnccanacatt

SEQ ID NO: 10653 - DNA, 912 bp, Triticum aestivum
  Clone ID: PAT_TA_10653
gcggccgcgtcgacactaattcacttccttcggatcccgctcgtgccaccaagctctgctcccgctaagatgtcgacggtgacccgtgccaacctcgaccagaggctcgccgccgccaaccgctgctccagaggtaaccaccgacgaccggttccggccacagcccagcactgctctgctcctatatcccaaccatccattgcagcttatgtgtctgctgaaacttgatcttgattaacattcctgcgttggtctgaaactgcagaggctgccatggcgggagccaaggccgcggccgtcgccaccgtcgctgccgcagtacccacagtaagtagccagctagccattcagttccagagttcatagaacacatctcatgaatcaacgcgttacctgtactgtaatttcagctggcgagcgtgaggatgctgccgtgggcgagggcgcacctcaaccccagcgggcaggcgctcatcatctccacggtcgccgggatggcctacttcatcgtcgccgacaagaccatcctctccatggccaggaagcactccttcgacgacgcgccagaccacctcaagaacacctccttccactaattagcccacaatagatccattagtggcgcgcaataagatactccctctgtccggaaatacttgtcgaaaaaatggatatatctagtcgtattttagttttagatacattcatttttacccgttttcgtgacaagtattttcggacggaggaagtactactattactagtagtataatgttcaacaattatgtgacatcacgcgaggcttgcagacagcgagtgctgtactgcgctgctctgcgtgcagaagcactaatctcatgtatccgtgtatccagccagtaatcttgaattaataataacctgcatttgtac

SEQ ID NO: 10654 - DNA, 873 bp, Triticum aestivum
  Clone ID: PAT_TA_10654
gaaatcagaacggtcatgtttcttctgccccttgataatttacacgtacggcacattcgtactctcatacttttccccggtaaaattcacacagcacatgatgctgcatcgcgcgcatgcagctgatcatcaacagccgacggcggcggacgggcaattaacggccagctcacaggctgggcaccctctcggcggcgccggagatgacggtgagcaggttgttgccgaaggggtcactgaggtgcgcgcacaggttctcgaaggggccctcgccggtgacgtaggcctggatgaagaaccccagcatggagaacatggccagccgcccgttcttgatctccttcaccttgagcagcgccgcctggtccgggtcggtggcgaggccgagcgggtcgaatgggccacctgggtggagcttgtcatcaaattcctgccggagaagttgacgaaaccgttggtcagtacaaggacgcctagctgcggcaacgaatatctatgtttcaggatactgaccagtccgttggtgatcctgtagtactcggcgcctccgacgaggacgacctcggcgacgacggcgaggatcaggttgatggggatgctgttgccgaagtagttgagggtgttgccgtcgaggagaagggcgccggtctgcaggatgttgtttatggcaccgtgagttcaaacttccaaagttctgaatctgaagccgtgaaaactgacgaccagcattcagcaattactaccttgaaccaaacggcctcggggccgcagtttgcgccgaacttgttgagcgcctcggggatgatgaatccggcggcgccgagcatggcccacctggcatgccatgagctcaaaggcctggcggacgcgtgg

SEQ ID NO: 10655 - DNA, 588 bp, Triticum aestivum
  Clone ID: PAT_TA_10655
gattcggccgaggtttcccagaggctacgctcgccggagcaaaggctgcagccgtcgccaccgtcgcgtctgcggtcccaacggtgagctcctccgtctgggatttgttgattttcatgcaagttggactctggttttcataactgaactgttaatcgtacgtgcagctggcgagcgtgaggatgctgccgtgggccaaggcgaacctgaaccccaccggccaggccctcattgtctgcaccgtcgccgggatggcatacttcgtcgccgccgacaagaccatcctctcgctggcgaggaggcactcgtacgagagcgcccccgaccacctcaaggacacctccttcgctggcgctgccgccgctcgtccccgtccaccggcattcttcaggccttgagctactgtcctgctaaagtatgatacgcacgcttgccgttgatgcgtattcctagaaaaaacgcatgcaccgttgtctgtcagtgtcccaagaaactgctgcggcatgaatatctgccgacgaaatgtatgcacatgctttacatctgtgatctgtgtactggataaaaaaactcgtgccgaattcctgc

SEQ ID NO: 10656 - DNA, 500 bp, Triticum aestivum
  Clone ID: PAT_TA_10656
acgagcgggagcccaggccgcgaccatcgccaccctcgctgccgcagtccccaccctggcgagcgtgagtatgttgccgtgggcgagggcgcacctgaaccccaccggccaggcgcttatcatctccacggtcgctgggatggcctacttcatcgtcgccgacaagaccatgctgtccatggccagaaagcactccttcgaggatgcgccagagcacctcaagaacacctccttccagtagtcagactataatagatccattagtagtgcgtaataagctgtatacgccagcccgtacgtgtctgctgaaagatggtgtataacgttcagcacttatgcgagatcaggcgaggcttgcagacagtgagtggtgtggtgtattggtcttctctgcgtgcaattagcacttatctgatcaagtaatcatcatgtatccagccagcagtaatcttgaattaataacaacttgcgtatgtctaaaaaaaaactcgtccgaatcg

SEQ ID NO: 10657 - DNA, 480 bp, Triticum aestivum
  unsure (1)..(480): unsure at all n locations
  Clone ID: PAT_TA_10657
ggtcgcggaaaaaaaattaaacaaaaataaaaaaagagggggcgaggaagaaaccgaaacactcacacagaacaccacaccccccaccccggcgacacaccacccctcccaccccaaatctcagatcagagcgccgggagatctgccatttccgggtggagggatcgagccccgcgcttctcgagtaaggattccgcctccccccccccctcccttccgccgcaagccttttcggggggacgcgcgatctggcgcgggtttttggcgcgagcagctgcgatttgggggcgggttcgttggtcggtttgctggatttaggagggggttccgggggngtnggagttgccctcctgggagcaactcccctgatgggggtttccgtggganggagcatccgggactattnagcaagggnaagggtttttgttttagcaaaacccgtccgggattcangtaagggtttttttgtaacaanaagcg

SEQ ID NO: 10658 - DNA, 402 bp, Triticum aestivum
  Clone ID: PAT_TA_10658
ttcgagcggccgcccgggcaggtacctcccaggctgactgtgctgttctcatcatcgactccaccactggtggttttgaggctggtatctccaaggatggccagacacgtgagcacgctctccttgctttcactcttggagtgaagcagatgatctgctgctgcaacaagatggacgccaccactcccaagtacaagtccatgctgttctttgacgacgaggacaggaatattcaatcggtatcgaaaatgggagttacaagtgttctagtaaacaacggattgaatctcgacatgtttaagttgggcctcagtaatttcgctactactgttgctgcacctgaacccacacctgcaccagaggacaagtaaaccttattgtacctcggccgcgaccacgcta

SEQ ID NO: 10659 - DNA, 559 bp, Triticum aestivum
  Clone ID: PAT_TA_10659
gctctactcatcttacctgacacacttcacttccttcggatctcgtgccaccaagctctgctcccgccaagatgtcgacggtgacccgcgcctacctcgaccagaggctcgccgccgccaagcgctgctccaaagaggctgccatggcaggagccaaggcggcggccgtcgccaccgtcgctgccgcagtgcccacactggcgagcgtgaggatgctgccgtgggcgaaggcacacctgaacccgaccgggcaggccctcatcatctccaccgtcgccgggatggcctacttcatcgtggccgacaagaccatcctctccatggccaggaagcactcctttgaggacgcgccggagcacctcaagaacacctccttccactaattagactataaaatagatccattagtagtccgtaatagtctgcacgccggactggaagtgtctgctgaaagatggtattgtaatgttcaggcagcacttctatgaaatcaggcgagtggtgtagtactgcgcttctttgcccgcaagaacttatctgatgaagtgatcatgtatcc

SEQ ID NO: 10660 - DNA, 664 bp, Triticum aestivum
  Clone ID: PAT_TA_10660
ttttttttttacggcaaaattataggtttgctaccatataccaatactgtcaattatcatcaccacaacgattggaggctgaaagcaaagtaaaataaggttcaacgacaacgagacgacaatagcataaacgctaacacagcaatggattcaaccggtccatgaaactgactagtagcactctagttcttgatcttcttcttgggcctcagctggttgctgtggccacacttcttcttgcggcagttgacagcccttgggtgcaggcgcgcgtagcatttgcggcagatcatcttctcctggttgtacttgcgggcaagagcctgcagggatggctcgatgatgcctccgcggagcctgaggacgagatggagggtcgatgtcccggaggctctcgccggcctcgtccgacgcgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaagcatatgactactgc

SEQ ID NO: 10661 - DNA, 410 bp, Triticum aestivum
  Clone ID: PAT_TA_10661
ttttttttttgcaggttatgggtgacggtagcgttcgcttcacacaagcatacacaagtaaccatgaacatgaacaggcacacgaattgcaaggttcacttcagttctgaagttcaaacgaggccaagaactcacagctaagtttaaccaatgttcaacatcctgacatgaggggcagcaaaacgataaccggaaaccatttttatgtctactggtgatttatccagacaacgaaatttacgaacgagctctagttcttgatcttcttcttgggcctcagctggttgctgtggccacacttcttcttgcggcagttgacggcccttggatgcagcctggcgtagcacttgcggcagatcatcttctcctccgcttatttatatgcttaaactcagcgggtagtcccgccc

SEQ ID NO: 10662 - DNA, 540 bp, Triticum aestivum
  Clone ID: PAT_TA_10662
aaaacagaatagcatcgtcattagcataattcataactagagaacaattcgttaactgaatcatataactcggcgaacacagtatttgcccatcaggttcagaacacggaagcaaactactaagcataggatactactagtactaagcatggaaggcacagaacccaaatcaactacagctttctctcctccttcgatttcttgaccgcgagccagggcttgtgcgccagggccagccagcgccgcggctcttcagccgccgaagccgtacagggtgcggccctggcgcttgagcgcgtagacgacgtccatggcggtgacggtcttgcggcgggtctcctcgtagatgagccccgagatgcgcttcacgccgcccctccgggccagcctccggatcgccggcttggtgatgccctggatgttgtcgcgcaggaccttgcggtggcgcttcgcgccgcccttgccgagccccttgccgcccttgccgcgccccgacatggctgcctgctccgagtagacttgggaagagaggggatttgc

SEQ ID NO: 10663 - DNA, 555 bp, Triticum aestivum
  Clone ID: PAT_TA_10663
cgcaaatgcgcctgtgaaggacgaatcgatgtcggacgtgaacgaccgtgaaggaagcaaggcggcggccagcggtggcacgcagcacgacaagctgtacactgctgagggcatccttgacccccgcaagaagaaagcggagaagaagcggcgcaaggggaacaagttcagcgtgctgaacgacatggacgcggactacgacttcaaggtggattaccagatgaaggatgcctcccccgcggacgacgaagatggcgatggcggcaagggcgaaggcgaagagcccaagggtgaagacgacaagaaagacgcccctgctgcggagtgcgagcccatgacgagttgatgatgcctgaggtaaaaccgcaggttttgggagtgcggattagtagggagggttgtattacaactgtatgatgtgggctgccaacaattggcaggagttttgtacgccgttaggtttaatgatgaagacagatgcaacaaatgggatgatgcttgttttttcccctcggttttttttgtcttgataaattaaaaaaaaaaaaaaaaaaa

SEQ ID NO: 10664 - DNA, 573 bp, Triticum aestivum
  Clone ID: PAT_TA_10664
tagcgtggtcgcggccgaggtacaagattggtggcattggaactgtgccagtggggcgtgttgagactggagtcatcaagccaggcatggttgtcacctttggtcctactggcctgaccactgaggtgaagtctgttgagatgcaccatgagtctctcctggaggcgcttcctggtgacaacgtcggcttcaacgtcaagaacgtggccgtcaaggatctcaagcgtgggtatgtcgcttccaactccaaggacgaccctgccaaggaggctgccaacttcaccgcccaggtcatcatcatgaaccaccctggccagatcagcaatggctacgccccggtgctggactgccacacgtcccacatcgccgtcaagttcgctgagatccagaccaagattgaccggcggtctggcaaggagattgaggcggcgcccaagttcctgaagaacggtgatgccgggttcgtcaagatgatccccaccaagcccatggtggtggaaaccttcgctcagtacatatatacatattcagcaagtaagtagatcttgtagtagtacctgcccgggcggccgc

SEQ ID NO: 10665 - DNA, 353 bp, Triticum aestivum
  Clone ID: PAT_TA_10665
acaatcagaagttcacttatccaaacgagtgtctgacaaccctcacaccatacatacacacttcagagttttacgagatacccatcgtgatggcccagggggcctgggtacctcttacaaggtcttatggatagtatgtatatagcaaaattaaacgaccatactttcgcaaccattcttcttcaggcgatgcttgtcctcctcaagattgtgtaggacttggcgtcacgcagcaaaaccacttctttgaatttgccttggtggcataagcttccaccctctcagtcctggcgtctttgcaaggggattcggtatcttgtccattcccagacctgcccgggcggccgctcgaa

SEQ ID NO: 10666 - DNA, 452 bp, Triticum aestivum
  unsure (1)..(452): unsure at all n locations
  Clone ID: PAT_TA_10666
tcgagcggccgcccgggcaggtgagagaactagtctcgagtttttttttttttttttttttttttttttttttttttttttttttcaatttaagctgtgaattcttaaattacacctcagtgtaaccacaaacggtgtctcttatttgttcagcttgaagcacaaacttcaaaaccacagtactacaaatacagtgcatacatcaagctgaaatcaataacacacacacagcacatacactgcaaaccacaacatccacaaattgctaacacatctgataccaggaacaggaacccatagctgcagcttcatcaaaccaggttgcaataacattcagtcgggcgcaacttacagggtaacaccagggacgngaacccattccaagctgtaagcaccgacagagccactgtcaanattcttcagcttcagaatcaagtnttggacgancttgc

SEQ ID NO: 10667 - DNA, 630 bp, Triticum aestivum
  unsure (1)..(630): unsure at all n locations
  Clone ID: PAT_TA_10667
ttttttttttcagcatagaacttgatttatttataagggtacgtatgagacgacacacaacaccaccacaaccttattacaatgaggtacgtacatacagacgtacaatacagtagggaaggaggtcctccagagccttgtgtgagctatgctcattctggatggcattgcggcaggtgaggtgatcggctatcacacatactagcagaaagcgtcatagttatttatcccactgatcggctatctcgatacggtcgatgattagccgtgtaggtggtaatcgtcgagtgcagaacgacgacgaacccgggcgcgggttctaacatgtagaacgntcgcggtggatgtcaaanttgcaagcagaagacagctggggttcccttccaacccggctgagttggcccaccttgcggatgcagccgccggcggggccctgcaggttgcagttgccgccgccgttgcgcatgatggtcctcatggaggtgagcaggtgtccgtaggtcgtgcgcggctcgcactcgactgctttgatgaagctgtgcgtcatggcgccaaccgtcgcatcaggtccaggcatcatgttcatctgggtctttccgttgctgctgccactgatgagcacggcctggc

SEQ ID NO: 10668 - DNA, 626 bp, Triticum aestivum
  unsure (1)..(626): unsure at all n locations
  Clone ID: PAT_TA_10668
cacaaacgagaaaacagttcaaacgatcgacagggcaccaccaaccggacgaccaaggataaaccagcaggtacaacgccaggacaattacttgaccaccacggaggcggagcaccaggtggagggtggactccttctggatgttgtagtccgcaagggtgcggccatcctccagctgcttgccggcaaagatcaggcgctgctggtccgggggaatgccctccttgtcctggatcttggccttgacattgtcgatggtgtcagagctctcaacctccagagtgatggtcttgccggtgagggtcttcacgaagatctgcatgccaccacgcagacgcaggacaaggtggagggtggactccttctggatgttgtagtcagcgagggttcggccatcctccagctgcttgccagcaaagatgagacgctgctggtcagggggaatgccctccttgtcctggatcttggccttgacattgtcgatggtgtcagacgactccacctcaagggtgctggtgccgaattcctgcagcccgggggatccactagttctagagcggccgccaccgcggtggagctccagcttttgttccctttagtgagggtaatttcgagctgnngatcaa

SEQ ID NO: 10669 - DNA, 664 bp, Triticum aestivum
  Clone ID: PAT_TA_10669
aggagcagcttcgaggacgtgcgggcggcgtaccggcggatggcgcgcaagtaccacccggacgtgtcccccccggacgccgccaaggagcacacccgccgcttcatccaggtgcaggaggcctacgagacgctctccgaccccagccgccgcaccacctacgaccgcgccctcgcccgcggcgtctgccgcctcgccttctccccggccgcacggcgccacgacgcctccgccttctaccaccaggagcaggaagagaagtctggatggaggacgtcctgggaaggccaaatatccgagctgaagaagcggagcacggtgaaggacgcagaagagaacctatcctggggagctcagatgcgaagaagaagggccgaacagtcgtgacatcgatcctctgacacgccatacgcactagccatccgtagcatctactaaactgtgtatatcttcgagtagcaaagttagaaaggttatgattaagaagcatggttaggatcggactacagcagcactagctcaacgatgtcacaatttgagtgggttccaggctgcatgtaaacctcaacgatgtcgctcctccttgaatctttgcctgatgaaatgtaaatataatgagacagaagtaatcaaatctagctgtacctcggccgcgaccacgcta

SEQ ID NO: 10670 - DNA, 490 bp, Triticum aestivum
  Clone ID: PAT_TA_10670
gcttttcccccatgtcggacgtttacaagaaagccaagcccggccgcctcgtcttcaagggcggcgaggccgccaccctccaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggcaagtgcggcctcacctacgtctacaaccagaaggcttagaggttgcttgcgattgctctgctcttttactctacctatcgagagtcgaactcacttagatgtgtcccgtttgtcgtttaaactgaaaccttgagtcttatgtttcctgaatatttcatcgcctactgctgtaacgcgatgcgtgcttaaattttggtgtccgtatgctcaaaaaaaaaaaaaaaaaaggccccta

SEQ ID NO: 10671 - DNA, 946 bp, Triticum aestivum
  Clone ID: PAT_TA_10671
gaccccgccaaacgcagttcgcccaccagggacagaaacgccagttcttcctcggcgtaggagctccatcgacccagctgtgcaatcagcacaactagaccgcaacctcggcgtccgaaccacaaccttcgctcgacggctgttgcgaggcgacggctgttgctgcaaaggacggagatccacctttgttatgttcaacggtgcccatcatgccctaggtttgccatcatcaattgtttcagcaatgtagttacctttctgtccaccgtagtgtgtgagctgtgtccctgttcgacttgcgctcttcttattgctgcagtgtgctggaaggcttcggctttcttagattcttactgctttcttccatggcgacccaggaagaagcagagttggagaagcatgtccatgtccatccgggaagcggcacatcctgcctatttccttggccattgtactatttccggcgggggcataggtggaggtgcagggcgagggcgtaggcggaggtggaagacggccgtcaggctactccctttctcctctcctcgctgctgtagttggttgcccttccatggcctcgcccatggatccatggctccctgagctcgctggctagggattcggctcctccgctgctgcggctgcgtggtcgtggaggaggacggcgctgtgaggtgaggaagaaatccccgctccgctgctccagcgccgctccacatcaagcaccactgccaagccggtgtggacgcacgcggatccagcctccaccgcccagaagcttgtcgccggcgcctaaaaatcaagcttttgacctacggtacggggtgcgctgtgggaggaaacggggtgcgtggtggtggagagaaagggaatcgaggagaggccggtgacggcggcgaggagaggccggcgatgacggggatctggaggagagcgagaaggggtg

SEQ ID NO: 10672 - DNA, 458 bp, Triticum aestivum
  unsure (1)..(458): unsure at all n locations
  Clone ID: PAT_TA_10672
aagaaagccaagcccggccgcctcgtcttcaagggcggcgaggccgccaccctccgcaagcccaagaagcaaaagaagaacaagaagcccgccgacgatgtccccgccgacgccgacgctgaagccgccgctgccgctgcggccacggagggtgccgaagccggaggcgactacaccatcgacgcggcgaagcggatgaagtacgaggagctgttccccgtggagacgaggaagttcgggtacgacccgtccaacgccgcccgcacctcccgcgaccgcaccgtcgagcaagccctcgacgaccgcgtgaggaagaaggccgaccgctactgcaagtgaggtcaggcgctagaatctaaggnttgttgattcggcggaatcgtcncttanattgttccctccaggcaattaaattggnttctggtgttaacacatggttaattttccggggaaaaaaa

SEQ ID NO: 10673 - DNA, 620 bp, Triticum aestivum
  Clone ID: PAT_TA_10673
tagcgtggtcgcggccgaggtactcatcgtagaacttgcctgccttctcgagctcaccaacttcggtgtagcaatcggctattgccccatatgcctcagtgacacctgaatcctctccagtcatcttggagatgctgagaaccatggagtggtacttccccagcacggcgccacgacgcctccgccttctaccaccaggagcaggaagagaagtctggatggaggacttcctgggaaggccaaatatccgagctgaagaagcggagcacggtgaaggacgcagaagagaacctatcctggggagctcagatgcgaagaagaagggccgaacagtcgtgacatcgatcctctgacacgccatacgcactagccatccgtagcatctactaaactgtgtatatcttcgagtagcaaagttagaaaggttatgattaagaagcatggttaggatcggactacagcagcactagctcaacgatgtcacaatttgagtgggttccaggctgcatgtaaacctcaacgatgtcgctcctccttgaatctttgcctgatgaaatgtaaatataatgagacagaagtaatcaaatctagctgtacctgcccgggcggccgctcgaaat

SEQ ID NO: 10674 - DNA, 849 bp, Triticum aestivum
  Clone ID: PAT_TA_10674
tccgtaagctcgaaattaccctcactaaagggaacaaaagctggagctccaccgcggtggcggccgctctagaactagtggatcccccgggctgcaggaattcggcaccagacgacaacgaggcacgggcggcgccacctgtgctctgccgcagcgccgacccaccctgcccgcccgcccgcccgccggtatataaatccggcgggagcacatctccgacccatctcactcactcgcactgacacagccacactgctgctgatacttcactgctactgccagttcccttccctcggatctcgtgccaccagtctctcgccggcgaagatgtctacggtgacccgcgcccacctcgaccagaggctcgccgccgccaaacgctgctccagagaggcagccatggcgggagccaaggccgcggccgtcgccaccgtcgccgccgcagtccccaccctggcaagcgtgaggatgctgccgtgggcgaagggcgcacctcaacccgaccgggcaggcgctcatcatcttcaccatcgccgggatggcctacttcatcgtcgccgacaagaccatcctatccatggccaggaagcactccttcgacgacgcgccggaccacctcaagaacacctccttcaactaattagactacaatagtagatccattagtagtgctcagcgacggcctgaaagatagtataatgtccagcacttatctgatatcaggccaagttcgcagacagtgagtggtgtagtactgcgcttctctgccgctctgcgtgcaagcacttgtctgatgatgtatccagccagtaatcttgaattaataataacctgcatctgtacaactca

SEQ ID NO: 10675 - DNA, 536 bp, Triticum aestivum
  Clone ID: PAT_TA_10675
gggccacaaaagtttcgggaggacttgcataataaaggggaattacaaatacagggcgccggtagaattgaaacacacaccgacacacgacacacacaccgacgcaagaggtgtgagagccactgcaagaaacagcaaccccacttattaagcacgcggaagctagcacgcagagaaaatcacgcacaggcgagcacgaaaccaggcccacgtcccagccttttttacttatggaacgcacgtaacgtaggcacacccacggccggcggcgaggccggccaccgcacgtcgacggcgacctagccgaagtggtggtgctttttttcgccgttggcctccttggcctccttgtggtcctgctttttttcgtggtgctcgtggaaaacaaagccgccggcgccgacggttgcggcggcagccacctcctcctcgatcttgtgcttgtgcgcgtgctccgggtcctttttcgcctcgtgcttttcgtagagggcgaaagctccggccgcggttgcgcccatcttgccgaggtgctcctt

SEQ ID NO: 10676 - DNA, 785 bp, Triticum aestivum
  Clone ID: PAT_TA_10676
tcgcgatctagaaccgggttcgtccacacactcccaccgctgccatccccgcgaaccggagagcgaggccgacaccgccgccgcgatgagggccaagtggaagaagaagaggatgaggaggctcaagaggaagcgccgaaagatgaggcagcgatccaagtaggcgccttggaaggaggggaagcatcatcttgcatccatgccgtcatcggacgcgtgggcggacgcgtgggcggacgcgtgggcggacgcgtgggcggacgcgtgggcggacgcgtgggttcacctcccaggtcatcatcatgaaccaccctggtcagatcggcaacggctacgccccagtgctggactgccacacctcccacattgctgtgaagtttgctgagctggtgactaagattgacaggcgatctggtaaggagctggaggcgctgcccaagttcctgaagaacggtgacgctggtatcttgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcatctatctagcagaaggtttttggtcatggtcattgcttttgttgctgcagactcttatcccgggcgagcaatgatcctgtctgtcgtttaattactgtatttctattcctgcttcggctaaactcctgtgccttgaga

SEQ ID NO: 10677 - DNA, 964 bp, Triticum aestivum
  Clone ID: PAT_TA_10677
gctggtgaaactgcagaaggaagagaaagaacggcttttggctgaaggcaatgcagctttggaagcccgcagagctgaagcggaagctgaatctaagcgtaagctggaccttgagagggaaaaggctcgtcaggccttgcaggagatggagagaactgtagaaattaatgacatcgtccatcccaaggacctagaaatgcttggtacagtcaccacggaacatattatgagttctgttgatgagacgagtcccgagcattcccaggatggcctgcccagttttcttcctggttctggcagcatgttggaaaaacttggactgtttatgaaagtggatgaggaagaagaggaagaagagccatgcagcaaaggcgcggaggatggagaaatcaattaatgtgtgttggcatgttggggccttgtgtggtcaaagacggaacaatcgcctgtttcagcggatgcacatagggaaattgctgggtagctgtgcacatgtcggacatttttttctcgaacggtgcacagaataccctcaaatttgagaggtgttgcttgcaggatgcgcgcctgcccttggaagggaagggaagggaatggaggatatagatcgaggccaccatgtacagctgcaaatgaaaatggagttcatctctcaaatgaactatttctcccagaatcaagacagttgctgcgagctgttgtcgggtgtattaatctgatacgtagatctcatgtagagccttggaaattacacgaggaccaaatggttctcccacgctgctcacgcatgtgcactgtgatccaagtgcgttttcccttagtggctaagcatagcttctcttcttagttttggatatttggttgcttcttcctgctgtaaattcaaattttgatgtagtcgaagaagttactagcagttgtttgctgggcaaaaaaaaaaaaaaaaaaaaaaaaaaaaaaaaaa

SEQ ID NO: 10678 - DNA, 863 bp, Triticum aestivum
  Clone ID: PAT_TA_10678
caaactctaaattcgaacagtttacttgtaacaattcacaatttacagtttagctcttacaatttgcaatttacatggactttggaatactccaagcattgttcaccttgttaaaccacccgatggaatcctgagctccaagcctttggtcaccttgacatttccaaagtccactgatactgcacaatacatcacgctgttcgtgtacgcccacaggctacggatttctacgcctcgtatttgcagatgttctcgaatcccatgtactcatgccgcgcgatcttgtggatcgtgttggagatgccgactccgcctagagagagcgcgctgatgaagatcatgaaggacaatatgaagacgatgatcgacgcccgtcctagcagatcaattagcttcctcacaaccctctggccgacgattgcagcgaaaaatgccaggatggtcaagtagacagcatatggcacggggaaccggttcaggaggtagtactccatgacggacatggaagatgagaacatcatcgcgaaggtggcggtggcacttgcgacctggggacgttcaacagaatgcaaacatttcgaaaacatgtgataaatagatagtagaaaccatgatggaaacataaagttcttaacatgagcaaacaaagatataattacttgcggagggacgccgagctccaggaagagaggccccatgatggagcccccaccgacgccaagcagaccggcgacgacaccagcggtaacgcccaagaagcagtatacgaaaagctgatgggctctcaggctgttctgctcattcctctttgatgatatcaccctcctcccctgcaccaaacctactgcttcgcctcgtgccga

SEQ ID NO: 10679 - DNA, 800 bp, Triticum aestivum
  Clone ID: PAT_TA_10679
gaaagggctcgtcaggccttgcaggagatggagagaactgtagaaattaatgacagcgtcgatcccaaggacctagaaatgcttggtacagtcaccacagaacatattgtgagttctgttgatgaaacgagtccatttctttcccaggatggcatgcccagttttcttcctggttctggcagcctgttggaaaaacttggactatttatgaaagtagacgaggaagaagaggaagaagagccatgcagcaaagatgcggatgaaggagaaatcaactaatgtctgttgacatgttggagccttctggtcaaagacagaacaatcgcctgtttcagctggccgacacacatggggaaattgctggtagctgcgcacatgccagacattttctcccaaatggtgcacggaatttgatgctgccggaggtgttaaatcatgtgcttgcaggatgcatgcctttggaagggaggcggggacagagatcgaggccaccaaaatccagctgcaaatgaagatggagttcatctctaaaatgcagtattcctcccggaatcaagacgttgctgcgagctgttgttgggtgtattaatctgatggaggcttctggaaggttccttccgactcgcgcgtggtctgatgttggctcagtaccacttctcaccgacacttttgctgctgtaagacgcccaaatccagctgctttggtgatactgtctcaatacaatccagtacgcattatgagtactaaagtattggtttgtggtgtcttgctttctgtgagtgtgaagtgcaagcgggac

SEQ ID NO: 10680 - DNA, 666 bp, Triticum aestivum
  unsure (1)..(666): unsure at all n locations
  Clone ID: PAT_TA_10680
aaatttcttgaatgaatntcctgacgctccgaccgtgtctacaagcctagaggctcttctagttcttgcaacacacacacacacacacacacacacacacacacaacagacgctacagagtacagacaccactcgtttctttcactttttaataacctgtctcaccctcttacttttaggaccatctatataatctctctctctctctctcactctctctcttctgacgctgctatgctctcaccggatcaaaaccttgtttcccatcggagggagtgggacgaagctctctctctagctcaccagctgctggttgccgtagaaggggtaggctccatacgcaggggcatacatgttcgggtgcgggacgggggatgcgtagccgtacccgccgtagaacggcgtgccatagtacatattgttgttgttcctcctgttgccggaatcgcccctagactgtttgtgtgatgggctgcggccccacgaaaggcgaactgcctgctttccaatgacagccccattcaatccttgcagtgcttcttctgcatcagttctgttgacatactgaacaaagccacactgcttccctagaggaattttgacagaggcaacatcaccatatttggcaaatgatttcctcagctcgtcttcactaacatttgggct

SEQ ID NO: 10681 - DNA, 738 bp, Triticum aestivum
  Clone ID: PAT_TA_10681
gggaagaagaaccatgcagcaaagatgcggatgaaggagaaatcaactaatgtctgttgacatgttggagccttctggtcaaagacagaacaatcgcctgtttcagctggccgacgcacatggggaaattgctggtagctgcgcacatgtcagacattttctcccaaacggtgcacagaagaattccctcaaatttgatgctgctggaggtgttaaatcatgtgcttgcaggatgcacgcccttgggaagggaagggaggacagagatcgaggcccaccaaaatccagctgcaaatgaaaatggagttcatctctaaaatgaagtattcctccctgtcccggaatcaagacgatgctgcgagctgttgttgggtgtattaatctgatggaggcttctggaagattccttctgactcgcgcgcagtcagatgttggctcagtaccacttctcaccgacacttttgctgctgtaagacgcccaaatccagctgctttggtgatattgcctcaatacagtccagtacgcattatgaacactgaagtcctggtttgtggtgttttgctttctgtgagtgtgaagtgcaagcgggacaatatctgccaaaatttgtatgcacgcatctacgattgttcattttgtatacacggatagacagatagtgtgtattgttcaccagtaaagattatatgattatcaccaggtcctaaaaaaaaaaaaaaaaaaaaaaaaaaaaaaaa

SEQ ID NO: 10682 - DNA, 1185 bp, Triticum aestivum
  unsure (1)..(1185): unsure at all n locations
  Clone ID: PAT_TA_10682
cgtgttgagactggtgtcatcaagcctggtatggttgtcacctttggtcccactggnctgacaactgaggtcaagtccgttgagatgcaccatgagtctctcctggaggcgcttcctggtgacaatgttggcttcaatgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagctggaggccctgccaaagttcctcaagaatggtgatgctggcatagtgaagatgattcccaccaagcccatggttgtggagacctttgctacttaccctcctcttggtcgttttgctgtacctgaagaaggtcggctacaaccctgacaaggttcccttcgtccccatctctgggtttgagggtgacaacatgattgagaggtccaccaaccttgactggtacaagggccccacccttctcgaggccctggaccagatcaatgagcccaagaggccctcagacaagcccctccgtcttccccttcaggacgtgtacaagattggcggcattggaactgtgccagtgggccgtgttgagactagcaaggttgcaacatgtggatgggatggtgtcataaaatactgggattaaagatttggcaatttaggcagaaacgttgctcgagatgctgcaagcccacatgccaattgaattcacaaggattcaactttcagttgagactgtaagcccacatgcctggctggaaattttcgatgtcactagtgaaaacatgagagaacagaaaacaggcccatatatttccaactaccgtctagttcatgctatgtactgtgtaccatacatgatgcaccattcagtttttcaactttacttctaggactttggtttcaggtttttctttgttttgctggtgcaacttttgtactacccgagtgacaaaatctgcactgatttctgggaaatgttcccagcgaaatcccctccttcgtgctccaatcagtctgtaacaaaatactaatactattnattncttcggctac

SEQ ID NO: 10683 - DNA, 705 bp, Triticum aestivum
  Clone ID: PAT_TA_10683
ttttttttttatatctgcctttgtttttgtgatatatatgcttgcaatcttctcaaggagaagcggtacattatcagtacaacagtgcaagattgaaaacgttggtgcaccactgagcttaattcaccttctgttttccgaaagacgtagtcgaaattttgggacaaattatatatgttccttgatatatatagcactatcaagtcccaactttctcaacagtacattattggggggtgctagttcgttgtactctgctttttatacgcctgatgcaagagagaaacagagtcaccaagcaaacatgacaacttcacacaaatttgttcttagtgctggctactcggtcgttggtctaaagctcggctgcacttcatggtctagtgaccggaaggcgggacaggaagcgggcggtcgtgcgccggcaggctgttgatcatgaaggccttgtcttcttccacggctgaaggccttccagtcccgtcgtatcctccaatggtggaggagtggccatgggtagcggtggaagtcggtggcccgcagtccggcggcagatcctcctcctcccctggtgccgccgatgtagggctgggcatggccgccgaccacgagctggctgcagacgagcgccagaaggaccagagctgggaatgccttggacgccatctctcttggtttctttactttgctcggctgctctgctcc

SEQ ID NO: 10684 - DNA, 738 bp, Triticum aestivum
  unsure (1)..(738): unsure at all n locations
  Clone ID: PAT_TA_10684
aacgagcccaagaggccctcagacaagcccctccgtcttccccttcaagacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgctgtgaaggatctgaagcgtggctttgttgcatccaactccaaggatgaccctgccaaggaagcggccaacttcacctcccaggtcatcatcatgaaccaccctggtcagatcggaacggctacgccccagtgctgggactgccacacctcccacattgctgtcaattttgctgactgggtgaccaagatcgacaggcatctgggtaaggactggaggcctgcccaattccctgaagaacggtgaccctggtacgtcaagatgatcccacaaaccatggtgtgggagacttcgcaactacctcctctgggcgctcnctgtcntgacatgagaaaacgtgcgttggtncacaagggctggagaaaaagaccacggcgcaagtacaaggtgcacaanagaatagctcatcacanaagntttgtncgcatgctttgtctanatctaccacacatattgcgcttattcgatcatccgtcgnaaaccgtccnaagnttttat

SEQ ID NO: 10685 - DNA, 727 bp, Triticum aestivum
  Clone ID: PAT_TA_10685
tcgaggggccggccgggccggggctttccctggccgcccaaaccaaaccccaccgcgccgccgccaccgtcgccgccgcagcgcgcggaggcgatcaccccgcagcagccaagatgcagatcttcgtgaagaccctgacgggcaagaccatcacgctggaggtggagtcctcggacaccatcgacaacgtcaaggccaagatccaggacaaggaggggatcccgccggaccagcagcgcctcatcttcgccggcaagcagctggaggacggccgcaccctcgccgactacaacatccagaaggagtccaccctccacctggtgctccgcctccgcggtggcgccaagaagcgcaagaagaagacgtacaccaagcccaagaagcaaaagcataagcacaagaaggtgaagctcgccgtcctccagttctacaaggtcgacgacgctaccggcaaggtcaccaggctcaggaaggagtgccccaacgcggagtgcggtgccgggaccttcatggccaaccacttcgatcgtcattactgcggcaagtgcggcctcacctacgtctacaaccagaaggcttagaggtggcttgcgattactcttcaaatcgaactcatttatatgtgtcctgtttgtctttgaaaactgaaatcttgggagcattacgttatgtttcctggatatttgatcgatgagagcttaaattttggtcattcttaaaaaaaaaa

SEQ ID NO: 10686 - DNA, 724 bp, Triticum aestivum
  Clone ID: PAT_TA_10686
cataaaaaaaagtaatacttctagtacagatgcattcatgcatcagcaagtcatcgtaaacatatttgcacagaaagatacatattctgcgctcatacaccagtgggctaccacgtgtagttgaaactcgagattagaattgctgcaacacagtcggcaaaagaataaggttacaacatggtataagggcttcggctgcatctgcacggctactctgtctcggtgaccggaggcactgcatccaccttgtaccggagagtctttttgaagaatgttgaatatgagttgtcccatacaagcttgtacgatccagcgaaaacagtgcaaaagttaccctgaaaagtagaatatttcgaagcaaaagaggataagcattaaagtgaactcacttggtcagcttcataacgtcggtagggaagaatcaacgttttctcccgtgacgggcttatgtactccacatgaaagccaatatccagcagtgtgctgagggccccttgttgcaacgagaaatcccatgcaatatatgagttgacagcctcaacacttaaaataacctcatgtgtctttcccgctggaataatggtttctcggtactcatcgtttttcctcgaatcagcacctgcatcctcagcagatatgaagaatggggcattcacaaaaacctcaccgatgaatgtagtgaacttcccaaattcctcggtgtatataaccactgcctgctgca

SEQ ID NO: 10687 - DNA, 555 bp, Triticum aestivum
  Clone ID: PAT_TA_10687
ccgctactcatcttacctgacacacttcacttccttcggatctcgtgccaccaagctctgctcccgccaagatgtcgacggtgacccgcgcctacctcgaccagaggctcgccgctgccaagcgctgctccagagaggctgccatggccggagccaaggccgcggccgtcgccaccgtcgccgccgcagtccccaccctggcgagcgtgaggatgctgccgtgggccaaggcgaacctcaacccgaccgggcaggcgctcatcatctccacggtcgccgggatggcctacttcatcgtcgccgacaagaccatcctgtccatggccaggaagcactccttcgacgacgcgccagaccacctcaagaacacctccttccagtaattacgctataatagctccattaatagtgcgtaataaaccgtgtacgccggtcggcctgtacatgtctgctgattcagctagggaggcgatcaggcgaggcttgcagacagtgagtggtctactgcgcttctctccgagcaagcacttatctgatcaagtaatcatcatgtat

SEQ ID NO: 10688 - DNA, 628 bp, Triticum aestivum
  unsure (1)..(628): unsure at all n locations
  Clone ID: PAT_TA_10688
gccggccggtccgggctagaagccccctgcctcctgcgcctccacttccatcgcctccccaagatcgcagatccgctccggtgagaatccgtcgccatgtcttccagcgaggtcgcctgcacccttgccgccctcatcctccacgatgacgggatccccatcacttccgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaggaagaaaagaaagaagaggccaaggaagagagcgatgatgacatgggcttcagcttgttcgactaagctgttcaattccagttctcctgtgggttcttctatgcgaaagacttgtcttatgtgcttttaggtcgaattttgaagatttattatgttatgctgtttgagactaagtatctgtgcaatgagtactgcaaaacctncttgggatgggtcttgtagaaatgaaatgggtctacattaaaaaaaaaaaaaaaaactcgga

SEQ ID NO: 10689 - DNA, 719 bp, Triticum aestivum
  Clone ID: PAT_TA_10689
agcttgaaattcaccctcactaaagggaacaaaagctggagctccaccgcggtggcggccgctctagaactagtggatcccccgggctgcaggaattcggcacgagggttggttacaaccctgacaaggttccctttgttcccatctctgggttcgagggtgacaacatgattgagaggtccaccaaccttgactggtacaagggccccacccttctcgaggccctggaccagatcaatgagcccaagaggccctcagacaagcccctccgtcttccccttcaggacgtgtacaagattggcggcattggaactgtgccagtgggccgtgttgagactggagtcatcaagccaggcatggttgtcacctttggtcctactggcctgaccactgaggtgaagtccgttgagatgcaccatgagtctctcctggaggcgcttcctggtgacaacgtcggcttcaacgtcaagaacgtggctgtcaaggatctcaagcgtgggtacgtcgcttccaactccaaggacgaccctgccaaggaggctgccaacttcaccgcccaggtcatcatcatgaaccaccccggccagatcagcaacggctatgccccggtgcttgactgccatacgtccacattgctgtcaagtttgctgagatccagaccaagatcgaccggcggtctggccaggagattgaggcggcgcccaagttcctcaagaacg

SEQ ID NO: 10690 - DNA, 531 bp, Triticum aestivum
  Clone ID: PAT_TA_10690
acagtaaattgtttcttctcatataaatataacttcaggcgactctagagtttcttgcaatgccaatacagctaacagtcgttggcaccaacacgctggtgattgattattcacacccacagttaaaaaaacaaaacaccgcaaaatgacgtgcgtctcatatgtaaatcatcctgccgccgcctcatcagtaggtgtagcccttctggaacatgcccttcttggcctcgtcgctctcgccctcgcccgtgtagctgccgagctgcgccaacgagttggccttggcgcggaccaacagggccttctgcgccgcctcaatgttctcgggctgcccctgccacgtcttcagcaccgagttctggagggcccgggcgtaggagaaggacacgtgccacgggttggcggactggttcatcgcgttcaggttcatggtcgcctccagttcaaactgtccgccggaaaggaacatgattccagggacagcagggtggtactctcctcctcagcattgtgaggggtgttcttcgcaat

SEQ ID NO: 10691 - DNA, 737 bp, Triticum aestivum
  Clone ID: PAT_TA_10691
attccaccccgccgcccagcccaaacccaaccccgccgccgcactgccgtcgccgccgcagcgcgcggaggcgaccaccccaccgccgcgaagatgcagatcttcgtgaagaccctgacgggcaagaccatcacgctggaggtggagtcgtcggacaccatcgacaacgtcaaggccaagatccaggacaaggagggcatcccgccggaccagcagcgcctcatcttcgccggcaagcagctcgaggacggccgcaccctcgccgactacaacatccagaaggagtccaccctgcacctggtgctccgcctccgcggtggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgccccaacgccgagtgcggtgccgggaccttcatggccaaccacttcgaccgtcactactgcggcaagtgcggcctgacatatgtctacaaccagaaggcttagaggtggcttgcgtttgctctgctcttttacctatcgaggatagaactcattatatgtgtccctgtttgtatttgaaaactgaaaccttggagtattatgtatcctagatatttgatcgcctgctgctgaaatgctatgcgagcttaaattttggtcattctgaatgacgttaatct

SEQ ID NO: 10692 - DNA, 843 bp, Triticum aestivum
  Clone ID: PAT_TA_10692
gaaatataagagcatttagatcactactttagaaacactcttagtaggagtactagtctgtagaaaccagatgccccgggtaaattctccgtgtgtgcgccagggcttctcaggtccacaacccaagctgttcccggcatcggcccacagcccatcaacattctctgggtaggcatgcatacagtaaattgtttgttctcatataaatataacttcaggcaaccctagaatttccgcgctgccaatacagctaacagtcgttggcaccaacacgctggtgattgattattcacacccacagttaaaaaaacaaaaccccgcaaaatgacgtgcgtctcatatgtaaatcatcctgccgccgcctcatcagtaggtgtagcccttctggaacatgcccttcttggcctcgtcgctctcgccctcgcccgtgtagctgccgagctgcgccaacgagttggccttggcgcggaccagcagggccttctgcgccgcctcgatgttctcgggctgcccctgccatgtcttcagcaccgagttctggagggcccgggcgtacgagaaggacacgtgccacgggttggcggactgggttcatcgcgttcaggttcatcgtcgcctccagttcggactgcccgccagaaaggaacatgattccagggacagcaggtggtactctcctcctcagcattgtgagggtgttcttcgcaatggcttctggagaagccttctccttgtgctcagcaccaggggtaaccatgctgggcttcagaaggatgccctcaaaaagaacattgttttcggccaggtagaagaacacctcggatcacaccttgccgtggaccc

SEQ ID NO: 10693 - DNA, 776 bp, Triticum aestivum
  unsure (1)..(776): unsure at all n locations
  Clone ID: PAT_TA_10693
gagggcggcatgcttaacacatgcaagtcgaacgggaagtggtgtttccagtggcgaacgggtgagtaacgcgtaagaacctgcccttgggaggggaacaacaactggaaacggttgctaataccccgtaggctgaggagcaaaaggagaaatccgcccaaggaggcgaccaagcgcgagtacgcggccgagtcggagtggaagaactgggtgtgggtatcggaaggcgacctgatggtaaacgacgcctacttcaccacgtccggcggaaaaataggccagaagctcaacggtaaggacctcatcaagcccaagcaaggggagtacgtcaggaggctcacccgcttcgccggcccgttggactgcaaccagggcagtccctgctgatcgtcgccgtaccataccatacctgccaggcggagtagccggatatgcatgtcgtcgccggccacacgcccaagggaaggaaacaacagttaacgttccacgcgacaacccatccaatctttgatgctacactagacaacaaggccgtaagcatgcatagagggaggaatgtaggagggtggccggattcatcagtctgctgctctcttcgtgtagtcgatgtacgtacctatcactgttcgtgtagtcaatggtacgtacctatcactacttgctttttcctgcttacttcttgcttccttgcctccaccgaggaaataggaattgtgtacctatatatatacatatacgcatgncatgttgtacaacaggnatgtactgtaaccgtc

SEQ ID NO: 10694 - DNA, 630 bp, Triticum aestivum
  Clone ID: PAT_TA_10694
gttatgatattaaaacgaggccagtactcatctagagttaaacaaggttcaacatcctgacatgagcagcaaaatgataacccagaaacattttatgtctacagatttatccagacaatgaaagcggcaataacagttttacgagctctagttcttgatcttcttcttgggcctcagctggttgctgtggccacacttcttcttgcggcagttgacagcccttggatgcagcctggcgtagcacttgcggcagatcatcttctcctggttgtacttgcgggcgagggcctggagcgagggctcgatgatgcccccgcggaggcggagcacgaggtgcagcgtcgactccttctggatgttgtagtcggccagcgtgcgcccgtcctccagctgcttcccggcgaagatcagccgctgctggtccggcgggatccctgcacacccacacaagaaatcaagaatcagaaaagctcgacggccggccatggccaaagaagagatctttgcgaagaaaaagcagagaacccaccctccttgtcctggatcttggccttgacattgtcgatggtgtcgctgctctcgacctcgagcgtgatggtcttgcccgtcagggtcttgacgaagatcttc

SEQ ID NO: 10695 - DNA, 553 bp, Triticum aestivum
  Clone ID: PAT_TA_10695
ttttatctgaaattcacttattcattacttgacgatactgctgtgccagcaacattttcaaccaacatataacatggggactcgatagttttcaaaccaacacataggactgacacgaacaagaaaacagttcaaatgaacgacagggtacggacgaccaaggataaaccagcaggtccaacgccagggcaattactgaccaccgcggaggcggagcaccaggtggagggtggactccttctggatgttgtagtccgcaagggtgcggccatcctccagctgcttgccggcgaagatgaggcgctgctggtccgggggaatgccctccttgtcctggatcttggccttgacgttgtcgatggtgtcagagctctcaacctcaagggtgatagtcttgccggtgagggtcttcacgaaaatctgcataccaccacggaggcggagcaccaggtgaagggtggactccttctggatgttgtagtcggcaagggtgcgaccatcctccagctgcttgcctgcgaagataaggcgctgctggtccgggggaatgccc

SEQ ID NO: 10696 - DNA, 377 bp, Triticum aestivum
  Clone ID: PAT_TA_10696
actcatctagagttaaacaaggttcaacatcctgacatgagcagcaaaatgataacccagaaacattttatgtctacagatttatccagacaatgaaagcggcaataacggttttacgagctctagttcttgatcttcttcttgggcctcagctggttgctgtggccacacttcttcttgcggcagttgacagcccttggatgcagcctggcgtagcacttgcggcagatcatcttctcctggttgtacgttcctccagagcctttgtatgagctatgcagtgctcattcttgatggcatggcggcaggtgatgtgatacatcgtcacacatactagtagcaagcatcatagttaattaaccggcccattattcagt

SEQ ID NO: 10697 - DNA, 603 bp, Triticum aestivum
  Clone ID: PAT_TA_10697
gccagcccatctcatctcatctcgctcgatcatcgcactcttcgtgctgagccgtttatgcacaagaccacggcgaagatgtcgtcgacggccaccgtcacccgcgcccacctcgataacaagctcgccctcgccaaacgctgctccagagaagcgacgctcgccggagccaaggccggcggccgtcgccaccgtcgcgtctgcggtgcccacgctgggcgagcgtgaggatgctgccatgggccaaggcgaacctgaaccccaccggccaggcgctcatcgtctgcaccgtcgccgggatggcctacttcgtcgccgctgacaaggccatcctctcgctgggcgaggaggcactcgtacgagagcgcccccgaccacctcaaggacacttccttccacggtggcgccgccgccgcagctcgtccccgtccgccggcattcttcaggccttgagctagtattatcctgcttctgccgttggccgttgcgcgtattctagaaaaaatgtatgcgtcgttgtcagtgtcccaagaaaccgctgccgcatgaatatctgacgccgaaatgtatgtacatccgtgtactgaataaaacagagggctc

SEQ ID NO: 10698 - DNA, 760 bp, Triticum aestivum
  Clone ID: PAT_TA_10698
agattaaactgtaaattctttaattgtaaccatttacagtttacattttagctcttacaatttgcaatttacaaggactttggaatactccaagccttgttcaccttgttaaaccacccgatggaatcctgagctccaagcctttggtcaccttgacatttccaaagtccagtgtactgcacaatacatcactctgttcatgcacgcctgcaggctgtggcatcctacgcgtcatatttgcagatgttctcgaatcccatgtactcatgccgtgcgaacttgtggatcgtgttggagatgccgactccgcctagagagagtgcgctgatgaagatcatgaaggacaatatgaagacgatgatcgacgcccgccctagcagatcaattagcttcctcacaaccctctggccaatgatcgcagcgaaaaacgccaggatggtcaagtagacagcatatggcacagggaaccggttcctctcgtactaggttgaattactatcgcgacactgtcatcagtagggtaaaactaacctgtctcacgacggtctaaacccagctcacgttccctattggtgggtgaacaatccaacacttggtgaattctgcttcacaatgataggaagagccgacatcgaaggatcaaaaaggcaacgtcgctatgaacgcttggctgccacaagccagttatcccttgtggtaacttttctgacacctctagcttcaaactccgaagatctaaaggatcgataggccacgcttt

SEQ ID NO: 10699 - DNA, 1600 bp, Triticum aestivum
  unsure (1)..(1600): unsure at all n locations
  Clone ID: PAT_TA_10699
atcgacgctacagactactaccgttcggactcaagaccaggcattacatacaggatcacatgatctctctctttctctcccatctcagatgcagaactacgcgacgcaacttggccctttctactcgtcggcggcggcctcctcctcggcgtcggcggcggccttcttcttgtcagcggcggcggtcttcttgtcggcggccttcttcttgggggtcttcttggcggcgggatctacgatgataccaagaccgtcacttggaggtaacgtgaagcccagcagaagaagaccaaatccgagcgaaaaccccgcaaccggtccagcagctgctaccttgagcaggtccccgcgattgcgtacaatattgactattctggtgatgccaccaaaagatcctatctgccagctaggaacaaaatatggtactgaaagcttgaccccagcatccttagcagcgaggatgtgtccaatttcatgaacccctactatgagtcccgttaccagggcaccgggaagtccatctttcaatagctcaaggttatcaaatgttgatagcaagttgtcctgaaggacaggtacgttccgaagcaacagagtgaagatggtaactactccgaacgcaccagcagcagcccactctgggacagatccagtggcaggctccactgtctgcttaggtacaactactgcaactggcttctcatcctctggatccatgagaagaaaaaccttaaattcatcgccaaatttgttctctagtcgagttgtgatcttttcaaaacttttggctggcacaccacgcaagttccctttaaatagtattccaccctcgtaaggctcgtggctggtcacgaagaacgtgtcaaaactgaaaacttgatcctttagaatgtctactgtagccttggggatactcacagcttcttcaagttgttgcttcattccaggcaaaggagagccactagcaacattaacatcaacctccagcagctgctcctgcgcagcgctgtcagcggcngcagtagcatctccgtcgatgctctgaaccgtgtcgctagcgcttaccggctctgcattcggggattcatctttcgtctgcgcagcgctgtcagcggctgcattgacaaaccggtcgatgttctgaagtgatttgacagcggcgcttactggctctgcattgggggattcatctttcgtctgcgcggcgctgtcagcggctgctttagcataccggtcgatgttctgaagcgatgtgagagcggagtttagcggctctgcattcggggattcatctttcgtatnatctgtctctgcagctgcatctgcttggacaacactgtcggctggaggcgatggagcatcatccacagcctcgtcgccattgctggcggctggcccaggctcgtcggccgcacggcatgccaccctccggctcctcgacctgctgcgagggccggccggaagcgggagggacgaggagctgagcgtgagcgcgaggcgagcgcctctgctcctggtcggcgcggaggtggacgcgaggagcgggcggtggcagcagcacccgtacggcgacgcggcccgcgacgtcggcgggcgagga

SEQ ID NO: 10700 - DNA, 1019 bp, Triticum aestivum
  unsure (1)..(1019): unsure at all n locations
  Clone ID: PAT_TA_10700
tgcattgcttttacgcatctcttttgaagatgaagcagcatataatttgatttattgaagggtatgagacgatgcacaacaccaccacagccttattacagtgaggtacgtacatacagacgtacagtacagtagggaacgtggtcctccagagccttgtatgagctatgctcattctggatggcatggcggcaggtgaggtgatcggctatcacacatactagaagcaggcatcataagtagtatttatcccactgatcggctatctcgatatgatcgatgattagccgtgtaggtggtaatcgtcgactgcagtagcctccagcagcgacgatgaacccccgcgcgggttctacatgcagaatggctcgcggtggatgtcaaacttgcaagcagaagacagctggggctcctccaacccgctgaagttggccaccttgcggatgcagccgccggcggggccctgcaggttgcagttgccgccgccctcgcgcatgatggtcctcatggaggtgagcaggtggccgtaggtggtgcgcggctcgcactccactgctctgatgaagctgtgcgtcatggcgccaaccgtcgcatcgggtccaggcatcatgttcatctgggtctttccgttgctgctgccactgatgagcacggcctggccaccactggtgcctttgaaggcgccgttcagagggcgctcatccctccacctcaagcatccgtactgcttggagaaggtgcactggtatgggagatcgaggacggtggcactgtggcaggcgtcgacgatggcgtggagcttgacgccgtgcacgagcgggcgtacgatggcctggttgatctcgtcgtccaggatggggccctgctggaacgagtccagggggcagatggcctcgtccatgccgtcacgctcttcgccgctgcagtcaaggacctgcacgccagcgccggagaactggaacaccagtgagtcgccaganctgcaaccctgcaccagccagtgcatcgccatgcggatg

SEQ ID NO: 10701 - DNA, 597 bp, Triticum aestivum
  Clone ID: PAT_TA_10701
gcacgaggctcatcttacctgacgcagttcactgctagccaattcacttctcgtaccaccaacctccctcgccaagatgtcgacggtgacccgcgcctacctcgaccagaggctcgccgccgccaagcgctgctccaaagaagctaccatggcgggagccaaggccgcggccgtcgccaccgtcgctgccgcagtccccacactggcgagcgtgaggatgctgccgtgggccaaggcgcacctgaaccccaccgggcaggccctcatcatctccactgtcgctgggatggcctacttcatcgtcgccgacaagaccatcctctccatggccatggccaggaggcactccttcgaggacgcgccggagcacctcaagaacacctccttccactagttagatccattattagtaatgcccaatgaaccgtgtatgccaaagtgcatagcgtacagtgatcagcaaagggaggtcataatataattttcatcatgcaagtagccatgtacagcatcttttgagctagcaatactgaaagatgtaccagcatttgttaaccaatattttccagctaaaaaaaaaaaaaaaaaaaaaaaaaa

SEQ ID NO: 10702 - DNA, 627 bp, Triticum aestivum
  unsure (1)..(627): unsure at all n locations
  Clone ID: PAT_TA_10702
ttcggcacgaggcccaaaccctaccccgccgccgccgtcgccgacgcagcgcgcggaggcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccagaaggagtccaccctccacctggtgctccgcctccgcggcgacgccaccggcaaggtcaccaggctcaggaaggagtgcccgaacgccgactgcggcgccggcaccttcatggccaaccacttcgaccgccactactgcggcaagtgcggcctcacctacgtctacaaccagaaggcttagaggtggcttgcgtttgctctgctcttttacctacctacctatcgagagtcgaactcatttagatgtgtcccgtttgtcgtttaaactgaatccttgagtatcatgtttcctgaatatttcatcgcctactgctgttatgcgatgcgtgcttaaattttggggtcccgtnaaaaaaaaaaaa

SEQ ID NO: 10703 - DNA, 595 bp, Triticum aestivum
  Clone ID: PAT_TA_10703
agccagcccatctcttctcactcgatcatcgcactctttgtgctgagccgtttctgtacaggatcacggcgaagatgtcgacgacggccaccgtcacccgcgcccaccttgagaacaagctcgccctcgccaaacgctgctccagagaggcgacgctcgccggagccaaggcggcggccgtcgccacggtcgcgtctgcggtgccaacgctggcgagcgtgcggatgctgccgtgggccaaggcgaacctgaaccccaccggccaggcgctcatcgtctgcaccgtcgccgggatggcctacttcatcgccgccgacaaggccatcctctcgctggcgaggaggcactcgtacgagagcgcccccgaccacctcaaggacacctccttcgatggtggtgccgccgcagctcgtccccgtccgccggcattcttcaggccttgagctagtattatcctgcttgtgccgttgcgcgtattctagaaaaaatgtatgcatcattgtcagtgtcccaagaaaccgctgccgcatgaatatctgacgccgaaatgatgtatatccgtgtactgaatgaaacagagggctcgatcctggtt

SEQ ID NO: 10704 - DNA, 920 bp, Triticum aestivum
  Clone ID: PAT_TA_10704
gccggccgggctgcgaaaaaaaaaaaaaaaaaaaaaattaaaaaacctgccccagccgaacgccgttgaaccgggcgaccaatccctccctgccgccggcgagcaatctccgccacggccgccgcagcagcagcgaggagaggaggaggggtccggccggccgggatgggcgacgagcgcgtgaaggcggaggcgctgcagatcctgggcctgttccaggtgctcccccgcctcgtcgtcttcgacctcgactacaccctgtggcccttctactgcgagtgccgctccaagagggagtcgcccagcctgtaccgccacgccaagggcatcatgtgcgcgctcaaggagaagggggtcgacatggccattgcgtcgcgctcgcccacctccgatatcgccagggtcttcattgacaagctcgagctccagcccatgttcgtcgcacaggaaatattctccagctggactcacaagacggagcatttccaaaagatccacagaaaaactggggttccgtacaagtccatgctgttctttgacgacgaggacaggaatattcaatcggtatcgaaaatgggagttacaagtgttctagtaaacaacggattgaatctcgacatgtttaagttgggcctcagtaatttcgctactactgttgctgcacctgaacccacacctgcaccagaggacaagtaaaccttattgtacaagtaaaaacagcagacggggaaaacgcccatgatttacggatacttgtgaaaaataaacatgtatttcttgtagttgattgcccttgctcctgggcagtaaagcagggatgactactgctgaaaccattctgtgtgtaagcttgtgttacttaagtgcgttccttgtgaaaggaaattaatttggaaccatttgattgacgaaaaaaaaaa

SEQ ID NO: 10705 - DNA, 695 bp, Triticum aestivum
  Clone ID: PAT_TA_10705
agcagccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctgggtgctccgcctccgcggtgggcgccaagaagcgtaagaagaagacgtacaccaagcccaagaagatcaagcacaagcacaagaaggtgaagctctccgtgctgcagttctataaggtggacgacgccactggcaaggtgacccgcctccgcaaggagtgccccaacacagagtgcggcgcgggcgtcttcatggccaaccacttcgaccgccactactgcggcaagtgcggcctcacctatgtctacaaccagaaggcgtaattgcttgccccgatttgctttatccgcctacctatcaagcatttagatgttggttactcaaattgtatctcatttagatctgtctgaggttgaaacttaaatggagcagtagtatctatcatattggtacccttgttactgagtaagaacaaaaaaaaatactcgaggggg

SEQ ID NO: 10706 - DNA, 645 bp, Triticum aestivum
  unsure (1)..(645): unsure at all n locations
  Clone ID: PAT_TA_10706
ctcatcttgcctcacacacttcactactctgctcgcaagttcacttccttgggttctcgtaccaccaacctccctcgccaagatgtggacggtgacccgcgcctacctcgaccaagaggctcgccgccgccaagcgctgctccagagaggccgccatggccggagccaaggcccgcggccgtcgccaccgtcgctgccgcagtccccacactgggcgagcgtgaggatgctgccgtgggcgagggcgcacctgaacccgaccgggcaggccctcatcatctccaccgtcgccggggatggcctacttcatcgtcgccgacaagaccatcctctccatggccaggaagcactccttcgacgacgcgccggaccacctcaagaacacctccttccactaataattcgactataatagatccattagtagtgggtaataatctgcacgcccggccctggaagtgtctgctgaaagatagtactgtaatgttcaggcagcacttatcctgagatcaggcgaggcttgcagacagccagtggcgtagtactgcgcttctctgcgcgcaagaacttatctgatgaagtgatcatgtatccacccattaatcttgaattantagtaataacttngtttgtaaaaaaaaaaaa

SEQ ID NO: 10707 - DNA, 766 bp, Triticum aestivum
  Clone ID: PAT_TA_10707
cccttgctcgaaattaaccctcactaaagggaacaaaagctggagctccaccgcggtggcggccgctctagaactagtggatcccccgggctgcaggaattcggcaccagcagtactcgagttcactagctactagttcactttcttcagcaccaagtcaagatgcctacctcgaccagaggctcgtcgccgccaagcgctgctccaaagaggctgccatggcgggagccaagggccgcggccgtcgccaccatcgcagccgccatccccactctggcgagcgcgaggatgctgccgtgggcgagggcgcacctgaacccgaccgggcaggcgctcatcatctccaccgtcgccgggatggcctacttcatcgtcgccgacaagaccatcctctccatggccaggaagcactcgtacgagacggcgccagagcacctcaagaacacctccttccactaattagacacttgattggttcaaaaaaactaattagacacttgattagccagtgcccaataaactgtgtacgctggcccgtggaaacgtgtgttctgaaacgtatgatgttcagcgacagggccagcaggcgaggcgacgatggttgcagtgctgaaaggtggtgtacagcccttcaatttgtgcgagcaagcactaataatgtggccatgttctccatcttactactagtaccttcccggagatcttgaattaataaaaactactagttctaaatttgtaaaaaaaaaaaaaaaaaactcgagggggg

SEQ ID NO: 10708 - DNA, 705 bp, Triticum aestivum
  Clone ID: PAT_TA_10708
ttttttttttttggcacaaacagtgttgtaacttattaagcaagtcaaaatttcttgaatgaatcaacatccatgacgctccgaccgtgtctacaagcctagaggctcttctagttcttgcaacacacacacacacacacacacacaacagacgctacagagtacagacaccactcgtttctttcactctttaataacctgtctcaccctcttactttaggacgatctatataatctctctctctctctctttctctctctctcactctctctcttctgacgctgctatgctctcatcggatcaaaaccttgttccccatcggagggagtgggacgaagctctttctctctctagctcaccagctgctggttaccgtagaaggggtaggctccatacgcaggggcgtacatgttggggtgcggcacgggggacgcgtagccgtacccgccatagaacggcgtaccatagtacatgttgttattgttcctcctgttgccggaatcgcccctagactgtttgtgtgatgggctgcggccccacgaaaggcgaactgcctgctttccaatgacagccccattcaatccttgcagtgcttcttctgcgtcagttctgttgacatactgaacaaagccacattgcttccctagaggaattttgacagaaggcacatcaccatatttggcaaatgatttcctcagctcgac

SEQ ID NO: 10709 - DNA, 1310 bp, Triticum aestivum
  unsure (1)..(1310): unsure at all n locations
  Clone ID: PAT_TA_10709
tcctgaaaagcctcctagattattgtgactactcacattatcgctcaaattacaatagataaatctaatacacaaaaattgggcaacaccaatgttccagctgtcctctggggtatctatgttcgaattggagaagttatcattgcagaagcttctgtacatgcctcctgcatataacctgatcaaggttcaaacaggtggcatatggaggcatgttcttttgacaggaccatacgtttttgcatgccttggttcggccttcagcaactcaagttccgttgttaccctgtgagacaacacccagttgcccaaatcaaatatttgaagcagacaaagtccgtgcataaaaatgaatgtagggtcactatcccaaccagccaacgattatatcaggtcaatcttgctccacgccctttgacaaggcattttcttcgtccatcttgtccttggccacattggcatttacttccactatgttgttctcaatagccacttcagcagtagtttccaccatcttgtccttagcctcatcagcactttcttcccccatcttgtcttctctagtcacattaccttcatccatcttgtttacttcctgcaccgtatcatcttttgactcaacagtatcttcctctatcttgtcattgttcacagcatcagttgcctcaccattttctttctctgtgccatccttcgcattatccaaaacaatatcaccattgccagtttcaggaggggctgcatcagcatttgcatggggtgcataatattgcatggattgcatctggcgaagatgttccagtctgaagttcaccaagtgtccaatatcttcaacatcagtaatataatgaatatttccagcttctcccaaaggtcgctctgtaaatggagtgcactcttcaagatttaacgcaagcttatcgggcctttggagtagaagctggaatgttggctgcagttcatagcattgttcaaacagagaacagcggcagaacacatataaacccaaccgagcacgggacattgccacaataagccttctgacatcacgaagatgacccacaaatcgggtccggacaagagacaataaaataaaatcattttgttgaccctggaatttgtccaccgtagtaaccttgcaaggtggctcaatattccatggcttgcatcgtctgctgataacatcacgaataagaagcttctgaccattgtaagtggttaatattgaaatcttattggcagggtatccaatcagacgcatgtaaatatagacactaacaatatactcagcctcccctncctcgtgccga

SEQ ID NO: 10710 - DNA, 1104 bp, Triticum aestivum
  unsure (1)..(1104): unsure at all n locations
  Clone ID: PAT_TA_10710
ccggaatattcagtattgggataccgaaactgggcaggtgatctcgaccttctctactggtaaggtaccttatgtcgtgaagctcaatcctgatgaagataagcagcatattctccttgctgggatgagtgacaagaagattgtgcagtgggatatgaagtcagggcagatcacacaggaatatgatcagcacttgggggcggtgaacactattacctttgtagataataataggaggtttgtgacatctagcgatgacaagtctcttcgtgtgtgggagtttggcatccctgtagttattaagtatatcagtgagccgcacatgcactccatgccgtctattgcagtacacccgaactctaactggctggcagcacagaggcttggacaatcagatactgatatacagcaccaaggaaaggtttcaacttaataagaagaagaggtttgcaggccacattgtggcaggttatgcttgtcaggtgagcttctctcctgatgggaggtttgtgatgtcaggagacggtgaaggtagttgctggttctgggactggaaaagctgcaggagattcaagacattgaagtgccacaatggagtttgcattggatgtgagtggcatccgttggagactagcaaggttgcaacatgtggatgggatggcgtcataaaatactgggattaaagatttggcaatttaggcagaaacattgctcgagatgctgcaaagcccacatgccaattgaattcacaaggattcaactttcagttgagactgtaagcccacatgcctggctggaaagtttcgatgtcactagtgaaaacatgagagaacagaaaacaggcccatatatttccaactaccgtctagttcatagtaatgtactgtgtaccatacatgatgcaccattcagtttttcaactttactttaccttacttgtaggacttcggtttcagtgtatcttcgttttgctggtgcaacttttgtactacccgagtgacaaaatctgcactgatttctgggaaatgttcccagcgaaatcccctccttaatgctccaatcagtctgtaacaaaatactaataatattnattncttggctacg

SEQ ID NO: 10711 - DNA, 749 bp, Triticum aestivum
  Clone ID: PAT_TA_10711
agcttcataccgccgcccaacccccaccccagcgcagcagcagccgccgccaccgtcgccgccgcagcgcgcggaggcgaccaccccaccgccgccaagatgcagatcttcgtgaagaccctgacgggtaagaccatcacgctggaggtggagtcgtcggacaccatcgacaacgtcaaggccaagatccaggacaaggaggggatcccgccggaccagcagcgcctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccactggtaaggtcaccaggctcaggaaggagtgccccaacgctgagtgcggcgccgggaccttcatggcaaaccacttcgaccgccactactgcggcaagtgcggcctcacctacgtctacaaccagaaggcttagaggtggcttgcgattgctcttcaaattgaactcatttatatgtgtcccgtttgtctttgaaaactgaaaccttggagtattatgttatctttcctggatattactgatatgcgatgtgggcttaaattttggtcattctgatgacgttaatctatttcatgtcggctatcattttttaaaaa

SEQ ID NO: 10712 - DNA, 644 bp, Triticum aestivum
  Clone ID: PAT_TA_10712
taagaagtacatgaaactttgggataaacatatatgtgttcccttgatggcactctgaagtcacaacattctcaacagtacattattagtactagtttggtggtactctgcttttatacccctgatgaggatggtagaaacagagttaccctcagtcaaaaagaaaaaaagaaacagagttaccgtgcaacaaacaggacaacttcacacaaatttattcttattattagtgctggccactgggccgctggtctcaagctcggctgcgttgcctagacggactagtgacctgtaggcgggacaggtagcggacggtcgtgtgccggcaggctgttgaccatgaaggccttgtcttcttccatggctgaaggccttgcagctccgttgtattctccaatggtggaggagtgggcatgggtggcggggtaagtcggtggctgcactccggcagcagatcctcctcctcccctgatgcggcggccgccggtgtagggctgggcatggccgtcgaccacaagctggccgcagacgagcgccagaaggaccagagctgggaatgccttggaggccatctcactttggtgtctgtggtgcgtgcttctctagttctctgtgtctgtgggttttttcccaacccggccggc

SEQ ID NO: 10713 - DNA, 814 bp, Triticum aestivum
  Clone ID: PAT_TA_10713
cactatccatctctcaccaccaacctccctctccctcgccaagatgtctacggtgacccgcgcctacctcgaccagaggctcgccgccgccaaccgctgctccaaagaggctgccatggcgggagccaaggccgcggccgtcgccactgtcgccgccgcagtccccaccctggcgagcgtgaggatgctgccgtgggccaaggcgcacctgaacccaaccgggcaggcgctcatcatctccaccgtcgccgggatggcctacttcatcgtcgccgacaagaccatcctctccatggccaggaagcactccttcgacgacgcgccggaccacctcaagaacacctccttccactagttagatccactattagtaatgcccaataaaccgtgtaagccaaagtgcatagcgtacagtgatcagcaaggggggtcagggatgctcccggatagtcttgtactgcgagtgcaattgctcatttcgtaatataattttcatcatgcaaaaaaaaaaaaaaaaaaaaaaaaaaaaaaaaaaaaaaaaaaaaaaaaaaaaaaaaaaaaaaagggcaaccaaaaaaaaaaaaaaaaaaatataacaaaaaaaaaaaaaaaaaaaaaatagctcttctatagaaaaaccaaaattaaattaactggccgtcgaataaaaacagtcgtaatagaaaaaaccctaaagtaaccaaactaaatcgccttaaaaaaaatcccaatttaaaaaactggggaaataccaaaaaaaaccgaaccgaacgacattccaaaaagttgagcagcctaaatggcaaaaggaacc

SEQ ID NO: 10714 - DNA, 623 bp, Triticum aestivum
  Clone ID: PAT_TA_10714
gccggccgggtcgcagattctcatatcacttcactgctactactaattcacttccttcggatcccgctcgtgccaccaagctctgctcccgctaagatgtcgacggtgacccgtgccaacctcgaccagaggctcgccgccgccaaccgctgctccagagaggctgccatggcgggagccaaggccgcggccgtcgccaccgtcgctgccgcagtacccacactggcgagcgtgaggatgctgccgtgggcgagggcgcacctcaaccccaccgggcaggcgctcatcatctccacggtcgccgggatggcctacttcatcgtcgccgacaagaccatcctctccatggccaggaggcactccttcgacgacgcgccagagcacctcaagaacacctccttccactaattagactataatagtagacacatataatgttctataatggtactataatgttcagcgagaggggcggtcaggcgaggtgatggtataattatctgatgatgtatgtatgtaataatgtggccatgttctttccagggatcttgtcatctttccagggatcgtgaattaataaccaccagtttttgtaccaaaaaaaaaaaaaaaaaaggccccta

SEQ ID NO: 10715 - DNA, 1157 bp, Triticum aestivum
  Clone ID: PAT_TA_10715
ttttttttttttttttttggctaaacgatcgagtttccagcttcaattcagcagtgattcaagatcaatcgacgctccagactactaccagttcggactccagaccaggcattacatacaggatcccatgctctctcctattaggtgctccggttcgaccaacttcaccaccagatgatggagggaacgtgtactgaagatagaaactctttgattcctcggtgtcaccaagagtgtcaattctttgtgccatctgatagtcacctaaagtgaccccagccagtgccttacctgtgtttctccccttgtggacaatgcactaccatgtgcccgtgggagtattccacattgagaattaatggggcgaagctcacaggcactccgtccatcgcttcgcttttcacatcaatcatcggtgagggagtcttggaggatacccatctacagtgccaaaraaatgtcttacataatggaacagagcaagtaggttttttcccaaactagtggttggggcgcacccaggtgcgccgcctgagaggaagctagggcggtgctagataggatgcgccccttccactttcttgattgtaccacgtgatgttatttcgtcagaatcaaaatatagcaatatgaagtactggtacatgcacgttcacatctaaaaccagaggctggcgacggtcgatgatacatgaggcaatggaaaatcactgcttgggtcatgagcgggtaagacgcgtcggtctccttggcgcacttgcccggatcgcccatgccctgacttcacttccacggcaccttgaaggcgtcatcgttggtgcaggcgtccctgatgtacaccagcaggacgtcgcttcagtagccatcaattgttatcacatgctttttcagtttgtttttgttgcatgcttcatctgattcaccaaacgggtagtcatccttcctgtcactcccaccattattaatcacaaacttataagcatagttcatgagcctacccgccacaaccagcattgtgggatctgtcacaaccgaatagtttctactcaggaaggctgagaagagagcccgtcgcgatcttgtttagtccttccatggcacctgaaatgacagtccagaccacattaaccggaagtacctcggccgcgaccacgcta

SEQ ID NO: 10716 - DNA, 583 bp, Triticum aestivum
  Clone ID: PAT_TA_10716
ctcatacttcactgctagtactaccgtggcaccaagctctctcccgccaagatgtcgacggtcacccgcgcctacctcgaccagaggctcgccctcgccaaccgctgctccagagaggctgccatggccggagccaaggccgctgccgtcgccaccgtcgctgccgcagtccccaccctggcaagcgtgaggatgctgccgtgggcgagggcgcacctcaacccgaccgggcaggcgctcatcatctccaccatcgccgggatggcctacttcatcgtcgccgacaagaccatcctatccatggccaggaagcactccttcgacgacgcgccggaccacctcaagaacacctccttcaactaattagactacaatagtagatccattagtagtgcgcagcgacggcctgaaagatagtataatgttcagcacctatctgatatcaggccaagttcgcagacagtgagtggtgtagtactgcgcttctctgccgctctgcgtgcaagcacttgtctgatgatgtatccagccagtaatcttgaattaataataacctgcatctgtacaactcagttcacctgcc

SEQ ID NO: 10717 - DNA, 1466 bp, Triticum aestivum
  unsure (1)..(1466): unsure at all n locations
  Clone ID: PAT_TA_10717
gtggaagctgctgcaaaaatagtgattcatgactggaatgaaggcaaggtaccctactttacactgccacctaaaagggatgttgtggaggacgccaatgcagtaattatcacagaagatggaagtgaattcaatgttgatgaaatttacaaagctgagtcttcatatattagtggtctaaaatctatggaggagttcagtcatattgaaattccatctaatgccccaccagagattgatgaagcgatgctcgaggatcccccaacgcagagtgcacctgtgaaggacgaatcgatgtcggacgcgaacgaccgtgaaggaagcaaggcggcggccagcggtggcacgcagcacgacaagctgtacaccgccgagggcatcctcgacccccgcaagaagaaagcggagaagaagcggcgcaaggggaacaagttcagcgtgctgaacgacatggacgcggactacgacttcaaggtggattaccagatgaaggatgcctcccccgcggacgatgaagagggcgatggcagcaaaggcgaaggcgaagaacccaagggtgaagacgacaagaaagacgcccctgctgcggagtgcgagcccatgacgacgagttgatgatgcgtcatgagataaaaactgcaggctgggagtgcgaattagtagggttgtattacaactgtatgatgtgggctgccaacaattggcaggagtttttgtacgccgatgaagacagacgcaacaaatgggatgatgcttgtttttagaaaaagtgtcatcaagcctggtatggttgttacctttggtcccactggtctgacaactgaggtcaagtctgttgagatgcaccacgagtctcttctggaggcgcttcctggtgacaacgtcggcttcaatgtcaagaacgttgctgttaaggatctgaagcgtgggtttgttgcatccaactccaaggatgaccctgccaaggaggcagccaacttcacctcccaggtcatcatcatgaaccaccctgggtcagatcggcaacggctacgccccagtgctggactgccacacctcccacattgctgtgaatttgctgagctggtgactaaagattgacagcgatttgggtaaggagtgggaggcgctgccaattcctgaagaacggtgacctggtatccgtgaagatgatccccaccaagccatggttgtggaaacttcgcaactacctcctcttggcgcttcncnntgcttacatnaanaacgttctnttgtgtcatcnaggcttgnnaaanaaggcccaaccgggcaaggtaccaaggtgcatcaagaaaatagatctacnacaaaaantttgtcaaaggcatgctttgttncngaaancttacccggnnaaaanatccgtcgtnttaatacgnattcatcctntcgnaaacccgtccttaaacgatttntaatcannttttngggggcgacatccnaag

SEQ ID NO: 10718 - DNA, 1005 bp, Triticum aestivum
  unsure (1)..(1005): unsure at all n locations
  Clone ID: PAT_TA_10718
cccacgcgtccgcaccaccactctctgctcctacggctaagccaagcaagcgcgaaagctgagcagatcagatcaggtggagctgagacagagatccgacccggtgcaccaggccgcacacatgccccacctcgcagcgtcccccgcgtccgcgttcgccgtcgccgggttccggcccccaccccgcgcgccgacgcgggcgcgggcgtctgccacggccggaggagccgcgcgcacggccacggcggtgcagcagcagacgcagcagccgacgttctacgacctgctggggatctcgccggaggggagcaccttcgaggacgtgcgggcggcgtaccggcggatggcgcgcaagtaccacccggacgtgtccccgccggacgccaccaaggagcacacgcgccgcttcatccaggtgcaggaggcctacgagacgctctccgaccccagccgccgcaccagctacgaccgcgccctcgcccgcggcgtctgccgcctcgccttctcccccgccgcgcgccgccacgacgcctccgccttctaccaccaggagcaggaagagaggtctggatggaggacgtcctgggaaggccaaatatccgagctgaagaagcggagcacggtgaaggacgcagaagagaacctatcctggggagctcagatgcgaagaagggctgaacaattgtgacagtgctcctcggacactcttatgtccactagccatccgtagcatctaaactgtctatatctttgagtagcagaagttagaaaggttatgcttaagaagcatggttaggatcggagttacagccatggcgctgctcgagccttgcctggtgtatgttaaaccatactaccatacatagctcacagcaaacatatagttcgaataggtgccaggatgtatgtcgaacccaacgatgtcgctcctccttggatcttacctgatgaaatgtaaatataatgagacagaaaataatcgaagctagttgtanttttgagtcc

SEQ ID NO: 10719 - DNA, 544 bp, Triticum aestivum
  Clone ID: PAT_TA_10719
ttttttttgacgaagcaacatagaacttgatatatttaagaggacatcgtgcacgagacgacacacgccaccacaacgccttattacagtgaggtatacgcacgtacgtagacgtggggtaccatagagaacaagttcctggagagccttatatgagctacgctcattcttgaaggcacatggcggcaggtgaggtgatacatcacacacattagtagcaagcatcatcatagttatttaacccagcactcgaccatctcgatacagtcgatgattagccgattattagggagtacataatcgtctgttgcagtagccagcagcagcgacgacgaacacccgcgtgggttctacatgcagaagggctcacggttgatgtcaaacttgcaagcagaagacatctggggctccctccacgccactgaagttggcgaccctgcgggatggagcaagccgacgggggcccttgcaggttgcagttgccggcgccggcgcgcatggtggtcctcatggaggtgagcaggctgccgtaggtggtgcgggg

SEQ ID NO: 10720 - DNA, 1011 bp, Triticum aestivum
  Clone ID: PAT_TA_10720
ttttttttttttacagtaaattgtttgttctcatataaatataacttcaggcaaccctagaatttccgcgctgccaatacagctaacagtcgttggcaccaacacgctggtgattgattattcacacccacagttaaaaaaacaaaaccccgcaaaatgacgtgcgtctcatatgtaaatcatcctgccgccgcctcatcagtaggtgtagcccttctggaacatgcccttcttggcctcgtcgctctcgccctcgcccgtgtagctgccgagctgcgccaacgagttggccttggcgcggaccagcaccgagttctggagggcccgggcgtacgagaaggacacgtgccacgggttggcggactggttcatcgcgttcaggttcatcgtcgcctccagttcagactgcccgccggaaaggaacatgattccagggacagcaggtggtactctcctcctcagcattgtgagggtgttcttcgcaatggcttctggagaagccttctccttgtgctcagcaccaggggtaaccatgctgggcttcagcaggatgccctcaaaaagaacattgttttcggccaggtagaagaacacctcggaccacaccttctcggcgacctcaagagttctctcgatgccatggtcaccgtcgaggaggatctctggctccacaattggcactaaaccattgtcctgagcaatagcagcatagcgagcaagtccccatgccgcttccttgacagctaatgcagtaggaccacaagggatgctaacaacagtccgccactttgcgaagcgtgcaccttgcttgtagtactcagcacaccttgaggccaaaccatcaagaccttggcaccaggattcattgttggatccgggcaatggaaccaaacccttgtcaaccttgataccaggcatgatattctggtccttcaagacatcaacaaaggtcttgccatctgtagtggactggtagagagtttcctccggacgcgtgggcggacgcgtggg

SEQ ID NO: 10721 - DNA, 1014 bp, Triticum aestivum
  Clone ID: PAT_TA_10721
tttttttttttttttttttaattctgaaattataaacacataaaaaaaataatacttctagtacagatgcattcatgcatcagcaagtcatcgtaaacatatttgcacagaaagatacatattctgcgctcatacaccagtgggctaccacgtgtagttgaaactcgagattagaattgctgcaacacagtcggcaaaagaataaggttacaacatggtataagggcttcggctgcatctgcacggctactctgtctcggtgaccggaggcactgcatccaccttgtaccggagagtctttttgaagaatgttgaatatgagttgtcccatacaagcttgtacgatccagcgaaaacagtgcaaaagttaccttggtcagcttcataacgtcggtagggaagaatcaacgttttctcccgtgacgggcttatgtactccacatgaaagccaatatccagcagtgtgctgagggccccttgttgcaacgagaaatcccatgcaatatatgagttgacagcctcaacacttaaaataacctcatgtgtctttcccgctggaataatggtttctcggtactcatcgtttttcctactcgaatcagcacctgcatcctcagcagatatgaagaatggggcattcacaaaaacctcaccgatgaatgtagtgaacttcccaaattcctcggtgtatataaccactgcctgctgcaacacagcaatgtcatccttccctattttcttctgtccatatcgtgccaaagagagatgtagatacaaccgaactgcaagcaccagttttgtaagtgtgtatagtgctggcccgtagcgttctctttgcacttccataggtccattagcatcatttatttgtcgaataaaatccaataacacctgtggaacaccaaccaagtacctaacaagtgtcttatatacacctgttgcagaaccaagctgcgctaattgcacccgcctatccatttgctgcttccatagcaatgcatatcctcgtgccga

SEQ ID NO: 10722 - DNA, 617 bp, Triticum aestivum
  Clone ID: PAT_TA_10722
tttttttttttcgacctcactttatatagataaatcgacgagttccacaagaacacgattatcgaatacaaaggttcagcaagcaaaagggaaatagttcgggcaggggcggcagcataggtaagcccgatataaagaagaagaaaacaagcttttacccttttgttccacacgagatttctgttctcgttgagctcatcttaggacacctgcgttatcttttaacagatgtgccgccccagccaaactccccacctgacaatgtcttccgccgacatcgaaggatcaaaaagcaacgtcgctatgaacgcttggctgccacaagccagttatccctgtggtaacttttctgacacctctagcttcaaactccgaagatctaaaggatcgataggccacgctttcacggttcgtattcgtactggaaatcagaatcaaacgagcttttacccttttgttccacatgagatttatgttatcgttgagctcatcttaggacacctgcgttatcttttaacagatgtgccgccccagccaaactccccacctgacaatgtcttccgcccggatcggcccggtaagaccgggccttggagccaaaaggaggggacacgccc

SEQ ID NO: 10723 - DNA, 725 bp, Triticum aestivum
  Clone ID: PAT_TA_10723
ctcccaaaccctacctcctagctccccctcccctcccatcgttgcggcggcgacagagagagagagagagagagagagagagagagagagatggcgaagtctctgcgctccaagcgggagaagcggctgcggactctccggcgggagatcgcggagcccttctacgacaagaaggaggccgccaagcaggccgcgcaggccgccgccctcgaggcccccaagctccccgtccgcgtgcacccggcgtacgaggagtccctcgccgccgccgctgccgccgccgccagccgggcctctgccatggaggttgatggaggaagcaagaagtcgacatcctttctgaagccaatgggcaccattagcaagaagaaggtacagcttcacttgaagatcaagaaagacaagagaaaagctaggaagaagggaaattctgggaagaagagttactagatgtgcgagctgctgtgttatgtatcatgcaatcttgtttcgttagtttgaacaacgcatgtaacggtaattctgcttgtgaacccaagtgttaatcctagggtggtcaacaatgtactgaaaaatatctcaatgagcaccccaaacgaaaaaaaaaaaaaaaaaaaaaaaaaaaaaaaaaaaagtaaaaaaaaaaaaaaaaaaggcccctaagggactaaagagggggaaataagagaaaaataggcctattggggtttttgggggcggagtag

SEQ ID NO: 10724 - DNA, 916 bp, Triticum aestivum
  unsure (1)..(916): unsure at all n locations
  Clone ID: PAT_TA_10724
acccgaaaatcacgtattcattacttaaatggaactgctgtaccagcaacttcataaaccaaacacataacagtgactcgatatagttcattaaaccaacataggacactaaggcgaacgagagaacagttcaaatgaacggacacaacggacaaccaagcttccagcaggtccaacggcagggcaattactgaccaccacggaggcggagcacaaggtggagggtggactccttctgaatgttgtagtccgcaagggtgcggccatcctccagctgcttgcctgcgaagatcagacgctgctggtccggggggatgccctccttgtcctggatcttggccttgacattgtcgatggtgtcagagctctcaacctccagagtgatggtcttccccgtcagggtcttcacgaagatttgcatgccaccacggagacgcaggacaagatgaagggtggactccttctggatgttgtaatccgcaagggtgcggccatcctccagctgcttgccagcaaagatggcgctgctggtccgggggaatgccctccttgtcctggatcttggccttgacgttgtcgatggtgtcagatgactccacctcaagagtgatggtcttgccggtgagggtcttcacgaagatctgcatgccaccacgcagacgcaggacaaggtggagggtggactccttctggatgttgtagtcagcgagggtgcgaccattcttcanctgcttgccagcaaagatggcgctgctggtccggggggaatgcccttcttgtcctggatcttggccttgacgttgtcgatggtgtcagatgactncacctcaaaantgatggtcttgccgggganggtctttacgaananntgcatgccaccacccaaacccaggaaaggtgggagggnggacttctt

SEQ ID NO: 10725 - DNA, 565 bp, Triticum aestivum
  Clone ID: PAT_TA_10725
aaacggaatttcggaacaaacttatatatgttctcttgaaaccactgtgaagtcccaactttctcaacaatacttttattagtagttcggtgtactctgcttttacacccctgatgacagaaacagagtcaccacaggacaacttcacacaaattaattcctattattagtgctggccactgggccgctgatctcaagctcgactgcgttgcctcgacggactagtgagcggaaggcgggacaggcagcgggcggtcgtgcgccggcaggctgttgaccatgaaggccttgtcttcttccacggttgaaggccttccacctccatcgttttctccaatggtggaggagtgggcatgtgcagtggggtaagtcggtggctgcattccgggagcagatcctcctcccctgatgcggccgccgccggtgtagggctgggcatggccgtcgaccacaagctggccgcagacgagcgccagaaggaccagagcagggaatgccttggacgccatctctcttggtctctcactttggtttgattgcgtgattctctgcctatgtgggcact

SEQ ID NO: 10726 - DNA, 633 bp, Triticum aestivum
  Clone ID: PAT_TA_10726
ggcacgaggagcacacccgccgcttcatccaggtgcaggaggcctacgagacgctctccgaccccagccgccgcaccacctacgaccgcgccctcgcccgcggcgtctgccgcctcgccttctcccccgccgcgcggcgccacgacgcctccgccttctaccaccaggaacaggaagagaagtctggctggaggacatcgtgggaaggccaaatatccgagctgaagaagcggagcacggtgaaggatgcagaagagaacctatcctggggagctcagatgcgaagaagaagggccgaacaattgtgacagtgcacctcttacactcttatgtccactagccatccgtagcatctaaactgtcgatatctttgtgtagcaaaagttagaaaggttattcttaagaagcatggttaggatcggagtacagccatggcgctgcttgagtcttgcctggtgtatgctaaaccatactaccatacatggctcacaggaaacatatagttcgactaggtgccaggatgtatgttgaacccaacggcgtcgctcctccttgaatctttacctgatgaaatgtaaatataatgagacagaagtaatcaaatctagttgtacctcggccgcgaccacgcta

SEQ ID NO: 10727 - DNA, 825 bp, Triticum aestivum
  Clone ID: PAT_TA_10727
tttttttttttttttttttttttgaacagatgaacagttacagccgggagtaatgaactgaactattttttgttctactctgatacaaggtgaacttcactagctaccacaagaaaaagactcctgcttttttattttgctactgcaaggagcactggagcatcaaaggctccaagctattcttatgatcacaaggaattgcaaagatggcaaaacatctcacggatacagttggaggaagagaagccgcggcgagtttcgaaactcttctgtcaaaagtcgaaatcagtaacttgcgaagggtcgaagaggaatgggtagggcaggcagaccagcagccccaggaacaaaatggcgacgccgaggccgatgtagatgttctcgggctccgttatctcctcggagaggggagctatcggacccctctgcaggaagaagatgagcaccgcccagtagaacgccacgtcgctgaagagcgacgagagcccgagcaatgcaatggtgacgctgccgagccgggatgatacctttcttccccacatggcgagcgctatgcggccgccgtcgagctctcctgcagggatgctgttaatggcgttgatcaggagaccagcccaagcccacaaaaccagtgggttgattgatagctgtgttccttcttttagaacatctccaagaataagctttgcaagaccaccaagaagaaatgattgatgaaatacggcgggatctacgatgataccaagaccgtcacttggaggtaacgtgaagcccagcagaagaagaccaaatccgagcgaaaaccccgcaaccggtccagcagct

SEQ ID NO: 10728 - DNA, 826 bp, Triticum aestivum
  Clone ID: PAT_TA_10728
gttgccactttactccaaattcgtctttcacagcaaataaaaaatatctacaacatcacacagttgctttccaggaacagtttgcgatgaaaaaatctgggtctatttaagtctccctccttaagctttgccggctcgtctgctccagtgccggcaacccccgaatccatgaatcctgatccccatgtcggacgtttacaagaaagccaagcccggccgcctcgtcttcaagggcggcgaggccgccaccctccgcaagcccaagaagcaaaagaagaacaagaagcccgccgacgatgtccccgccgacgccgacgctgaagccgccgccgccgctgctgccgctgcggccacggagggcgccgaagccggaggcgactacaccatcgacgcggcgaagcggatgaagtacgaggagctgttccccgtggagacgaggaagttcgggtacgacccgtccaacgccgcccgcacctcccgcgaccgcaccgtcgagcaggccctcgacgaccgcgtgaggaagaaggccgaccgctactgcaagtgaggtcaggcgctagaatctagggtttgttgattcggcggaatcggtcgccttagattgttgcgcttgaggcgaattagattggtttctggtgttgaaacacatggattaagttgtcggggaactgatttatgttcgattgtgtagtttgatttggtatcgatatgaattatgaaacagccatatgtgatgtgttgctacttttgttcaatgtttgatgcacattggtgataccagagtaacagtctatttatacaatccacaaaaaaaaaaaaaaaaaaa

SEQ ID NO: 10729 - DNA, 1102 bp, Triticum aestivum
  Clone ID: PAT_TA_10729
gcgccaagggtagggtttcacctcgtcgcctccaatcctcgccgccgccgccgccgtcgccttccacctcccgcctccgctccgattccgcctcccttcccgccgcacacccgcctcgcccgcgtcatctgccgcccaccgttgccgccagccacgtctgccgagctccttcgccagcaggtcgacaccaccggatccgtccaccccgtgtcgccgccgaactgccgtcccccgtctcgccgccgtccaagcccgtccacggcctcgagctcgcctccgctcagtttagctggacttacaagcttggaaaaagaatgtttaagaatacattccagtccgggtttctatcgattctctacagccttgggaccaagccgttgcagatatgggacaaggaagttgttgatgggcacattaaaagacctcaggatgaagatatcaagtctaatgtacttgaaattgttggaacaaatgtgcaatcaacctacatcacctgcccagctgaccctgctgccactcttggaattaagcttccatttcttgcccttgttgtgaagaatcttaaaaaatacttcacatttgaggtccaagttttggatgacaagaatgtccgccgacgattccgagcatcaaattttcaatccgtcacaagggtgaagccatatatctgcacgatgccgttgaagcttgatgatggctggaacaacatccagttgaatctcactgacctgacaaagagagcctatggcacaaactacgtcgaggcattgcgagtgcaagtccacgcaaactgccggctccgcagggtctatttctccgaccgcctctactcggaagaggagctgccggccgagttcaagctctaccttccaattcagaaatcatagagctcagaccaagatggatggttgggagtcatgacctccccaggagcccaggcgacatcgatgcatgtcacctcgacgcctgtcaacgtgtaaactatgcgtaaagtatcagaatgcttaatggatgtatctggatgtacgctaattgttgtacgcatgacctgtgtaaaactgttgctaattgaacccccgcccactgctgtaaaaaaaaaaaa

SEQ ID NO: 10730 - DNA, 677 bp, Triticum aestivum
  Clone ID: PAT_TA_10730
actactactacggatctcagccaggagtactcgagttcactagctagctactagttcacttccttcggcaccaagctctctccggcgaagatgtccacggtgacccgctcctacctcgaccagaggctcgccgccgcccagcgctgctccaaagaggctgccatggcgggagccaaggccgcggccgtcgccaccgtcgctgccgcagtccccaccctggcgagcgtgaggatgctgccgtgggcgagggcgcacctcaaccccaccgggcaggcgctcatcatctccaccgtcgccgggatggcctacttcatcgtcgccgacaagaccatcctctccatggccaggaagcactcgtacgagacggcgccagagcacctcaagaacacatccttccactaattagacacttgattagccagtgccaataaagtgtgtacgcaggcccgtacgtgtcttctgaaacatatagtagtataatgttgagcgaggcgatggttgctgtgcggaaaggtggtgtataacccttttctgcgagcaagcactaattatctgatgatttatgatgtagtactccataataatgtggccatgttccccatcgtactagtatctttccaaaggtcatgaatcaataacaaccatagttttgattgaaaaaaaagtcgacgcggccg

SEQ ID NO: 10731 - DNA, 878 bp, Triticum aestivum
  unsure (1)..(878): unsure at all n locations
  Clone ID: PAT_TA_10731
ctgaaattcacttattcattacttgacgatacttctgtgccagcaacattttcaaccaacatataacatggggactcgatagttttcaaaccaacacataggactgacacgaacaagaaaacagttcaaatgaacgacagggtaccaccaaccggacgaccaaggataaaccagcaggtccaacgccagggcaattactgaccaccgcggaggcggagcaccaggtggagggtggactccttctggatgttgtagtccgcaagggtgcggccatcctccagctgcttgccggcgaagatgaggcgctgctggtccgggggaatgccctccttgtcctggatcttggtcttgacgttgtcgatggtgtcagagctctcaacctcaagggtgatagtcttgcccggtgagggtcttcacgaaaatctgcataccaccacggaggcggagcaccaggtgaagggtggactccttctggatgttgtagtcggcaagggtgcgaccatcctccagctgcttgcctgcgaagataaggcgctgctggtccgggggaatgcccctccttgtcctggatcttagccttgacgttgtcaatggtgtcggagctatcaacctccagagtgatggtcttgccggtgagggtcttcacgaagatctgcatgccaccacgcaggcggagcaccaggtggagggtggattccttcttggatgttgtagtcggcaagggtgcgaccgtccttccagctgcttgccagcgaagataaggcgctgctggtccggggggaatgccctccttgtcctggatcttggccttcacgttgtcgatggtgtcagacactcccnccttaanggtgatggtctttgcccgngaatgtctttac

SEQ ID NO: 10732 - DNA, 753 bp, Triticum aestivum
  Clone ID: PAT_TA_10732
cattccaccccgccgcccagcccaaacccaaccccgccgccgccactgccgtcgccgccgcagcgcgcggaggcgaccaccccgccttcgccaagatgcagatcttcgtgaagaccctgacgggcaagaccatcacgctggaggtggagtcctcggacaccatcgacaacgtcaaggccaagatccaggacaaggaggggatcccgccggaccagcagcgtctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccaccggcaaggtaaccaggctcaggaaggagtgccccaacgccgattgcggcgccgggaccttcatggccaaccactttgaccgccactactgcggcaagtgcggcctcacctatgtctacaaccagaaggcttagaggtggcttgcgtttgctctgctcttttacctatcgaggatagaactcatttatatgtgtccctgtttgtatttgaaaactgaaaccttggagtattatgtttcctagaaaaaaaaaaaaaaaaaaaaaaaaaaaaaaaaaaaaaaaaaaaaaaaaaaaaaaagaaaaaaaaaaaaaaaaaaggccccta

SEQ ID NO: 10733 - DNA, 615 bp, Triticum aestivum
  Clone ID: PAT_TA_10733
ttctgttttggtaagatgtaaacgaaatttgggataaacttatgttttccattgaatcaaggggccttggtatagcactttaaacccagactttctcaacagtacattattagtagttcggtgtactctgcttttatacccctgatgatgatgacagaaacagagtcaccctgcaacaaacagggcaacttcacacaaatttattcttattatcagtgcttggccacttgattgttggtctcatgctcggctgcacttgacggtctactgaccggaaggcgggacaggaagcgggttgttgtgcgccggcaggctgttgaccatgaaggccttgtcttcttccacggctgaacgccctccaatggtggaggagtggccatggggaggggcgtaagtcggtggctgcagtccggcagcagatcctcctcccctaatgctgccgccgccgatgtacgcctgggcatggccgccgaccatgagctgggtgcagacgagcgccagaaggaccagagctgggaatgccttggacgtagccatctctcttggtctctgttctttgcttggctgctccgctcttctctgtgtctgtctgtggtgtgtcggaacccggccggc

SEQ ID NO: 10734 - DNA, 881 bp, Triticum aestivum
  Clone ID: PAT_TA_10734
tcgtcctccctcgacgctgccgccgccgccgcctgcctcgagccgccgtcgccatggggagaagacctgcgaggtgctaccggcagatcaagaacaagccgtaccccaagtcaaggtactgccgtggtgtgcctgaccctaagatcaggatctatgatgttggcatgaagaagaagggtgtcgatgagttctctcactgtgttcaccttgtctcatgggagaaggagaatgtgtccagtgaggctctcgaggctgcccgtattgcttgcaacaagtacatgaccaagcatgcaggaaaggatgccttccacctcagggtcagggttcacccgttccatgtgctccgtattaacaagatgctttcgtgcgctggggctgataggctccagactggtatgaggggtgctttcgggaagccgcagggagtctgtgcccgtgttgccattgggcaggtcctcctttctgtgcggtgcaagcccaacaatgccatccatgccactgaggcccttcgtcgtgccaagttcaagttccctggccgccaaaagatcattgagagcaggaagtggggcttcaccaagttcaaccgcaacgactacctcaagttcaagagtgagggcaggatcttgcctgatggagttaacgccaagctgctcggatgccatggccgccttgcgaaccgtgcccctggacaagctttcctgtctgccgcataatctagcagaagactatcagttctgtcgaagcttattttactgtgtggaacttagattccaagcacctgtggtgctatgttattttgtctgaatgttgtgtcgaaccttgttatcgaagatattatctattttgtgatgatggtactaatatgaatggcctgttgaatc

SEQ ID NO: 10735 - DNA, 650 bp, Triticum aestivum
  Clone ID: PAT_TA_10735
cagtatcgtcatagcaataattcatagttctaggacaattttgttaactctggattcatataactcggcaaacacagtgtttgtccatcagaaattcagaacactgaagcaaccatcgaacaaccagctactgccactacagatatatcactactaatcatagaaggcatggaacccaaatcaagtacagttttctccactcctccaccttcttgaccgcgagccaggttttgtgcgccacggccggccagccagcgccgcggctcttcagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgcccctccgggccagcctccggatcgccggcttggtgatgccctggatgttgtcgcgcaggaccttgcggtggcgcttcgcgccgcccttgccgagccccttgccgcccttgccgcgccccgacatggctgagtagcttgggaagagaggggatttggggattttggagcggggcttggtggctgggagcgatgagt

SEQ ID NO: 10736 - DNA, 1208 bp, Triticum aestivum
  Clone ID: PAT_TA_10736
gttgcgggaatttgtcatgaactcattagcagaatcgtacagatgaacagttatagccggagcaatgaactggactacattgttctactctgatacaaggtgaactttcactagctaccacaagaaaaaactcctgctttttattttgctactgcaaggagcacttgagcatcaaaggctccaagctattcttatgatcacaaggaatcgcgaagatggcaagacatctcacagatacagttggaggaagagaagccgcggcgagtttcgaaactcttctgtcagaagtcgaaatcagtaacttgcgaagggtcgaagaggaacgggtagggcaggcagaccagcagccccaggaacaaaatggtgacgccgaggccgatgtatctgttctcgggctccgttatctcccttcggagaggggagcgatcgggcccctctgcaggaagaagatgagtaccgcccagtagaaggcgacgtcgctgaagagcgacgagagcccgagcaacgcaatggtgacgctgccaagccgggatgatacctttcttccccacatggcgagcgctatgcggccgccgtcgagctctcctgcggggatgctgttgatggcgttgatcaggagaccagcccaagcccacaataccagtgggttgatggatagttgtgttccttcttttagaacatctccaagaataagttttgcaagaccaccaagaagaaatgattgatgaaatatggcgggatctacgatgataccaagaccgtcacttggaggtaacgtgaagcccagcagaagaagaccaaatccgagcgaaaaccccgcaaccggtccagcagctgctaccttgagcaggtccccgcgattgcggacgatattgactattctggtgatgccaccaaaagaccctatctgccagctaggatactaaaatatggtaccgaaagcgtgaccccagcatccctagcagcaaggatatgtccaatttcatgaacccctactatgagtccagttaccaaggcaccaggaagtccatctttcaatagctcaaggttatcaaatgttgatagcaagttgtcctgaaggacaggtacattccgaagcagcagagtgaaaatggtaactactccgaatgcaccagcagcagcccactctgggacggatccagtggcaggctccactgtctgcttaggtacaactactgcaactggcc

SEQ ID NO: 10737 - DNA, 661 bp, Triticum aestivum
  Clone ID: PAT_TA_10737
ggcacgaggtcagccagccaaccagcccatctcatctcacttgatcgcaccctttgtactgagccgtttctgcacaagatcacggcgaggatgtcgtcgacggccaccgtcacccgcgcccacctcgagaacaagctcgccctcgccagacgctgctccagagaggcgacgctcgccggagcaaaggcggcggccatcgccacggtcgcgtctgcggtcccaacgctggcgagcgtgcggatgctgccgtgggccaaggcgaacctgaaccccaccggccaggcgctcattgtttgcaccgtcgccgggatggcctacttcgtcgccgccgacaagactatcctctcgctggcaaggaagcactcgtacgagagcgccccggaccacctcaaggacacctccttccatggcgccgcccgccggcaactcgtcccccgtccgccggcattcttcaggcctttgagctagtaattaatcctgctaatgtatgatagcacgcgcttgtccgttgcgcgtattctaaaaaaaatgtatgcatccttgtcagtgtcccaacgcaagaaactgctgcgccggaatgtattatgtatgcacatgctttacatctgtgtactgaataaaactgagggctcgatcctggtttcagataaaaaaaaaaaaa

SEQ ID NO: 10738 - DNA, 646 bp, Triticum aestivum
  Clone ID: PAT_TA_10738
atctcaccaccactactcatcttgcctcacacacttcactgctagctactagtaattcacttccttgggttctcgtgccaccgagctctctcccgccaagatgtcgacggtgacccctgcctacctcgaccagaggctcgccgccgccaagcgctcctccagagaggccgccatggcgggagccaaggccgcggccgtcgccaccgtcgccgccgcaatccccaccctggcgagcgtgaggatgctgccgtgggcgagggcgcacctcaacccaaccgggcaggcgctcatcatctccaccgtcgccgggatggcctacttcatcgtcgccgacaagaccatcctctccatggccaggaagcactccttcgacgacgcgccagagcacctcaagaacacctccttccactaattagactgtaataacagatccattagcagtgcgcgataagctgtgtgcgccagcccgtacgtgtctgctgaaagatggtgtgtaacgttcagcacttacccgaggcttgcagacagtcagtggtgtggtgtactgctcttctctgcgtgcaaggacttgtctgatcaagtaatcatcatgtatccagccagtaatcttgaactaataataacttgcatttgtaaaaaaaaaaaa

SEQ ID NO: 10739 - DNA, 698 bp, Triticum aestivum
  Clone ID: PAT_TA_10739
gcttacttgacttcactacctagctcacttccttcggatctcgtgccaccaagctctcttccacggccacgaagatgtctacggtgaccggtgcccacctagaccagaggctcgccgccgccaagcgctgctccagagaggctgccatggcgggagccaaggccgcagccgtcgccaccgtcgctgccgcagtccccacactggcgagcgtgaggatgctgccgtgggccaagacgcacctgaaccccgccgggcaggcgctcatcatctccaccgtcgccgggatggcctacttcatcgtcgccgacaagaccatcctctccatggccaggaagcattccttcgaggacgcgccggaccacctcaagaacacctccttccactaattaggctatactttcaataattagtagtagtgcgcaataaactacacgccggcccgtacggccgtacgtgtctgctgaatgatactagtatgatgttcagcgagagaggcgaggcgatgcagatcaggcctcgcgcttctatccgtgcaagcacttatctcatgaagttaccatgtaatccagctagtattcttggataaatgaatactagtatttgtacaactctagttcatctgccatcactcatcttacatgtggcagagcataaaaaaagaatctccgacgccgaccctaaaaaaaaaaaaactcgtg

SEQ ID NO: 10740 - DNA, 571 bp, Triticum aestivum
  Clone ID: PAT_TA_10740
ttttttttttccccttgaaagcactgtgaagtcccaactttctcagcagtacatcattcgttgtgctttgcttttatacccctgatgcatgacagaaacagagtcaccctgcaaacatgacaacttcacacagattttatttcttaatattagggctggccactgggccgttggtctcaggctcggctgcactgcctggacctggacggactagtggccggaaggcgggacaggaagcgggcggtcgtgcgccggcaggctgttgaccatgaaggccttgtcttcttccacggctgaaggccttgcagcaccgttgtattctcagctatagatagattaccgatggtggaggagtggccatgggtggtggtgtaagtcggtggctgcactccgtcggcagatcctcctcccctgatgcggccgccgccggtgtagggctgggcatggccgtcgaccacaagctggccgcagacgagcgccacaaggaccagagctgggaatgccttggacgccatctctcttggtctctcactttgcttggctgctctgctcttctctgcctctgtgtctg

SEQ ID NO: 10741 - DNA, 1868 bp, Triticum aestivum
  Clone ID: PAT_TA_10741
gatcccggtagatgaccggcgggttagccttctcatggaggtattcgagacccttagcggttccgtggactatcttcatccttctatgccaacttagtggtatttgatcagtagtgttatctgcgacaacaacagttcaacttataagttttttatgcatctagtaatcaaatgtgctaacggtgacagcacttgaaagtgatgctatactgttgcctcaatatatttcacatgtccgcaaaaaaagagagaatatatttcacatgttttttaagttgaaaatgacgcatcaatgttaattcatgatcaataagaatctagatttttttttgtttttttgcgaaatatgagaatctagattttcgttctagtataatttggatgttaagtttagcactgaaacttgaacgtattaatgaagaaaagactagcgcttaccaagcaggtgatctgcaagtgaacctaaggccatgtactcgtacaccagtagccgctgatctccgtctgcgcaatagcctaccaagctgaccaggtttggatggtgcaagaggctgagcatcaagacttcaaccaggaactcacggttgccttgaaatccgttcaggtctagttgtttgacagctacaatctgatcatgcatcaaaaagataattgaaacaatgagcagattgttacaagtcagtagggctatctgaagaatgtttgtcattgggttgttcctatatatacctggccattttcaagctgtcccttgtagaccctgccaaagcccccctctcccagaaggttgtcggagcggaagttcttggtggctgtcgctaactcacggtatgtgaatgcttttgcatttttggccatgctagacctttcggcaggttcaccgtttgctcttgtttcggatgatgattgcccatgttttggagcctctgcaaggtgagttttcagtatttgttagagagaactccattttgtgcttatttgaaggatcttagttttgctctcgacaaaattcaaacagtctgctgcaatagtctggggtccatatttaaataccattgtggcccatcatgcattattaccagaattcaacatgcattacagggacaagcatggcaacaagatggatttgacaaatggtacaaaacgaatcctccgtggtccttaccagattccatgaggggtgctccagatcgcgtcgagacggtggcatttgcgacggcggaggtggcgacctcccctgaccccgtcttcctcggcgacgtcttcttctcaggcctgaagcatgaaaagcatttcacggtccgaattccccaatgcatgtgcctctcaaccaaacctcctcctccttgtgcccaccacgagatctccaacccctctgctccttacaatccagaagactctttgcacatgcaatggcagcatggacgaggagttctcctcccttgctgcaagatcctggtcacagattgccatcgcactcatcttgcaagaagaatgcgatccctgtggatgggatgtgatcaggtaggaggagcattgtcaccgtgccttttgtggaggtcaatgtgctcagccaagaataggatctctctcggttttaggccacagttgagctctaaaattagaacgcctgcccctttgaagatcagcatcctctggaatgcactggatgtaaacgccttccatcattccctgaattttttcatttgttggccccatggttggtattccccaaggggaaatggcctgctccctgtttgtgtccctgttgttggaatagtggaaaaaaaaagggccccctatgtcatatgccccttcaattatgtcgcttttagcagatgcttcattgagtctgttgtgacgtgttg

SEQ ID NO: 10742 - DNA, 571 bp, Triticum aestivum
  Clone ID: PAT_TA_10742
tgtctcactactactgctgatacttcactgctactaccagttcacttccttgggatctcggccaacatgtcgacggtgacccgcgcctacctcgaccagaggctcgccgccgccaaccgctgctccagagaggctgccatggccggagccaaggccgcggcagtcgccgccgtcgctgccgcagtccccaccctagcgagcgtgaggatgctgccgtgggcgagggcgcacctcaacccgaccgggcaggcgctcatcatctccaccgtcgccgggatggcctacttcatcgtcgccgacaagaccatcctctccatggccagaaagcactccttcgaggacgcgccggaccacctcaagaacacctccttcaactaattaggctataatctgcacgccggcctggaagtattataatgttcagcacttattcgagatcaggcgagccttgcagacagtcagtggtgtagtattgcgcttcgctgcgtgcaacttatctgatgaagtaatcatcatgtatccagccagtaatcttgaattaataatgacttgtatttgtacaaaaaaaaaa

SEQ ID NO: 10743 - DNA, 612 bp, Triticum aestivum
  Clone ID: PAT_TA_10743
cgattcggcacgagctcacatccacgctccacttatacactagctacttcgcttccttcggatctcgtgtcaccaatatctccggcgaagatgtcgacggtgacccgtgcctacctcgaccagaggctcgccgccgccaagcgctgctccaaagaggctgctatggcgggagtcaaggccgcggcggtcgccaccgtcgctgccgcagtgcccaccctggcgagcgtgaggatgctgccgtgggcgaagagcgcacctgaaccccaccgggcaggcgctcatcatctccacggtcgccgggatggcctacttcatcgtcgccgacaagaccatcctctccatggccaggaagcactcgcacgagatggcgccagagcacctgaagaacacctccttccactaattagcctatagtagatccattattagtatagtgtgtaataaaccgtgtctgctgaagcctgaaagatggtataatgttgagcgagaggggcgatcaggcgaggtgatggtataattaactgatgatgtatgtaataatgtggtcatgttctccatcttgtcatctttccagggatcgtgaaataataaccagctcttgtaaaaaaaaaa

SEQ ID NO: 10744 - DNA, 880 bp, Triticum aestivum
  Clone ID: PAT_TA_10744
ctagtctcgagttttttttttttttttttcaacacactcatatttaatatagagatagcaccgacaacatggaaactggaagatctgtatctctgacaatcaagccatgatgtcccagcaccagaaacgaaactctgattcgacaaaaccgcacaagataattttcttaggctaacaagtttcagacatggaacacaatcataacgaagctactagcatcctgcagaatccggaaactggaaggctgtccctagtgcgacttgacgtattcctgcacgatgtgaagaccctccgaatcttcgccgtagtccttcacgacgacacatgagcagcccaccacctttcttgccttgccctcagagtcaatcttgcaaagcccagcccactcgccaagagttttggcactaggcacagtgaccaagtgaacgttgtgctcagcacacagtgccttcaccagcttcacgtaatcaggctggtcgcagtcctcagcaagcacacagatctgagcagcatgcttctcaatcgctttcgcagcttcacgaagtcccttgacaaggccgtcatgagcgcttgacttcttcatcacaagctgcagagcagtcatcagtagggtaaaactaacctgtctcacgacggtctaaccccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaactccgaagatctaaaggatcgataggccacgctttcacggttcgtattcgtactcctcgtgccgaa

SEQ ID NO: 10745 - DNA, 1803 bp, Triticum aestivum
  Clone ID: PAT_TA_10745
gcacgaggctacctgtgttgctctccctctccctccctctccccctctctctctctcttgcgcgcttgcttgcttcccttctccgtgtgagcgaggccaccagcggaggagggctgtgctgaagaaggctgcgccagcgagagcttggtgactggggacgcaggagtttcatacattccacaaaaccactgaaatactggaagactcgcaatctgaagagattacattccgcgaaacagcgctggggtcaacgctagtagatcatcaaaatggtgactgaacatcagtctggatatctggattaatgtaatataggtatattagataatacgaaatcggaagtccactctactgccgcagtatcagcaggagacactggaatggctgaagtcaacttgttgcatggtgaatctgacacatcagctaccggtttactgccagtgtcattcttgtcatgcagtcctagatctatggttccaatatcagttccgtcatcatctggccttgaagctatcctgacacctaatccaatgtacagtgatgttcagttgaaagaagtgatgaactacaatgctacagcaatggatgaaagcactgagttccttcagctgattcttagtggcaatgatgaaggctacaatactacaagcgaactgcaagtttgggatgttctggacttctacttctcagaaagtttttctgatgtacaatttgatagcataatgggttttacaagtgacgtcagtacttcctctcatgattatatgatgaatattgttgacttggtagagcggcctgtggcactcctgtctctcaatgagacagaggaaccaaataatgcaaccaataaggctccagtcgatcacagtacaatggaccctgatgacacatccttgtaccttcaaatgaaaccaccagattcagaaaccgaaagtacttctgcctctcaggatgtgataggaattgagtatgttgatgaaaagcttcattctaaaggtctgcctgatttaatggatgttgactcatccagtcgtctgcgaaaatcaccagtgagaacaaagcatgtcactcttgtgcttgatttggatgaaactcttgtccattcaacattggatcactgtgatatatctgatttcagcattcaagttttcttcaatatgaaagaccatacagtccatgtgagacaaaggccccacctgaagatgttccttgagaaggtagctcagatgtttgagcttgtcattttcacagctagtcagagaatctatgctgagcagataatagataggcttgaccctgatgggaaattgatctcgcaacgaatttatcgtgagtcgtgtatattctctgatggcagctatacaaaagacctgacaattctaggagtccacttggcaaaagttgctataattgacaatacgccacaggttttccagttgcaagtcgataatggcatcccgataaagagctggtttgacgaccccgcggaccaggaactggtcgagttactcccattcctcgagacccttgttgatgcagaggacgtaaggccactaatctcaaggacttttcacggcaccatccagcaggattagatttagatgcatcattgtcgtgcactgagcctgagcctgcgaacttatcttgggaaattaggtataggatcagcattcaccatttatgttatgttggctgttacagatagcaagcataaactgcatgtcgccatggcttgtatacgtagtattgctcgggttttctgtgtggcaggtctgtgtaaataaattatagtattgaataaaa

SEQ ID NO: 10746 - DNA, 658 bp, Triticum aestivum
  Clone ID: PAT_TA_10746
aattaaaatctcacctaactcacactgctgctgacacttcactgtactaccggttcatttccttgcgatctcgcgccaccaagctctgctcctgcgaagatgtgtaccgtaacccgagcccacctcgaccaaaggctcgccgccgccaagcgctgctccagagaggcagccattgcgggagccaaggcggccgccgtcgccaccgttgcaaccgcagtccccaccctggcgagcgtgaggatgctgccgtgggcgagggcgcacctcaacccgaccgggcaggcgctcatcatctccaccgtcgccgggatggcctacttcatcgtcgccgacaagaccatcgtatcaatggccaggaagcactcctacgaggacgcgccggagcacctcaagaacacctccttccactaattagactgtaatagacccattagtagcagtgtgcaataaactgcatgccggcctgcacgtgtctgctgaaggatactagcactagtataatgttcagcaattatctgagatcaggctaggcttgcagacagtgagtggtgtagtgtactggtcttctctgcgtgcaattagcacttatctgatcaagtaatcatcatgtatccagccagtgatcttgaattaataataacttgcatttgtacaactg

SEQ ID NO: 10747 - DNA, 862 bp, Triticum aestivum
  Clone ID: PAT_TA_10747
gaagaaaatggcggcttgtgctgcgcccctttgcgtccgcatctcctgctccacaccttcgcctaccgctctccaccggccacgccgccggcgcgtcacctccgcccgatgctccctcgccgcagcccccggtctccgggcgccggcggagctcgtcgactccatcctctccaaggtgaaggggactgacaggggagtgctgctgccagaggaaggccaccaggaggtcgccgatgtcgcgcagcagctggggaagtactgcatcgacgagccagtcaagtccccgcttatattcggagactgggacgtggtgtattgctctgtgccgacgtcccccggagggatttaccggacccctctcggccggctggtgttcaagaccgacgacatggttcaggtggtggaagcccccgacatcgtcaggaacaaggtgtccttctccatcttcggcctcgatggtgcggtgtctttgaaaggcaagctgaatgtattggacagcaagtggattcaggtcatatttgagcccccggaactgaaggtaggccccttgggtttccaatacggtggcgagagcgaggtcaagctggaaatcacctatgtcgacgagaagatcaggcttgggaaaggatcccgaggctcgcttttcgtcttcctgagacaagattagaagggtaggttgcatattttgcatgtgctcgatgccacaaggtatatcagctatatggatgtctgcacaactgcttgcagacgtaagttcagagataaaacccgcaaagtagtttcttgtgatattaatttctacctgaagcagattgccttgttgtgagcgaaaatgtttgcagtacctgcccgggcggccgct

SEQ ID NO: 10748 - DNA, 811 bp, Triticum aestivum
  Clone ID: PAT_TA_10748
ggctaaacgatcaagtttccagcttcaattcagaagtgattcgagatcaatcgacgctacagactactaccagttcggactccagaccaggcattacatacaggatcccatgctctctctctttctctcccatctcagatgcagaactacgcggcgcaacttggccctttctactcctcggcggcggcctcctcctcggcgtcggcggcggccttcttcttgtcagcggcggcggtcttcttgtcggcggcggcggtcttcttgtcggcggcggcggtcttcttgtcggcggccttcttcttgggggtcttcttggcggcgggggcgggagcgggggccttcctcttgggcgacttgggcgactgggcctccttctcggccttctcgagggccttcttggggagcagcacggggttgatgttgggcagcacgccgccgtgcgcgatggtgacgccggcgagcagcttgccgagctcctggtcgttgcggatggcgaggagcaggtggcgcggcacgatgcggctcttcttgttgtccttggcggcgttgccggcgagctccagcacctcggcggcgaggtactcgaggacggcggcgaggtagacgggggcgccggagccgacgcgctgcgcgtagcggcccttcttgaggaagcgcccgatgcggccgacggggaactggaggccggccttgacggaccgggtcaccgccttcttcctctctccgcccttcctggccatctctcttccctctccggcgagctcggacccctcggaatgcggcggtggatggaatgcgcggaactgcgtct

SEQ ID NO: 10749 - DNA, 982 bp, Triticum aestivum
  unsure (1)..(982): unsure at all n locations
  Clone ID: PAT_TA_10749
gcacgagggaaagaacggcttttggctgaaggcaatgcagctttggaagcccgcagagctgaagccgaagctgaatctaagcgtaagctggaccttgagagggaaaaggctcgtcaggccttgcaggagatggagagaactgtagaaattaatgacatcgtccatcccaaggacctagaaatgcttggtacagtcaccacggaacatattatgagttctgttgatgagacgagtcccgagcattccctggatggcctgcccagttttcttcctggttctggcagcatgttggaaaaacttggactgtttatgaaagtggatgaggaagaagaggaagaagagccatgcagcaaagatgcagaggtcggagaaatcaactaatgtgtgttggcatgttggagccttgtcaaagacagaacaaccgcctgtttcagccgatgcacatagggaaattgctgggtagctgtgcacatttcggacatttttttctcgatcggtgcacagaataccctcatatttgaganntgttgcttgcaggatgcgcgcccgcccttggaaggggagggaggatagagatcgaggccaccatgtacagctgcaaatgaaaatgtgagttcatctcccaaatgaactttgtcccagaatcgagacgcggtgctgggagctgttgtcgggtgtattaatctgataaaagccctggaaatacaggaggaccaaatggttccgtcacactgctcgcctcccatctgcactgtgatccaagtgtgttttcccctagcggctagttgtttgctcagcatagcttctcttattagttttggatgttttgttgcttcctgctgtaaattcaaattttgatgtagtacaggaagtgctttagttgtttgctgggcattttgtaacaggaaaaacgtgtggaaatgttaaatctagttcaatgttgtgaactccccccaaaaaaaaaaaaaaaaaaaaaaaaaaa

SEQ ID NO: 10750 - DNA, 1025 bp, Triticum aestivum
  unsure (1)..(1025): unsure at all n locations
  Clone ID: PAT_TA_10750
ggacgaggctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtgggcttcaacgtcaagaatgttgccgtgaaggatctgaagcgtggttttgttgcatccaactccaagggatgaccctgccaaggaggcagccaacttcacctcccaggtcattatcatgaaccaccctggtcagattggcaacggctacgccccagtgctggactgccacacctcacacattgctgtcaagtttgctgagctggtgaccaagattgacaggcgatctggtaaggagatagaggccgcgcccaagttcctcaagaacggcgatgctggcatagtgaagatgattcccaccaagcccatggttgtggagacctttgccacttaccctcctcttggtcgttttgctgtccgtgacatgaggcaaactgtggctgttggtgtcattaaggttgtggagaagaaggacccaactggggcccaagggaccaaggcttgncattcagaagaaatgaggcgt

SEQ ID NO: 10751 - DNA, 1097 bp, Triticum aestivum
  Clone ID: PAT_TA_10751
aggagctggagaaactgcagaaggaagaaaaagaacggcttttggctgaaggtaatgcagccatggcaagctcgcagagctgaagccgaagctgaatctaagcgtaagcgggaccttgagagggaaaaggctcgtcaggccttgcaggagatggagagaactgtagaaattaatgacagcgtccatcccaaggacctagaaatgcttggtacaatcaccacggaacatattgtaagttctgttgatgagacgagtcctgagcattcccaggatggcatgcccagttttcttcctggttctggcagcatgttggaaaaacttggactatttatgaaagtagatgaggacgaagaggaagatgagccatgcagtttccctagcagtaaagatgtggaggaagtagaaatcaactaatgtctgttgacatgttggagccttatcgtcaaagacagaacaattgcctgtttcagcttgacgagggaaattgttgggtagctgtgcacatatcagacattttttttctgaaacggtgcaccggattccctcatcatatttgatgccgctggaggtgttaagtcatgcttgcaggatgcatgcccttggaagggaggatagagatcgaggccaccatgtttcctgcacggcccttggaagggaggctagagatcgaggccaccatgtacagctgcaaatgaaaatgtgagttcatctcccagatgaactatttctcccagaatcgagacgttgctggcagcggttgtcgggtgtattatgatctgatgaagctcatgtagagccttggaaatacaggaccaaatggttccgtcacactgctcacctccatctgcactgtgatccaagtgtgttttcccctagcggctagttgtttcctcagcatagcttgtctttttagtttttgatgttttgttgcttcctgctgtaaattcaaattttgatgtagtcgaggaagtgctttagttgtttgctgggcatctgtgatgaacagctcctgctattcttgtaacaggaaaaacgtgtgcaaatgtgataatactaaattcagttcaaaaatgttgtgaactccctcaaaaaaaaaa

SEQ ID NO: 10752 - DNA, 617 bp, Triticum aestivum
  Clone ID: PAT_TA_10752
agccagcccatctcatctcatctcgctcgatcgcactccttgtgctgagccgtttcagcacaagaccacggcgaagatgtcgtcgacggccaccgtcacccgcgcccacctcgagaacaagctcgccctcgccaaacgctgctccagagaggcgacgctcgccggagcaaaggctgcagccgtcgccaccgtcgcgtctgcggtcccaacgctggcgagcgtgaggatgctgccgtgggccaaggcgaacctgaaccccaccgggccaggccctcattgtctgcaccgtcgccgggatggcatacttcgtcgccgccgacaagaccatcctctcgctggcgaggaggcactcgtacgagagcgcccccgaccacctcaaggacacctccttcgctggcgctgccgccgctcgtccccgtccaccggcattcttcaggccttgagctactgtcctgctaaagtatgatacgcacgcttgccgttgtgcgtattctagaaaaaacgcatgcaccgttgtctgtcagtgtcccaagaaactgctgcggcatgaatatgctgccgccgaaatgtatgcacatgctttacatctgtgatctgtgtactggataaaaaaaaaa

SEQ ID NO: 10753 - DNA, 916 bp, Triticum aestivum
  unsure (1)..(916): unsure at all n locations
  Clone ID: PAT_TA_10753
atctgaagttcacttattcattacttaacgatacgccagcaacagtttcaaccaacagataacatggggactccatagttcataaaaccaacacataggactgacacgaacgagaaaacagttcaaatgaacgacaaggcaccaccgaccggacgaaaaaggataaaccagcaggtccaacgccagggcaattactgaccaccgcggaggcggagcaccaggtggagggtggactccttttggatgttgtagtccgcgagggtacgaccgtcctccagctgcttgccagcgaagataaggcgctgctggtccgggggaatgccctccttgtcctggatcttggccttgacgttgtctatggtgtcggagctctcaacctccagagtgatggtcttcccagtgagggtcttcacgaagatctgcatgccaccacgcagacgcaggacaaggtggagggtggactccttctggatgttgtagtcagcaagggtacggccatcctccagctgcttgccagcgaagatgagacgctgctggtccgggggaataccctccttatcctggatcttggccttgacgttgtcgatggtgtcggagctctccacctccagagtgatggtctttccagtaagggtcttcacgaagatctgcatgccaccacgcaggcgcagcaccaggtggagggtggactccttctggatgttgtagtcggcaagggtgccggccatccttccagcttgcttgccagccaaagataaaggcgctgcttggtccggggggaatgcccctccttgtcctggatcttggcctttgacgttgtcgatggtgtcagagctctcaaccttccaaagtgatggtctttgccggtganggtcttcacnaaaatttgcatgccaccccnccaacncaggaaagg

SEQ ID NO: 10754 - DNA, 1611 bp, Triticum aestivum
  Clone ID: PAT_TA_10754
gtcaagcaatgcttctttgtgattattaagaaaaagtaatgcttctagtacagatgcattcatgcatcagcaagtcatcgtaaacatatttgcacacaaagatacatattctgcgctcgtacaccagtgggctaccacgtgtagtgtatgatcgttgaaacccggcgattagaattgccgcaaacagtcggcaaaagaataaggttacaacatggtataagggctactctgtctcggttacaaccggaggcactgcatccaccttgtaccggagggtctttttgaagaatgttgaatatgagttgtcccatacaagcttgtacgatccagcgaaaacagtgcaaaagttaccttggtcagcttcataccgtcggtagggaagaatcaacgttttctcccgtgacgggcttatgtactccacatgaaagccaatatccagcagtgtgctgagggccccttgttgcaatgagaaatcccatgcaatatatgagttgacagcttcaacacttaaaataacctcatgtgtctttcccgctggaataatggtttctcggtactcatcgtttttcctcgaatcagcacctgcatcctcagcagatatgaagaatggggcattcacaaaaacctcaccgatgaatgtagtgaacttcccaaatttcctcggtgtatataaccactgcctgctgcaacacagcaatgtcatccttccctattttcttctgtccatatcgtgccaaagagagatgtagatataaccgaactgcaagcaccagttttgtaagtgtgtatagtgctggcccatagcgctctctttgcacttccataggtccattagcatcatttatttgtcgaataaaatccaataacacctgtggaacaccaaccaagtacctaacaagtgtcttatatacacctgttgcagaaccaagctgcgctaattgcacccgcctatccatttgctgcttccatagcaatgcgtatctatcatgaatgcttccaccagcactaactacagcatcaacctccgcttgcttatttctctcagagcgttctcgctgttgcctgatcagtgtaccgcggaagtcttgtggcatgtatgtcataactgtattgaaaacattatcggcattttttagctgaaactgttctaacttcttcaacatctctttcaatttagtttcacaatcatcaagtgtggaaactatctcagcgtcttctggtgtggacttctgttgaagagcaactggacgacgagatttattaagcagaaacagaatctcttccatctgttctctgttcttccacatgttctcatctattttatgggcaggtacaccagatgcctcttgtttcaagtgctcctcctcgggggagaagggagaagcggcggcgagttcggcggacagagcgcggaggcgggcagagagggcggttacgccgtcggggatcgggggcagcgggtacttgtcgtagtagcgcgcgaggtagtcccgcgtgatcggcaccagaccctctgtcgtcgtcatctccggtgggaagattggagagcgacggggacgagttcgccggcggtaggtggaggtgccgttgaagggtggtaggtcaccgggc

SEQ ID NO: 10755 - DNA, 1020 bp, Triticum aestivum
  Clone ID: PAT_TA_10755
caaactccagaagaaaatggcggcttgtgctgcgcccccttgcgtccgcatctcctgctccacaccttcaccgaccgctctccgccggccacgccgccggcgcgtcgcctccgcccgatgctccctcgccgcagcccccggtctccgggcgccgccggagctcgtcgactccatcctctccaaggtgaaggggactgaccggggcgtgctgctgccggaggaaggccaccaggaggtcgccgacgtcgcgcagcagctggggaagtactgcatcgacgagcccgtcaagtccccgcttatattcggagactgggacgtggtgtattgctcggtgccgacatcccccggagggatttaccgcacccctctcggacggctggtgttcaagaccgacgacatggttcaggtggtggaagcccccgacatcgtcaggaacaaggtctccttctccatctttggcctcgatggcgcggtgtctctgacaggcaagctgaatgtattggacagtaagtggattcaggtcatatttgagcccccggaactgaaggtaggctccttgggtttccgatatggtggcgagagtgaggtcaagctggaaatcacctatgtcgatgagaagatcaggctcgggaaaggatcccgaggctcgcttttcgtcttcctgagacaagattagaagggtaggttgcatattttgcatgtgctcgacgccacaagggatatcggccatatgggcgtctacgcaactgcttgcagatgtaaattcagagataaagcccacaaagtagttttttatgatattcatttctaccttaagcagattgccttgttgtgagcgaaaatgtttgcggtaaaaaaaaaaggagagaactagtctgagttttggttatttgtgtcgagcagtgttcgaactgcttattactgtggtcatagtatcgttcggttgtgttggtgaaacttcgtcagataaagttgctattttatatttgagtgatatttggagtcgttttaaaaaaaaaa

SEQ ID NO: 10756 - DNA, 748 bp, Triticum aestivum
  Clone ID: PAT_TA_10756
agcctccattcccaccgcgccgcccaaccaaaccccaccgcgccgccgccgccgccaccgtcgccgccgcagcgcgcggaggcgaccaccccgccgccgccaagatgcagatcttcgtgaagaccctgacgggcaagaccatcacgctggaggtggagtcgtcggacaccatcgacaacgtcaaggccaagatccaggacaaggagggcatcccgccggaccagcagcgcctcatcttcgccggcaagcagctcgaggacggccgcaccctcgccgactacaacatccagaaggagtccacgctccacctggtgctccgcctccgcggtggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgccccaacgccgagtgcggcgccgggaccttcatggccaaccacttcgaccgccactactgcggcaagtgcggcctcacctacgtctacaaccagaaggcttagaggtggcttgcgtttgctctgctaaaatcgaactcatttatatgtgtcccgtttgtctttgaaaactgaaatcttggagtattatgttatgtttcctggatatttgatcgtctattgctgagatgggatgcgagcttaaattttggtcattctgatgacgttaatctatttcatgc

SEQ ID NO: 10757 - DNA, 924 bp, Triticum aestivum
  Clone ID: PAT_TA_10757
atcctttctttttacctgccccagccgagcgccgttgaaccgggcgaccaatccctccctgccgccggcgagcaatctccgccacggccgccgcagcagcagcgaggagaggaggaggggtccggccgtccgggatgggcgacgagcgcgtgaaggcggaggcgctgcagatcctgggcctgttccaggtgctcccccgcctcgtcgtcttcgacctcgactacaccctgtggcccttctactgcgagtgccgctcgaagagggagtcgcccagcctgtaccgccacgccaagggcatcatgtgcgcgctcaaggagaagggggtcgacatggccattgcgtcgcgctcgcccacctccgacatcgccagggtcttcattgacaagctcgagctccagcccatgttcgtcgcacaggaaatattctccagctggactcacaagacggagcatttccaaaagatccacagaaaaactggggttccgtacaagtccatgctgttctttgacgacgaggacaggaatattcaatcggtatcgaaaatgggagttactagtgttctggtaaacaacgggttgaatctcgacatgtttaagttgggcctcagtaattttgctactactgctgctgcacctgaacccgcacctgcaccagaggacaagtaaccttatattgtacaagtaaaaacagcagacagggaaaacgcccatgatttacggatacttgtgaaaaataagcctgtatttcttgtagttgattgcccttgctcatgggcaagtaaagcaaggatgactactactgaaaccattctgtgtgtaagcttgtgttacttgtgaaagtgcgttccttgtgaaaggaaatgaatttggacccatttggttgccgatgttaaagattgtttggccaacttttgctgaatgctcc

SEQ ID NO: 10758 - DNA, 1028 bp, Triticum aestivum
  Clone ID: PAT_TA_10758
gaattcactagtgattagcgtggtcgcggccgaggtgagactagctcgagtttttttttttttatgtaaactaattaccaccaatctttcaatttaagagtgaattcttaaattacacctcagtgtaaccacaaacggtgcctcttatttgttcaacttcaagcacaaacttcacaaccacagtactacaaatacagtgcatacatcaagctgaaatcaataacgcacacacagcacatacactgcaaaccacaacatccacaaagtgctaacacatctgacaccaggaacaggaaccatagctgccgcttcatcaaaccaggttgcaataacattcaatcgggcgcaatttacagggtaacaccaagggacgtgaacccattccaagctgtagcacgacagagccactgtcaacgttcttcagcttcagaatcaagtcttggacgaccttgccattcttccacgacacctggctctcaccgccaaggtagtttgtgccaactgggtagatcgtcttgatcctggttccgtcagaggcatgctttagatccagctttgcaccgtcatagatatcagttacgttgaactcagccactcccatgcttgtcatccgcttgtgaatttatcctcatcaaaaacctcaagtttcactggctttgtaggatttgtgacagggagcaccaatacatcattcccataagggattggcatttttcttcttgaacgctagtcttcaccttctgggagccgtagcagaggacgacgtaggggtcgctggtgtgggtgagcgagtcggcgatgacgaggttgtggcctcggacaacgcggacgctgagcttcccgatcaccggctccgacgccatggcagaccggccggtacagtacaggtttatcgacggacgaatccccggcttctaggcactggatgggagcggagccaggctgggcgaggagaggagcgggctggcggcagggtggcatggatgcggccaacagctgccggccggccggcgccgggttttatcggc

SEQ ID NO: 10759 - DNA, 634 bp, Triticum aestivum
  Clone ID: PAT_TA_10759
attgagataaattcatattctgttttggtaagatgtaaacgaaatttgggataaacttatgtgttccattgaatcaagggccttgatatagcactttaaactcgaggctttgtcaacactacttttattactagttcgatgctactctgcttttatacccctgacgatgatggtagaaacagagtcaccctgcaaactggacaacttcacccagatttattcttattattagtactggccacttgatcgttggtctcaagctcggctgcacttcacgatctactgagcggaaggcgggacaggaagcgggtggttgtgcgccgtcaggctgttgaccatgaaggccttgtcttcttccacggctgaacgccctccaatggtggaggagtggccatgggtagtggtggaagtcggtggctgcagtccggcagcagatcctcctcctcccctggtgccgccgatgtacgcctgggcatggccgccgaccatgagctggctgcagacgagcgccagaaggaccagagctgggaatgccttggacgtagccatctctcttggtctctcactttgcttggctgctctgctcttctctgcctctgtgtctgtggtgttgtgttttcgaagcccggccggc

SEQ ID NO: 10760 - DNA, 954 bp, Triticum aestivum
  Clone ID: PAT_TA_10760
ccaagcaagcaactcaagcacaagatttacccgaaagttcacttattcattacttaaaatgaaactgctgtactagcaatttcgcaaaccaacacgtaacagtgattcggtagttcattaaacccaacataggactgacgcgaacaaaaaactgttcaaatgagcggacacaacggacgaccaaggataaaccagcaggtccaacgccagggcaattactgaccaccacggaggcggagcacaagggggagggtggactccttctgaatgttgtagtccgcgagggtgcggccatcctccagctgcttgccagcgaaaatcaaaccctgttggtccggggggatgccctccttgtcctggatcttggccttgacattgtcgatggtgtcagagctctcaacctccagagtgatggtcttccccgtcagggtcttcacgaagatttgcatgccaccacggagacgcaggacaaggggaagggtggactccttctggatgttgtagtccgcaagggtgcggccatcctccagctgcttgcctgcgaagataaggcgctgctggtccgggggaatgccctccttgtcctggatcttggccttgacgttgtcgatggtgtcagacgactccacctcaagcgtgatggtcttgccggtgagggtcttgacgaagatctgcatgcctccccgaagacggaggacaaggtgaagggtggactccttctggatgttgtagtcagcaagggtgcgaccatcctccagctgcttgccagcgaagatgagacgctgctggtccggaggaatgccctccttgtcctggatcttggccttgacattgtcaatggtgtcggagctctcagccttaagcgtgatggtcttgcctgtgaaggtcttcacgaagatctgcatgccttcccgaaggcggaggacaaggtgaaagggtggactccttttggat

SEQ ID NO: 10761 - DNA, 661 bp, Triticum aestivum
  Clone ID: PAT_TA_10761
ttttaaagcagaacagcatcgtcattagcataattcataactggagaacagttttgttaactctcgaaccatataactcggcaaacacagtatttgcccatcaggttcagaacacggaagcaaactactaagcataggatactactactaagcatagaaggcacagaacccagatcaactacagatttctcctcttctccactttcttgaccgcgagccatggctggtgcgccagggccagccagcgccgcggctcttcagccgccgaagccgtacagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgcccctccgggccagcctccggatcgccggcttggtgatgccctggatgttgtcgcgcaggaccttgcggtggcgcttcgcgccgcccttgccgagccccttgccgcccttgccccgccccgacatggctgcctgctccgagtagcttgagagaaaaggggatttgggggtttttgagcggggattggtgggtggaagcgattctggatccgaccggc

SEQ ID NO: 10762 - DNA, 984 bp, Triticum aestivum
  unsure (1)..(984): unsure at all n locations
  Clone ID: PAT_TA_10762
ttgccgaaggggtcgctgaggtgcgcgcacaggttctcgaaggggccctcgccggtgacgtaggcctggatgaagaaccccagcatggagaacatggccagccgcccgttnttgatctccttcaccttgagcagcgccgcctggtccgggtcggtggccacctgcccggcgccgctcgagcggccnnccgggcaggtactacaaatacagtgcatacatcaagctgaaatcaataacacacacacagcacatacactgcaaaccacaacatccacaaattgctaacacatctgataccaggaacaggaacccatagctgcagcttcatcaaaccaggttgcaataacattcagtcgggcgcaacttacagggtaacaccagggacgtgaacccattccagctgtagcacgacagagccactgtcaacattcttcagcttcagaatcaagtcttggacgaccttgccattcttccacgatacgtggctctcaccgccaaggtagtttgtgccaacccgggtagatcgtcttgatcctggttccatcagaggcatgctttagatccagctttgcagcgtcataggtatcagttacgttgaactcagccactcccatgctgtcatccgctgtgaatttgtcctcatcaaaaacctcaagtttcactggctttgtaggatttgtgacagggagcaccagtacgtcattccataagggattggcatttttcttctgaacgctagtcttcaccttctgggagccgtagcagaggacgacataggggtcgctggtgtgggtgagcgggtcggcgatgacgaggttgtggcctcggacaacgcggacgctgagcttcccgatcaccggctccgacgccatggcagacaaattcttggcttctagccacgggatgggagtagggcaagaagagagaattaaggagcaggtagctggcacctcggccgcgaccacgctaatcactagtgaattc

SEQ ID NO: 10763 - DNA, 951 bp, Triticum aestivum
  Clone ID: PAT_TA_10763
cgtcccttgactttcaccatttgctttttcctctgtcttctctcttcccttttcttactctcttctgcttctattttctttttttttctcttttttttgtaattggctaaacgatcaagtttccagcttcaattcagcggtgattcaagatcaatcgacgctacagactaccaccagttcggactccagaccaggcattacatacaggatcccatgctctctctctttctctcccctctcagatgcagaactacgcgacgcaagttggccctgtctactcgtcggcggcggcctcctcctcggcgtcggcggcagccttcttgtcggcggcggcggtcttcttgtcagcggcggcggtcttcttgtcagcggcggtcttcttgtcggcggcggtcttcttgtcggcggccttcttcttgggggtcttcttggcggcgggtgcgggggcgggggccttcctcttgggcgacttgggcgactgggactccttctcggcccttctcgagggccttcttggggagcagcacggggttgatgttggggatcacgccgccgtgcgcgatggtgacgccggcgagcagcttgccgagctcctggtcgttgcggatggcgaggagcaggtggcgcggcacgatgcgggtcttcttgttgtccttggcggcgttgccggcgagctccagcacctcggcggcgaggtactcgaggacggcggcgaggtagacgggggcgccggagccgacgcgctgcgcgtagcggcccttcttgaggaagcacccgatgcggccgacggggaactggaggccggccttggtggaccgggtcaccgctttcttcctctctccgcccttcccggccatctctcctccctctccggcgagctcgaacctctcggaatgcggcgggcggcggcggtggatggaaatgcttcgaatttgtcggaacccggccggc

SEQ ID NO: 10764 - DNA, 649 bp, Triticum aestivum
  Clone ID: PAT_TA_10764
gccggccggttcgggagaagctccctgcctcctgcgcctccacttccatcgcctcccaagatctgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaagaagagaaaaaggaggaggctaaggaagagagcgatgatgacatgggcttcagcttgttcgactaagcagttcaattccagttctcctgtggaatcttttatgctaaggattacttatcttatgtgcttttaggtcgaattttgcggatttaatatgtttgagacctaagtatctgtgcaatgagtactgcaaaccaccttgggatggtctttttagaatgaaaatggttttggtgcttggttgaaaagccattgcttgttttaccctaaaaaaaaaaaaaaaaactcgagactag

SEQ ID NO: 10765 - DNA, 1584 bp, Triticum aestivum
  Clone ID: PAT_TA_10765
gaggctttgcagtacgtggggggcgtcgtcggagaggatgaggccacatcgtcttctcctcatcttcttctccatcttccatccatcagataggccatggcttccaccgtccccttctccccggccaaggtccagatgctccaggcgaccaactgccacgggcacgcgccgttcggcagctctttcgccgtcccaagaaccgggccaaagcagcgttccctggccgtcagggtcagcagcgagcaggaggcgggccgccgccgtcagggcgccgtcggggaggagcatcgaggagtgcgaggccgacgccgtcgccggaaaattccccgcccccgctgcgtttgtcagaccaaaggccccagacggcacgcctgagatcaggcctcttgacatgccaaagcgccctcgtcgcaaccgcaggtcgccagctcttagggctgcattccaggagacaaccatctcgcctgcaaatttggtgctcccattgttcatccacgaaggggaagaggatgctccaattggcgctatgcccgggtgctttaggcttggatggcaacatgggcttcttgatgaggtgtataaggcacgtgatgttggtgttaacagctttgtgctctttccaaaggttccagatgcattgaagtctccgacaggaattgaagcatacaatgacaatggtttggttccacgtacaattcgcctgctcaaggataagttccctgatatcattgtctacacggatgttgctttggacccttattcatctgatggacatgatggcatcgtgagggaagatggagtaattttgaacgatgaaactgtatatcagttgtgcaaacaggcagtttcacaggcacgtgctggtgccgatgtagttagtcctagcgacatgatggatggtcgtgttggagcaatccgttctgctttggatgctgagggcttcaatgatgtctccattatgtcctatactgcaaagtacgccagttcattttatgcggccattccgagaagctttagattcaaatccacggtttggggataagaagacctatcagatgaacccagctaactacagggaagcccttctagaaactgcagcagatgaggcagaaggagctgatattcttctagtgaaacctggattgccatacttggatatcatccgacttctccgggataactccgcactgccaattgctgcataccaggtgtctgggggagtactcgatgatcaaggccggcgggggcgctgaacatgatcgacgaggagaaggtgatgatggagtcgctcatgtgcctgcggcgagccggcgccgacgtcatcctcacctacttcgcccgccaggccgccgccgtcctctgcggcatgggatccgccgccaagtagaagcgctaggtcaggtcaactgggtcaccccctgtgattaattgattaatgtgtaaagctgaggagccaatgtgctcgagtagttggccttgacgtttgaccctaagcacttgaataatcggcaagtctcgtactagtacatgcctgttagtttgttactagttctttctttttaccgagtactatatcataaaaat

SEQ ID NO: 10766 - DNA, 737 bp, Triticum aestivum
  Clone ID: PAT_TA_10766
tccctactaaagggaacaaaagctggagctccaccgcggtggcggccgctctagaactagtggatcccccgggctgcaggaattcggcaccagctactagctagtccacttccttcggatctcttgccaccaagctctgctcccgccaagatgtcgacggtgacccgcgcctacctcgaccagaggctcgccgccgccaagcgctgctccaaagaggctgccatggcgggagccaaggcggcggccgtcgccaccgtcgctgccgcagtgcccacactggcgagcgtgaggatgctgccgtgggcgaaggcgcacctgaacccgaccgggcaggccctcatcatctccaccgtcgccgggatggcctacttcatcgtcgccgacaagaccatcctctccatggccaggaagcactcgtacgagacggcgccaagagcacctcaagaacacctccttcaactaaattagacagtagatccattagtagtgcgcaataaaccatgtacgcccgtcgccaagtcgggctttagcccctgtataatgttcaattgttcagtgaggtgcgatcaggcgaggcgatacctgcagcgcgaatggtggtgtactgctgttctctgcgagcaataactaattatgtgacaaggatgtatggaataatgtggccatgttctccatctttgcatctttccaaggatcgtgaataaataacaaccagtttttggtcgacgcggccgcga

SEQ ID NO: 10767 - DNA, 681 bp, Triticum aestivum
  Clone ID: PAT_TA_10767
ctcacactactactgatctcagctagcctaggagtactcgagtttactaccagttcaattccttcggtacgaggctctctccggcgaagatgtctacggtgacccgcgcctacctcgaccagaggctcgccgccgccaagcgctgctccagagaggctgccatggcgggagcaaaggccgcggccgtcgccaccgtcgctgccgcagtgcccacactggcgagcgtgaggatgctgccgtggggccaaggcgcacctgaacccgaccgggcaggcgctcatcatctccaccgtggccggggatgggcctacttcatcgtcgccgacaagaccatcctgtccatggccagaaagcactccttcgacgacgcgccagaccacctcaagaacacctccttccactaattagacacttgattagccatggcccaataaactgtgtacgcaggcccgtggcaacgtgtcggctgaaacatagtagtataatgttcagcgacagggccagcaggcgaggcgacgatggttgcagtgctgaaaggtggtgttcagcccttcaatttgtgcgagcaagcacttattatctgatgatgtatgtatgtaataatgtggccatgttctccatcttagtatcttcccggagatcttgaattaataacaactactagttctaataaaaaaaaaa

SEQ ID NO: 10768 - DNA, 1622 bp, Triticum aestivum
  Clone ID: PAT_TA_10768
gagatctctttgcagtaggtgggggtcgtcgtcggagaggattgaggccacatcgtcttctcctcatcttcttccccatcttccatccatcagataggccatggcttccaccgtccccttctccccggccaaggtccagatgctccaggcgaccaactgccacgggcacgcgcccttcggcagctgtttcgccgttccaagaaccgggccaaggccgcgttccgtggccgtcagggtcagcagcgagcaggaggcggccgccgccgtcagggcgccgtccgggaggagcatcgaggagtgcgaggccgacgccgtcgccgggagattccccgcccccgctgcgttcgtcaaaccaaaggcccctgacggcacgcctgagatcaggcctcttgacatgccaaagcgccctcgtcgcaaccgcaggtcgccagctcttagggctgcattccaggagacaaccatctcgcccgctaatttggtgctcccattgttcatccatgaaggggaagaggatgctccaattggcgctatgcccgggtgctttaggcttggatggcaacatgggcttcttgatgaggtgtataaggcacgtgatgttggtgttaacagctttgtgctctttccaaaggttccggatgcattgaagtctccaacaggagttgaagcatacaatgacaatggtttggttccacggacaattcgcctgctcaaggataagttccctgatatcattgtctacacggatgttgctttggacccttattcatctgatggacacgatggcatcgtgagggaagatggagtaattttgaatgatgaaacagtatatcagttgtgcaaacaggcagtttcacaggcacgtgctggtgccgatgtagttagtcctagtgacatgatggatggtcgtgttggagcaatccgttctgcgttggatgctgagggtttcaatgatgtctccatcatgtcctatactgcaaagtacgccagttcattttatgggccattccgggaagctttagattcaaatccacgatttggggacaagaaaacctatcagatgaacccggctaactacagggaagccctacttgaaactgcagcagatgaggccgaaggggctgatatccttctagtgaaacctggattgccgtacttggatatcatccgacttctccgggataattccgcactgccaattgctgcataccaggtgtccggcgagtactcgatgatcaaggccggcggggcgctgaacatgatcgacgaggagaaggtgatgatggagtcgctcatgtgcctgcggcgagccggcgccgacgtcatcctcacctacttcgcccgccaggccgccgccgtcctctgcggcatgggatccgctgccaagtagaaggaagcgctaggtcaggtcaactggtcacccccctgtgattattgattaatgtgcaatgctgaggagccaatgtgcttgagtagttggccttgacgtttgaccctaagcacttgaataatccgcaagtctcgttctagtacatgactgttagtttgttatactagttctttctctttaccgagtatacatgatatttttttctcccttacgattgctggggacttgaattttc

SEQ ID NO: 10769 - DNA, 617 bp, Triticum aestivum
  Clone ID: PAT_TA_10769
ttttttttttttttttttgataactctggattcatattactcggcaaacacagtgtttgcccatcagaaattcagaacactgaagcaaccattgaacaaccagctactgctactacagatattactactaatcatagaaggcatggaacccaaatcaactacagctttctcctctcctccactttcttgaccgcgagccagggcttgtgcgccacggccggccagacagcgccgcgactcttcagccgccgaagccgtacagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgcccctccgggcaagcctccggatcgccggcttggtgatgccctggatgttgtcgcggaggaccttgcggtggcgcttcgcgcctcccttgccgagccccttgccgcccttgccacgccccgacatggctgccgctccgagtagctttaggaagagaggggatttggggattttggagcggggtttggcc

SEQ ID NO: 10770 - DNA, 552 bp, Triticum aestivum
  Clone ID: PAT_TA_10770
ttttttttttggtaagatgtaaacgaaatttcgggataaacttgtatatgtcccaacttcctcaacagtacatcattcgttgtgctctgcttttatacccctgatgacagaaacagagtcaccctgcaaacatgacaacttcacacagattttattcttatattagtactggccactgggccgttggtctcaagctcggctgcactgcctggacctggacgaactagtggccggaaggcgggacaggaagcgggcggtcgtgcgccggcaggctgttgaccatgaaggacttgtcttcttccacggctgaaggccttgcagcaccgttgtattctccaatggtggaggagtgggcatgggcaggagggtaagtcggtggctgtagtccggcagcagatcctcctcctcccctgatgcggccgccgccggtgtagggctgggcatggccgtcgaccacaagctggccgcagacgagcgccagaaggaccagagcggggaatgccttgggcgccatctctcttgatctctcactttgcttggctgctcttcccg

SEQ ID NO: 10771 - DNA, 676 bp, Triticum aestivum
  Clone ID: PAT_TA_10771
cgactcccaaaccctaccgagctcctcctccccccatcccctcgttgcggcggcgacagagaggagagagagagagagagatggcgaagtctctgcggtccaagcgggagaagcggctgcggacgctccggcgggagatcgcggagcccttctacgacaagaaggaggccgccaagcaggccgcgcaggccgccgccctcgaggcccccaagctccccgtccgcgtgcacccgatgtacgaggagtccctcgccgccgccgctgccgccgccgccagccgggcctcggccatggaggttgatggaggaagcaagaagtctgcatccttcctgaagccaatgggcaccattagcaagaagaaggtacagcttcacttgaagatcaagaaagacaagagaaaagctaggaagaagggaaattctgggaagaagagttattaggtgtgcgagctgctctgttatgtatcatgcaattttgtttcgttagtttgaacaacgcatgtaacggtaattctgcttgtgcacctaagtgttaaccatccattctagggtggccaacaaatgtactggaatatctcaacgagcactcgagacgaaactagtgtctgccaagttcatctgtttgtacccacttgtctgaacttgagctcacctgattacgaggttatgccattgtg

SEQ ID NO: 10772 - DNA, 441 bp, Triticum aestivum
  Clone ID: PAT_TA_10772
taggggcctttttttttttttttttttcagagtactgcaaaattaatagctgcataaaattcagtcacaaacacatataatcctcacattacataaaactcagtactggaacatagccagactagtattaaacaactaaatttgaccaaacacaggtaaaagcaacttccacagccaaaacaacagaacaaatcaagaatcactagacaatgccatcacccctcagagttccgctgcctggatgcaagatgatgcttaccgcctacttggatcgctgcctcatctttcggcgcttcctcttgagcctcctcatcctcttcttcttccacttggccctcatcgcggcggcggagtcggcctcgctctcctcttcgcggcggcggagtcggcggcggaagtgtgtggacgaacccgatctccgtatatcccggcccggccggc

SEQ ID NO: 10773 - DNA, 640 bp, Triticum aestivum
  Clone ID: PAT_TA_10773
acaaacaatgacactattagagcaaattttgagatggatgggccacaaaagtttcgtgaggacttgcataataaagtgaaattacaaatacagggcgccggtagaattgaaacacacaccgacacacgacacacaccgacgcatgaggtgtgggagccactgcatgaacagcaaccccacttattcaggcacgcggaagcttagcacgcagagaaaatcacgcacgggcgagcacgagaccgggcccgcgtcccagcctctctcactttatggaacacacgtaacgtaagcacacgcacggccggcggcgaggccggccaccgcacgtcaacgacgatctagccgaagtggtggtgcttcttctcgccgctggcctccttggcctccttgtggtcctgcttcttctcgtggtgctcgtggaagacgaagccgccggcgccgacggctgcggcggcggccacctcctcctcgatcttgtgcttgtgcgcgtgctccgggtccttcttcgcctcgtgcttctcgtagagggcgaaggctccggcggcggcggcgcccatctcgccgaggtgctccttgtgcttgtggtgcttctcctccgcttatttatatgcttaaactcagcgggtagtcccgcctgacc

SEQ ID NO: 10774 - DNA, 839 bp, Triticum aestivum
  Clone ID: PAT_TA_10774
cggccgctcaggcggcgggcgggagcctccttcaccccgccgccgcgcccaaacccaacccgccgccgccactgccgtcgccgccgcagcgcgcggaggcgaccaccccaccgccgccaagatgcagatcttcgtgaagaccctgacgggcaagaccatcacgctggaggtggagtcctcggacaccatcgacaacgtgaaggccaagatccaggacaaggaggggatcccgccggaccagcagcgcctcatcttcgccggcaagcagctcgaggacggccgcaccctcgccgactacaacatccagaaggagtccacccttcacctggtgctccgcctccgtggtggcgccaagaagcgcaagaagaagacgtacaccaagcccaagaagcaaaagcacaagcacaagaaggtgaagctcgccgtcctccagttctacaaggtcgacgacgccaccggcaaggtaaccaggctcaggaaggagtgccccaacgcggagtgcggtgccgggaccttcatggccaaccacttcgaccgccactactgtggcaagtgcggcctcacctacgtctacaaccagaaggcttagaggtggcttgcgtttgctctgctcttttacttgtcgagaatcgaactcatttatatgtgtccctgtttgtatttgaaaactgaaaccttggagtattatgtttcctagatatttgatcgcctaatgctgagatgctatgcgagcttaaattttggtcattctgaatgacgttaatctatctcatggcagctatcatattttatgctttgttgaaaaaaaaaaaaaaaaaaactcgagggggggcccggta

SEQ ID NO: 10775 - DNA, 1610 bp, Triticum aestivum
  Clone ID: PAT_TA_10775
atcgtcttctcctcatcttcttccccatcttccatccatcagataggccatggcttccaccgtccccttctcgccggccaaggtccagatgctcaaggcgaccaactgccacggccacgcggccttcggcagctgtttcgccgtcccaagaaccgggccaaagcagcgttccctggccgtcagggtcagcagcgagcaggaggcggccgccgccgtcagggcgccgtcggggaggagcatcgaggagtgcgaggccgacgccgtcgccgggagattccctgcccccgcggcgtttgtcagaccaaaggcccccgatggcacgcctgagatcaggcctcttgacatggcaaagcgccctcgtcgcaaccgcaggtcgccagctcttagggctgcattccaggagacaaccatctcgcccgctaatttggtgctcccattgttcatccacgaaggggaagaggatgctccaattggcgccatgcccgggtgctttaggcttggatggcagcatgggcttcttgatgaggtgtataaggcacgcgatgttggtgttaacagctttgtgctctttccaaaggttccggatgcattgaagtctccaacaggagttgaagcatacaatgacaatggtttggttccacgaacaattcgcctgctcaaggataagttccctgatattattgtttacacggatgttgctttggacccgtattcatctgatggacatgatggcatcgtgagggaagatggagtaattctgaacgatgaaacagtatatcagttgtgcaaacaggcagtttcacaggcacgtgctggtgccgatgtagttagtcctagtgacatgatggatggtcgtgttggagcaatccgttctgctttggatgctgagggtttcaatgatgtctccatcatgtcctatactgcaaagtacgccagttcattttacgggccattccgagaagctttagattcaaatccacgatttggggataagaaaacctatcagatgaacccagctaactacagggaagcccttctagaaactgcagcagatgaggccgaaggggctgatatccttctagtgaaacctggattgccgtacttggatatcatccgacttctccgggataattctgcactgccaattgctgcataccaggtgtctggcgagtactcgatgatcaaggccggcggggcgctgaacatgatcgacgaggagaaggtgatgatggagtcgctcatgtgcctgcggcgagccggcgccgacgtcatcctcacctacttcgcccgccaggccgccgtcgtcctctgcggcatgggatccgctgccaagtaggagcactaggtcaggtcaactggtcacccccctgtgattatcgattaatgtgtaaatctgaggagccaatgtgcttgagtagttggccttgacgtttgaccctaaagcacttgaataatctgcaagtctcgtagtacatgatcgttagtttgttactaattctttctttttaccgagtatacatgatttttttccctttcgattgctagggagatactaccgtgccccggtatatgatgattttacgagtacatttgaattttcactggcgcac

SEQ ID NO: 10776 - DNA, 1627 bp, Triticum aestivum
  Clone ID: PAT_TA_10776
agaaggaatcatatagccgcgatagtaagatattgcccagatcaaaatgcaagcaagcaattaaagcacaatatacaggaccaacagcaaattagcgcaatatctgaagttcagttattcattacttataacgatactgctgtgccagcaaccgtttcaaccaacaaataacacggggactcgatagttcattaaaccaacacagtaggactgacacgaacgagaaacagttcaaatgaacgacagggcaccacccaccggacgaccaggataaaccagcaggtcaaacgccagagcaattactgaccaccacggagacggagcaccaggtgaagggtggactccttctgaatgttgtagtctgcaagggtgcggccgtcctccagctgcttgccagcaaagatcaggcgctgctggtccgggggaatgccctccttgtcctggatcttggccttgacgttgtcgatggtgtcggagctctcaacctcaagggtgatggtcttgccggtgagggtcttcacgaaaatctgcataccaccacggaggcggagcaccaggtgaagggtggactccttctgaatgttgtagtctgcaagggtgcggccgtcctccagctgcttgccagcgaagatcaggcgctgctggtccgggggaatgccctccttgtcttggatcttggccttgacgttgtcgatggtgtcggagctctcaacctcaagggtgatggtcttgccggtgagggtcttcacgaaaatctgcataccaccacggaggcggagcaccaggtgaagggtggactccttctggatgttgtagtctgccagggtgccggccgtccttcagctgcttgccagcaaagatcaggcgctgctggtccggggaatgccctccttgtcctggatcttggccttcacgttgtcaatggtgtcggaggattccacttcaaagtgtgatggtcttgccggtgagggtcttgacgaagatctgcatgcctcccctaaggcggaggacaaggtgaagggtggactccttctggatgttgtagtcagcaagggtcctgccatcctcgagctgcttgccagcgaagatgaggcgctgctggtccggcgggatgccctccttgtcctggatcttggccttcacgttgtcgacggtgtcggaggattccacctcaagtgtgatggtcttgccggtgagggtcttgacgaagatctgcatgcctcccctaaggcggaggacaaggtgaagagtggactccttctggatgttgtagtcagcaagggtcctgccatcctcgagctgcttgccagcgaagatgaggcgctgctgcctcccgtaggagtctgggccgtgtctcagtcccagtgtggctgatcatcctctcggaccagctactgatcatcgccttggtaagctattacctcaccaactagctaatcagacgcgagcccctccttgggcggatttctccttttgctcctcagcctacggggtattagcaaccgtttccagttgttgttcccctcccaagggcaggttcttacgcgttactcacccgttcgccactggaaacaccacttcccgttcgacttgcatgtgttaagcatgccgcctcgtccgaattcct

SEQ ID NO: 10777 - DNA, 760 bp, Triticum aestivum
  Clone ID: PAT_TA_10777
gccgggcctggattccaccccgacgcccagcccaaacccaaccccgccgccgcactgccgtcgccgccgcagcgcgcggaggcgaccaccccaccgccgcgaagatgcagatcttcgtgaagaccctgacgggcaagaccatcacgctggaggtggagtcgtcggacaccatcgacaacgtcaaggccaagatccaggacaaggagggcatcccgccggaccagcagcgcctcatcttcgccggcaagcagctcgaggacggccgcaccctcgccgactacaacatccagaaggagtccaccctgcacctggtgctccgcctccgcggtggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgccccaacgccgagtgcggcgccgggaccttcatggccaaccacttcgaccgccactactgcggcaagtgcggcctcacctacgtctacaaccagaaggcttagaggtggcttgcgtttgctctgctcttttacctatcgaggatagaactcattatatgtgtccctgtttgtatttgaaaactgaaaccttggagtattatgtatcctagatatttgatcgcctgctgctgaaatgctatgcgagcttaaattttggtcattctgaatgacgttaatctaaaaaaaaaaaa

SEQ ID NO: 10778 - DNA, 1162 bp, Triticum aestivum
  Clone ID: PAT_TA_10778
ttttttttttttttttttttagaaatgatgatgataataatttatacaatagggaaatttgaattaaatagagatcgtgggacaacagtacacaccaaccccatcttcctcatctcctctcttccctccaccgccaaccaccgctacaacaacaaccttatcatcgcactgtttcttcgtcgtggccgccccatcgccatctttcacccaccttcctctccttttttttgaaactctcggggacgcctttaattttttcaaaggaaagaaaggaaaagagtgggctctgctgcttcggatttgtagtcgtggtgatcagaaccggacgatcttggcggcgcgcacgacggggttctcccgggcgatggcgtccctggccgccgacttgtagtcgtagctgcagtcgtgccggtccgagtaccggtgcgcgccgcagaacatctcgccgcaccggcagcggaaccccgtcaggcccacgcgcttccggcagttgtggcagcggttcaccgacgacttagacgccttcgggtccgccggcccggcggcaggccggtcaacggccatgtagacgggcgcggccggtgacgcggcggcggccggcctcggcttgtcgaagagcgggaacgcggccgcgggcgaggaggaaggggacggcggtgaggcggcggaggaggacggcgaggaggaggaggacgccaggaagcagttctggcagaggttcttggtggccgggttgcccgggaagccgcagctgttggcgcagagcgtgatctccgcggcgtgcaggtgcacctccgtcggctcctccaccttcttgtcccgctgcgccatgacgcctacgagccgagagacgctagacggtcccgcgcgcgcgaggacggccggcgagccctgtctgcaccgcacggtggcctgatctcctcgggggaggccgggcgtgggcaggagacgggatcgagcgagcgagtcgaggctttgggggaatggggcggaggaggaggaggcgaggcggggacggagggtgggagggggtgggtttttatcgcgggaggagacgggcggcgtacgcgttcccgcacgcgacagcgacgtcggccgtggccgtgcccgcgggggaggttatttccagtgctggccgcgttggcgcggcgtggaatggcgg

SEQ ID NO: 10779 - DNA, 584 bp, Triticum aestivum
  Clone ID: PAT_TA_10779
catctcatcccatctcactcgatcaccgcactctttgtgctgagccgtttctgcacaagagatcatggcgaagatgtcgtcgacggccaccgtcacccgcgcccacctcgagaacaagctcgccctcgccaaacgctgctccagagaggcgacgctcgccggagcaaaggcggcggccatcgccaccgtcgcgtctgcggtcccaacgctggcgagcgtgaggatgctgccgtgggccaaggcgcacctgaaccccaccggccaggccctcgtcgtctgcaccgtcgccgggatggcatacttcgtcgcggcagacaaggccatcctgtcgctgggcgaggaggcactcgtacgagagcgcccccgaccacctcaaggacacctccttcgctggcgcccgccgccgccgctccgtccccgtccgccggcattcttcaggccttgatctagcgtcctgctaatgtatgatacgcacgcttgtgccccttgtgcgtattctagagaacatgtgctttacatccgtgttactgaataaaactgagggctcgatatcctggtttccgaaaaaaaaaaaaaaaaaaaac

SEQ ID NO: 10780 - DNA, 1127 bp, Triticum aestivum
  Clone ID: PAT_TA_10780
cgctcgaaattaaccctcactaaagggaacaaaagctggagctccaccgcggtggcggccgctctagaactagtgggatcccccgggctgcaggaattcggcacgaggccgccgtcgcctcctctcctcttcctccgtcgcgtcgccaccgccttcgccatggggagacgacctgctaggtgctatcgccagataaaaaacaagccataccccaagtcaaggtactgtcgtggtgtacctgacccgaagatcaggatctatgatgttgggatgaagaagaagggagtggatgagttcccctcctgcgtccacctggtcagctgggaaaaggagaatgtctccagcgaggctcttgaggctgcccgtattgcttgcaacaagtacatgacgaagaatgctggaaaggatgcgttccacctgagggtcagggtccatacataccatgtccttcgcatcaacaagatgctttcatgtgctggggctgataggctccagactggaatgaggggtgcttttgggaagcctctgggtacctgtgctcgtgtggacattggccaagttctactatctgtgcgctgcaaggagagcaatgctgttcatgctgatgaagcccctccgccgtgcccaagttcaagttcccaggccgtcaaaagatcattcgcagcaggaagtggggctttaccaagttcaacaaggccgattacatcaagtacaagagtgagggaagaatcgtgcctgatggtgtcaatgctaagttgcttggtgtccatggccccattgctaaacgtgcccctgggcaggcgatcctggcttgaggcagttgaagcatgcacagaccatttccttcactagatggaactcatgagttctgtttttgctttagctagtataattccccatgcttgaacgagtgttaagtaaagctggctgctggctgcagtataatctacttctgtagttctttactgtagaccgtttctcatggtggaggtttacatatctgcagttgtcctgttttagcactttcttgagattgttatctacaagtgctggagaattttctggatcatccatgaatgatgtataactgttgcctatgctcaatcacctagtgtggccttttcatt

SEQ ID NO: 10781 - DNA, 1466 bp, Triticum aestivum
  Clone ID: PAT_TA_10781
ttttttttttttttttttgttctcggtatccgcccacagtgagctatcatcaactttctcagggtaggtatgcatacagtaattgtttgttctcataaatataacttcaggcaaccctagagtttcttgcaatgccaatacagctaacagtcgttggcaccaacacgctggtgattgattattcacaccaataattagaaaacaaaaccccgcaaaatgacgtgcatctcatatataaatcatcctgccgtcgcctcatcagtaggtgtatcccttctggaacatgcccttcttggcctcgtcgctctcaccctcgccagtgtagctgccgagctgcgccaaggagttggccttggcgcggaccagcagggccttctgcgccgcctcgatgttctcgggctgcccctcccacgtcttcagcaccgagttctggagtgcccgggcgtaggagaaggacacgtgccacgggttggcggactggttcatcgcgttcaggttcatggttgcctccagctcggactgtccgccggagaggaacatgattccagggacagcaggtggtactctcctcctcagcattgtgagggtgttcttcgcaatggcttctggagaagccttctccttgtgctcagcaccaggggtaaccatgctgggcttcagcaggatgccctcaaacagaacgttgttttcggccaggtagaagaacacctctgaccacaccttctctgccacctcgagagttctctcaatgccatggtcaccgtcaagaaggatctctggctccacaattggcactaaaccattgtcctgagccaatagcagcatagcgagcaagtccccatgccgcttccttgacagctaatgcagtaggaccacaagggatgctaacaacagtccgccactttgcgaagcgtgcaccttgcttgtagtactcagcacaccttgaggccaaaccatcaagaccttggcaccaggattcattgttggatccgggcaatggaaccaaacccttgtcaaccttgataccaggcatgatattctggtccttcaagacatcaacaaaggtcttgccatctgtagtggactggtagagagtttcctcaaaaagaatagcaccagagatatattcaccaagaccagcagtggtcagcaacagctgcctgtaagcctggcggttaacttcggtgttgtccaaaccaatggatgccaatctctttccacatgttgcactcgactcgtcgatcgcaaggatcccacggccaggggaagcaacagttttcgcggtggagacgagctcgtcggcgtaggagccgccggaggcgcggacgcggacgagcgaggcgcggcgggcgggctgcgcggaccggacgggggcgagccgggcggcggccggggagctgagcttcgcggtcaccatcgccattggttcgatcggtcgatgcgttctgcgtttggacgcctcgtgc

SEQ ID NO: 10782 - DNA, 914 bp, Triticum aestivum
  Clone ID: PAT_TA_10782
gacatacacatccaatccatttcattgcttgctcctccgcctcaaccacccgttgatattacatcacacacgctattctttccttttcatccacatctttacctcccatttttttccttccaataaataaagatttttttaattaaaaagggaaacactccggagaacaacagcataatactagcggctcgcacggcggcccactgcctcgatgagatgattctttgctttgcctcggctggaattctgaattcttctttccccttggtttcagcttcagaacctgacgatcttggcggcgcgcacgacggggttgtccctggcgatggcgtccctggcggcggccttgtagtcgtagctgcacccgtgccggtccgagtaccggtgctcgccgcagaacatgtcgccgcaccggcaccggaaccccgtcagccccacgcgcttccggcagctggagcaccggttcaccgacgtcctcgccggcttcgcctccgtcgccggagcaaggtcgacggcggggcgtgccagctccgcctccaacggcgccggcctcggcctgtcgatgacgggggtcggcgcggacacgcccggcagagaagaggaggaggaggaggaggaagacggcgacgtggacgccgggccggccaagaagcagttctggcagaggttctgcgtggccgggttgcccgggaagccgcagctgttggcgcagagcgtgatctccggcgcccgcagctccgtgggctcctcctgcttgtgatcccgctgcgccatgatttttcaaacacgcacgaggtggctggttggtttgctgccggccgggaggtccgggcgtcctcggcggcggccgggaggtgggtggtctgggagagatcgggaggtcgaggagaggagaattggatgggcgtggatgt

SEQ ID NO: 10783 - DNA, 596 bp, Triticum aestivum
  Clone ID: PAT_TA_10783
gttaactctggattcatatatctcggcaaacacagtgtttgcccatcagaaattcagaacactgaagcaaccattgaacaaccagctactgctactacagatattactactaatcatagaaggcatggaacccagatcaactacagctttctcctctcctccactttcttgaccgcgagccagggcttgtgcgccacggccggccagcaagcgccgcggctcctcagccgccgaatccgtacagggtgcgtccctggcgcttgagcgcgtagacgacgtccatggcggtgacggtcttccggcgggcgtgctcggtgtaggtgacggcgtcgcggatgacgttctcgaggaagatcttgagcacgccgcgggtctcctcgtagatgagccccgagatgcgcttcacgccgcccctccgggccagcctccggatcgccggcttggtgatgccctggatgttgtcgcgcaggaccttgcggtggcgcttggcgccgcccttgccgagccccttgccgcccttgccgcgccccgacatggctgagtagcttcggaagagaggggatttggggattttggagcggggtttggtgcggacg

SEQ ID NO: 10784 - DNA, 1029 bp, Triticum aestivum
  Clone ID: PAT_TA_10784
aacgaatagtgcatcatagaaatgataataataataatttatacaatagggaaatttgaattaaatagagattgtgggacaacagtacacaccaaccccatcctcctcatctcctctccaccgccaaccaccgctacaacaacaacgttatcatcgcactgtttcttcgtcgtggctgccccatcgcaatctttcaccttcctctccttttttttcacctttaagaaactctcgcgaacgcctttaatttttcaaaggaaagaaaggaaaagagtggttctgctgcttcagatttcgccgggtacgcgtagacgtggtgtcctgttgatcagaaccgaacgatcttggcggcgcgcaccacggggttttccctggcgatggcgtccctggccgccgacttgtagtcgtagctgcagtcgtgccggtccgagtaccggtgcgcgccgcagaacatctcgccgcaccggcagcggaatcctgtcaggccaacgcgcttccggcagttgtggcagcggttgacggacgacttggacgccttcgggtccgccggcccggcggctggccggtcgacggccatgtagacgggcgccgcctgcaggggcgacgcagcggcggccggcctcggcttgtcgaagagcgggaacgccgcgggcgaagaggaaggagactgcggcgaggcggcggagggcgacggcgaggaggaggacgccaggaagcagttctggcagaggttcttggtggccgggttgcccgggaagccgcagctgttggcgcagagcgtgatctccgcggcgtgcaggtgcacctccgtcggctcctccaccttcttgtcccgctgcgccatgacgtacgcctgcgagccgagagagacggtagctacacgatcccgcgcgcgcgaggacggccggcgagccctgtctgcaccgcacggtggcctgatctcctcgggggaggccgagcgtgggcaggagacgggatcgatcgagtcgaggctttggggaaatggggtggaggaggaggaggcgaggc

SEQ ID NO: 10785 - DNA, 1474 bp, Triticum aestivum
  Clone ID: PAT_TA_10785
ttttttttttttagaacttgatatgtttattaagaggacatcgagcatgagacgacacacaccaccacaacgccttattacagtgaggtacgcacgtacgtagaacttgcagtaccatagagaacaagttcttggagtgccttaattataggagctacgctcattcttgaaggcatggcggcaggtgaggtgatacatcacacacattatagtagcaagcatcatcatagttatttaacccagcagtgttcgactatctcgatacggtcaatgattagccgattgctagatagtagtcgtcgattgcagcagcgacgacgaacccgcacgcgtgttctacatgcagaagggctcacagttgatgtcaaacttgcaagcagaagacatctggggctcctccacgccactgaagttggccaccttgcggatggagcagccgacggggccctgcaggctgcagtcgccggcgccggcgcgcatggtggtcctcatggaggtgagcaggtggccataggtggtaccgggctcgcactcgagtgctttgatgaagctgtgcgtcagggcaccgatcgtggcattgggctctggcagcacgctcatctgggtcttcccgttgctgctgccactgatgagcacggccttggcctccgctggtgcctttgcaggcgccattcagagggcgctcgtccatccacctcaagcacccgtactgcttggagaaggtgcaccggtatgggagatcgaggacggtggcactgtggcaggcgtcgacgatggcgtggagcttgacgccgtgtacgagggggcggacgatggcatggttgatctcgtcgtccaggatggggccctgcttggaacgagtccacgggacagatggcctcgtccatgccgtcccgctcgtcgccgtcgcagtcggggacctgcgcgcccgcgccggagaactggaacaccagggagtcgccggagctgcacccctgcaccagccagtgcatggccatgcggatgttggccttggtcggctgcctgcacgggtccctctcctcatcggtgaggatgaggacgcagtcgttggcgaagccgaagcgctcggtgaggatgtacctcatgcacttgacgtcgttgatgggacccctgagctcgcaggcgcgagtgttggtgtacttgataccgacgagcacggcgcgcttcttgccgcggccaccgccgaagttcgggatggggcgcatcacactgagctgtcgcccagccccgccgacgcgggtcacgcagcagcactgcgcgcactggacggcacaggcaccggccggcgcggcgacgctggcgctgcactgcctgcagcgcaccatcgtcgccggagcgggaccgcttccgcagttcatggctgccgagcgccgcatgacctgctgggtgggtggtggtgagcgctgcttgcttgcttgcttgcttgcactgcctcttaataaacatatcaagt

SEQ ID NO: 10786 - DNA, 698 bp, Triticum aestivum
  Clone ID: PAT_TA_10786
tattgtgtttatggtaagatgtaaacgaaatttcgggacaaacttatatatgttcccttgaaaccactgtgaagtcccaactttctcaacagtacttttatttgtttttcggtaagaagtaaatgaaactttgggataaacttatatgtgttcccttgatggctctctgaagtcacaacattctcaacagtacattatcagtactagttcagtggtactctgcttttatacccctgatgatgatggtagaaacagagtcaccctgcaaacaggacaacttcacacaaatttattcttgttattagtgctggccactgggcggctgatctcaagctcagctgcgttgcctagacggactagtgaccggtagacaggacaggtactgggcggtcgtgcgccggcaggctgttgaccatgaaggccttgtcttcttccatggctgaaggccatgcagctccgtcgtatcctccaatggtggaggagtggccatgggtagtggtggaagtcggtggccgcagtccggcagcagatcctccccctccgatgtacgcctgggcatggccgccgaccacgagctggccgcagaccagcgccagaaggaccagagctgggaatgccttggacgtagccatctctcttggtctctcactttgcttggctgctctgctcttctctgcctctgtgtctgtggtggtagt

SEQ ID NO: 10787 - DNA, 1053 bp, Triticum aestivum
  Clone ID: PAT_TA_10787
ttttttttttttttttttttttttaacgaatactgcatcatagaaataataataataataattatacaatagggaaatttgaattaaatagagattgtgggacaacagtacacaccaaccccatcctcctcatctcctcctctccactgccaaccaccgctacaagcctacaacaacaacgttatcatcgcactgtttcttcgtcgtggctgccccatcgccatctttcaccctcctctccttttttttcacctttaagaaactctcgcgaacgcctttaatttttcaaaggaaagaaagaaaaagagtgggtttttgcttcagatttcgccggtccgggtaggcgcgcgtggtgtcttgttggtcagaaccgaacgatcttggcggcgcgcacgacggggttctccctggcgatggcgtccctggccgccgacttgtagtcgtagctgcagtcgtgccggtccgagtaccggtgcgcgccgcagaacatctcgccgcaccggcagcggaaccccgtcaggcccacgcgcttccggcagttgtggcagcggttgacggacgacttggacgccttcgggtccgccggcccggcggccggccggtcgacggccatgtagacgggcgccgcctgcagcaggggcgacgcgacggcggccggcctcagcttgtcgaagagcgggaacgccgcgggcgaagaggaaggggacggcggcgaggcggcggagggcgacggcgaggaggaggacgccaggaagcagttctggcagaggttcttggtggccgggttgcccgggaagccgcagctgttggcgcagagcgtgatctccgcggcgtgcaggtgcacctccgtcggctcctccaccttcttgtcccgctgcgccatgacgcctacgagccgagaaaaggtagctagatgatcccgcgcgcgcgaggacggcgagctctgcaccgcacggtggcctgatctcctcggaggccgggcgtgagcgggagatgggatcgagcgagtcgaggcgcggctcgaggcttgaggaaatggggcggaggaggaga

SEQ ID NO: 10788 - DNA, 891 bp, Triticum aestivum
  Clone ID: PAT_TA_10788
ttagcagtagacacaacacctcatgcaagctcaaaatcaacatactcccatatttaatagagatagcaccaacaaaatggaaactggaagatctgtatctctggcaatcaagccatgatgtcccagcaccagaaacaaaacactgattcgacaaaaccgcatacgataattttcataggctaacaagtttcagacatggaacacaatcataaagaagctactagcatcctgcagaatccggaaactggaaggccgtccctagtgcgacttgacgtattcctgcacgatgtgaagaccctcggaatcttcgccgtagtccttcacaacgacacatgagcagcccaccacctttcttgccttgccctcagagtcaatcttgcaaagcccagcccactcgccaagagttttggcactaggcacagtgaccaagtgaacgttgtgctcagcacacagtgccttcaccagcttcacgtaatcaggctggtcgcagtcctcagcaagcacacagatctgagcagcatgcttctcaatcgctttcgcagcttcacggagtcccttgacaaggccatcatgagcgcttgacttcttcatcacaagctgcagagcagtcatcaagtccatgggctctccaagaactggggtaggggccgcaaccggagcggcaacctcaactggggcattctcctccgccatgtctcgagctccgaagaccgaaccgaacctcgcgcgcgtagatctgttgggggcggagggactcggcgctcctgggaggcaggctagggttttctctctctctctctctctctctctctctctctctctctctctctctctctctctctctctctctctctctctctctctatactctctctctctctctctctctct

SEQ ID NO: 10789 - DNA, 1666 bp, Triticum aestivum
  Clone ID: PAT_TA_10789
ttttgtaacttattaagcaagtcaaaatttcttgaatgaatcaacatccatgacgctccgaccgtgtctacaagcctagaggctcttctagttcttgcaacacacacacacacacacacacacacacaacagacgctacagagtacagacaccactcgtttctttcactttttaataacctgtctcaccctcttacttttaggacgatctatataatctctctctctctctcactctctctctcttctgacgctgctatgctcttaccggatcaaaaccttgttccccatcggagggagtgggacgaagctctttctctctctagctcaccagctgctggttgccgtagaaggggtaggctccatacgcaggggcgtacatgttggggtgcgggacgggggacgcgtagccgtacccgccgtagaacggcgtgccatagtacatgttgttattgttcctcctgttgccggaatcgcccctagactgtttgtgtgatgggctgcggccccacgaaaggcgaactgcctgctttccaatgacagccccattcaatccttgcagtgcttcttctgcgtcagttctgttgacatactgaacaaagccacattgcttccctagaggaattttgacagaggcaacatcaccatatttggcaaatgatttcctcagctcgtcttcactaacatttgggtcaagcccaccaacatataccgttctgttatttgaatcaccatctgaatggccaggtgttgaggaaccagaatcaccagaggttcttctaggcgttgcaggtcctacgcgaatcggtctagtagagcaataaacaccgttcatttcagtcattgcatgagctttgtcagtatcatctccaaatctaacaaatccatagcccctagaacggcctgtgtttgcatcaatgataactttagctcctttgacggagcgatacttgctagcaaaaagctccatcaacatttcatcagtaacatcagcagctaaatcaccaacaaaaattgagtgatcagagacaacttctgatcgcttttcacccatgctataggatgcccagttcaacttaaaggctcgatcggtgttgggcatcacatggccagtaaaattctgaagggctttgtctgctgatgcatgggaaaagaactctacaaaaccatatccctctgattgtccagtttgcctattgcggataacttttattgttaccacctcgccgctggggccgaagcagttatggaggtagttctcgtccatccagtactggaggtcgccgacccagatcgtcttattctcctcgcagccgttcccgccggatccggccgcgggtggggtcggcgtgcgtcgcccggccgcggcagggggaggcggcggccccggcgcgtagtgcttggcgaactgcggcgggggcgggggcggggcggccaccatggacggcggcgggtaggggaggacgacccaccgcggctgcggcatgtgatggtgcgggtgcgggtgatgcggaggtgggtgcggatgtgggtgcgcgtgggggtggtgaggcggcacggccacctgtggctccgttgtggtcgccgccatctgcatcgccgcccgcgccgccgccgccgaggagggtcgcctggggttgggggagtctcgtgaggttgcgcggacg

SEQ ID NO: 10790 - DNA, 2058 bp, Triticum aestivum
  Clone ID: PAT_TA_10790
ggaattcggcacgaggctaatactgttgccttgatccgtagtttgctagggtcatgttcctaatttgttagcgcaattgcaagctcgcaataccgaatcatctctgctccttgttcgtatatttatcggtccatggacgtatacttttagttcgtaggatgcacagattacagtcgtgtggaatatttatatgtcgctccatcgttttttttgtcgttccctggtggtgttgccgagatctagttatggcttctgcatgatatgctggaggtgtaataacatcttattagaccatctttttactgttaaccgtcatagcatcttattaaaccatctttttaccgtttaccgtcacgggttagctaagatatttgatctatcagtttatgtcacttgtccacatgatgattccctgtgtccgttagttttaataatcttttttctgtgtcgcagttgggtagtttacctctacccaccagccatgggtaaggagaagactcacatcaacatcgtggtcattggccatgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcaaaggcgcgttatgaagaaattgtcaaggaggtctcttcctacctgaagaaggtcggctacaaccctgacaaggttcccttcgtccccatctctgggtttgagggtgacaacatgattgagaggtccaccaaccttgactggtacaagggcccaacccttcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagcccatggttgtggagacctttgctacttacccacctcttggtcgttttgctgtccgtgacatgaggcaaactgtggctgttggtgtcatcaagggtgtggagaagaaggacccaaccggcgccaaggtgaccaaggctgccatcaagaagaaatgaggcgtttacctgaatccatctatgtctgcttttgagatctctagtagtttagtgcctattaagttttgctactgttagcgccgtgtgatatgcgccctgttgatgtgtcatttgagtactgtcgttaattttggcttttggcaaaacatggaagcttctgagactactcatttttatcctctgctttggaatgttaggctgctacttttagtcttagctgctgtttctctttg

SEQ ID NO: 10791 - DNA, 497 bp, Triticum aestivum
  unsure (1)..(497): unsure at all n locations
  Clone ID: PAT_TA_10791
tgttcctgtatttgttcatctcggagcaaagaaaaggacctgtcacaccgcaaaagataaaataacttgacncaacaaatgcagggccaaaaggcacatttcagagtacctcaaggataataggtgcataaaattaggtcacaaacacatataatcctcacattacataaaactcagtcctggaacatagccagactagtattaaacaactaaatttgaccaaacacaggtaaaagcaacttccacagccaaaacaacagaacaaatcaagaatcactagacaatgccatcacccctcagagttccgctgcctggatgcaagatgatgcttaccgcctacttggatcgctgcctcatctttcggcgcttcctcttgagcctcctcatcctcttcttcttccacttggccctcatcgcggcggcggtgtcggcctcgctctccggttcgcggcggtggtggcggcgggagtgtgtggacgaacccgcggacgcgtggg

SEQ ID NO: 10792 - DNA, 2482 bp, Triticum aestivum
  Clone ID: PAT_TA_10792
tcactatagggcgaattgggtaccgggcccccccctcgagttttttttttttttttttcaggggaaacaacttagaagatataataaaccagtcttttttgttgccaggaactgcacatctacaaaacatcatatgactagtgaagaacgaaaagtttagcagtgtttgcattctcacaggtagcgcgcgcgcacacacacacacattttcagtcattctccaatcttgcaatgtactcatcgtagaacttgcctgccttctcgagctcaccaacttcggtgtagcaatcggctattgccccatatgcctcagtgacaccagaatcctctccagtcatcttgggatatgctgagaaccatggagtggtactttattgcttccttgtaatttccttgtctttgcaatgacggacctaatcctcgtgccgccttcttctcttcaacatgatcacccaaagattgtgcaagatcaagagctgccttaaactcggaaaatgccttgtctggagcttggtttctcaggtagttcttcccagtcctcagatatgcgagcaggcgctgtttgtgaggatcaacaatgacttctgattctggtatcttactagcagccggtgcatagctcaaagcaggagcataagattcgatcttggcttgtcttctcagtgaagcatttatctgacgtagctgatcattaagctttttaagttcccctttcctttgtctcgcaaggagccctccaacagtagcaccaaccatggctatcgcaaacagcagcggcatgttaggaagagagtaccccgggtcacattcttctgccaagcaactgggcggcatcgcaagcatgacagcactgctggtcaccaatgctttcccgaaacaagaagatacagcttccatcatacctgaagatcagatgtagacttgataaggaaatgaccatgtccattagctatatcaaagttgtcgctcccaggacgcaccgcatcagtcgacgatgaggcatgtctagctacaagaaacattcgctctgaggtctcggggagtacggcgtttaatctcgtggtagaacctccgtggcttcgccggtactgcggcgacggcgccgccgccggtggggagagacgcattagaagcggcatcaggaggataaggaatgcaactatgaatctcatggagagttcgatcctggctcaggatgaacgctggcggcatgcttaacacatgcaagtcgaacgggaagtggtgtttccagtggcgaacgggtgagtaacgcgtaagaacctgcccttgggaggggaacaacaactggaaacggttgctaataccccgtaggctgaggagcaaaaggagaaatccgcccaaggcaggggctcgccgtctgattagctagttggtgaggtaatagcttaccaaggcgatgatcagtagctggtccgagaggatgatcagccacactgggactgagacacggcccagactcctactggaggtatcagtgttgaatttttcgcattgggcgaaagccttactgatcaattccatgttgaggtggaaggcctacgggtcgtcaacttcttttctcggagaagaaacaatgacggtatctgaggaataagcatattgtaactctgtgccagcagccgcggtaagacagaggatgcaagcgttatccggaatgattgggcgtaaagcgtctgtaggtggcttttcaagtccgccgtcaaatcccagggctcaaccctggacaggcggtggaaactaccaagctggagtacggtaggggcagagggaatttccggtggagcggtgaaatgcattgagatcggaaagaacaccaacgtgaagaacgttgctgtcaaggatctgaagcgtgggtttgttgcatccaactccaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtattgtgaagatgattcccaccaagcccatggttgtggagaccttcgccacctacccacctcttggccgcttcgctgtgcgtgacatgagacaaacggttgctgttggtgtcatcaagggcgttgagaagaaggaccccaccggcgccaaggttaccaaggctgccatcaagaagaaatgagtgctctggtgtctgccatcgagttatctagcagaagttttagtgtcaagtcttttttggagaatcttagtgtatgttaagtggtgttcctgggcgttgttgcacttccgactcctgcacctgtgtgcgagctatgatgtgtcgtttaaatactctatttcgattccattaaaaaaaaaaaaaaaaaaggccccta

SEQ ID NO: 10793 - DNA, 906 bp, Triticum aestivum
  Clone ID: PAT_TA_10793
ccgaggtgagaactagtctcgagtttttttttttttttttttagaaaaccagcacaaggcctcactttatatagataaatcgacgagttcaacaggaacacgattattgaatacaaaggttcaacaagcaaaagggaaatagttcgggcctggggcggcagccacaggtgaagcccgacataaagaaaaagagaaatgccgatgcattcagcatcggattatttattcgaagcatagcagagcaccacctctcccatcatagggaaacggaagcatcacggctggcttgttattggtattggtggtcttaagcaaggcttttgggacggattgaacttgggcgaaccactgggcgactcttgagcttgcgcttgttgcccgtcctttctttgtcgatgtagacggaggccggaaccgtgagctgtagccggaggctcccattcggaagttgtcgatcagaccccacgtgaagtggccccgcacgtccgcgccctggtctattgcgtcccttgacggcttgagatgtggcgcttggaggtagtctagcctctttccagtcatccaaaggatcttgtcatggttgggtcgcttgtccacatcagcaattccgttctccagtgatgaagacgggtgggtttccgtatttctccttcatgatcagaaggaggtccgttaggccttttgggtacatgtagatccaataagtcccggttataggaccgatgtcattcccatcactccctgtagtttctgaactggcgtaagcgtcgtcggtgttcagctttggcgtaaagtctgatgaaatgtcaacatgcttggagaatctggaggtgtaatagttgagccccatgatgtcacatgaggacgctagcttctcttgctcctccttagtgaacatgggtagac

SEQ ID NO: 10794 - DNA, 580 bp, Triticum aestivum
  Clone ID: PAT_TA_10794
ttttttttttgcacggttcacttcagttatgatattaaaacgaggccaagtactcatctagagttaaacaaggttcaacatcctgacatgagcagcaaaatgataacccagaaacattttatgtctacagatttatccagacaatgaaagcggcaataacggttttacgagctctagttcttgatcttcttcttgggcctcagctggttgctgtggccacacttcttcttgcggcagttgacagcccttggatgcagcctggcgtagcacttgcggcagatcatcttctcctggttgtacttgcgggcgagggcctggagcgagggctcgatgatgcccccgcggaggcggagcacgaggtgcagcgtcgactccttctggatgttgtagtcggccagcgtgcgcccgtcctccagctgcttcccggcgaagatcagccgctgctggtccggcgggatcccctccttgtcctggatcttggccttgacattgtcgatggtgtcgctgctctcgacctcgagcgtgatggtcttgcccgtcagggtcttgacgaagatctgcatctcggctgctggcggcg

SEQ ID NO: 10795 - DNA, 870 bp, Triticum aestivum
  Clone ID: PAT_TA_10795
gagatcaaacggcatacatagaacttgatttatttaaggggacgacacgacacacaacggccatgttacagtgatttacagtacagtacagtggagaacgaggtcctcgagagccttgtatgagctatatgcagtgctcattcttgatggcatggcaacaggtgaggtgatacatcgtcacacatactagtagcaagcatcatagttaattaaccggcccattattcagtacggtcgatgcatgattcggtggtaattaatcgtcgactgcagtagcctgcggtgcagcgacgacgagcccgcggatcgggtcaggttctacatgcagaacggctcgcgctcgatgtcaaacttgtaggcagaggacagctgaggctcctccacgccgctgaagtttgcgaccttgtggatggagccgccgatggggccttgcaggttgcagttgccgccgctgtcgcgcatgatggccctcatggaggtgagcaggcggccgtaggtggtgcgcggctcgcactccaccgctcggatgaagctgtgcgtcatggcgccgatcgtggcgtagggctcaggcagcacgctcatgttgctctttccgttgctgctgccactgatgagcacggcctggcctccgctggtgcccttgcaggcgccggtcatagggcgctcgtccctccacctccagcgcccggtctgcttggacacggtgcattggtaggggaggtcgaggacggtggcgctgtggcaggcgtcgacgatggcgtggagcttgacgccgtgcaccagcgggcggacgatggcctcgttgatctcgtcgtccaggatggggccctgctggaacgagtccacggggcagagggcctcgtccatgcc

SEQ ID NO: 10796 - DNA, 751 bp, Triticum aestivum
  Clone ID: PAT_TA_10796
acaagacggacagaaaacaattgcatcacaggatttgcaacaagctaaatgcggtagcacaaagagttgtaaaacagaatagcatcgtcattagcataattcataactagagaacaattcgttaactgaatcatataactcggcgaacacagtatttgcccatcaggttcagaacacggaagcaaactactaagcataggatactactagtactaagcatggaaggcacagaacccaaatcaactacagctttctctcctccttcgatttcttgaccgcgagccagggcttgtgcgccagggccagccagcgccgcggctcttcagccgccgaagccgtacagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgcccctccgggccagcctccggatcgccggcttggtgatgccctggatgttgtcgcgcaggaccttgcggtggcgcttcgcgccgcccttgccgagccccttgccgcccttgccgcgccccgacatggctgcctgctccgagtagcttgggaagagaggggatttggggattttggtgggtggaggcggtgagtaatccgccactttagtccactcagccatctctcccgcagcccggccggc

SEQ ID NO: 10797 - DNA, 767 bp, Triticum aestivum
  Clone ID: PAT_TA_10797
tccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagattggcaacgggctacgccccagtgctggactgccacacctcgcacattgctgtcaagtttgctgagctggtgaccaagatcgacaggcgatctggtaaggagctggaggccctgcccaagttcctcaagaatggtgatgctggcatagtgaagatgattcccaccaagcccatggttgtggagacctttgctacttacccacctcttggtcgttttgctgtccgtgacatgaggcaaactgtggctgttggtgtcatcaagggtgtggagaagaaggacccaaccggcgccaaggtgaccaaggctgccatcaagaagaaatgaggcgtttacctgaatccatctatgtctgcttttgagatctctagtagtttagtgcaagttttgctactgttagcgccgtgtgatatgcgccctgttgatgtgtcatttgagtactgtcgttaattttggcttttggcaaaacatggaagcttctgagactactcatttttatcctctgctttggaatgttaggctgctacttttagtcttagctgctgtttctctttgaaaaaaaaaaaaaaaaaaaaaactcgag

SEQ ID NO: 10798 - DNA, 1251 bp, Triticum aestivum
  Clone ID: PAT_TA_10798
ccgaggtctcgagtttttttttttttttttttagcacacgaactcactttatatagataaatcgacgagttccacaagaacacgattatcgaatacaaaggttcagcaagcaaaagggaaatagttcgggcaggggcggcagcataggtaagcccgatataaagaagaagaaaacaagctacggagccggccggagcaggaaacaagtgagccaccctccggaggccaagaaggagccatccaacccgccgcgatcccgacgacatgcaaacatccgccatggctactagttcaacatccctgaactgaaacggccacatcgcttcattttattgcatccatccgattattaatttcttcaaactgcatgccatgcatccagcccttggattatttgttcgaacatagcaccacttcgttctccatcatacggaaacggaagtaactgtcaccgttgcgttgttattggtagtcttaagcaagcgttttgggacggagttgaacttggcgaaccacttggccgacttcttgagcttgcgcttgttgccgtcctttctttgttcggatgttagaggagccggaatcgttgagcttgtagccccaggctcccattcgaagtttgttcgatcagacccccacgtgaagttggccccgcacgtccgcgcgccttggtctattgcgtcctttgacggctgagatgtggcgctggaggtagtctagcctcttccagtcatccaaaggatctgtcatggttgggtcgctgtccacatcagcaattccgttctcagtgatgaagatgggtgggtttccgtatttctccttcatgatcagaaggaggtccgttaggccttttgggtacatgtaaatccaataagtcccggtaataggaccgatgtcatttccgtcactccctttagtttctgaactggcgtaagcgtcgtcggtgttcagcttcggcgtaaagtctgatgaaatatcaatatgcttggagaatctggaggtgtaatagttgagccccatgatgtcacatgaggacgctagcttctcttgctcctccttagtgaacttgggtagacgatctccgatcagcgatctcatggagaaggggtagtcaccacgaaccactggctccaggaaccatccgaggttgtagtcgatggatctttcccgggcctggtcgtcgaggaaggagtcttggaatggctcgtaacccattacatcaaaggccggacgcgtgggcggacgcgtggg

SEQ ID NO: 10799 - DNA, 1062 bp, Triticum aestivum
  Clone ID: PAT_TA_10799
gcacgaggcctcgtgccgaattcggcacgagggagagagagagagagaactagtctcgagtttttttttttttttttttttttatctaagttcacttattcattacttaaggatactgcagtgccagcaacggtttcaaccaacataacaaggggactcgatagttttcaaaccaacacataggactgacacgaacgagaaaacagttcaaatgaacggcagggcaccaccgaccagacgacccaggataaaccagcaggttgaacgccagggcaattactgaccaccgcggaggcggagcaccaggtggagggtggactccttctggatgttatagtccgcgagggtgcggccatcctccagctgcttgccagcaaagataaggcgctgctggtccgggggaatgccctccttgtcctggatcttagcctttacgttatcgatggtgtcggagctctcaacctccagagtgatggtcttgccggtgagggtcttcacgaagatctgcatgccaccacgcaggcggagcaccaggtggagggtggactccttctggatgttgtagtcggcaagggtgcgaccatcctccagctgcttgccagcgaagataaggcgctgctggtccggggggatgccctccttgtcctggatcttggccttgacgttgtcgatggtgtcagagctctcaacctccagagtgatggtcttgcctgtgagggtcttcacgaagatctgcatgccgccacgcaggcgcagcaccaggtggagagtggactccttctggatgttgtagtcggcaagggtgcggccgtcctccagctgcttgccggcgaagataaggcgctgctggtccgggggaatgccctccttgtcctggatcttggccttgacgttgtcgatggtgtcagacgactccacctcaagggtgatggtcttgcccgtgagtgtcttcacaaagatctgcatcttgaggcggtggggaaggaggattcgacgagcctcgggtcgatcggagacgagattagcttgggatttgttggttccgttgctgggagcggtggt

SEQ ID NO: 10800 - DNA, 1241 bp, Triticum aestivum
  Clone ID: PAT_TA_10800
ggaaattgtaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggatgtgtacaagattggcggcattggaactgtgccagtggggcgtgttgagactgggagtcatcaagccaggcatggttgtcacctttgggtcctactgggcctgaccactgaggtgaagtccgttgagatgcaccatgagtctctcctggaggctcttcctggtgacaatgtcggcttcaacgtcaagaatgtggctgtcaaggatctcaagcgagggtacgtcgcttccaactccaaggacgaccctgccaaggaggctgccaacttcaccgcccaggtcatcatcatgaaccaccctggccagatcagcaacggctatgccccggtgctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgcccagtaccctcccctgggccgctttgctgtgcgcgacatgaggcagacggttgccgtgggcgttatcaaggccgtggagaagaaggatccgaccggcgccaaggtgaccaaggctgcggccaagaagaaatgagatggtgtcgggcggcggcgtcgttggtggttctttaccacatctatggtggtggcggcggtatacggtggtggtcatagtcgtgttagcggatttgcaaacttgttaagcttcggttatttgtgtcgagcagtgttcgaactgcttattactgtggtcagcatagtatcgttccttgtgttggtgaaacttcgtcagataaagttgctattttatatatgcgtggtatttggagtcgctgcctgtgcaagcatatttggtaatggtttttgttttgcaaagtggattttttttcgttgctaactactcatgctgaaacttacctgtgctgaaaatttattactcaaactcagacggagagttgcagcagctgcttttttttccaggtgcatctaaga

SEQ ID NO: 10801 - DNA, 1049 bp, Triticum aestivum
  Clone ID: PAT_TA_10801
cgtggtcgcgggccgaggtggtccaccaaccttgactggtacaaggggcccacccttcttgagggcctggaccagatcaatgagcccaagaggccctccgacaagcccctgcgtcttccccttcaggacgtgtacaagattggtggcattggaactgtgccagtggggcgtgttgagactggagtcatcaagccaggcatggttgtcacctttggtcctactggcctgaccactgaggtgaagtctgttgagatgcaccatgagtctctcctggaggcgcttcctggtgacaacgtcggcttcaacgtcaagaacgtggccgtcaaggatctcaagcgtgggtatgtcgcttccaactccaaggacgaccctgccaaggaggctgccaacttcaccgcccaggtcatcatcatgaaccaccctggccagatcagcaatggctacgccccggtgctggactgccacacgtcccacatcgccgtcaagttcgctgagatccagaccaagattgaccggcggtctggcaaggagattgaggcggcgcccaagttcctgaagaacggtgatgccgggttcgtcaagatgatccccaccaagcccatggtggtggaaaccttcgcccagtaccctcccctgggccgctttgctgtgcgtgacatgaggcagacggttgccgtgggcgttatcaaggctgtggagaagaaggatccgaccggcgccaaggtgaccaaggctgcggccaagaagaaatgagatggtgtcgggcggtggcgtcgttcgtggtactttaccacatctgtggtggtggtggcggtatacggtggtggttatagtcgtgttagcgaatttgcgaacttgttaagcttctgttatttgtgtcgagcagtgttcgaactgcttattactgtggtcatagtattgttcggttgtgttggtgaaacttcgtcagataaaattgctattttatatatgcgtgatatttggagtcaaaaaaaaaaaaaaaaaaaaaaaacctgcccgggcggccgctcgaaatcactagtgaattc

SEQ ID NO: 10802 - DNA, 825 bp, Triticum aestivum
  Clone ID: PAT_TA_10802
gatccgatgacattattagagcaaattttgagaagatgggccacaaaagtttcgtgaggacttgcataataaagtggaattacaaatacagggcgccggtagaattgaaacacacaccgacacacgacacacacaccgacgcaagaggtgtgagagccactgcaagaaacagcaaccccacttattaagcacgcggaagctagcacgcagagaaaatcacgcacaggcgagcacgagaccaggcccacgtcccagcctctctcacttatggaacgcacgtaacgtaggcacacgcacggccggcggcgaggccggccaccgcacgtcgacggcgacctagccgaagtggtggtgcttcttctcgccgctggcctccttggcctccttgtggtcctgcttcttctcgtggtgctcgtggaagacgaagccgccggcgccgacggctgcggcggcagccacctcctcctcgatcttgtgcttgtgcgcgtgctccgggtccttcttcgcctcgtgcttctcgtagagggcgaaggctccggccgcggctgcgcccatctcgccgaggtgctccttgtgcttgtggtgcttctcctccttggtgatccgctcgtactcgccgtcgttgccggtggcggtcaccaccgtctcggtcgagtacccgtacgtgtcgacgccgccgtcagcggcgggctggaagtcctcgccctccttgtggtggaacaggtggtggtgcttctcctccgacatggctggctgatcgattagctagctagcacttgtgtgtgtgtgtatgtgacagtaggacagctgcttcggacgcgtggg

SEQ ID NO: 10803 - DNA, 1166 bp, Triticum aestivum
  Clone ID: PAT_TA_10803
gcgaagaaattgttaaggaggtctcttcgtacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaatgttggcttcaatgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagctggaggccctgccaaagttcctcaagaatggtgatgctggcatagtgaagatgattcccaccaagcccatggttgtggagacctttgctacttaccctcctcttggtcgttttgctgtacgtgacatgaggcaaactgtggctgttggtgtcatcaagggcgtcgagaagaaggacccaaccggggctaaggtgaccaaggctgccatcaagaagaagtaatttgacaattgatatccaaatcactgtttcaggcaccaagcagtttttagtattggctgagttttgttaagggcattgttcgtactgggtatattctagctgttcagctgttagcgctgcatatcgtgcccttagtggtgtctgtcttgtgccttctacatactgtcctaatgtaagcttcggtgaaacctggatgttatgagacttggttgtgtcttttaatactagtttgttgaattttatctgtgtagatgctttatctagtgcatttttggatgcatctaaaaaaaaaaaaaaactcgagactagttctcacctcgg

SEQ ID NO: 10804 - DNA, 694 bp, Triticum aestivum
  Clone ID: PAT_TA_10804
cgccctactaaaaccttctccgcgccaaccatcccgtcccccacacacctcacgccgcgcgccaagccaagaagaagacgcacccacgcagcacgcacgccatggccgccaccgcgtccttgtccgccgtcgcggcgcccctgtccgtcgccgggctcaagaaggccgcgtcgttccggcccctgccggtggccagggccggcaggcccgcggcgaggatgacggccgtccgggcgtcctccgcgtccgtgcaggagaagctcacggccgggctgaccgcggcggccgtggcggcggcgctggtgctgcccgaggtcgcggaggccgcgtccccggggctgtccccgtcgctcaagaacttcctgctcagcatcgtgtccggcggggtcgtcttcgccggcatcgccggggccgtcgtcgccgtctccaacttcgaccccgtcaagaggacctgatcatcttactggattctcatggcaggtcgcctcgctttgtatctcgatgaatctctttgctgtgttttattcggagactctgtacgtagaagagatccatgacaatggagttctgattaatggctgtgtatactctggttcgtctgcttaaactgttgcttgcgggctgtatccagtaattgcatgtttgtttacttccgaaactaaaaaaaaaaaaaaaaaaaaaaaaaaaaaaaaaa

SEQ ID NO: 10805 - DNA, 609 bp, Triticum aestivum
  Clone ID: PAT_TA_10805
ttttttttttagatacatccatattatgttcatggtaagatgtaaacggaattttggaacaaacttatatatgttctcttgaaaccactgtgaagtcccaactttctcaacagtacttttattagtagttcggtgtactctacttttacacccctgatgacagaaacagagtcaccacaggacaacttcacacaaatttattcctattattagtgctggccactgggccgctgatctcaagctcgactgcgttgcctcgacggactagtgagcggaaggcgggacaggcagcgggcggtcgtgcgccggcaggctgttgaccatgaaggccttgtcttcttccacggctgaaggccttccagctccatcgtattctccaatggtggaggagtgggcatgggcagtggggtaagtcggtggctgcattccgggagcagatcctcctcccctgatgcggccgccgccggtgtagggctgggcatggccgtcgaccacaagctggccgcagacgagcgccagaaggaccagagcagggaatgccttggacgccatctctcttggtctctcactttggtttgattgcgtgattctctgcctatgtgtgctctt

SEQ ID NO: 10806 - DNA, 946 bp, Triticum aestivum
  Clone ID: PAT_TA_10806
caagcaagcaattgaagcacaatatacaaaaccaacagcaaataagagcaatatctggagttcacttattcattacttataatgatactgatgtgccagcaacggtttcaaccaacagatagttcactaaaccaacgcagtaggactgacacggggattcgacagttttcaaaccaacacagtaggactcacacgaacgagaaaacagttctactgaacgacagggcaccgcccaccggacgaccaggataaaccagcagctcaaacgacagggcaattactgaccaccgcgaagacggagtaccaggtggagggtggactccttctggatgttgtagtctgcgagggtgcgaccatcctccagctgcttgccagcaaagatcaggcgctgctggtccgggggaatgccctccttgtcctggatcttggccttgacattgtcgattgtgtcggagctctcaacctccagggtgatggtcttgccggtgagggtcttcacgaagatctgcatgccaccacgcaggcgcagcacaaggtggagggtggactccttctggatattgtagtcggcgagggtacggccatcctccagctgcttgccagcaaagatcaggcgctgctggtccgggggaatgccctccttgtcctggatcttggccttgacgttgtcgatggtgtcggagctctcaacctccagagtgatggtctttcccggtgaggggtcttcacgaagatttgcatgccaccacgcatgcgcaggacaaggtgggagggtggactccttctggatgttgtaagtccggcgaagggtaccggcattcttccagctgcttgccagcaaagatcaagcgctgctggtcccgggggaatgcccttccttgtcctggatcttggccttgacgttgtcgatggtgtcagagctctcaacctcaagggtgatggtctt

SEQ ID NO: 10807 - DNA, 1467 bp, Triticum aestivum
  Clone ID: PAT_TA_10807
cggagatcaaacggcatgcatagaacttgatttatttaaggggacgacacgacacacaacggccatgttacagtgatgtaaagtacagtggagaacgaggtcctcgagagcatttgtatgagctatgcagtgctcattcttgatggcatggcaacaggtgaggagatacatcgtcgcacatactagtagcaagcatcatagttaattaaccggcccattattcagtacggtcgatgcatgattcggtagtaattaattcgtcgactgcagtagcctgcggcgcagtgacgtcgaaccgcgggtacggtcgggttctacatgcagaacggctcgcgctcgacgtcgaacttgtaggcagaggacagctgaggctcctccacgccgctgaagtttgcgaccttgcggatggagccgccgatggggccttgcaggttgcagttgccgctgctgtcgcgcatgatggccctcatggaggtgagcaggcggccgtaggtggtgcgcggctcgcactccaccgccctgatgaagctgtgcgtcatggcgccgatcgtggcgtagggctcaggcagcacgctcatgttgctctttccgttgctgctgccgctgatgagcacggcctggcctccgctggtgcccttgcaggcgccggtcatagggcgctcgtccctccacctccagcgcccggtctgcttggacacggtgcattggtaggggaggtcgaggacggtggcgctgtggcaggcgtcgacgatggcgtggagcttgacgccgtgcaccagcgggcggacgatggcctcgttgatctcgtcgtccaggatggggccctgctggaacgagtccacggggcagagggcctcgtccatgccgtccagctcgtcgccgtcgtcgtcgggcacctgcgcgcccaggccagagaactggaacaccagggagtcgccgtagctgcacccctgcaccagccagtgcatcgccatgcggatgttgtccttggtcggctgcctgcacgggttcctctcctcgtctgtgaggatgagaacgcagtcgttggggaagccgaagcgctcggtgagcaggtaccgcatgcacttgacgtcgttgatggggccccgcagctcgcaggagcgccggttggtgtacttgatcccgatcagcacggcgcgcttcttgccgcggccgccgccgaaggccggggtgggacgcatcggcggcatcagcatcccgccgccgttaccgccgtaaccctggccgtatccgtgctgctgccggccacggccgctgacgcgcgtcacgcagctgcactgcatgcactgcacggcgcgggcgccgggcatcgccgtgatgctcgagctgcactgcctgcaccgcaccatcgcgccaggacccatggagccgtagttcatgttcatggctggctacctgggttagcttagttaagctagcgctacgacgtgcgtttgctctcgtgcc

SEQ ID NO: 10808 - DNA, 849 bp, Triticum aestivum
  unsure (1)..(849): unsure at all n locations
  Clone ID: PAT_TA_10808
aagcaatccagtacaaacaatgacactattagagcaaattttgagatggatgggccacaaaagtttcgtgaggacttgcataataaagtgaaattacaaatacagggcgccggtagaattgaaacacacaccgacacacgacacacaccgacgcatgaggtgtgggagccactgcatgaacagcaaccccacttattcaggcacgcggaagcttagcacgcagagaaaatcacgcacgggcgagcacgagaccgggcccgcgtcccagcctctctcactttatggaacacacgtaacgtaagcacacgcacggccggcggcgaggccggccaccgcacgtcaacgacgatctagccgaagtggtggtgcttcttctcgccgctggcctccttggcctccttgtggtcctgcttcttctcgtggtgctcgtggaagacgaagccgccggcgccgacggctgcggcggcggccacctcctcctcgatcttgtgcttgtgcgcgtgctccgggtccttcttcgcctcgtgcttctcgtagagggcgaaggctccggcggcggcggcgcccatctcgccgaggtgctccttgtgcttgtggtgcttctcctccttggtgatccgctcgtactcgccctcgttgccggtggcggtcaccaccgtctcggtcgagtacccgtacatgtcgacgccgccgtcagcggcgggctggaagtcctcgccctccttcttgtggtggaacaggtggtggtggtgcttctcctccgccatggctggctgatcgattagctagctagcacttgtgtgtgtgtatgtgacagtaggacagctgcctcgtgccgaattncctgca

SEQ ID NO: 10809 - DNA, 812 bp, Triticum aestivum
  Clone ID: PAT_TA_10809
ttttttttttcgttcatcaaacttagcagtagacacaacacctcatgcaagctcaaaatcaacatactcccatatttaatagagatagcaccaacaaaatggaaactggaagatctgtatctctggcaatcaagccatgatgtcccagcaccagaaacgaaactctgattcaacaaaaccgcatacgataattttcataggctaacaagtttcagacatggaacacaatcataaagaagctactagcatcctgcagaatccggaaactggaaggccgtccctagtgcgacttgacatattcctgcacgatgtgaagaccctcggaatcttcgccgtagtccttcacgacgacacatgagcagcccaccacctttcttgccttgccctcagagtcaatcttgcaaagcccagcccactcgccaagagttttggcactaggcacagtgaccaagtgaacgttgtgctcagcacacagtgccttcaccagcttcacgtaatcaggctggtcgcagtcctcagcaagcacacagatctgagcagcatgcttctcaatcgctttcgcagcttcacggagtcccttgacaaggccatcatgagcgcttgacttcttcatcacaagctgcagagcagtcatcaagtccatgggctctccaagaacttggggtaggggccgcaaccggagcggcaacctcaactggggcattctcctccgccatgtctcgagctccgaagaccgaaccgaacctcgcgcgcgtagcatctgttgggggcggagggactcggcgctcctgggcctcgtgccgaattcctgc

SEQ ID NO: 10810 - DNA, 785 bp, Triticum aestivum
  Clone ID: PAT_TA_10810
ctgtgcggcgctcgagccggccgggaatcaacgacggagtcccgcgccgacctggtacgccgcgatcccgcctccgcctccacacgccctactaaaaccttctccgcgccaaccatcccgtcccccacacacctcacgccagcccaagaagaagagacgccgctacgcacccacgcagtacgcacgccatggccgccaccgcgtccctgtctgccgtcgcggcgcccctgtccgtcgccgggctcaagaaggccacgtcgttccggcccctgccggtggtcagggccggcaggcccgcggcgaggatgacggtcgtccgggcgtcctccgcgtccgtgcaggagaagctcacggccgggctgaccgcggcggccgtggcggcggcgctggtgctgcccgaggtcgcggaggccgcgtccccggggctgtccccgtcgctcaagaacttcctgctcagcatcgtgtccggcggggtcgtcttcgccggcatcgccggggcagtcgtcgccgtctccaacttcgaccccgtcaagaggacctgatcgcctcgccggattctcagggcacgtcgcctcgctttgtatctccataaatctcttttctgtgttttattcggagactctgtacgtagaagagatccatgacaatggagttctgattaatggctgtgtatactctggttcgtctgcttaaactcatgcttgcgggctgtatccagtaattggatgtttgtttacttctgaagctacttccccctttcaaaaaaaaaaaaaaaaaggccccta

SEQ ID NO: 10811 - DNA, 646 bp, Triticum aestivum
  Clone ID: PAT_TA_10811
tctagactagtggatcccccgggctgctggaattcggcacgagctcacgccgcgcgccaagccaagaagaagacgcacgccgacctttctctcgccatggccgccaccgcgtccctgtctgccgtcgcggcgcccctgtccgtcgccgggctcaagaaggccgcgtcgttccggcccctgccggtggtcagggccggcaggcccgcggcgaggatgacggccgtccgggcgtcctccgcgtccgtgcaggagaagctcacggccgggctgaccgcggcggccgtggcggcggcgctggtgctgcccgaggtcgcggaggccgcgtccccggggctgtccccgtcgctcaagaacttcctgctcagcatcgtgtccggcggggtcgtcttcgccggcatcgccggggccgtcgtcgccgtctccaacttcgaccccgtcaagaggacctgatcatctcgctggattctcagggctcgctttgtatctcgataaatctcttgctgtgttttattcggagactctgtacgtagaggagatccatgacaatggagttctgattaatggctgtgtatactctggttcgtctgcttaaactcatgcttgcgggctgtatccagtaattggatgtttgtttacttcaaaaaaa

SEQ ID NO: 10812 - DNA, 459 bp, Triticum aestivum
  Clone ID: PAT_TA_10812
taggggccttttttttttttttttttgtagggccaaaaggcacatttcagagtacctcaaggataataggtgcataaaattcagtcacaaacacatataatcctcacattacataaaactcagtactggaacatagccagactagtattaaacaactaaatttgaccaaacacaggtaaaagcaacttccacagccaaaacaacagaacaaatcaagaatcactagacaatgccatcacccctcagagttccgctgcctggatgcaagatgatgcttacggcctacttggatcgctgcctcatctttcggcgcttcctcttgagcctcctcatcctcttcttcttccacttggccctcatcgcggcggcggtgtcggcctcgctctccggttcgcggcggtggtggcggcgggagtgtgtggacgaacccgatctccgtagattcggaacccggccggc

SEQ ID NO: 10813 - DNA, 1231 bp, Triticum aestivum
  unsure (1)..(1231): unsure at all n locations
  Clone ID: PAT_TA_10813
cggcacgagatggacgccaccactcccaagtactcgaaggctcgttacgaagaaattgttaaggaggtctcttcgtacctgaagaaggtcggctacaaccctgacaaggttcccttcgtccccatctctgggttcgagggtgacaacatgattgagaggtccaccaaccttgactggtacaagggcccaaccctgcttgaggcacttgaccagatcaacgagcccaagaggccctcagacaagcccctccgtcttcccctacaggatgtttacaagattggtggcattggaactgtgcctgttggccgtgttgagactggtgtcatcaagcctggtatggttgttacctttggtcccactggtctgacaactgaggtcaagtccgttgagatgcaccatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgttgagaagaaggacccaaccggggccaaggtgaccaaggctgccatcaagaagaagtaattccacaattgatatccaaatcactgtttcagacaccaagcagtttttagtattggctgagttttgttaagggcattgttcgtactgggtatattttagctgttcagctgttagcgctgcatatcgtgcccttggtggtgtctgtcttgtgccttacatactgtcctaatgtaagctttggtgaaacctggatgttatgagacctggtttgtgtcttttaatactagcttgttgcattttatctgtgtagatgctttatctagtgcatttttgaaagacacaaatgcatctaaaccatttgttcttttaaaaaaaaaaaaattnaaaaaaaaaaaaaaaa

SEQ ID NO: 10814 - DNA, 843 bp, Triticum aestivum
  Clone ID: PAT_TA_10814
ctgatttataccatcatcgccataaccaaatataagtcatagggacaaacacaatgatgtcaaatggaacatgcaacagcgacagagcaaaaaatcaaaattgtaatattgcaaagagaaatatattatcagctcttgatgatttacgctaaaggcagcagctgcctgataaacaaaggttcagaggtccaaattgacgatatctgctaggctcacacttgaaacttcgaacaataggaagcccgagaataaagtataaatgaaaccgaggaccaaaatgcccaacacaagtgtttgcatcatgaaacattctcatctagtgagacttgacgtactcctgcacgatgttaaggccctcggattcttcaccgtagtccttcacaacaacgcaagagcagcccacaaccttccttgccttgccctcagagtcaatcttgcaaagccctgcccactctccaagagttttagcacttggcacagtaaccaggtgaacattgtgctcagcgcatagtgccttaacgagcttcacgtaatcaggctggtcacaatcctcagccagcacacaaagctgagcagcatgcttctcaatggacttggcagcctcacggagccccttcacaaggccatcatgagcacttgacttcttcatgacaagctgtagagcagtcatcaagtccattggctcaccaagaaccggggtaggtgcctctgctggggcaacaactggtgctggggcttcttccgccatctcgtgcgctccaaaggccaccgaggtagctgcgagagagggagatctgtagccttgggacctggagagcggcggcgcccacgcgtccgcgaaaa

SEQ ID NO: 10815 - DNA, 815 bp, Triticum aestivum
  Clone ID: PAT_TA_10815
tttttttttttttttttttttgttcccccggtgcaacgcacgggcccttttgctagttcattacttaaggatactgctgtgccagcaacggtttcaaccaacataacatggggactcgatagttttcaaaccaacacataggactgacacaaacgagaaaacagttcaaacgatcgacagggcaccaccaaccggacgaccaaggataaaccagcaggtacaacgccaggacaattactgaccaccacggaggcggagcaccaggtggagggtggactccttctggatgttgtagtccgcaagggtgcggccatcctccagctgcttgccggcaaagatcaggcgctgctggtccgggggaatgccctccttgtcctggatcttggccttgacattgtcgatggtgtcagagctctcaacctccagagtgatggtcttgccggtgagggtcttcacgaagatctgcatgccaccacgcagacgcaggacaaggtggagggtggactccttctggatgttgtagtcagcgagggttcggccatcctccagctgcttgccagcaaagatgagacgctgctggtcagggggaatgccctccttgtcctggatcttggccttgacattgtcgatggtgtcagacgactccacctcaagggtgatggtcttgcccgtcagtgtcttcacaaagatctgcatcttgaggcggtggggaaggaggattcgacaagcctcgagtcgatcggagacgagattagcttgggatttgttggttccgttgctgggagcggtggtccccttctgtcgtctgtcgaccc

SEQ ID NO: 10816 - DNA, 1277 bp, Triticum aestivum
  Clone ID: PAT_TA_10816
tgtttcttctgcccttgataatttacacgtacggcacattcgtactctcatacttttccccggtaaaattcacacagcacatgatgctgcatcgcgcgcatcgcacgcagctgatccatcaacagccgacggcggcggacgggcaatcaacggccagctcacaggctgggcaccctctcggcggcgccggagatgacggtgagcaggttgttgccgaaggggtcgctgaggtgcgcgcacaggttctcaaaggggccctcgccggtgacgtaggcctggatgaagaagcccagcatggagaacatggccagccgtccgttcttgatctccttcaccttgagcagcgccgcctggtcggggtcggtggcgaggccgagcgggtcgaatgggccaccggggtggagcttgtcatcaaattccagtccgttggtgatggggatgctgttgccgaagtagttgagggtgttgccgtcaaggagaagggcgccagtcttgaaccaaacggcctcgggaccgcagtttgcgccgaacttgttgagcgcctcggggatgatgaatcccggcggcgccggagcatggcccacctggcatggatgagctcaaaggcctggtacttggcgaagtcctctggcttcttgcccagaccaaaaggatcatagccgtagtctccgggaacctctccgttgaggtactccggcacctccgaccggtcaaggagaccgttgggcaagtagatcctcctgtcagggccgtaccacttggcgagctcgtcgtcgatgcctacgctcgaggtggcaacgggtgcgggcttcggcttcggggcgggcttcttcttgaagcgatcaaagagggagacgatcttctgtgcgccagcagttggtgccgctgtggcatacctggaggatccggcgaagttgagccgggtgccgagcatcttcgtcggagcgagcgccgccattgcctcagcccaaagttgagagagaaggggcgtgctcagctcagcaagaattaatcagggtgcagatcagtgttggtgtgcttgatgaaaattacttactcaggatgcagagtgtggttagggtaattaagtaaggccggaataacggcggtgctgatctctcttctcttcactcccgtggagaagaggtttttgtttttggatgaagaagaaaatgtacccctaatcagcatgcgcgcggttgttgtagaaggagaagatgtaagttgatgcagatgtaatcaatggaagttggttaaatttcgtagtaaaaaaaaaa

SEQ ID NO: 10817 - DNA, 653 bp, Triticum aestivum
  Clone ID: PAT_TA_10817
agcgttcgcttcacacaagcatacacaagtaactctgaacatgaacaggcacacgaattgcaaggttcacttcagttctgaagttcaaacgaggtcaagaactcacagctaagtttaaccaatgttcaacatcctgacatgaggggcagcaaaacgataaccggaaaccatttttatgtctactgatgatttatccagacaacgaaatttacgaacgagctctagttcttgatcttcttcttgggcctcagctggttgctgtggccacacttcttcttgcggcagttgacggcccttggatgcagcctggcgtagcacttgcggcagatcatcttctcctggttgtacttgcgggcgagggcctggagcgagggctcgatgatgccgccgcggaggcggagcacgaggtgcagcgtcgactccttctggatgttgtagtcggccagcgtgcgcccgtcctccagctgcttcccggcgaagatcagccgctgctggtccggcgggatcccctccttgtcctggatcttggccttgacattgtcgatggtgtcgctgctctcgacctcgagcgtgatggtcttgcccgtcagggtcttgacgaagatctgcatcctggcctcgtgccgattcctcagcccggggatcactattaa

SEQ ID NO: 10818 - DNA, 803 bp, Triticum aestivum
  Clone ID: PAT_TA_10818
ttttttttttttttttttttggccacaaaaagtttcgtgaggacttgcataataaagtgaaattacaaatacagggcgccggtagaattgaaacacacaccgacacacgacacacaccgacgcatgaggtgtgggagccactgcatgaacagcagccccacttattcagcactcggaagctaagcacgcagagaaaatcacgcacaggcgagcacgagaccaggcccacgtcccagcctctctcactatggaacacacgtaacgtaagcacacgcacggccggcggcgaggccggccaccgcacgtcaacggtgatctagccgaagtggtggtgcttcttctcgccgctggcctccttggcctccttgtggtcctgcttcttctcgtggtgctcgtggaagacgaagccgccggcgccgacggctgcagcggcggccacctcctcctcgatcttgtgcttgtgcgcgtgctccgggtccttcttcgcctcgtgcttctcgtagagggcgaaggctccggcggcggcggcgcccatctcgccgaggtgctccttgtgcttgtggtgcttctcctccttggtgatccgctcgtactccccctcgttgccggtggcggtcaccaccgtctcggtcgagtacccgtacgtgtcgacgccgccgtcagcggcgggctggaagtcctcgccctccttgtggtggaacaggtggtggtggtgcttctcctccgccatggccgccggctgatcgattagctagctagcacttgtgtgtgtatgcgacagtaggacagctgcctcgtgccga

SEQ ID NO: 10819 - DNA, 1320 bp, Triticum aestivum
  Clone ID: PAT_TA_10819
gtacttgaagaaggtcggctacaaccctgacaaggttcccttcgttcccatctcttgggtttgagggtgacaacatgattgagaggtccaccaaccttgactggtacaagggccctacccttcttgaggctcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtgaagatgattcccaccaagcccatggttgtggagacctttgccacttatcctcctcttggtcgttttgctgtccgtgacatgaggcagactgtggctgttggtgtcatcaagggcgtcgagaagaaggacccaaccggggccaaggtgaccaaggctgccatcaagaagaagtaattcgacattgatatccaaatcactgttcagacaccaagcagtttttagtattggctgagttttgttaagggcattgttcgtactggtatattttagctgttcagctgttagcgctgcatatcgtgcccttggtggtcgtctgtcttgtgccttttacatactgtgtcctaatgtaagcttcggtgaaacctggatgttatgagacctggttgtgtcttttaatactagcttgttgcattttatcaaaaagaagtaattcgacattgatatccaaatcactgttcagacaccaagcagtttttagtattggctgagttttgttaagggcattgttcgtactggtatattttagctgttcaggctgttagcgctgcatatcgtgcccttggtggtcgtctgtcttgtgccttttacatactgtgtcctaatgtaagcttcgggtgaaaccctggattggatgaggaccctggttgtgtctttttaatactaggcgttggtgcat

SEQ ID NO: 10820 - DNA, 1636 bp, Triticum aestivum
  unsure (1)..(1636): unsure at all n locations
  Clone ID: PAT_TA_10820
gaacagtgagctatcatcaactttctcagggtaggtatgcatacagtaattgtttgttctcataaatataacttcaggcaactctagagtttccgcactgccaatacagctaacagtcgttggcaccaacacgctggtgattgattattcacacccataattagaaaacaaaaccccgcaaaatgacgtgcatctcatatataaatcatcctgccgccgcctcatcagtaggtgtagcccttctggaacatgcccttcttggcctcgtcgctctcgccctcgccggtgtagctgccgagctgcgccaacgagttggccttggcgcggaccagcagggccttctgcgccgcctcgatgttctcgggctgcccctgccacgtcttcagcaccgagttctggagggcccgggcgtacgagaaggacacgtgccacgggttggcggactggttcatcgcgttcaggttcatggttgcctccagctcggactgtccgccggaaaggaacatgattccagggaccgcgggcggtactctcctcctcagcattgtgagggtgttcttcgcaatggcttctggagaagccttctccttgtgctcagcaccaggggtaaccatgctgggtttcagcaggatgccctcaaacagaacattgttttcggccaggtagaagaacacctctgaccacaccttctctgccacctcaagagttctctcgatgccatggtcaccgtccagaaggatctctggctccacaattggcactaaaccattgtcctgagcaatagcagcatagcgagcaagtccccatgccgcttccttgacagctaatgcagtaggaccacaagggatgctaacaacagtccgccactttgcgaagcgtgcaccctgcttgtagtactcagcacaccttgaggccaaaccatcaagaccttggcaccaggattcattgttggatccgggcaatggaaccaaacccttgtcacccttgataccaggcatgatattctggtccttcaagacatcaacaaaggtcttgccatctgtagtggactggtagagagtttcctcaaagagaatagcaccagagatatattcaccaagaccagcagtggtcagcaacagctgcctgtaagcctggcggttaacttcggtgttgtccaacccaatggatgccaatctctttccacatgttgcactcgactcgtctccaccgcgaaaactgttgcttcccctggccgtgggatccttgcgatcgacgagtcgagtgcaacatgtggaaagagattggcatccattggtttggacaacacggaagtgaaccgccaggcttacaggcagcttttgctgaccactgctggtcttggtgaatatatctctggtgctattctttttgaggaaactctctaccaagtccactacagatggcaagacctttgtggacgtcttgaaggaccagaaatatcatgcctggtatcaaggttgacaaagggttttggttccaattgcccggatccaacaatgaatcctggtgccaaggtcttgatggtttggcctcanagtgtgctgagtactacaagcagggtgcacgcttcgcaaagtggcggactgttgttagcatcccttgtggtcctactgca

SEQ ID NO: 10821 - DNA, 838 bp, Triticum aestivum
  Clone ID: PAT_TA_10821
cggccgcgtcgaccgcggccgcgtcgacttttttttttttgcaagctcaaaatcaacatactctcatatttaatacagagatagcaccaacaaaatgacactggaagatctgtatctctgacaatcaagccatgatgtcccagcaccagaaacgaaactctgattcgacaaaaccgcacaagataattttcataggctaacaagtttcagacatggaacgcaaccataacgaagctactagcatcctgcagaatccggaaactggaaggctgtccctagtgcgacttgacgtattcctgcacgatgtgaagaccctcggaatcttcgccgtagtccttcacaacgacacatgagcagcccaccacctttcttgccttgccctcagagtcaatcttgcaaagcccagcccactcgccaagagtcttggcactaggcacagtgaccaagtgaacgttgtgctcagcacacagtgccttcaccagcttcacgtaatcaggctggtcgcagtcctcagcaagcacacagatctgagcagcatgcttctcaatcgctttcgcagcttcacggagtcccttgacaaggccatcatgagcgcttgacttcttcatcacaagctgcagagcagtcatcaagtccatgggctctccaagaactggggtaggggccgcaaccggagcagcaacctcaactggggcattctcctccgccatgtctcgagctccgaagaccgaaccgaacctcgcgcgcgtagatctgttggggacggagggactcggcgctcctgggaggcaggctagggtttcgtctggggtttggtgagccccgtcggcccgcgaat

SEQ ID NO: 10822 - DNA, 872 bp, Triticum aestivum
  Clone ID: PAT_TA_10822
gccggccgggtccgaaaaaccctagcctccactccgcaccccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggcaagtgcggcctcacctacgtctacaaccagaaggcttagaggttgcttgcgattgctctgctcttttactctacctatcgagagtcgaactcacttagatgtgtcccgtttgtcgtttaaactgaaaccttgagtcttatgtttcctgaatatttcatcgcctactgctgtaacgcgatgcgtgcttaaattttggtgtccgtatgctatcagtctaaatgcttttaatctattccatgtccgtattctatgctttgttgatcttaataaggtggtgtgatcacggagaggatgtatcctgttgatacatgtgttcttgaaaaaaaaaaaa

SEQ ID NO: 10823 - DNA, 833 bp, Triticum aestivum
  Clone ID: PAT_TA_10823
gttatcacataataatgggccaaatcacaggtagggattggaattttgggatgtttgcagttctggcaataggcgagactcaaatcacatatcaacttcaccactactactacacaaaacgaggaccgacaagggaagaccagaattacaatcagaagttcacttatccaaactgagtgtctgacaaccctcacaccatacatacacacacttcagagttttacgagatacccatcttttacgagatacccatcgtgatggcccagggagcctgggtacctcttacaaggtcttatggatagtatgtatatagcaaaattaaacgaccatacttcggcaaccattttttcttcgggcgacgcttgtcctcctcaagattgtgtaggacttggtgtcacgcagcaaaaccacttctttgaatttgccttggtggcataagattccaccctctcagtcctggcatctttgccaggggattcagtatcttgtccattcccagcctttttctcatccctggctttgttgaatataacagtgaacccatcagcagaagctgggtcgttgacgtcccattcgccaaacttgggcaaagggcgaccagattcctccgacatggatggagcgcggcggtccgatccaccgaggggcttggggaaagtttcgtcggctgcgggtgggaggaaggggaaagggacggggataagggcgaggagcgagacggaggggaagggggaggaggagacggcgaatcgaagtggaaaaggagcagcagtcgattgacggatttatacctcgagacgggggaaacgcaccccgcggccccgtaaaaaaag

SEQ ID NO: 10824 - DNA, 770 bp, Triticum aestivum
  Clone ID: PAT_TA_10824
aaattgtgatattgcaaagagaaatatattattagctcttgatgatttacgctgaaggcagcagctgcctgataaacaaaggttcagaggtccaaatcgacgatatctgctaggctcacacttgaaagttggaacaataggaagcccaagaataaagcataaatgaaaccgaggacaaaaatgcccaacccaaatgtttgcatcatgaaacattctcatctagtgagacttgacgtactcctgcacgatgttaaggccctcggattcttcaccatagtccttgacaacaacgcaagagcagcccacaaccttccttgccttgccctcagagtcaatcttgcaaagccctgcccactctccaagagttttagcacttggcacagtaaccaggtgaacattgtgctcagcgcatagtgccttaacgagcttcacgtaatcaggctggtcacaatcctcagccagcacacaaagctgagcagcatgcttctcaatggacttggcagcctcacggagccccttcacaaggccatcatgagcacttgacttcttcatgacaagctgtagagcagtcatcaagtccatcggctcaccaagaaccggggtaggtgcctctactggggcaacaactggtgtcggggcttcttccgccatctcgtgcgctccaaaggccaccgaggcagctgcgaaggagggagatctggagccttgggaccttggagaatggagagcggcggcggtagggttttcgcgagcctcgtgccgaattcctg

SEQ ID NO: 10825 - DNA, 769 bp, Triticum aestivum
  Clone ID: PAT_TA_10825
cagagcaaaacatcaaaattgtgatattgcaaagagaaatatattatcagctcttgatgatttacgctgaaggcagcagctgccagataaacaaaggttcaaaggtccaaatcgacgatatctgctaggctcacacttgaaacttggaacaataggaagcccaagaataaagcataaatgaaaccgaggaccaaaatgcccaacacaagtgcatcatgaaacattctcatctagtgagacttgacatactcctgcacgatgttaaggccctcggattcttcaccgtagtccttgacaacaacgcaagagcagcccacaaccttccttgccttgccctcagagtcaatcttgcaaagccctgcccactctccaagagttttagcacttggcacagtaaccaggtgaacattgtgctcagcgcatagtgccttaacgagcttcacgtaatcaggctggtcacaatcctcagccagcacacaaagctgagcagcatgcttctcaatggacttggcagcctcacggagccccttcacaaggccatcatgagcacttgacttcttcatgacaagctgtagagcagtcatcaagtccattggctcaccaagaaccagggtaggtgcctctactggggcaacaactggtgtcggggcttcttccgccatctcgtgcgctccaaaggccaccgaggcagctgcgaaggagggagatctggagccttgggaccttggcagagcggcggcggtagggttttcgcgagcctcgtccgaat

SEQ ID NO: 10826 - DNA, 979 bp, Triticum aestivum
  Clone ID: PAT_TA_10826
acaagcccctgcgtcttccccttcaggatgtttacaagattggtggcattggaactgtgcctgttggacgcgttgagactggtgtcatcaagcctggtatggttgttacctttggccccactggtctgacaactgaggtcaagtccgttgagatgcaccacgagtccctcctggaggcgcttcctggtgacaatgtcggcttcaacgtgaagaacgttgctgtcaaggatctgaagcgtgggtttgttgcatccaactctaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtattgtgaagatgattcccaccaagcccatggttgtggagaccttcgccacctacccacctcttggccgcttcgctgtgcgtgacatgagacaaacggttgctgttggtgtcatcaagggcgttgagaagaaggaccccaccggcgccaaggttaccaaggctgccatcaagaagaaatgagtgctctggtgtctgccatcgagttatctagcagaagttttagtgtcaagtcttttttggagaatcttagtgtatgttaagtggtgttcctgggcgttgttgcacttccgactcctgcacctgtgtgcgagctatgatgtgtcgtttaaatactctatttcgattccattattgtgctcttatcccatttgtggttttgtctgcctgtgttgaatgctcttaatagatggatatgattacctgctttcccgtttgcaatttcactctgctatcatgctggggtgaatactgctttgtgaggaaaaaaaaaaaaaaaaaggccccta

SEQ ID NO: 10827 - DNA, 831 bp, Triticum aestivum
  Clone ID: PAT_TA_10827
aaacttagccgtaaacacaacacctcatgcaaactcaaaatcaacacactcatatttaatatagagatagcaccgacaacatggaaactggaagatctgtatctctgacaatcaagccatgatgtcccagcaccagaaacgaaactctgattcgacaaaaccgcacaagataattttcttaggctaacaagtttcagacatggaacacaatcataacgaagctactagcatcctgcagaatccggaaactggaaggctgtccctagtgcgacttgacgtattcctgcacgatgtgaagaccctccgaatcttcgccgtagtccttcacgacgacacatgagcagcccaccacctttcttgccttgccctcagagtcaatcttgcaaagcccagcccactcgccaagagttttggcactaggcacagtgaccaagtgaacgttgtgctcagcacacagtgccttcaccagcttcacgtaatcaggctggtcgcagtcctcagcaagcacacagatctgagcagcatgcttctcaatcgctttcgcagcttcacgaagtcccttgacaaggccgtcatgagcgcttgacttcttcatcacaagctgcagagcagtcatcaagtccatgggctctccaagaactggggtaggggccgcaaccggagcggcaacctcaactggggcattctcctccgccatgtctcgagctccgaagaccgaaccgaacctcgcgcgcgtagatctgttgggggcggagggactcggcgctcctgggaggcaggctagggtttcgtctggggtttggggccccttctgtcgtcttctcgcagccg

SEQ ID NO: 10828 - DNA, 936 bp, Triticum aestivum
  Clone ID: PAT_TA_10828
gccggccgggctgggagcctccactccgccccctaacccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgccggcaccttcatggccaaccacttcgaccgccactactgcggcaagtgcggcctcacctacgtctacaaccagaaggcttagaggtggctcgcgtttgctctgctctttttacctacctatcgagaatcgaactcatttagatgtgtcccgtttgtcttttaaactgaaaccttgagtatcatgtttcctgaatatttcatcgcatactgctgtagtgcgatgcgtgcttaaattttggtgtccgtatgctatcagtccaaatgcttttaatctatcccatgtcggctttcttattctatgctttgctgatcttaataaggtggtgggaagatcacgaaaaatgtatcctgttgatacatgtgttctttggcttataacctttatggcaggtgtttgtagattagtcaatagctatgcagggcttacatgtggatgacgactattt

SEQ ID NO: 10829 - DNA, 677 bp, Triticum aestivum
  Clone ID: PAT_TA_10829
gtctgtaggccggatagagaggaaaccactagctttcgcgggcagattaccaacgaggcaagaattaaccagaaagcagatcaaacaggggagatacggcaaaattataggtttgctaccatataccaatactgtcacttatcatcaccacaacgataggaggctgaaagcaaagtaaaataaggttcaacgacaaccgagacgataatagcataaactctgacacagtgatggattcaaccggtccatgaaactgactagcagcactctagttcttgatcttcttcttgggcctcagctggttgctgtggccacacttcttcttgcggcagttgacagcccttggatgcaggcgcgcgtagcatttgcggcagatcatcttctcctggttgtacttgcgggcaagagcctgcaaggacggctcgatgatgcctccacggagcctgaggacgagatggagggtggactccttctggatgttgtagtcggcaagggtgcggccgtcctccaactgctttccggcgaagatcagccgctgctggtccggcgggatcccctccttgtcctggatcttggccttgacattgtcgatggtatcgctgctctcaacctcgagggtgatggtcttccccgtgagggtcttgacgaagatctgcattttggcggagggtgttcca

SEQ ID NO: 10830 - DNA, 598 bp, Triticum aestivum
  Clone ID: PAT_TA_10830
ttttttttttgaaaaatctgtcaggcagattaactgtcctacacaatcagaagcaatttgcttggctttatcatttctaatacatgcattgtaatatttcaaccattcagaaggcataacagatattaatcatctaaaattttagaaacatatagcatcatcgcatcacaaaaaagatgagacgccgcaaaattaataggtgcataaaattcagtcacaaacacatataatccccacattacataaaactctgtcttggaacataaccagactagaattaaacagctaaattggacataacacaggttaaacagcttccacagccatagcagcaaacacgccaggaatcactagaccatgccgtcatccctcggtgcctggcagcctggatgtaggatgatgcttccgctgctccaaggcgcctacttggatcgctgcctcatctttcggcgcttcctcttgagcctcctcatcctcttcttcttccacttggccctcatcgcggcggcggagtcggcctcgctctccttttcgcgtcgtcggcggcggcggcggaagtgtgtggacgaacccgcccacgcgtccgcccacgcgacag

SEQ ID NO: 10831 - DNA, 1179 bp, Triticum aestivum
  Clone ID: PAT_TA_10831
attgtcaaggaagtctcttcatacctgaagaaggtcggttacaaccctgacaaggttcccttcgttcccatctctgggttcgagggtgacaacatgattgagaggtccaccaaccttgactggtacaagggccccacccttcttgaggccctggaccagatcaatgagcccaagaggccctccgacaagcccctgcgtcttccccttcaggacgtctacaagattggtggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaatgtcggcttcaacgtcaagaacgtggccgtcaaggatctcaagcgtggatacgtcgcttccaactccaaggacgaccctgccaagggaggctgccaacttcaccgcccaggtcatcatcatgaaccaccctggccagatcagcaacggctatgccccggtgctggactgccacacgtcccacattgctgtcaagttcgctgagatccagaccaagattgaccggcggtctggcaaggagattgaggcggcgcccaagttcctgaagaacggtgatgccgggttcgtcaagatgatccccaccaagcccatggtggtggaaacctttgcccagtaccctcccctgggccggtttgctgtgcgcgacatgaggcagacggttgccgtgggcgttatcaaggccgtggagaagaaggatccgaccggcgccaaggtgaccaaggctgcggccaagaagaaatgagatggtgtcaggttctttactgcatctatggtggtggtggcggtggcggtatttggtggtggtgatagttgttctagtcgttttgagaacttgttaagcttcggttatttgtgtcgagcagtgttggaactgcttattgctctggtcattgtatcgttcggttgtgttggtggaactatgtcagttgatgttgctactaaatatagtcgtcatgtttggagtcgttttatatcagttgatcatgtttcttgtcatgcaaagttgaatttttgttttgcttccttaactattcctattcctgtgcttcttttgcagccagaatatttcttcttcagttgtcc

SEQ ID NO: 10832 - DNA, 3038 bp, Triticum aestivum
  Clone ID: PAT_TA_10832
ccacgcgtccgcctggtcaccgtgatttcatcaagaacatgatcactggtacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttacgatgaaattgtcaaggaagtctcttcatacctgaagaaggtcggttacaaccctgacaaggttccctttgtccccatctctgggtttgagggtgacaacatgatcgagaggtcctccaaccttgactggtacaagggcccaaccctgcttgaggcgcttgaccagatcaatgagcccaagaggccctccgacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgataatgtcggcttcaacgtcaagaatgtggctgtcaaggatctcaagcgtgggtacgtggcctctaactccaaggacgaccccgccaaggaggctgccaacttcaccgcccaggtcatcatcatgaaccaccccggccagatcagcaacggctacgccccggtgctggactgccacacgtcccacatcgctgtcaagttcgctgagatccagaccaagatcgaccggcggtctggcaaggagattgaggcggcgcccaagttcctcaagaacggtgatgccgggttcgtcaagatgatccccaccaagcccatggtggtggagaccttcgcccagtaccctcccctgggtcgctttgctgtgcgtgacatgaggcagacggtcgccgttggcgtgatcaagagcgtggagaagaaggatccgaccggcgccaaggtgaccaaggctgcggccaagaagaaatgagatggtgtcgggcggtggcgttgttggtggttctttaccacatctatggtggtggtggcggtatacggtggtggtgatagtcgtgttagccgatttgcgaacttgttaagctttggttatttgtgtcgagcagtgttcgaactgcttattactgtggtcatagtatcgttcggttgtgttggtgaaacttcgtcagataaagttgctattttatatttgagtgatatttggagtcgttttaaaaaaaaaaaaaaaaaaaagcggaaaaaaaattaaacaaaaataaaaaaagagggggcgaggaagaaaccgaaacactcacacagaacaccacaccccccaccccggcgacacaccacccctcccaccccaaatctcagatcagagcgccgggagatctgccatttccgggtggagggatcgagccccgcgcttctcgattaaatcctgggctctgtatcttgtgtggatggcatttgtgcctcagagactgtagctcaccaagtgttgatttgaacctgtgaagatagagatgggttctccgagaaaatccgacaagaaggccgccttagactttgcagcatggggtttcaatatcacctcatccgttgggatcatcatggtcaacaaaagccttaatggctacacatggattcagttttgccacaacattaactggccttcatttattgacaacgaccttgatgactattgtgtttcggtggttaggcctgagccagccctctcacttaccgctaccagatctgattaagtttgtaatcttttcaaatttgtcgatcgttggcatgaatgtgagcttgatgtggaattctgtggggttttatcagatagcaaagctgtgcatgatacccgcatcatgtcttctggaagttgtctttgatcgtgtacattattcacgggacacaaagctgagcataatggttgtacttataggcgttgcagtttgcactgttactgatgtcagtgtgaatgcaaaaggcatgcttgcagctgttatagctgtctggagtacagctttccaacaatattatgttcattatctgcagcggaagtactctctgaactcattcaatctcctaggccacactgctccagcccaagcaggttccctcctgttagtagggccctttgtggatttcttgttgactggcaaaagggtggatcacttcaatttcacatcgctttctctgttattcgtcgtactctcatgcatcatcgccatcggcgttaatctgagccagttcatctgcatcggccggttctctgctgtatctttccaagtcttaggccacatgaagactgtgctggtcctcttccttggctttctcttctttggcaaggagggcctgaacctacacgtagtccttgggatgatccttgctgttcttggaatgatgtggtatgggaacgcatcagcgaagccaggcggcaaagagcgtcggagtgtcctcccagtgaggtccgacaggcacaatggaggttcaagaagacaaggatggcggtgataagtgatttttgcaatcggcaactgcagtgcgtgcatattttttcccttgaggtttctggtgacacacaacacatcgaaggaagacagtctggtattgttcttgatagaggttactacagaagctgaaccttaccccacctaggaactcggcaccgttctcgttataggttacatacattaccgtcacattttttcgatacattcatagtcacgagatgttttacaaggtttgagtatagtataatcctttagaagtaagtcgtatgtgaaggttgtggaattgtggtgaagaatgttggaagttaaggccttgttttgatcttgtggaagtatggactacacattaggatcatttttgaattgtcattactgaatgaaattcattatcggggttttatagaccaaaaaaaaaaaaaaaaaactcgagacta

SEQ ID NO: 10833 - DNA, 1078 bp, Triticum aestivum
  Clone ID: PAT_TA_10833
agcctttgaaggcagaatccacaacaaataatacaagttttcccttgacattagcttttgcccctctttttttttgaaaaaggaggattgcccccggcctctgcatcagaatgatgtatataaatacatcatctatactaattcaacattagaaaacaagcacacgaactcactttatatagataaatcgacgagttccacaagaacacgattatcgaatacaaaggttcagcaagcaaaagggaaatagttcgggcaggggcggcagcataggtaagcccgatataaagaagaagaaaacaagctacggagccggccggagcaggaaacaagtgagccaccctccggaggccaagaaggagcccatccaacccgccgcgatcccgacgacatgcaaacatccgccatggctactagttcaacatccctgaactgaaacggccacatcgcttcattttattgcatccatctgattattaatttcttcaaactgcatgccatgcatccagccttggattatttgttcgaacatagcaccacttcgttctccatcatacggaaacggaagtaactgtcaccgttgcgttgttattggtagtcttaagcaagcgttttgggacggagttgaacttggcgaaccacttggccgacttcttgagcttgcgcttgttgccgtccttcttgtcgatgtagacgaggccgaatcgtgagctgtagcccaggctccattcgaagttgtcgatcagaccccacgtgaagtggccccgcacgtccgcgccctggtctattgcgtccttgacggctgagatgtggcgctggaggtagtctagcctcttccagtcatccaaaggatctgtcatggttgggtcgctgtccacatcagcaattccgttctcagtgatgaagatgggtgggtttccgtatttctccttcatgatcagaaggaggtccgttaggccttttgggtacatgtaaatccaataagtcccggtaataggaccgatgtcatttcccgtcactccctttagtttctgaactggcgtaagcgtcgtcggtgtacctcggccgcgaccacgct

SEQ ID NO: 10834 - DNA, 1140 bp, Triticum aestivum
  Clone ID: PAT_TA_10834
tcgccagctcgaaattaacccccctaaagggaacaaaagctggagctccaccgcggtggcggccgctctagaactagtggatcccccgggctgcaggaattcggcaccagttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggccgtgttgagactggtgtcatcaagcctggtatggttgttacctttggtcccactggtctgacaactgaggttaagtctgttgagatgcaccatgagtctctcctggaggcgcttcctggtgacaacgttggcttcaacgtcaagaacgttgctgtgaaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctgaagaacggtgacgctggtatcgtcaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcgtgctatctagcagaatgtttttgttcacggtcattgcttttgttgcttcagactcttatcccgagcgagcaatgatctgtctgtcgtttaattactgtatttctattcctgcgtcggctaaactcctgtgcccctgagactgatttgttgtgaaatgcaagttattagattgcaacttgttagcttgtttttctgctgcttttgccaaatggttgcctgcttaagatgcttctttatatcgaactttaaa

SEQ ID NO: 10835 - DNA, 2962 bp, Triticum aestivum
  unsure (1)..(2962): unsure at all n locations
  Clone ID: PAT_TA_10835
cgccatgcgccggggaattgattggtgtcgcgccgagtttttataaaacaggcatgaagccccactttatagataagtcggcgagttccacaaatacatagttatcgaatacgaaggttcaccaagcaaaaaggaaataatttgggctgggttgcaacacaggtaagcccaacttaaagaaaacaaaccagaagcccagagcgggatgttgaagagctacaccctttgggagtcaatgctactaattcaacatcaccggtagtaaatgtccacattccttcattttattgcatccattggattacttattccttcaaactgcataccatgcattggagcattggattatttatttgaacataacattgcttctcccgtcacacgggagcttgcccagttgggcttggtagtaccaagcaagtgttttgggacggcgttgaacttggcgaaccacttggctgacttcttgagcttgcgcttgaagccgtcatttttgtcaatgtagacgaggccgaaacgtgagctgtagccgctgcccccactcgaagttgtcaatcaaaccccaggtgaagtggcccccgtacgtctgcgccttggtctattgcgtccctttgacgggttgagatgtggcgcttggaggtagtctagcctctttcccagtcatcccaacggatcttggcatggtttcgtcgccgtccacgtcagcgattccgttctcagtgatgaagatgggtgggtttccgtatttctccttcatgatcagaaggaggtccgttaggccttttgggtacatgtaaatccaataagtcccagttataggaccgatgtcattcccgtcactccctgtagtttcttgaactggcgtaagcgtcgtcggtgttcagctttggcgtaacgtccggtgaaatgtcaacatgcttggagaacctggaggtgtaataattgagccccatggatgtcacatgaggacgtagtttctcttgctccttccttggtgaacatgggtagacaaatctccgaatcagtgatctcatggagaaggggtagtcacccacgaccactgctcccaggaacccatcccatgttgtagtcaatggatctttcccgggcctggtcgtcgaggaaggagtcttggtatggctcgtaacccattacgtcaaaagccattcctattttggaatctccatgcatgttgtaacgagctttgaacagctgaacagcctcagcatgagctaggaggatgtggtgaccagcagtgtatggctctctgagcgagtctccttctggaacggcactatccatctccgggaagcacctcccagaagcatgaatcccctctccgtaggagaaacaacaatatgtatgtggctcgttaaaggtgaaccagttcttcaccctgtcgccgaagttcttaaagcacacctcggagaattgtttgtaatcagctccaatctgcctatttaagaagcaccacgcctcacaccatacatacacacttcagagttttacgagatacccatcgcgatatgcccaggggggctgggtacctcttacaaggtcttatggatagtatgtatatagcaaaattaaacgaccatactttcgcaaccattttttcttcgggcgacgcttgtcctcctcaagattgtgtaggacttggtgtcacgcagcaaaaccacttctttgaatttgccttggtggcataagattccaccctctcagtcctggcatctttgcaaggggattcggtatcttgtccattcccagcctttttctcatccctggctttgttgaatataacagtgaacccatcagcagaagctgggtcgttgacgtcccattcgccaaacttgggcaaagggcgaccagattcctccgacatggatggagcgcggcggtccgatccgccgaggggcgtggggaaagtttcgtcggctgcgggtgggaggaaggggaaagggacggggataagggcgaggagcgagacggaggggactgaaacattaacacaaatttgttaaacagtcacatactattagtggttaataacctgtctcattgttacaggtagcaagtatattggtatacttggcaaagctaagtttgcttagaattattagtgatatcaaagtgaacaatgacctatgtagatctcaccttgtgaggggaaaaagacttgtcaatgatgcgataaggatagcggaaaaaatactgaatccttcgagggaagatcagaaaaaaccgaagaatgccttcggtatcgaattggagcggattgcggcaacaggaatacttttggaagcacttgaaattgttggacatcttgactctggaagaatggcaatacaagcatgggcaccagcgaactcggtactcttgctaaggcttcctcgggaacatatgaagcatggatacttcaagattgatgttgtgcgcataccagacaaatgctggctattcatatggccagcaaaatatctcataagtcttcaatataccacgttacgaatccattttaataaatttgaaaagtttgattatgaacattttgaacaagctgtgcgcaagtgggtttcactttacaatgagcctcgtacacgaaacatagtgtccaacgccctcagggcgcactacatgaaatgctggaggaccctcgtcggtggtactcggcgcactccttacatgaatgcaccacatatccaagatttgctggctgagtcacaacaaataatgaaggaattgggaggagagaacaatatgacaggcagtgtggattttggtgatgcagaggaataaccttgtcagactcggtcattgtgggcaagtggacaagacgttgactgatacatgtagttatacaaagtctatctaagatttcatgtgcaaaatgagtgtttgcactccttttgtcatatttttcacaataaatctttgggtagaatatcaaaagnattaattaata

SEQ ID NO: 10836 - DNA, 1469 bp, Triticum aestivum
  Clone ID: PAT_TA_10836
gacgacctcggcgacgacggcgaggatcaggttgatggggatgctgttgccgaagtagttgagggtgttgccgtcgaggagaagggcgccggtcttgaaccaaacggcctcggggccgcagtttgcgccgaacttgttgagcgcctcggggatgatgaatccggcggctggccatgttctccatgctggggttcttcatccaggcctacgtcaccggcgagggccccttcgagaacctgtgcgcgcacctcagcgaccccttcggcaacaacctgctcaccgtcatctccggcgccgccgagagggtgcccagcctgtgagctggccgttaattgcccgtccgccgccgtcggctgttgatgatcagctgcatgcgcgcgatgcagcatcatgtgctgtgtgaatttacacgtacggcacattcgtactctcatacttttccccggtaaaattcacacagcacatgatgctgcatcgcgcgcatgcagctgatcatcaacagccgacggcggcggacgggcaattaacggccagctcacaggctgggcaccctctcggcggcgccggagatgacggtgagcaggttgttgccgaaggggtcgctgaggtgcgcgcacaggttctcgaaggggccctcgccggtgacgtaggcctggatgaagaaccccagcatggagaacatggccagccgcccgttcttgatctccttcaccttgagcagcgccgcctggtccgggtcggtggcgaggccgagcgggtcgaatgggccacctgggtggagcttgtcatcaaattccagtccgttggtgatcctgtagtactcggcgcctccgacgaggacgacctcggcgacgacggcgaggatcaggttgatggggatgctgttgccgaagtagttgagggtgttgccgtcgaggagaagggcgccggtcttgaaccaaacggcctcggggccgcagtttgcgccgaacttgttgagcgcctcggggatgatgaatccggcggcgccgagcatggcccacctggcatggatgagctcaaaggcctggtacttggcgaagtcctctggcttcttgcccagaccaaaaggatcatagccgtagtctccgggaacctctccgttgaggtactccggcacctccgaccggtcaaggagaccgttgggcaagtagatcctcctgtcagggccgtaccacttggcgagctcgtcgtcgatgcctacgctcgaggtggcaacgggtgcgggcttcggcttcggggcgggcttcttcttgaagcgatcaaagagggagacgatcttctgtgcgccagcagttggtgccgctgtggcatacctggaggatccggcgaagttgagccgggtgccgagcatcttcgtcggagcgagcgccgccattgcctcagcccaaagttgagagagaaggggcgtgctcagctcagcaagacggacgcgtgggcggacgcgtggg

SEQ ID NO: 10837 - DNA, 596 bp, Triticum aestivum
  Clone ID: PAT_TA_10837
aggggccttttttttttttttttttagaacagcatcacatcaaaaaaaaaaagatggacgcagggcagaattacatatatcaagagtactgcaaaattaatagctgcataaaattcagtcacaaacacatataatcctcacattacataaaactcagtcttggaacaaaaccagactaggcattaaacagctaaattggacagaacacaggtaagacagcttccacagccatagcagcaaacacgccaggaatcactagaccatgccgtcctccctcggtgcctggcagcctggatgtaggatgatgcttcccctccttccaaggcgcctacttggatcgctgcctcatctttcggcgcttcctcttgagcctcctcatcctcttcttcttccacttggccctcatcgcggcggcggagtcggcctcgctctccttttcgcggcggcggcggcggaagggtgtggacgatcccgatctccgtagatttttttttttttttttttttttcgttagtaatttccaccatcgatttggactcgtttgaaaatttgcgtgggaatgaacgacaaataaacagcattgtctgacccggccg

SEQ ID NO: 10838 - DNA, 667 bp, Triticum aestivum
  unsure (1)..(667): unsure at all n locations
  Clone ID: PAT_TA_10838
agccggccgggccgggctatcaagctccctgcctcctgcgcctccacttccatcgcctcccaagatcgcagatctgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaagaagagaaaaaggaggaggctaaggaagagagcgatgatgacatgggcttcagcttgttcgactaagcagttcaattccagttctcctgtggaatcttttatgctaaggattacttatcttatgtgcttttaggtcgaattttgcggatttaatatgtttgagacctaagtatctgtgcaatgagtactgcaaaccaccttgggatggtctttttagaatgaaaatggttttggtgcttggttgaaaagccattgcttgttttaccctactggttatgttgtccccagctttcaaaanaaaaa

SEQ ID NO: 10839 - DNA, 688 bp, Triticum aestivum
  Clone ID: PAT_TA_10839
cgccaaccagtcaagaattaaacagaacgcagaacaaacagaggagatacggcaaaattataggtttgctaccatataccaatactgtcaattatcatcaccacaacgattggaggctgaaagcaaagtaaaataaggttcaacgacaacgagacgacaatagcataaacgctaacacagcaatggattcaaccggtccatgaaactgactagtagcactctagttcttgatcttcttcttgggcctcagctggttgctgtggccacacttcttcttgcggcagttgacagcccttgggtgcaggcgcgcgtagcatttgcggcagatcatcttctcctggttgtacttgcgggcaagagcctgcagggatggctcgatgatgcctccgcggagcctgaggacgagatggagggtcgactccttctggatgttgtagtcggcaagggtgcggccgtcctccaactgcttgccggcgaagatcagccgctgctggtccggcgggatcccctccttgtcctggatcttggccttgacattgtcgatggtatcgctgctctcaacctcgagggtgatggtcttccccgtgagggtcttgacgaagatctgcattttggcgaagggttttcttctcctccgcttatttatatgcttaaactcagcgggtagtcccgcctgacctggggtcgc

SEQ ID NO: 10840 - DNA, 661 bp, Triticum aestivum
  Clone ID: PAT_TA_10840
ttttttttttggaaaccacaagcgttcgcagagagattaccaaccagtcaataattaaacagaacgcagaacaaacagaggagatacggcaaaattataggtctgctaccatataccaatactgtcaattatcaccacaacgatacgaggctgaaagcaaagtaaaataaggttcaacgacaaacgagacgataatagcataaactccgacacgcgatggattcaaccggcccatgaaactgactagtggcactctagttcttgatcttcttcttgggcctcagctggttgctgtggccacacttcttcttgcggcagttgacagccctagggtgcaggcgcgcatagcatttgcggcagatcatcttctcctggttgtacttgcgggcaagcgcctgcagggatggctcgatgatgcctccgcggagcctgaggacgagatggagggtcgactccttctggatgttgtagtcggcaagggtgcggccgtcctccaactgcttgccggcgaagatcagccgctgctggtccggcgggatcccctccttgtcctggatcttggccttgacattgtcgatggtatcgctgctctcaacctcgagggtgatggtcttccccgtgagggtcttgacgaagatctgcattttggcggacgcgtggg

SEQ ID NO: 10841 - DNA, 1201 bp, Triticum aestivum
  Clone ID: PAT_TA_10841
tcaaaaagagtcaatctggtttttaacgatgatgaaaaccatttcagaaattactcaagtagcagtggtccgatactcccatcagaaatcagaacggtcatgtttcttctgcccttgataatttacacgtacggcacattcgtactctcaaacttttcccggtaaaattcacacagcacatgctgctgcatcgcgcgcacgcagctgatcatcagcaaccgacggcggcggacgggcaataaacggccagctcacaggctgggcaccctctcggcggcgccggagatgacggtgagcaggttgttgccgaaggggtcgctgaggtgcgcgcacaggttctcgaaggggccctcgccggtgacgtaggcctggatgaagaagcccagcatggagaacatggccagccgcccgttcttgatctccttcaccttgagcagcgccgcctggtcggggtcggtggcgaggccgagcgggtcgaatgggccaccggggtggagcttgtcgtcaaattccagcccgttggtgatcctgtagtactcggcgcctccgacgaggacgacctcggcgacgacggcgaggatgaggttgatggggatgctgttgccgaagtagttgagggtgttcccgtcaaggagcagggcgccggtcttgaaccaaactgcctcgggaccgcagtttgcgccgaacttgttgagcgcctcggggatgatgaatccggcggcgccgagcatggcccacctggcatggatgagctcaaaggcctggtacttggcgaagtcctctggcttcttgcccaggccaaaaggatcatagccgtagtctccgggaacctctccgttgaggtactccggcacctccgaccggtcaaggagaccgttgggcaagtagatcctcctgtcaggaccgtaccacttggcgagctcgtcgtcgatgcccacgctcgaggtggccacgggggcgggcttcggcttcggggcgggcttcttcttgaagcgatcaaagagggagacgatcttctgtgcgccagcagttggtgccgctgtggcgtacctggaggagccggcgaagttgagccgggtgccgagcatcttcgtcggagcgagcgccgccattgcctcgagcccaaagttgagggagaaggggcgtgctcagctcagcaagaagggaggatgtgatgggtggttgtggagggaaatgtggg

SEQ ID NO: 10842 - DNA, 1623 bp, Triticum aestivum
  Clone ID: PAT_TA_10842
aagaataatacacccgtattcaattacacccatgccaagcgcggccttatgattttgcttattccgttcacaatgccagttcacctttgtgttgccattctcgaaccgaacatgtgcataatttcgacagtttgaactgcatatatctttcggagatcaaacagcatacatagaacttgatttatttaaggggacgacacgacacacaacggccatattacagtgaggtgcagtagagtggagaacgaggtacgttcctccagagcctttgtatgagctatgcagtgctcattcttgatggcatggcggcaggtgatgtgatacatcgtcacacatactagtagcaagcatcatagttaattaaccggcccattattcagtacggtcgatgcatgattaggtagtaatcgtcgagtgcagtagcctgcagcgctgtgacgacgaattcgctggtcgggttctacatgcagaacggctcgcgctcgacgtcaaacttgtaggcagaggacagctgaggctcctccacgccgctgaagtttgcgaccttgcggatggagccgccgatggggccttgcaggttgcagttgccgctgctgtcgcgcatgatggccctcatggaggtgagcaggcggccgtaggtggtgcgcggctcgcactccaccgctctgatgaagctgtgcgtcatggcgccgatcgtggcgtagggctcaggcagcacgctcatgttgctctttccgttgctgctgccactgatgagcacggcctggcctccgctggtgcccttgcaggcgccggtcatagggcgctcgtccctccacctccagcgcccggtctgcttggacacggtgcattggtaggggaggtcgaggacggtggcgctgtggcaggcgtcgacgatggcgtggagcttgacgccgtgcaccagcgggcggacgatggcctcgttgatctcgtcgtccaggatggggccctgctggaacgagtccacggggcagagggcctcgtccatgccgtccagctcgtcgccgtcgtcgtcgggcacctgcgcgcccaggccggagaactggaacaccagggagtcgccgtagctgcacccctgcaccagccagtgcatcgccatgcggatgttgtccttggtcggctgcctgcatgggttcctctcctcatcggtgaggatgaggacgcagtcgttggggaagccgaagcgctcggtgagcaggtaccgcatgcacttgacgtcgttgatggggccccgcagctcgcaggagcgccggttggtgtacttgataccgacgagcacggcgcgcttcttgccgcggccaccgccgaagttcggggtggggcgcatcggcggcatcagcatcccgccgccgttcccgtaaccctggccgtagccgtgctgctgccggccacggccgctgacgcgcgtcacgcagctgcactgcatgcactgcacggcgcgggcgccgggcatcgccgtgatgctcgagctgcactgcctgcaccgcaccatcgcgccaggacccatggagccgtagttcatgttcatggctggctacctggtttagcttagttaagctagcgctacgacgtgcgtttgctagctgctttgcttgcactccg

SEQ ID NO: 10843 - DNA, 1011 bp, Triticum aestivum
  Clone ID: PAT_TA_10843
gcggcgctcgaggccggccggttttcaaaaggcgagctcttccgtctcctctcgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgttggcatgaagaagaagggtgtcgacgagttctctcactgtgttcaccttgtctcatgggagaaggagaatgtgtccagtgaggctcttgaggctgcccgtattgcttgcaataagtacatgaccaagcatgcaggaaaggatgccttccacctcagggtcagggttcacccgttccatgtgctccgtatcaacaagatgctttcgtgtgccggggctgataggctccagactggtatgaggggtgcttttgggaagccgcagggagtctgtgcccgtgttgccattgggcaggtcctcctttctgtgcggtgcaagcccaacaatgccatccatgccactgaggcccttcgtcgtgccaagttcaagttccctggccgccaaaagatcattgagagcaggaagtggggcttcaccaagttcaaccgcaacgactacctcaagttcaagagtgagggcaggatcttgcctgatggagtcaacgctaagctgctcggatgccatggccgccttgcgaaccgtgcccctggacaagctttcctgtctgccgcataatctagcagaagaagtctatccgttctatcagaacttattttactgtgtggaacttagattccaagtgcctgtggtgctatgttattttgtctgaatgttgtgtcgaaccttgttatggaagatattatctattttgtgatgatggtactaatatgaaccgcctgttgaatcattgccgcttgaattcgtttgtcaatgtattttgctgtggtggatgcttcattttatgaagctacatcaggaaaatgttatacgtt

SEQ ID NO: 10844 - DNA, 2222 bp, Triticum aestivum
  Clone ID: PAT_TA_10844
attcccttgccatattctgatcttaaaaacattagaaaacaagcacaaggcctcactttatatagataaatcgacgagttccacaagaacatgattattgaacacaaacgttcagcaagcaaaagggaaatagttcgggctggggcggcagcacagataagcccgacataaagaaaaagaacacaacctacagagcccgccggaaccggaagctggcgagccacaccctccggaggccaagaaggagcccatccaatccgccgtgatcccgacgccaagcgagcatccgccattacagaatccatcgaggctactaattcaacatccccggcagtgaactgaaacggccacatcctcccttcattttattgcacccatccgattattaatttcttcaaactaactgcatgccatgcatccagccttggattatttgttcgaaaatagcaccacttcgctctccatcatacagaaacggaagcagctgtcatggttgcgttgttattggtggtcttaagcaagggttttgggacggagttgaacttggagaaccacttggccgacttcttgagcttgcgcttgttgccgtcattcttgtcgatgtagacaaggccgaaccgtgagctgtagccccaggctccattcgaagttgtcgatcagacccccacgtgaagtggcccccgccacgtccggcgccctggtctattgcgtccttgacggcttgagatgtggcgcttggaggtagtctagcctctttccagtcatcccaaagaatctgtcatggttgggtcgctgtccaacatcagcgattcccgttctcagtgaatgaaagacgggtgggtttccgtatttcccccttcatgatcagaaggaggtccgttaggccttttgggtacatgtaaatcccaataagtccccagttataggaccgatgtcattcccgtcactccctgtagtttcttgaactggcgtaagcgtcgtcggtgttcagcttcggcgtaaagtctgatgaaatatcaatatgcttggagaatctggaggtgtaatagttgagccccatgatgtcacatgaggacgctagcttctcttgctcctccttagtgaacttgggtagacgatctccgatcagcgatctcatggagaaggggtagtcaccacgaaccactggctccaggaaccatccgaggttgtagtcgatggatctttcccgggcctggtcgtcgaggaaggagtcttggaatggctcgtaacccattacatcaaaggccatccctatcttggaatccccatgcttgttgtaacaagctttgaacagctcaacagcctcagcatgagctaagaggatgtggtgaccagcagtgtatggctctctgagcgagtctcttttgggacggcacaatccatccccggcgagcacctcccaggagcatgaatcccctctccgtaggagaaacaacaatatgtatgtggctcgttaaaggtgaaccagttcttcaccctgtcaccgaagttcttaaagcacacctcggcgaattgtttgtaatcatctacaatctgcctatttaagaagccgccgtacttgtcttccagtgcttgaggggtgtcccagtgccaaattgtaacatatggcactatgtcgttatctatcagcgagttgatcagcttattgtagtagtcgatacctgcctggtttacttttcccgtcccatctggcagtattctcgaccaagcgatggagaacctatacactttcatgcccatgtccttgagcgctttgacatcctcttcatatagatggtaggagtttgccgcaacgtccccattggtcctgtcggatatgcgctcaggatatgtgtggcagaagtggtcccaagtgcttggccccttgccatcttcattccaagcaccttcaatctggtatgctgaagtggaggcaccaaataggaagtccttgtcgaaccagtcccttttagggatttgccacggcttgagcttagtgaacacaggcccaatgggctctgctggctttgacggtgtgcctgccctgatggtgaggttacagaaccttcccttgctcttctgtgatgaagcagcagaccggagccataggttctcactgttgcgtcctgcacggcttctaaggctaaggtgggtggtgggattcagggtagcggcagcaagtagagccatctcttgctagcagctggctggagacctcggct

SEQ ID NO: 10845 - DNA, 1332 bp, Triticum aestivum
  Clone ID: PAT_TA_10845
aggctgactgtgctgtgctcatcatcgactccaccactggtggttttgaggctggtatctcgaaggacggccagacccgtgagcacgccctccttgctttcactcttggagtgaagcagatgatctgctgctgcaacaagatggatgccaccactcccaagtactcgaaggcccgttatgaggaaatcgtcaaggaagtctcttcgtacctgaagaaggtcggctacaaccctgagaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtctgttgagatgcaccacgagtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggcgccaaggttaccaaggctgccatcaagaagaaataggcgcgctatcttgcagaaggattttgttcacggtcattgcttttgttgcttcagactcttatcccgagcgagcaatgatctgtctgtcgtttaattactgtatttctattcctgcttcggctaaactcctgtgcccctgagactgatttgttgtgaaatgcaagttattagattgcaacttgttagcttgaaagcaggagctccctccccgcgggcgcgatggtgtacatcaagaaccagaagacaagggcgtactccaagcgtttccaagtcaagttcaagagaaggcgccaggtcgacgcggccgcga

SEQ ID NO: 10846 - DNA, 1534 bp, Triticum aestivum
  Clone ID: PAT_TA_10846
gcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggttggttacaaccctgacaaggttccctttgttcccatctctgggttcgagggtgacaacatgattgagaggtccaccaaccttgactggtacaagggccccacccttctcgaggccctggaccagatcaatgagcccaagaggccctcagacaagcccctccgtcttccccttcaggacgtgtacaagattggcggcattggaactgtgccagtgggccgtgttgagactggagtcatcaagccaggcatggttgtcacctttggtcctactggcctgaccactgaggtgaagtccgttgagatgcaccatgagtctctcctggaggcgcttcctggtgacaacgtcggcttcaacgtcaagaacgtggctgtcaaggatctcaagcgtgggtacgtcgcttccaactccaaggacgaccctgccaaggaggctgccaacttcaccgcccaggtcatcatcatgaaccaccccggccagatcagcaacggctatgccccggtgctggactgccatacgtcccacattgctgtcaagtttgctgagatccagaccaagatcgaccggcggtctggcaaggagattgaggcggcgcccaagttcctcaagaacggtgatgctgggttcgtcaagatgatccccaccaagcccatggtggtggagacctttgcccagtaccctcccctgggccgctttgctgtgcgtgacatgaggcagacggttgccgtgggtgttatcaaggctgtggagaagaaggatccgaccggtgccaaggtgaccaaggctgcggccaagaagaaatgagatggtgtcaggttctttactgcatctatggtggcggtggcggtatttggtggtggtgatagttgttctagttgttttggaaacttgttaagcttcggttatttgtgtcgagcagtgttggaactgcttattgctctgtcattgtatcgttcggttgtgttggtgaaacttcgtcagttaatgttgctactatatatagttggcatgtttggagtcgttttatatcagttgatcatgtttttcgtcaaaaaaaaaaaaaacctgcccgggcggccgctcgaaatcactagtgaattc

SEQ ID NO: 10847 - DNA, 2782 bp, Triticum aestivum
  Clone ID: PAT_TA_10847
taggggccttttttttttttttttttgcacatacacatccaatccatttcattccttgctcctccgcctcaaccacccgttgatattacatcatcacacacgctattctttcctttcctttccatccacatccttacgtcccattttttttcccaataaataaagatttttttaattagaaagggaaacactccggagacgagaacaacagcataatactagcgcacggcggcccacggcttgggtttcgttgagatgagatgattcttttcctttgcctcggcaggggttctggatcctttttcctttcctcttctcagaacctgacgatcttggcggcgcgcaccacggggttgtcccgggcgatggcgtcccgggcggcggccttgtagtcgtagctgcacccgtgccggtccgagtaccgatgctcaccgcagaacatgtcgccgcaccggcaccggaaccccgtcagccccacccgcttccggcagctggagcaccggttcaccgacgtcctcgccggcttcgcctccgtcgccggagcaaggtcaactgccgggcgtgccagctcgacctccaccggcgccggcctcggcctgtcgacgacgggggtcgacacggacacgcccggtagagaagaggaggaggaggaagacggcgacgtggaggccggtccggccaagaagcagttctggcagaggttgtgcgtggccgggttgccggggaagccgcagctgttggcgcagagcgtgatctccggcgcccgcagctccgtgggctcctcctgcttgtgatcccgctgcgccatggtatgtcaaacacgcacgcgcggccggaggtgcctgggctggtttgttggttgaaccggtgccggccggtaggaggtccgggcgtgtgcgcgccgcgggtggtctgtgagggatcgggaggccgatgcgaggagaggaggagaggccgagaggagaattcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccacccccaagtactcgaaggcccgttatgaggaaattgtcaaggaagtctcttcctacctgaagaaggtcggatacaaccctgacaaggttccctttgtccccatctctgggtttgagcgtgacaacatgattgagaggtccaccaaccttgactggtacaagggccctacccttcttgaggctcttgaccagatcaacgagcccaagaggccctcagacaagcccctccgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgctgtgaaggatctgaagcgtggctttgttgcatccaactccaaggatgaccctgccaaggaagcggccaacttcacctcccaggtcatcatcatgaaccaccctggtcagatcggcaacggctacgccccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggcgtggagaagaaggaccccaccggtgccaaggttaccaaggccgccatcaagaagaaatgagtgctctggtgtctgccatcgagttatctagcagaggttttagtgtcaagtcttttttggagaatcttagtgtatgttaagtgttcctgggcgttattgcactttgactcctgcacctgtgtgcgagctatgatgtgtcgtttaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccctttaaaaaaaaaaaatttaaaaaaccggggaaagaaaaaaaaaaattttttttaaggggacccaaaataaaataaatgggccgggttttaaaaaggggggaagggaaaaaacccggggggaaccaaattaaaaccctttgaaaaaaaacccctttttccaagggggggaaaaaaaaaaaaggcccaaaaaaaacgcctttccaaaaatttgccccccctaaagggaaaaaggaaacccccctttggggggcattaaaggggggggggggggggggttttcccccaggggggcggttttttttgcaagggccaaaagccccgcccttttggtttttttcctttttttt

SEQ ID NO: 10848 - DNA, 877 bp, Triticum aestivum
  Clone ID: PAT_TA_10848
atccaagtgtgttttcccctagcggctagttgtttcctcagcatagcttgtctttttagtttttgatgttttgttgcttcctgctgtaaattcaaattttgatgtagtcgaggaagtgctttagttgtttgctgggcatctgtgatgaacagctccttgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaagaagagaaaaaggaggaggccaaggaagagagcgatgatgacatgggcttcagcttgtttgactaagcagttcaattccagctctcctgtggaatctgctatgctaaagattacctatcttatgtgcttttaggttgaattttgcggatttgatatgtaattctgttgagacctaagtatctgtgcaatgagtactgcaaaccaccttgggatggtctttttagaatgaaaatggttctacattatgtgccttcagctttagtttggtgctcggttgaaaagccattgcttgttttaccctactgattgtgtcgtcaccagcttttgatgctctgtgcttggttgactgctttttgaatctgtctgttgattaattatatggacctaaatc

SEQ ID NO: 10849 - DNA, 1286 bp, Triticum aestivum
  unsure (1)..(1286): unsure at all n locations
  Clone ID: PAT_TA_10849
ccggattgatatgacgcggcatatatatgtaacacacactcgagtttacacaacttcatcagatttcagatgatacaagctaggggcatataggcgcccggtacagtatttcagatgatgatacaaacccccggttacatgggtcatttatttggacaccacaaacatgacacactttcatgcacttatgtttactcacctacctagtgatcactgcatgcatgcataatggtaatgcatgacagagaaccaaggcatgcacaagacatatagatgaactcaaacacaaactggagtagtgtatagacggctgcatgcatggcatgtgtacccagcatgccatgcttggacgagtactttgatcgatcagtgcgggcaggtgaagacaggcgggcaggtcttgtggcagtggttgagcaggagcaccaggtcgacggggacattgagcttgatgacgccgaggaccttggccctgatggcggtgcagaggcacaccgcggcgtccaggtcggccagatcggccagcagtgggcagcaccgctcgctgggcggcacgccaagcccgagcttcagcaggttcagcacgttggcgcacacgcgcagcttcaacgtgtcaatcgggcacgagccgctgttggtcgatggaggcggcggtggggtcggggtagggcagtggggtccgcagccaccgtgcacagctgtgaccatcaagtttaggccgaggagcacgaggaagagcttggtcgatggctccattgccaaagctagccttggtcgagaggaagcaaggcttactataggaagcaactaggtggtgctgctgccgctgaagagaagaaggaagaaaagaaagaagaggccaaggaagagagcgatgatgacatgggcttcagcttgttcgactaagctgttcaattccagttctcctgtgggttcttctatgcgaaagacttgtcttatgtgcttttaggtcgaattttgaagatttattatgttatgctgtttgagactaagtatctgtgcaatgagtactgcaaaacctccttgggatggtcttgttagaatgaaaatggttctacattatgtttattgatcttttggtgcatgttttcctttttctggtcagttactgattatgttgtcaccagttttctatgctctgtgcttggatgactgcctgtagcttttttgaaattgtgtctcgttgattaattatggtgttgcagctgattttggtggggtgcacgtagctgctcgtactanaaaaaaaaaaaaaaaggccccta

SEQ ID NO: 10850 - DNA, 1203 bp, Triticum aestivum
  Clone ID: PAT_TA_10850
taggggccttttttttttttttttttccttttttgggtttttttttttttttttttttttttttttttttttttttttttttttttttttttttttttttttgcagggccaaaaggcacaattcggagtacctcaaagataataggtgcataaaattcagtcacaaacacatataatcctcacattacataaaactcagtcctggaacatagccagactagtattaaacagctaaatttgaccaaacacaggtaaggcaacttccacagccacaaccgcataacaaatcaggaatcactcggacaatgccatcatccctcagagtttcgctgcctggatgtcagatgatgcttcccctccctccaaggcacctacttggatcgctgcctcatctttcggcgcttcctcttgagcctcctcatcctcttcttcttccacttggccctcatcgcggcggcggagtcggcctcgctctccggttcgcggcggcggcggcggcgggagtgtgtggacgaacaccctagcgggccaacttcacctcccaggtcattatcatgaaccaccctggtcagattggcaacggctacgccccagtgctggactgccacacctcacacattgctgtcaagtttgctgagctggtgaccaagattgacaggcgatctggtaaggagatagaggccgcgcccaagttcctcaagaacggtgatgctggcatagtgaagatgattcccaccaagcccatggttgtggagacctttgccacttaccctcctcttggtcgttttgctgtccgtgacatgaggcaaactgtggctgttggtgtcatcaagggtgtggagaagaaggacccaactggcgccaaggtgaccaaggctgccatcaagaagaaatgaggcgtttacctgaatccgtctatgtctgcttgatggcgccaaggtgaccaaggctgccatcaagaagaaatgaggcgtttacctgaatccgtctatgtctgctttttgagatctctagtagtttagtgcctattaagttttgctactgttagcgccgtgtgatatgcgccctgttgatgtgtcatttgagtactgtcgttaatttcggcttttgacaaaacatggaagcttctgagactactcatttttatcctctgctttggaatgttaggctgctacttttagtcatagctgatgtttctctttg

SEQ ID NO: 10851 - DNA, 1878 bp, Triticum aestivum
  unsure (1)..(1878): unsure at all n locations
  Clone ID: PAT_TA_10851
atgcaaggacttaactaatcaagtttcaaagagtcaatctggttcttaacgatgataaaaaccatttcagaaattactcaagtagcagtgtcgcaccagttatcaagcacaagtttccagcaagaaaataaaaaatcaagcacaagctgaagcagtggtccgatactcccatcagaaatcagaacgatcatgtttcttctgcccttgataatttacacgtacggcacattcgtactctcatacttttccccggtaaaattcacacagcacatgatgctgcatcgcgcgcatcgcacgcagctgatccatcaacagccgacggcggcggacgggcaatcaacggccagctcacaggctgggcaccctctcggcggcgccggagatgacggtgagcaggttgttgccgaaggggtcgctgaggtgcgcgcacaggttctcaaaggggccctcgccggtgacgtaggcctggatgaagaagcccagcatggagaacatggccagccgtccgttcttgatctccttcaccttgagcagcgccgcctggtcggggtcggtggcgaggccgagcgggtcgaatgggccaccggggtggagcttgtcatcaaattccagtccgttggtgatcctgtagtactcggcgcctccgacgaggacgacctcggcgacgacggcgaggatcaggttgatggggatgctgttgccgaagtagttgagggtgttgccgtcaaggagaagggcgccagtcttgaaccaaacggcctcgggaccgcagtttgcgccgaacttgttgagcgcctcggggatgatgaatccggcggcgccgagcatggcccacctggcatggatgagctcaaaggcctggtacttggcgaagtcctctggcttcttgcccagaccaaaaggatcatagccgtagtctccgggaacctctccgttgaggtactctgcttttacacccctgatgacagaaacagagtcaccacaggacaacttcacacaaatttattcttattattagtgctggccactgggccgctgatctcaagctcgactgcgttgcctcgacggactagtgaccggtaggcgggacaggcagcgggcggtcgtgcgccggcaggctgttgaccatgaaggccttgtcttcttccacggctgaaggccttccagctccatcgtattctccaatggtggaggagtgggcatgggcagtggggtaagtcggtggctgcattccgggagcagatcctcctcccctgatgcggccgccgccggtgtagggctgggcatggccgtcgaccacaagctggccgcagacgagcgccagaaggaccagagcagggaatgccttggacgccatctctcttggtctctcactttggtttgattgcgtgattctctgcctatgtggtgctccggtttttttttttttttttttttttttttttttttttttttttttttttttttnttagacgccgcaaaattaataggtgcataaaattcagtcacaaacacatataatccccacattacataaaactctgtcttggaacataaccagactagaattaaacagctaaattggacataacacaggttaaacagcttccacagccatagcagcaaacacgccaggaatcactagaccatgccgtcatccctcggtgcctggcagcctggatgtaggatgatgcttccgctgctccaaggcgcctacttggatcgctgcctcatctttcggcgcttcctcttgagcctcctcatcctcttcttcttccacttggccctcatcgcggcggcggagtcggcctcgctctccttttcgcgtcgtcggcggcggcggcggaagtgtgtggacgaacccgatctccgtagatt

SEQ ID NO: 10852 - DNA, 1476 bp, Triticum aestivum
  Clone ID: PAT_TA_10852
gaggagaggtctttcagtatgcctgggtgcttgacaagctcaaggctgagcgtgagaggggtatcaccatagatattgctctgtggaagttcgagaccaccaagtactcgtgcactgtcattgatgctcttggtcaccgtgatttcatcaagaacatgatcactgggacctcccaggctgattgtgctgtgcttatcattgactccaccactggtggttttgaggctggtatctccaaggatggccagacccgtgagcatgctctccttgctttcactcttggtgtgaaacagatgatctgctgctgtaacaagatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaacgtcggcttcaacgtcaagaatgtggctgtcaaggatctcaagcgtgggtacgtcgcttccaactccaaggacgaccctgccaaggaggctgccaacttcaccgcccaggtcatcatcatgaaccaccctggccagatcagcaacggctatgccccagtgctggactgccacacgtcccacatcgctgtcaagtttgctgagatccagaccaagatcgaccggcggtctggcaaggagattgaggcggcgcccaagttcctcaagaacggtgatgccgggttcgtcaagatgatccccaccaagcccatggtggtggagaccttcgctcagtaccctccccctgggccgctttgctgtgcgtgacatgaggcagacggttgcggtgggcgttatcaaggccgtggagaagaaggatccgaccggcgccaaggtgaccaaggctgcggccaagaagaaatgagatggtgtcaggttctttactgcatctatgatggtggtggcggtgacggcatttggtggtggtgatagttgttctagtcgttttgaaaacttgttaagcttcggttatttgtgtcgagcagtgttggaactgcttattgctctggtcattgtatcgttcggttgtgttggtggaactttgtcagttaatgttgctactatatatagtcatcatgtttggagtcgttttatgtcagttgatcatgtttttttgtcttgcaaaaaaaaaaaaaaaaaaaac

SEQ ID NO: 10853 - DNA, 991 bp, Triticum aestivum
  Clone ID: PAT_TA_10853
cccattcgcaatccccacctctatataagcggccccgtcgatccacaccaaaccctagtcgcagctcttccgtctcctcccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgtcggcatgaagaagaagggtgtcgatgagttctctcactgtgttcaccttgtctcatgggagaaggagaatgtgtccagtgaggctcttgaggctgcccgtattgcttgcaacaagtacatgactaagcatgcaggaaaggatgccttccacctcagggtcagggttcacccgttccatgtgctccgtatcaacaagatgctttcgtgtgccggggctgataggctccagactggtatgaggggtgctttcgggaagccgcagggagtctgtgcccgtgttgccattgggcaggtcctcctttctgtgcggtgcaagcccaacaatgccatccatgctactgaggcccttcgtcgtgccaagttcaagttccctggccgccaaaagatcattgagagcaggaagtggggcttcaccaagttcaaccgcaatgactacctcaagttcaagagtgagggcaggatcttgcctgatggagtcaacgcgaagctgctcggatgccatggccgcctggcgaaccgtgcccctggacaagctttcctgtctgctgcataatctagcagaagaagtctatccgttctatcgaaacttattttaccgtgtggaacttagattccaagtgcctgtggtgctatgttattttgtctgaatgttgtgtcgaaccttgttatggaagatattatctattttgtgatgatggtactaatatgaatggcctgttgaatcaaaaaaaaaaagaaaaaaaaaaaaaaaaaaggccccta

SEQ ID NO: 10854 - DNA, 2378 bp, Triticum aestivum
  Clone ID: PAT_TA_10854
ggcgaattggtaccgggcccccctttttttaatcatactatctttgtactagcattcaacacaggcagacaaaaccacaaatgggatgagagcacaataatggaatcgaaatagagtatttaaacgacacatcatagctcgcacacaggtgcaggagtcaaagtgcaacaacgcccaggaataacacttaacatacactaagattctccaaaaaagacttgacactaaaacttctgctagataactcgatggcagacaccagagcactcatttcttcttgatggcagccttggtaaccttggcaccggtggggtccttcttctccacgcccttgatgacaccaacagcaaccgtttgtctcatatcacgcacagcaaagcggccaagaggagggtaggtggcgaaggtctccacaaccatgggcttggtgggaatcatcttcacgataccggcgtcaccattcttgaggaacttgggcagcgcctccagctccttaccagatcgcctgtcgatcttggtcaccagctcagcaaacttgacagcaatgtgggaggtgtggcagtccagcactggggcatagccgttaccgatctgaccagggtggttcatgatatgatgacctgggaggtgaagttggccgcctcccttggcagggtcatccttggagttggatgcaacaaacccacgcttcagatccttaacagcaacgttcttgacattgaagccgacgttgtcaccaggaagcgcctccagcagagactcgtggtgcatctcaacagacttgacctcagttgtcagaccagtgggaccaaaggtaacaaccataccaggcttgatgacaccagtctcaacacggccaacaggcacagttccaatgccaccaatcttgtaaacatcctgaaggggaagacgcaggggcttgtctgagggcctcttgggctcgttgatctggtcaagagcctcaagaagggtagggcccttgtaccagtcaaggttggtggacctctcaatcatgttgtcaccctcaaacccagagatggggacgaagggaaccttgtcagggttgtagccaaccttcttcaggtacgaagagacttccttgacaatttcctcataacgagccttcgagtacttaggagtggtggcatccatcttgttgcagcagcagatcatctgcttcactccaagagtgaaagcaaggagggcgtgctcacgggtctggccatcccttggagataccagcctcaaaaccaccagtggtggagtcaatgatgagcacagcacagtcagcctgggaggtaccagtaatcatgttcttgatgaaggctgtgtcgtacctgaagaaggtcgggtacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtccctcctggaggcgcttcctggtgacaatgttggcttcaacgtgaagaacgttgctgttaaggatctgaagcgtgggtttgttgcatccaactccaaggatgaccctgccaaggaggcagccaacttcacctcccaggtcatcatcatgaaccaccctggtcagatcggcaacggctacgccccagtgctggactgccacacctcccacattgctgtgaagtttgctgagctggtgactaagattgacaggcgatctggtaaggagctggaggcgctgcccaagttcctgaagaacggtgacgctggtatcgtgaagatgattcccaccaagcccatggttgtggagaccttcgccacctaccctcctcttggccgcttcgctgtgcgtgacatgagacaaacggttgctgttggtgtcatcaagggcgtggagaagaaggaccccaccggcgccaaggttaccaaggctgccatcaagaagaaataggcatctatctagcagaaggtttttgttcatggtcattgcttttgttgctgcagactcttatcccgggcgagcaatgatcctgtctgtcgtttaattactgtatttctattcctgcttcggctaaactcctgtgccttgagactgatttgttgtgaaatgcaagttattagattgcaaaaaaaaaaaaaaacctgcccgggcggccgctcgaaatcacttagtgaattc

SEQ ID NO: 10855 - DNA, 1539 bp, Triticum aestivum
  unsure (1)..(1539): unsure at all n locations
  Clone ID: PAT_TA_10855
gaattcactagtgattagcgtggtcgcggccgaggtctaatctcgagttttttttttttttttttttttttaagactaaaagtagcagcctaacattccaaagcagaggataaaaatgagtagtctcagaagcttccatgttttgccaaaagccgaaattaacacgacagtactcaaatgacacatcaacagggcgcatatcacacggcgctaacagtagcaaaacttaataggcactaaactactacagatctcaaaagcagacatagatggattcaggtaaacgcctcatttcttcttgatggcagccttggtcaccttggcgccggttgggtccttcttctccacacccttgatgacaccaacagccacagtttgcctcatgtcccggacagcaaaacgaccaagaggagggtaagtagcaaaggtctccacaaccatgggcttggtgggaatcatcttcactatgccagcatcaccattcttgaggaacttgggcagggcctccagctgcttaccagatcgcctgtcgatcttggtcaccagctcagcaaacttgacagcaatgtgcgaggtgtggcagtccagcactggggcatagccgttgccaatctgaccagggtggttcatgatgatgacctgggaggtgaagttggctgcctccttggcagggtcatccttggagttggatgcaacaaacccacgcttcagatccttcacggcaacattcttgacgttgaagccgacgttgtcaccgggaagcgcctccaggagagactcatggtgcatctcaacggacttgacctcagttgtcagaccagtgggaccaaaggtaacaaccataccaggcttgatgacaccagtctcaacacggccaactggcacagttccaatgccaccaatcttgtaaacgtcctggaggggaaggcggaggggcttgtctgacggcctcttgggctcgttgatctggtcaagcgcctcaaggagggttgggcccttgtaccagtcaaggttggtggacctctcaatcatgttgtcaccctcaaacccagagatggggacgaagggaaccttgtcagggttgtagccgaccttcttcaggtaggaagagacctccttgacaatttcttcataacgcgccttcgagtacttgggagtggtggcgtccatcttgttgcagcagcagatcatctgcttcactccaagagtgaaagcaaggagggcatgctcacgtgtctggccgtccttggagataccagcctcaaaaccaacagatggtggagtcgatgatgagaacagcacagtcagcctgggaggtaccggtgatcatgttcttgatgaagtcacggtgaccaggggcatcaatgacngtgcagtagtacttggttgtctcaaacttccagagggcaatatcgatggtgatacctctctcacgctcggccttgagcttgtcaagcacccaggcgtacttgaaagacctcttgttcatctcagcggcttccttctcgaacctctcgatgacacgcttgtcaatgcctc

SEQ ID NO: 10856 - DNA, 2128 bp, Triticum aestivum
  Clone ID: PAT_TA_10856
cgtccgcggacgcgtggggcggcgacaacgcgcacaccgtcaagcgccggctgcagctcgccctcaacgtgcccaccggcggcacctcgctcaccttcggcgaccgcgtcctggagaacgacctctcctccgtccgccacgactcgccgctgctgctcacccgcaacagcatccaccgcagctgctccaccccgtgcctctgcccggtctccgaggacttcgagcagaaggactgcggcggcctggttgagatactggggtcgtcgagcggcagcgtgaggcgcctcgtcgacgacgtggcctccggcataatgggcgggctggatccggtccccattgacagtggccttggcggctcctactacttcaagaatgatgaaggcgacagagtcgccattgtcaagccgacggatgaagagcccttcgccccgaacaacccaaaagggttcaccgggagagcgcttggccagccgggactgaagaagtccgtcaaggtaggggagacagggttcagggaggtcgcggcgtacctgttggatcatgaaaacttcgcaaatgttcctgcaacggctctggtgaagataacacactcggttttcaatatcaatcgtccgatgaacggcggcactccggctcatgaccataagccgcaggtcaccagtaagattgcttcatttcagcagttcatcgctcatgacttcgatgccagtgaccacggcacttcgagcttcccggttgcagctgttcacaggatcggcatattagacatcaggattttcaacactgacaggcatggtggcaatgtcctggtgaggaagcttgatggaggaaccggccgctttggttgccaaacagaactgttcccaattgatcatgggctgtgcttaccggagaacttggaggacccttatttcgagtggatacactgggcgcaggcgtcaattccgttctccgaggaagagctcgagtacataagcaaacttgatccgatgagggatgctgcaatgctgcggggagaactgcccatgatacgggaggcttgcctccgagtgcttattctatgcacaatcttcctcaaggaggctgctgctttcgggctttgcttggcagagataggtgagatgatgaccagggaattcagaggaatggaggaggaacccagcaaactggaggttgtgtgcatggaagccaggaggaaagtagacgaatgggaacccttctcccctagtgttgaacaaggagaggacatggatttccagttctcgatggatgtgttaggagggtacagtgatgtgattcgatcgccaagattcaattgctcgggcttgaagggcagcttcagaaaccctctgacaaagctcgtggagagcatgaacgaggacggtgatgatgaagaagatcgaaaggagccttccatgcattcatctgatcggttctcatccgctgacttcagcacgcccagtcttcacagaaccaccagttcaaaaactagttcaaacagcagcgtgcacgccccgaacaggagcgcagacgagcagctcccatcgagcttgtgctttgtcaggttgtcggacatgagcgcagaggagtggcacgtcttcgtcgagaagttccaggagctgctgaaagaagcgctggaggaatgcaaggcggccgcggggcagcggatgaagcaacggctgggcacctcctgcaaattttgactaggtccatagagcagcagagaagaaataatgtactgttgcccgtgttgcttttggagctagtgcagcaaagatcatatctagtactacttcggccgatgttgcagtttaactgcctcaagttatgttcatcaggtagacgagaccaaaggctggtgatgggtgtggagaaccgctacgcacgtttactagttatgttaattaaaaccgagttttgcataataaatgcttggcagcttgtgtatattgtgttagatgctacacaccaagagtgctattcgttggctgttgctgaacattctttgtgttgtgctgtgagcagtgtaaatatgaaactctgatgtaaaatgcttacctggtgttgaacatcttggatgaaatctgtcttgcgatggttctgaaaaaaaaaaaaaaaaaaactcgag

SEQ ID NO: 10857 - DNA, 1089 bp, Triticum aestivum
  unsure (1)..(1089): unsure at all n locations
  Clone ID: PAT_TA_10857
ttccgccggagcaccatgagcactccaccctcggcacatgccttcctcgtcctcctccttctcgtcctcgccggagcggtcatcgcctccgccgagaataacaaagactgtcaccctagcgataaggccgcgctcctcgccgtcaagtccgccttcggcaatcagagccacttcgcctcgtggactccttccaccccgtgctgcgactggcacgacatcacttgcaacgacgccggtcgcgtcatcatcctcctcttcttcgaggatgtcaacctcacgggcaccatcccggacgccatttccggcctcaccgagcttctcgtcctcaacctctattacctcccggccatctctggccctatccccaagggaatcgccaagctatccaagctcacctcgctctccatctctcttacctccgtttcgggccccattccgtccttcctgggcgcactgaccaagctcaacgacctcaccctctcctccaactccctcaccggcaccatcccggcctcgctcgcgggcctccgttacttagacaccatcgacctcagaaacaaccgtctcacgggcaccatcccgccactcttctacaactccaaatcccctataatctcgtaccttttgctctccaacaaccacctctctggctccatcccgaccgagttcgctgcagtcggcttccagttcatcgacctctcccacaacgctctcaccggcgacgcgtccgtgttcttcggcaggacaaaggagctagaaagcattaacctgtcccacaacgccctcagcttcgacctctccagcgtggagttcccggaggagatgcaagccatggatgcgagctacaacgccatccgcggcggcatcccagcgcaggtggcgaatgtaacgaacctgcggcagttcaacgttgagctacaacaagctgtgcggccaaggttccggccgccttgggcgaggttgggatgtctacaacttccagcacaacaagtgcctctgcggtgcgcccctcccagatccatgcaagaaataatttgaacgtcatttctgtcaacggatgtcaggcgnccagatgtatttatgaatctt

SEQ ID NO: 10858 - DNA, 1034 bp, Triticum aestivum
  Clone ID: PAT_TA_10858
attcggcacgaggtgagcctccagtgcgcggcagttcaccgtagctgagagtattgaagccaacagtagcaatagcatggttacattcaccggggatggtgttggggcactgttttcccaccccgcccatcagcacgggcttaagctggtagtcacggagaagctgttccagtgcgacggctgcaggcagatcggcgacatgcataggtaccggtgcgagccatgcgactttgacctccacgtatgctgcgcccaggcgccggcgcgcttcgagcattccatgttcgagggccgtgcgctcaccttcttccacagccgtcccacgaccccgccaggcggccttgtgtgctgcgacgtctgcgccgacccggtgctgggcttcctttaccacagcctcgagcacgacctcgacctccaccctttctgcgcaatcatgccgaagcgcatcgggggaggacggcggccgcgtgctggaactccacaaggccaccggccatagctgcgggctgtgcgggaaggttggcggaggttacttgtcctaccgcttgcaggacgacgacgggaagcttgtgcacctccatgtggcgtgcatgatagaggccaactacaccagcgacagccagttcgtgcaggccaactccatgacgactggggaggtgagtgctcgcagggcgacgacaggagagctgggcacggtgcagaacacgcccaggagcaggggcaaattcaggcttatctgcaaagtcgccttccgcgtcgcgaagctctcagccactcagtcgccactatgaaccgatgggggttatacagcgattgtaagccccgtctgacttaccagttagcctatcggattgttactatcaaccccgttcactccgtcggtcatgaaaccacagcttcactccgtgtgccttggtgtctccagtgttctgtttctttaatctcaaaactcatgcacaaataccattgtgcgagtatatatatgtggctataacatcaagtgattctcaaagaggtttctgcaatcaaaaaaa

SEQ ID NO: 10859 - DNA, 1227 bp, Triticum aestivum
  unsure (1)..(1227): unsure at all n locations
  Clone ID: PAT_TA_10859
ggaattattgaggggctttgcgcaaacgatccagtccgaccaagtgtgccacgaatcagctaattgggcgccaattgtctgtctctgattggctgtggcctaaaccatcacatggtttgcatgtttatgtaccgattgatcaccttttgcaagtttatggactaaaccatcacatccaacgcaaatttgtgggtctctagtgttcttgcctcttagatttgtctagcttctacttgcctgatccttaccatggggtacatagacatgcacaaacgcagtcccatccctgtcctttggaaagaggtgcttggtatttaggtatgtactccctccccgttcgagagggcgcaccgggtgccgctcttcgagtactgggcgaggggccctcgcctctgcgggctggtcttccttgctatcttccacaggtcagtcacggtcatcagcaagatggtcgagcgcttcgacggctccgacggcgtctgagttctcgtcgacgtcggcggggggactggtgccgccctggagctgatcaccgcccgccacaagcatataaagggcatcaactttgacctgccttacgtcatcactcaggcgccgtctctcccgggtgtggaaaatattgctggaaatatgtttgagaatgtacccacgggagatgcaatttttttaaagtgggatactccatctacagaatgatgatgaatgcattaagatcctcaagaactgccaccgggctcttccagccaacggcaaggtgatcgttgtggaaattgtcctgccgaccaccacagaggcaactcgtgaggcgcagaatatgttccttctagacgtcatcatgttcaataaccagcagggtggaaaggagaggactgagcaggatttcctaaagatggccaggagctccgggtttgatggtgccttccgttccacctacatcttcggtaacttctgggctctcgagttcaccaagtagttgccatgggcatgcagactgcagctacatctccatctacgccatgcatgtatcattttttttccttttttgaaaaggaggactacccccggaccatgcatcattgcgatgtgcacagcctttatcattgtttgtattgatctcctctcctatatgtgttacttcgattgtatacttgtttacattaatattgtaagacgtgcagcagnacctatttgtattctcaacatatgagccatgtgaagngtacttat

SEQ ID NO: 10860 - DNA, 1001 bp, Triticum aestivum
  Clone ID: PAT_TA_10860
ccaccgtccactcccgtcccactcctccctccctcccagatcaatcaaccaagcccaaaaatggcgcagctgcaggagacgtacgcgtgctcgccggcgacggagcgcgggcgcgggatcctgctggcgggggacgccaagacggagaccatcgcctactgctccggccgcagcgtcatcttccgccgcctcgacgcgccgctcgacgcctgggcctacacggagcacgcctacccgaccaccgtcgcccgcttctcccccaacggcgagtgggtcgcctccgccgacgcctccggctgcgtccgcgtctggggccgcaacggcgaccgcgccctcaaggccgagttccgccccatcaccggccgcgtcgacgacctccgatggtcccccgacggcatgcgcatcgtcgtctccggggacggcaagggcaagtccctcgtccgcgccttcatgtgggactctggcagcactgtcggtgaatttgatgggcactcaaagagagttttgagttgcgatttcaagccaacccgaccattccgcattgtgacatgtggtgaagattttctggcaaactactatgaaggaccaccattcaaattcaaacattccataagggatcacactaactttgttaactgtatccggtattcacctgatggaaccaagtttatcactgtgagttcagataagaagggtttaatatatgatggcaaaactggagataagattggagagctatccagtgaaggcagtcacactgggagcatatatgctgttagctggagtcctgacagtaaacaagttctaacagtttctgctgataaaactgcgaaagtatgggatatcagtgaggatgggaagtggaacgttgaacagaactttggtttgtactggtattggtggtgtcgatgacatgcttgtgggttgcctctggcagaatgataatcttgtcacaatctctcttggtgggacatttaatgtcttctccgcaagcaatccag

SEQ ID NO: 10861 - DNA, 697 bp, Triticum aestivum
  Clone ID: PAT_TA_10861
cggcacgaggacctgctctactcggtctcgtggtcttcttcttctgccttgcatttctccttcttcaaactagctgtccacacacattatcaaatggcttccgccagagcctccgcgctcatgacagccgccgtcgtcctctgtgctgtgctggtcctgtcgtccatggggcagaccgcgatgggcgattgcgcctccgagtgcgccgccgcgtgctcctgcactggtacgtgccggccctgcatccaggaagcggcatgcaccggtatctgcaaccccgcctccgtccagttctcaaactgctggggctgcaaggagaccgccaggacaacgtgcgaaaacgaatgcgtcaccggctgctcattccaataaggcgccgacgcggtgtggtggtggcctgccggccggccgcgcgctcgttgattcgtggtttatgttttcgatcccttccgagttgtttgctggtattctattgtatgaataagccgatgcagtgcagccgcgcaaggtcgtgttctatactgcatatgcactagttccgaccaccggggaccccccttgaggaagctgctgcctggttgcgtcaagtgtttgtgttgtaattcgctgtgttttccctttttgtacgtgtcattgttcaatctcttctgtcgaaaatgctgcaccatggtgtattgttcaaaaaaaaaaaaaaaaa

SEQ ID NO: 10862 - DNA, 1033 bp, Triticum aestivum
  Clone ID: PAT_TA_10862
aattcggcacgaggctcccctggctcctcacaccttaccacctgcaagagaaagacctgtctgcagattttcctccttatcaagccgagttcaacaggagacactcttcagcatcaaccatcacgctggctgcgctgaccaggttgaaagacacttggaagatcctggacagagcggttggctcatgtccaccttttgaaacaatctatgcgtgctgcgtgttacataatatagtgatagacaaggaggaagaggaagatggtgcaggcatgccaatcaatcaggagaattacatcaagcaagtgcggcgggtagcagatgaggacgccatcagggtgagggattcactgtcccagcacttgatcgaatctggagttcacacaaaggctgcagaggaggaacaagaagcagcagcaactgtatctggttcaggagatggaaacaaggaacaggaagcagactgacaacagaacactgatcgaggaaaggagaaagtgcatgtttcctctccactgaaataattcgttgaccggccagtggacgaacacaagggaacacgtacaaagcacatacaagaagagcagctgagctaggagatgagatcgtcatcactgcttaatttggttgcgctttgtctcgaagctgcgagtttaattagctcaaagaaatgtcattctcggagcaagcgactcttcagcatgcaagtttaggacattggcaaagattttgttaaaagacgtgatgtatctgcctgtgacactagagacctttgattgacatgtctttttaggttttgcacccattttttgcatgatgtacgcatatcatgctggtggccaaagcctgctagtgtcattgcgtctacctgctggtggcttggcttggctactgtgtaactgtaactgtatttgcactgcactcgcagtaaatataaatgtaccgtgtcgcctgtgttgtgaacgtgtaatccatagtagctccttgtgtgaaatacatagtagctcactgcccaggaatagcttcacatggcaat

SEQ ID NO: 10863 - DNA, 678 bp, Triticum aestivum
  unsure (1)..(678): unsure at all n locations
  Clone ID: PAT_TA_10863
ttgttcagcgtccgcccacgcgtccgtccatgtttgctagatctgccgtgcttctccccttgctgcccgtaccgactcccggttcttttctccggttcctcggcgatggtcgtctgcaaatgccgcaaggcgacgagggtttattgcttcgtccaccaggttccggtctgcggcgagtgcatctgcttcccagaacatcaattatgcgtggtgaaaaactatgctgaatgggttgttaattctgattatgactggccacaacactgctctttgtgtaatttagttctagaagctgcaagcgaagaaactacacgattgggttgcctccatgtgatgcacacaaaatgcttgatatcacatgtccaaagttttccggcacaaacagcaccagcaggatttgtctgcccctcatgttcaattcctatatggcctccttcgagtattaaagatacaggctcccgcctccatgctaaactgaaggaagcagtagtccagaccgtccgcccacgcgtccgcggacgcgtgggttttgtgacaatgcctaaagctgatgcccgcacaccccctgcatttgcttcagacccccttaagcgtctatcatattctggtgaatctactgatgcaaacatgcttaactcttcgaaagatgcaactttatcatcagcggtactctccnna

SEQ ID NO: 10864 - DNA, 1013 bp, Triticum aestivum
  Clone ID: PAT_TA_10864
tttgcttttccgtcggctcccctgtgtgcgccggtagcatccccttggcccctctcatgttctccagtcccgcggccgctgccggcgtggcctgatagagctccgccaattccttgtccggccgccccttcctcccgccctgtgcccgggcggacggcctctgcgacaagtcataattctgctctataataaccaagaaaatgtatatggtggcctcgacttctaacaaagtttcttacctactcattttcaattgccggatacactctccagcaatttcgtcgtctcaggtcctacgtgaatcccatcatcttcgatgcgctgagcaatggatgggttggttctacctgcagctatataggtccgcaccatgccctcataagcttccgcatcaaggcaatcgagcttcttcaggcactcgcagaaagactccacaccgtcaacatccttggactcttcatagtgcttcagaaatctgctcgtaagcttttccgatggcacccatttgtgtgccgtaagcatcttctttgcatctctcaagatctccagtgccgcggtaacatcagatttgtccaaatagaactcggcaaacatgtaaaccgtcctcccgttgcaatggccctgagacatggtgctctgacggatagcctcagcttcgtctatcatgcccttatcaaggtaagctttgatcatgacatttgttatcctcatgtcgtaatgttcattactcgattcccactcctgaaagatttgctgcaaagactcaaggtcatcaatcatactcagagcttcaagcatcacaagatagtttttgttcgagcatttcttgaatgtggacttcaaagactcccagatcctcttaagctcggttgaattgccagaacgggcatacaaagagatgaggaaatgccaggacaacaactcagctttatccatgacttcctcagctttctttagggccacttctgcctttccaaacagctcttgtttgaggtaattgttgccatcatagt

SEQ ID NO: 10865 - DNA, 935 bp, Triticum aestivum
  Clone ID: PAT_TA_10865
accttctacaaccgcaagaagaagggtggcgctccccaagacgccggggctcccagcagcgccgccgtcgccaatatcgagagcccggagccggaagcgcactggcacggccacgggacggcgttggccaagcccgacgacgccgaggccggccagatgcagctccgccggaaccgcgtcgtcgttcaggttctggagatgggcatcgtggtgcactcggtggtgatcgggctgggcatgggcgcgtcgcagagcgtgtgcaccatccggccgctggtggcctgccatgtgcttccaccagatgttcgaggggatgggcctcggcggctgcatcctccaggcggaatacggcaccaagatgaaggccggcctcgtcttcttcttctccaccaccacgcccttcggtatcgcgctcggcctcgcgctcaccaaggtgtaccaggacaacagccccaccgcgctcatcgtcgtcggcctgctcaacgccgcctccgcggggttgctgcactacatggcgctcgtcgagctcctcgccgccgacttcatggggcccaagctgcagggcagcgtcaggctccagctcatctgcctcaccgccgtcctcctcggcgccggcggcatgtccgtcatggccaaatgggcgtgagctagcgcgcgcggagcgcacgtactcgatcgtccaggcgtgtccatcgtgcaccccaactttgctttatgatgtgtatacgtgtatgttgcaatgtgtgtgtgtgtgtgtgtgtgtggcattgctctctagtctctagagtagtaattaagcttgcttcatcgatcactctcaggtagcatctcacgtacgttctagcaatcctatgtagatgtccaccagacaccaagtactgttgtactatgtgtgtgtaaaatgtcatgcttttctggccatgttaaaaaaaaaa

SEQ ID NO: 10866 - DNA, 669 bp, Triticum aestivum
  unsure (1)..(669): unsure at all n locations
  Clone ID: PAT_TA_10866
actcgctgaccgccagcttgagtggctccaacaacctcatccctgctcccaacgacaccctccccaccatcaccgccaagttccgcaaccagggtctcgacgtcgtcgacctcgtcgcgctctcaggagcccaccccgccgcccagttccggttcgacaaccagtactacaagaacatcctcgccatgaacggcctgctcagctccgacgaggtcctgctcacgcagagccacgagaccatggagctcgtcaagagctacgccgccagcaacgagctcttcttcgaccacttcgccaagtccatggtcaagatgggcaacatctcgccgctcaccgggcacaacggcgagatccaggaagaactgcaggagggtcaaccacttctaaacagaccgagggactgttctgaagccggtgattccgtcagtgcttcaagtcccttgatttgcaatgcttccttcaagtactgtttctctgataagctgctttcacgttatttatgtgggagactgatgtatttcctttttcgtgtggcaccgttaaagggttgcgatcgtgtttgctccccttcttgcactgcttgttgatattcatctgtgcgacgtgcttactgaaccaagaaaggatccaataaagtgcttacgagttgtnccctgtccaaaaaaaaaa

SEQ ID NO: 10867 - DNA, 851 bp, Triticum aestivum
  Clone ID: PAT_TA_10867
aaagcactactccattggtgtgttagcatgtggagctctggagggagaacaacacaaagtaggaaattgattccctcgcccttgcttgcttcaacgaccccgtccgtcttggtggggtcgattcccccatcgcccgactcatctccgacgagtatggcgtcagtgggtacgccccgccgttcgtatgcttggcgggtcccagaacacccgtgacgtgtatgagcttgactagggcgaggggctcgtgctcgtgctcgagctcgacaagacgcacttcgatctcgtcaccaactacgagctggactgtgagactccagagcaggcgggggtgacgaagacgaaagtgggggcagttcgagcttgtcgctgccggagaccctggagaggtgcgcgaagagacctggttagatttgttggccaccactggtaaactgcactaataacaaatcggatgtcatctctcatgttgcggattcaaccctggacgatgttgcgtggcctgcggccatggacgatgtgctgttggacaacgacacaaggccgaggcagccaatgtgaatgaccactggaaatcatttacctttcaatcttggaaggccctaagctgaaggagagcatcaattgtcatgagagataagcaatatctattagacatgcatactatcaggctaacgcaaaccactcgggaatgaagtatacttaccgtaactttctatgtgttgacttgagttttcctattagtaaaagaaacatgccatttttttgcggttcatggattcatgctccaatgttgaattattatctgatctacaaaagcatgccttactgctgctcaaaaaaaaaaaaaaaaa

SEQ ID NO: 10868 - DNA, 1437 bp, Triticum aestivum
  Clone ID: PAT_TA_10868
cgtccgcctaattatcacagctaaagagggaggattcgcaaaatatccaatatcttcccacttccgaagcaacaccgagtggccagtcaaaggaaaaagaaaaaccaaaacccacaccgacgtcagcgaagtcgacggcggtgagtcgacaccgagccttgtagaatttcccaagcgcgatggatctctgggagagggcgcggtccttcgccggcgaggcggcgaagcggtcgcaggagctgtcgctggaggcggccaagcggtcgtcggtgctggtgtcggagacggcgaagaagtccaaggagatcttctcggagaccgccatcaagtcccgcgagatggccgcggaggcgaccaagcaggccgacctcctcgccggccagatcatgcacctcgcctcggacatccccgtcccctccatcccgcccatccccgcgatctcgcccctcccctccgcggccgagtcggagcccgacgccgccgagctcgagcgctacggcatcaccgacgacctccgcgagttcgtcaacggcatgaccataagcaccttccgcgacttccccttgcaagatgagccggagatgtctgatgtgcccacggtgtcgaatgtgcgtcaggatctgaacgaatggcaggctaggcacgccactctcgtcctctcggccgtcaaggaaatttcaaagttcagatatgagctgtgcccaagatacatgaaagagcgtaaattctggcgagtttatttcttgctagtaaacaactatgtaaccccttacgagaccaaatattttgaggagctgaaagtgaaagccgaggaggaaaaaatggttgcccagaaggaaatatcacagacctcacaagctacaacttcagaacagaaagacacgaaggtgccaagcaagacatctacctcatcaaatcgagagcaggatctggatgtatttcttcttggagatctaggcagtgatgatgagggtcctgatgctggcgatgatgatgagctagacgatgactttgataagatagatggtgcctcaggcttagagagtgacggtgacgaggataagaaggcagaaaatgcgaaggagttgctctgatcatacgtgatgccttcccgagtctacacagatggcgttgatgttgatgaaggcgctagcgcgcagctaccgagtcccagctgccgctgtacattggaatgtttgcatctttgccgtgtcccgttgaagcaaatgctattcttgttgtgattgaagtctagaaaactggtacccctgctctggcattcctttttgtttctactagggtgttctctattcttcctacactgttatattcctcaagagtgcggtgaactaaaattaagcccggattgacttctcatgtgaaataagattccatttttattcaacaaaaaaaaaaaaaaaaaaaaaaaaaaaaaaa

SEQ ID NO: 10869 - DNA, 797 bp, Triticum aestivum
  unsure (1)..(797): unsure at all n locations
  Clone ID: PAT_TA_10869
ctccttcttccacctccggccgccgccgcggccaggccggcgtggcggcgcaccacccagcacctccacctactccactacgccgcatcatctccatccgcgctaccgcaacccatccatccaccagcgccatcacatccagccaccacaacctcacgcgccctaccagactagaggtcgtggttgtctagtgccccgcgcaagtcctctcctctgcttgtgcccgactgctgctgctcattcccctgccccgtctcccctcccccgcccccgccgcccctcccctctctccctctcctgctcgccgcccccctctgctctggcccccctccctctcccgcccccccccctgctcttccttgccgaagctcttctctgaacctctcctcctcccaacgtccccctgctgctccttccccttcacttcctgctgccgctccccaacttctcttgttgctccttctctctgtacctctgctgctgcttcttcttcgcctacctcgctgcttccctgcttcttctgaatcactttctccttcttcaacacttgctactgttctctccccctctctgaaatttctatgtattagatgtgagtgggttcctgtgaaattcggacttgtccttgtctgcatgtattctgttgatctgcaagaactagaacagtttatgtgcgtgtgcgtgtgtgcgggggtctgtgtaagtgctgtctgttttgtcactcgtgtaacctgaaccttggtgtagtancttgtgcccgtatgtgtggttaagtatgtactgtanctcctgcgttt

SEQ ID NO: 10870 - DNA, 782 bp, Triticum aestivum
  Clone ID: PAT_TA_10870
ggaattcggcacgagggtggaggtcctctcgctgccggcgccctcctctcgcggcgatgcaggttccgggcgacggcggggggggtggccgggaagccggggacatgcggggccggcaccggatccaggccgagctcaagaagctcgagcaagaagcgcgcttcctcgaggaggaacttgaagagctcaataagatggataaggtgtcaacggcactccaagagtttgtagtaacaattgaaagcaaagcagaccctctacttcctgtaactaccggagctgcttaccagtcttgggataggtggtttgaaggtccgcaggatctgcgtagatgcaaatgctggtttttgtgacaaaatgccaagaacgcaagcagcagccaggaccgattcatttcccatagagtttcttcacaatctctgttgaaggagtggtatgagaagggtactgtggaacacggaggcagcactgaggactgacttaagactttgttcttcaataagttctttctgtctattgcattcctgtgcattacattatctctggtgttggtgaagtatgagatcttagctcaagaatgtcgtcctagtctgagaaattatatgaactctcttgtatttccacttagttatcatgttgttggatattctgaaatcaacgtcgaacaatgaaaattgacgcttatttctctttcttttgaactgtgacaaaaaaaaaaagcatggatgtatgtttgttgctgtgcaaaaaaaaaaaaaaaaaaaaagtcgacgcggccgcga

SEQ ID NO: 10871 - DNA, 436 bp, Triticum aestivum
  Clone ID: PAT_TA_10871
gcgcctccgacagatagctggggatgttgatatcttacacgtattcgtgccgataaggtttacttactgagaggtttcagcaatgcaaagaagttgacgcacacaagaaatcttgctacttgccgaggcaagaagtggagttaagctgggattgcacgcgctcttcaatgaaagcgtaaccatatagtatatctcgtcgatccattgatgtgggtaaaggaggaaaaggatcatctgatgcatgtgtagccagatgagctccgtggaaatttgcaagctgggaaacagctatgtgcttggtgttgttgccagtatgccatatatgtgcatatatataggagatgtaaagaagtgatgatgatgaatgtttttttgtacgcttgacaagtataaacataggtaacaatagatatagctttttgtttcaaaaaaaaaa

SEQ ID NO: 10872 - DNA, 587 bp, Triticum aestivum
  Clone ID: PAT_TA_10872
gcccatggcgcccgtcgagtgggaggaggaaggcgagatcagcctctggagcttctcctcctacaactgatcgagctcaaatgccagcttcgaccgagagcttcgagcttcgagcttcgactggccatggaggccatttcatgcttcgactggtcaaatcaccactaagcaattccatcaacactgacagattaattactcaactaccactacgagtgaccaagaattggtcacggtaaaaataatcgcaggccatgatcaattcttacttcatggcctcgcgaagaatgatgattaattattatttcattcatattccgtagctaaatataatatactagtaccactggcgtactagtagtacgtagccgtacaaggccaattatgcatttgtgggggaggtctgatggagctacatgttttaaggcagcttccatggagccaactcccttcaattagtttacatgtgtactagtatgtgtaaaagctgtttgtgcaagtgtgcaagcaatgggttatgatgatgaattacctctttaattttgcttcgttctaggtgagtactctacatgttctaaagtcaacct

SEQ ID NO: 10873 - DNA, 706 bp, Triticum aestivum
  Clone ID: PAT_TA_10873
gggttggggagatcaactctttaaattctttcatagcttgtccagtatgagattacgttatcaagctcttggagaagggttggcagcactgagtcggtttgagactgatagctactcaagaaaaggcttgctttataagttgatattagctgtgttgacgagatttggcatacctggccttgagtatcattcatcagctgttggccgtttatttaaaagtggattgggtaggtttggccttggacagtccaaaccaaattttggcgatcaaagttttctcatcgtttttgttgtgggaggtatcaatactcttgaggtccgggaagtcatgaaggcaatctcagagagcggcagacctgatgtggagctcattcttggtggtacaacccttctcaccccagacgacatgtttcagttaatgttgggctcatccagctttacttagacattaattagacatagatttaattattgcttatcggtacagtagcaatcatgtaaatttaatctgtacatgtttttgcttctgcgatggaatttttgaatatttactggcttagagaattgttaagtcacaatgttgtaaactcgtataatttccaccctcatttctcaggaggttgtatcagaatataagatccagcccctggcttcgacccagtatttaggctgtatctttggactaaaaaaaaaaaaaaaaaaaaaa

SEQ ID NO: 10874 - DNA, 681 bp, Triticum aestivum
  unsure (1)..(681): unsure at all n locations
  Clone ID: PAT_TA_10874
aatccctatagnggccagggatatcaaatctcagaacatcctattagatggcactctctagcaaaggtgtcagactttggagcttcgaggtgcattccgatcgatgaaacaggggacgcaactgccatccaagggacatttgggtatctagaccccatgtactactactccggacaacttaccgagaagagtgatgtttatagctttggcgttctcctcatggagctgctaacgaggaaaaaaccatgctcatatcgatcatctgaggagaaaagccttgttgcatatttcactgccttgctcgcgacaggcgacctcgccagtttgttagatcctcaggttgcgcaggaaggaggcaagatggttgaagaggtagctctattggcagcggcatgcgtgaggatggaagggggccaacggccaaccatgaggcaagtggagatggcactcgagaaccttcgagtaccccatgaaaatgtcgcgatgtctgatatggatgcaccaagttatgcaatgatcgaaggtggaagaatggaggaggtgagcagacaatatagccaagaagaagaatatttgttgtcatcaagatacccgaggtagtgactgtgttcctgtgtgatatgcacatggatcaaatggcttgtatgctttatgttttttcttctttttcatgtaaggaaa

SEQ ID NO: 10875 - DNA, 273 bp, Triticum aestivum
  Clone ID: PAT_TA_10875
tctaccctttgcttgcttgcttgcttgcttgcttgtcctttctgctgctgcggaaccctcggcctatcccagtcctcagttttccggttcttaccattaccagcaacaacaaaattattttcattctttaatatgaagccccccctcacagagagcctcctgcattgctgaaacctgaatattacttactgccaacaactggggggaattttctcctctcctctgcaacggcgccatgctgcccttctatatctgctctgctctcttcacact

SEQ ID NO: 10876 - DNA, 620 bp, Triticum aestivum
  Clone ID: PAT_TA_10876
gccaaggtggcagagctcgtgtcagtgtgctggctgggcttgtctggccgaatcagcagtaaggagctctcaccaggcacccactacgcaggctacctcgtcttcaagctcacacacgacgcccacggcctgagcgccccgcgccaggtttcatatgttgaggtagacggccaggtggtggcggggagcgtccgcacgccgtctttccatccctgcaaccgtgccgctgcttcctgcggcgaggccggagagccgcacgagcacgcggaggaggacggcgtagggggcgtcaggaggtacccaaggcaacgggacgacgggtggctggagctggtgatcggcgattaccacacaggcacaggtgatgatgatgtaggagcagatattaagatggaactgcatgagtgggaggagctcaagtggaagaaggggctcatcatccagggaaccgagttcaggcctaaacaagcttagttcatttatcatatggtaatcaaatctccaccgtgtggaatggagtagcttcttatcttacactaaagaaataatttgggtcagtctaaatgtccagcgagcaatatatttgatagcccttcagacgttaactgtcatgtatttct

SEQ ID NO: 10877 - DNA, 451 bp, Triticum aestivum
  Clone ID: PAT_TA_10877
ggcgccgcggggtaagacgccgaggaaccacaggtgacgtgacggctcctgctatgcgcggttaatggaagctgattactgcttgtctccccgaaggtggtttgggtcctttgggatgatgcctctatctttagagcaagtgctggttttggttgtaatttgttctatgatccccagcttttcaagcatttgtatctcataatagtaggtttttgcctcatagtgcttgttcgagagcgaacatcattcagagcgggtttcttactagtgttccaactcgcaactctctttattgtttttgtcccccccccctctcccctttaccacttgtaagtgttattttcttaagcaattagtggaaatgggtttagttaggttgtaaacccaaacaaggtgaagctaggaattcaacggtgaggcgatgctagtgctcgcgcatgctcttcatgca

SEQ ID NO: 10878 - DNA, 498 bp, Triticum aestivum
  unsure (1)..(498): unsure at all n locations
  Clone ID: PAT_TA_10878
acnccatgcgaggactgccccacgaactgcagctctaggtgcacccacaacatcaacgcccaagcgtcgccctggcttgcatgcaccacctccggaccctgtggcccgccgccggacccgggctgcgtgcagtcatgcaagtccaatgcccccgcccagtgcgcggacgccaggtgcaagaggcagtgcgccgcctgctcggtttcccctcaggagtgtcgcgaaaccatcaacatgttcatcgggatttgcacgaacgactgcacgacccgctgcaagaaggactgtgtcgccgcctgatccaccggctaactactccctccgtcctgtaagacttttttgatactacactagtgtcaagaaagtcttgcgttacgagatggagggagtggttttcttcgccaaatagcagtaccatctttgttgtgtttgtgtccactggttgcatgtgcctagatgttttatnctcgttgtcttacatctctgttttaataaaat

SEQ ID NO: 10879 - DNA, 734 bp, Triticum aestivum
  Clone ID: PAT_TA_10879
atccactacaatggtcagtgcaagccatggctagacattgcttttaaaaacttgcaaccgttttggaccaagcacgtaaattactccaacgacttcattagaaactgccatattttggagcccctatacgacagataaggactttgggaaatggtgtagacacactgaactgagggggcatagccccgccattcatttgcttactggagaggtggattgctgttgaaggaggaaagcaatcatcagtgaacacatacatatatctctgacacgcccctgcaccaaccgagttgcagatacctcgatactttgatctgtatcatatgggcacacgattcttttcatctgtatcatattggttgggtcattccttttgggcagtcctaactatcaaagggtagcttggggagggcccctcccctgggattgggctgatccattatcggagaataatgcagcggatggtttagcaaatggaacatggatttatcacggtgaagaaagggggcagctaaggtcgtgacagtttataatgtttatttttcctccatctattcttttttccttcttgaaattttgttctgctagttttgtgatcgttctggtagaggttggagaagactgtagtagatatgccattgctgtgtgtacctacaggatattgttacaactgaggaatgtgcagatattaattctttgaagttaggagtcgtcgcaaaaaaaaaaaaaaaaaa

SEQ ID NO: 10880 - DNA, 882 bp, Triticum aestivum
  Clone ID: PAT_TA_10880
ggcacgaggcgaggacgagagcagggcaggcaatggcgctgccggcgccgaggtggctgcggcgggaggtgctcgtgggcctcgcgctcgggcagttcgtctcgctgctcatcacctccaccggcttctcctcctccgagctcgcacgccgaggcgtcaatgcgccgacgtcgcagtccctgctgaactacatcctcctcgcgcttgtctacggaggaattatgatctacaaacggcaacatctgacggtgaaatggtactactacttgatcctcagcatcgtcgacgtggaggctaactacatcgtcgtcaaggcttaccagtacacgtccctgacgagcgtgatgctcctggactgctgggcgatcccctgcgtcctcttcctcacctggatcttcctcaagacgaagtacgggttgaggaagctgttcggcgtcgggatctgcgtggccggtgtcgtgctggtggtgttctccgacgtgcacgcctccgaacgaaaatcaaaaggacccagccccttgaaaggtgatatgcttgtcatcgccggggcctcgctttacgccgtcagcaatgtcaccgaggagtatattgtagagaaaagcagcaggattgaggtgatggcgatgctaggtgtttttggagcaattataagtggcatacagatctgccctcttggccgggcgcaacctcgatctgcactttcgtctgccggccctctgctcccttgtctgggatgtgcgccagcctggttcctgtgccactccgccgtaccgattatcctgaagatatgcggagcaaccatgctgaacctatcacttctgacctccgacatgtgggccgttctaatccgtatcttcgcttaccatgagaaggtcgattgga

SEQ ID NO: 10881 - DNA, 629 bp, Triticum aestivum
  Clone ID: PAT_TA_10881
gcacacacacaccaacctgctcttggcacaccgctgagcaaccatcaagcagccctttgcctacctagttagcgagagtgagaatcaatggcatcccggctggagctgctcatgtcgcaggggatgcgactgtggagctatctcacctcctcatccgcctctgcagcaggaaccggagttgctcttgcatcctccgttactcttgccagttccagaagccaacctccgcaccggaaccgtgaccccccaagaaacagggcaaacgcgcccgggagggcccgcgaggcagagaaacggtgagccttacagtttgcatgcagaggattctctaattctctgacgcgcagccgcttgtaggatcctgctaagttgagctgccatgttgattttcacttcgatgcaggaaacatgtcatagtaatgattgtgtgtgctgctcgagtcgaattaatcaagaaatgtgcagttcagtcttttgttttgaaaaggatgtgtaagctagtgaactttgccgctgtgcgtcgcgtgttggttctctgttacagatcgtatcaaacctgtctgtacctcatatatgttcttctttatcagaaagaaaaatactcgtatatgttctgtgtaaaaaaaaaa

SEQ ID NO: 10882 - DNA, 949 bp, Triticum aestivum
  Clone ID: PAT_TA_10882
cagcgggagtggcaaaccgcttcggggaagttgtcggcgaggatggcgaactgcttcggcgaagtggtcgacgacgagcaggctgaacaaaatggagaggtacatgggtaagccaaagtcacgccaagacagagcaagagaggcctggaatcagatcagcaaggacgacaaggacgccaacgctaccaggtacgtcgaaggtctcaagtccatgtatggcaatggacagtccacactgtgccttgtgtataatgcgacgggtgacaccctccgcaaagtcgacaaccacgactggtatggttatatcggcagcgctccctaccccgacgagatcggcaatggccagtgggctgccttccatcacgtccaccgggctggcgagccgtcgggttccgtaggcgctgttgtgtaccgtgggaagaatggcgaaggggagcagaaggactatcttgttgcatggagtactccatggggcatgtggtaccgcaacaaggcttattgcgagatcggtgccgtcaattgctaccaaaatctttgggctggtatgtacaatagagtggccaattctgattattcttcgagtgctagatccaacgggtgcgagattgatgcaagaattgaaacaggcgatagcccgaaatttactgcaaaaatcaccgtccgctgaccagtcatatacagcaattgtgtgccatgcgccggctctatggatggcacttcgatttagttggaggatggcgtttgtttgtatcattaattcctgtagttccgaataaacggcactaaacctatttgcacattttcatctattcagtatcataattttagtttgatttattatggtctacccaatcatcactacgttgtaatgggacacaaatatatacgcaatcatcattaattacgtcatttcctgttatgtgattacgtacaaaaatagacttaactc

SEQ ID NO: 10883 - DNA, 1268 bp, Triticum aestivum
  unsure (1)..(1268): unsure at all n locations
  Clone ID: PAT_TA_10883
cgtccggcgcctcctcctcctccttcccctcccggcctcgtccggtcctcctcccgcctcccctctcctcccctcccctccaagcttcccacgccacagcccagagaaccctagcggaagcctttgctctccagagcccaagcatggaggcgacggcgcctagcgtgggcgccggcgccaatggttccctggcggcggcggcgagggcgcaggtggggccacccacgaaccccatggcgacggcgctgctcaccgatcagtaccagttttccatggcctacgcctactggaaggccggcaagcacgcagaccatgccgtgtttgacctgtacttcaggaaaaatccatttggtggagagtttactgtttttgctggtcttgaagaatgtattaagttcattgcaaactttaagttcacggaagatgagatttctttcctgcagtcagtaatgccaatgtgtgaggatgcattctttgattatctccggggaattgattgctctgatgtggaagtgtactccattcctgagggctcagtagtctttccaaaagtgcccttgatgagagttgagggtccagttgctgtggttcaactacttgagactccatttgtaaatctcatcaattatgcttctttggtgaccacgaatgctgcgcggcaccgtcatgttgctggaaagtcaaaggttctaatggaatttggtttaagacgagcgcaggggcctgatggcgcaataagtgcttcaaagtattgttttatgggaggctttgatgcaaccagtaatgtattggcaggacatctatttggcataccactccgtggaacacattctcatgcttatgtcagctcatatatgagccttgatgagatcccagacaggaccctaaggaacaaagatggttcaaaaatctgcatggattttgttagtttagtgaaagactggctttgcaagattcaagcggccgatgaattacgtaatgtatttggcgatacaaatcaaagtgagctggctgcatttgcatcanctgcgttgcctctccaatcatctttccagcgctcgccgccctctcgctgcctcngtgtggcctcctgacgccctccacggggacaccncanctcgcngcgcaacctacacccccgacagncaacgccnngtcnctncancgctgcntccgangatcaactcagggcgacaagacnactggttnnacaagcatnancgcatncttgcttctttgtctcncgtctnntnccnttntacanannc

SEQ ID NO: 10884 - DNA, 617 bp, Triticum aestivum
  unsure (1)..(617): unsure at all n locations
  Clone ID: PAT_TA_10884
gcacgaggcatcgctccgacagtcgacacagagcgagtcctcacccagagcaagcaagcaagaagatcgggaggagggtcggagtttgatcgccattggattcgatggcgccggagtttgggtggtggccgatgtcgccgtggctgagcccgggcgcggcgtcgttcatcttcttcaacgtcctcgtcggcgccatcgcggtcatgtcgtcgtcccgggggccggaaccggccgcccggcgcaagctcgttcgcacggcctcgaccgtcgtgctggagagcctgcgctcgatctccaacttccccttccactcgctgggcgactacgccgtcgccgcgtgctctgcaccggcgtcgtcgcagctccaccacgtgcaagcccagtactatagtgctacgatccaagagcaagaagcgcgggaggtgagcgcggtggagcccgagccggcatcagtcgcccgagaagaagctgtagtggcggccgcaacgaccacctcgccgcagagcgcgcctgccgtggcagnnngnnntgaacagaatggagcccgagccagcgtcagacgcccaagaagaaactgtagcggcggccacaacaactacctcgccgcagnncgcggc

SEQ ID NO: 10885 - DNA, 649 bp, Triticum aestivum
  unsure (1)..(649): unsure at all n locations
  Clone ID: PAT_TA_10885
caaatggagaagtaaaaaaataaggcctggagttatacccaaataacatttgtgcaggattgaagtggcggtggtaacacagtcagttgggaggacccaatggcagagtcgatattattgacattttccttgttagaaacggtagtatctggtgttcttaatgaatttggaccatgaagtggagtctgatcactcattatcacatcaacaggtatgcctgcatcataattgtatgtacaatatcagctgttgacacacaaacgccggtattatggttggatgtaggagaacacatgacctttggcagctggtgtgtgtcgttgctgggtgatagcagactgtgcactgggcctctccgcagtgtcaaaacatgttcaaaagaacacttaattaacatgattttacatgtgattgatgaatttgtgataaaaaacagagaaaatggagttaccaaggcgacatggcctgtgtggcttaaatggagtgttgatccaatttagaatacaaccgtacttcctacgatccntgctcctgtctttcnttaataatgtatcctgttagtgcatactctcctttcctcngtctctanctcttttggatttgtttttncatgtagacatgacatatccggattanagattcaatangg

SEQ ID NO: 10886 - DNA, 424 bp, Triticum aestivum
  Clone ID: PAT_TA_10886
cccacgcgtccgcaccaccaccagggcctcgccccgtctcctcctatcccctccagggcctcgccccgtctcctcctatcccctccagggcctcgccccgtcggcccttatccccagcacgacctcgccccgccccctcctctcaccaccgcggccttgcctcgctgccaaccccgcggatcttccctggatcgactctgccgcctccatcctactgccccagaggatatcgagatgtgagctggtcgacacaattcgggagcaggcatatggaattggatcgagatccactgcgtcatcaagtcgctctgggaaggagttcgcagctcgcgtacgtgctctacaggatcagcctaatctctctgtcgccgctgttgttggcttgcaatagaccagactatttccagaggtaccacaaagtggt

SEQ ID NO: 10887 - DNA, 451 bp, Triticum aestivum
  Clone ID: PAT_TA_10887
cggcacgaggctcgattctgctggccctgcttggcctcctgtgggcgtacgcctccggctgcagccgggagtggaagacgtcgggatatgtcgtcgcgctcgccgtcgctgtgctgctctacatggccatccatgtggcgctatcatgccacgacaagaaaggcaaaaaaacacctcaagaggacggcaaatcacctggcaagcaatgcagttccgaagacggtgaaggaaagctagagcgggttcaatctgagattaacactgtatagggaacgaatgatctagaaaacaatgtatagggaactccggaatttgtttacttctgttgacatggctatcgatccttaatttgtacacatgtacacggctagtttgttattgtcatttcgcacattaggcaaacctcttccgactcttcaattacaaacagaaacactttgtaaaaaaaaaa

SEQ ID NO: 10888 - DNA, 843 bp, Triticum aestivum
  unsure (1)..(843): unsure at all n locations
  Clone ID: PAT_TA_10888
gcgccgacgctgccccgccgccggnactgtgcaaacctcatcagcttcgcgcccatcaatggagccaaccgcgctttcactgccagcacgagcacgagcgctttttctcatcatctcatgaaagaagcggctgatcatcatcctatgctcttctcccgcttctccaaccacagctcctctccgccagctcaggagggcgtgtccagcgactcaccgtcgccggcttgccacagcaagtacatgcagtacgccggcgggcagttcatcaacgttactggcataaggacatcgccgttgactgtgggatcagcgccggcggagtactggccggtggtggaggtcaccggcgtcgacagtgctgtcgcaggcatggacagcttcccttcctccccgagcagcctcgggttcatgtcgggctcgttggagggatcatttggcaataacgtttacgacgacgacctgttcagctttgattcctgaccataacaagggcttgcgcagtttgcacgggccgagtaacgatagtacggtgtactgtctatgtatgagtatattgggcatgtgtggaactgtggatatgaacagaaagatagctatctagtaatctgtactatattggcatgtcaagtgtaaatatatatgtaagtttgcctgtacgaccttaaattatgggtttgtaaatgttgatttatgtaaacatattttttttggaaaaaaaaaaaaaaatcaggggggccgtacaantgcctanatgntctataccccccangcctcntttaactctaatggaaactgggttccaattannctnaaaatcccttncnatggaaancaaagcccctt

SEQ ID NO: 10889 - DNA, 665 bp, Triticum aestivum
  Clone ID: PAT_TA_10889
tgcgcaggcgcggcgggagtataacgatcctgggagagggttggctgccttctgtaagaagagagataagagggtggttgacatggcactgcggaagaaggcagaggaagagaaaaagaagaaggaagagatggagcgaaagaaggccgaggagaagaagaagaaggagcgggcaatggcgtatcaagagcctgagtgggcgagggtggacgacatcgagttagcctttgaggaagaggatgatgaggagacgagggaaaaggccaaggaggagctgtactgtgtcgcctgtaataagaagttcaagtcggagaagcagtggaagaaccatgagcagtctaggaagcataaggataaggtggctgatctgaggatggcctttaaggaggaggaggcggctctaaaggaagccgaggaggaggcaggaggtgagtgggaagaagttgatgtggggttcgactttaagcctgctaacgagtccgaggagagtgattggtcagatgctgcagaagagttggctgaggagttggacgagggcttggaggtggcggatcaagacaatggtaataaggacttcaataatggggagcaggaggttggttcatatgatgagacgagtgtgctggaggcgatgttgtcaagccgtaagaacaagaaaagtggct

SEQ ID NO: 10890 - DNA, 332 bp, Triticum aestivum
  unsure (1)..(332): unsure at all n locations
  Clone ID: PAT_TA_10890
gggtctcgncctgnagncgaanaaggcgctgcagtaagcggccgagtcgaggagctgtctgcgggcgagggccgacggcggacgagggttagggagctggaggtgatgttcatcaactgaataagctgcatgatgatggtgcgaatcttgtcacacgcatgatatattcgtcatatgcgtgcaatatctatgtcgatgatcgatcttaccatcctgggagtcagcggtaaagttttccatccgaatgagcgagnacncctcgaacgtgttgatgagcgggggcaggatcgagccatgcgtcatatncagggtgtagaacgcgtcgccgttat

SEQ ID NO: 10891 - DNA, 915 bp, Triticum aestivum
  unsure (1)..(915): unsure at all n locations
  Clone ID: PAT_TA_10891
cggaatccgacggcgcctctccctccctctccaccgcgccgagctccccacaaaacaccgtacgcacgcctctccaagcccgccggccgccgacgccctctccgacgagtaggccaggcctctctccaccacgccggccggatccccgccgccgctgacctccttcgtctctcccctcccttccgccgccatgcttctgggcgctaaggtggtaccccgcgacaagcagcaaggaggcggcgaggaggaggagatgggaggtgacgggatgagggccactgaggttgttagcaaggagatggagggcgtccgtgccatcgtgctcaagccgtccgagcccctcgacgagtcgcgattcatgaaaatcgccggcgccgacttcaacgacgccggcctcggcctcgacggccttcttggctccctcgcctccacgggcttccaggcgtccaacctcggcgacgccatcgacgtcgtcaatcagatgttacattggagcttgtcgcatgagaagccaagcgaggactgcgaggaagctgaccttgacccgacatacagagattctgccaggtgcaagatatttcttggttttacctcaaaccttgtttcttccggtatacgggatgttatacggtttctggctcagcatcacatggtggatgttattgttacgacagctgggggtatagaggaagacctcataaaatgcctcgcaccaacttaccgaggtgaattttctttacctggggcacttctacggtcaaaaggacttaaccggataggaaatctgttggtgcccaatgatnactattgcaagtttgaaaactggatcatgccactctttgaccagatgctacaagaacaatctgctgagaatgtctggacaccatcgaaagtgattgctcgtcttggcaaaga

SEQ ID NO: 10892 - DNA, 866 bp, Triticum aestivum
  unsure (1)..(866): unsure at all n locations
  Clone ID: PAT_TA_10892
ggtttcgggtacattcgattgattatcatcaccttcattaacacgtgtacgttggcagttgggccatgcccatgaatcacccaggcagatagcatttcaacgaggcacttttccaaaggtcgagacagttctcttcaacttgagtgtccagaaggcaaaagatgatggcaatggcgatttctactttggcctgcagaacctcgtgtcccttcggcaggtcactatgggaatcgaccgtcatggtgtcacacttgcggatgtgaaggaggcggtggctgcatcgaggcgcgcagtcgatgtccatccccagcgtcccatcatcatctttgatattaggccacttatacaacatgacgaggtacaatcacctaattaatgatgtccctttacatgcttgcattttaaatcgtagcacatttgttaatttcatgatgacatatgcaccttctctctcatcttaaattcacgcacataaggcaaaggagttgcatcccgagttcatcatcgacgaagagctgatcggggagcaaaggaaactccctgaaaattttcagaaatttcattcacaaactacaagttgggattcaacatccataatttatattggctctgtcgtagggccgagcgtgtgaatttgttgttttctgtaagcacgggaacgccaacccaccgtgcctagtgaaatgcaaaatctctcctctttttttttcttgcctcgaagttgttgtcatttgggttattttctttttcttttcacagaagtcatttttgtatatctgctagacggtttctctgactttggagatttgtacttgactggtacagaccgtcgtcgtagtatatactnagagnacaagnagaggatt

SEQ ID NO: 10893 - DNA, 650 bp, Triticum aestivum
  unsure (1)..(650): unsure at all n locations
  Clone ID: PAT_TA_10893
cgtccggccaattttacagttacagacctgtaatgactcctgcggaaatgatcgcatggtcaaagaacatctaagggactgagttgtctttgtattttggatctttgctgtcttgcttctattaatggtattcaagcctgtaaactaatatctatggttcccgggcaatgagaagatagtaagcagaaagcaaccgcagtccagcgcagaacttctgacgtgaatagatgaaggaactgtattgctttctcttttgatgaatttgactgaatcataacaacaaacatgcagtacgatgggatgggatgttaaaagcatgtaaatgtcaaactatggcttagcttctatttctcattccaagttgttataactgacaaacgaaccgccgttctggaagtgccctggccttatttgaacaatcaaaccacaactctggagaacgcaacaaggatatggaagttgattatgaaacaggaaacacctcttacaagaagtaggtcggaaataagcatcctgtatcaacaggtcactgggggaaaaaagaagccgccgggctgtggggtgggaggagggggccggtccctggtccccactggccccgcgccgcgaaggcacccctgttccccggcccttttccctgaatnanaccn

SEQ ID NO: 10894 - DNA, 669 bp, Triticum aestivum
  unsure (1)..(669): unsure at all n locations
  Clone ID: PAT_TA_10894
ctgcaggnaattcggcacgaggnctttccctctctctctccgtattgttcgctgcttttcagagaagcgaggaatatctgcggcggagggggaagaagcgccgccccagtttcaaaaagaaccgccacctcccctgcaccggcctacgatcctctctcctctcgtattaatttcggttgcccccatccatccatccatccgtccacccgtcctccattttcttggtcgccgtacagagctcaatccaccccagtactcctgcctaccagccgctgctgctagtaggagcgtttgctgtccggtgattccagttggagtagtctgtagcctcttctcttctcttcaatgcgaggagaaggcatcggcggtgggaggaggagtagtcgtccttgctgaagtttcgtcaagctcggtccctgtccctgtccgggcaagcgaacttcttggcagcggcaacgaagcagaggagggatataatggcctccacggaaggcggctgcggcggcggcggaggaggaggagcagagagggcggaggatcctctccctggctccgccgaggaagtgcaaggagtggcccaggaagagagcaggagaagctccggcgaaactgccgatgtgggctgcggcaatagcgggttggcagctgatgccgctgtgctgagcgaag

SEQ ID NO: 10895 - DNA, 822 bp, Triticum aestivum
  unsure (1)..(822): unsure at all n locations
  Clone ID: PAT_TA_10895
ccgggctgcaggcaaacactggagctaaccatatctagtccatatcctctcccaagctagctcgaagcagcaatggcgaaatctttcaccttattagcgctacttagcgcactggttgtcctctcacttcttgtgagccccattgcttgttcccgcaagctccccaggcctgcaaccaaggcccacaagaaccacaccgctgctaccccctcgtcgtctgccgcttatggctccggcggctggttagccggcggcgcgacgtattacggcgcccccaacggcgacggaagcgacggtggcgcgtgtggctaccagaccgccgtcgggaaccggcccttctcgtcgatgatcgccgccggcaacccgtcgctcttcagagagggcaagggctgcggagcgtgctacgaggttaaatgcacaggcaaccaggcatgctccggccagccggcgaccgtcgtcatcaccgacgagtgccccgccggggccgcctgcctcggtgaggccgcccacttcgacatgagcggcacctccatgggcgccatggcgaagcctggcatggccgacaagctccgcgccgccggtatcctcaagggtcaatacaagaaggtcccgtncaagtacaacggcgtgaaatnccttccgggtggacaaggctcaaaccgttcncttcaagngtggccaattcaggacgggaacggaactnangccgtcaactaatgaggcggtgcggaatgacccnatgngnaaangggccctntgggtaaatcaatccggaagggtnacggccttcngtcggtnacncatcggaaggctctncaanan

SEQ ID NO: 10896 - DNA, 1024 bp, Triticum aestivum
  Clone ID: PAT_TA_10896
ccccgcgtccgtcgaccgccattgcctgccaaccccgtcgtgtaggtaggtgactggccggccgcggtagtgagtgaaggcttctgtgctctgctctgctctgtgaggcggccatggcggggctgcggcttcttgttggggcgctttggctgctggcggtgctgcggcagggcgcggcggcggaggcgggggccgtctccgtggacgggcggcgcgccattgcgtccacgggcgaggacttcgtgtgcgccaccctcgactggtggccgcccgacaagtgcgactacggcacctgcagctggggccgcgcctcgctcctcaacctggatctctccaacaaaatccttctcaatgccgtcaaagccttctcgccgctggtgctccggctgggcggctcgctgcaggacaaggtggtgtacggcacggcggaccggcgggggccgtgcgcgccgttcaccaggagtaagtcggagatgttcggcttcacccagggctgcctgcccatgccccgctgggacgagctcaacgccttcttcgagaaatccggggcgaagatcgtgttcgggctcaacgcgctcaacggccgggtgccactgcagggcggggccatgggaggcaactgcgtccccacgaacgcggcgtccttcatccggtacaccggcggcgagggctacaaaatctatggctgggagctcgggaatgagctcagcggcaccggcgtcgggaccaaggtgggcgtggctcagtacgtcaaggacgcgatcgccctcaagacgacggtggacaccatctaccggggcagcccggagaagccgctggtgctcgcgcccggcggcttcttcgacccgcgctggtacggcgagttcatcgccaagaccaagcccggcatgctcaacgtggtgacccaccacatctacaacctaggggcgggtacgcaatgcgagctcggcgcgacatcgcaagcgcgataattcggcgcattttaacagattctcagcagaaagatacatgcatacatgaaccg

SEQ ID NO: 10897 - DNA, 1169 bp, Triticum aestivum
  Clone ID: PAT_TA_10897
gctgaccacagaattctcaggcacaacgatacatgcatacatgaaccggtcctgggctcgcttgccaaacctcggacccttgcagcggccgacatggccacccaactgcggcacaggatactcaacccgaagacgctcgacggcatggcgggcccgttcagggatctccagcgggctgctgaaagccgcgcggacgtcggccgtcgcctgggtcggggagtctggcaggagcttacaacacgtggggcatcaccttgtcaccgacgcatttcgtgttcaggcttctggttccttggatcaagctccggcatgttcggcgaaattcgaccaccatgagctactgcagggcaggagcttcatggcggcggcagactgagcggcccttggctgcaacacatcccaccccttccaagccaaatcctgactactacaaagctctgctgtggcatcgggtgatgggaaccaaggtgctggaagccaagtgcacgggcagcaacatggtccgcgcctacgcgcattgcgcaaagcatgctccggggataaccctgctgctcatcaacctgcacgtcaacgcgacgaaccacgtctcggtggcgggccgcggcggcgcgcacgccggaggaaggaagcacggggggaggtttgctcagccgcccggggcggcgagggaggagtaccacctcacgcccgagggcggcaacatccagagccaggtgatgctgctgaacggcagggcgctggccgccggcgccgacgggagcatccccgggatggagcctgtcaaggtggacgcggcgcggcccatcgccgtggcgccccggtccatcgtgttcgtccacatgccggattaccatgcccctgcgtgtgcttagttagggctttttggtgttcttgttggtataggtagtggtgataaaagggtggcttgctaagcatgtccatcctagctagggtagttataagatggctgaagagagtgtgtggctttgtgtgattagatgtaataagtttggagggaaaattgaaatagtgaaacaagaggcaatgggaataaactctttcctggtttctgctgagtggttgtgttttcttgtaatggtggcagacagaaaagataggaaacattttaccttcgcaacgccacgaaccacgtcaaggtggcaggttca

SEQ ID NO: 10898 - DNA, 460 bp, Triticum aestivum
  Clone ID: PAT_TA_10898
ccacgcgtccgggcgagggttctaggcggctgcgccggagacatggaggagagggcgaggcagctgctcctcctcgccgccgtcgcgggcgtcggcgccgcattcggcgcgctctccaccgcggccgtcttcagcttcctctccagggcgaagcggagagagggctacgtgcgcaagctgctggaatccaatggcggtgctggtggtccgcacgctggcagtactggaccgggagcacgtctgcatgatagctcggatcttctctctgatgaagttgttgctgagcagcttacaaggaatatacatttttttggagtcgaatctcagaagaaagttactgaatcttttgttgtagtcattggtcttggaggagttggcagtcatgctgcttccatgctcctatatctggatgtggctggttgtcctattaaattttgatcaagtcttactggcatcacta

SEQ ID NO: 10899 - DNA, 672 bp, Triticum aestivum
  Clone ID: PAT_TA_10899
ctagtataagtgcatgtgatcgagtagtgcaatacacacagaagaaagtactagtatacagtacagaagtcgaagccaacaagaaaagtgagacaatgaagctcatctgcgacttcccgtcgccgaagtccctgccggacaagtacgtcttgccgccggaggaacgcccttgcaaccacgagttacgggacgacctctcagtcgctctccccgtcatcgacctccaaggagctcttggagatggccgccgacaggttattggcgacatcatgaaagccggcaaggagtttggcttcttccaggcggtgaaccacggtgtgggggaagacgtgatccagggcttccgagaagcggcggcagagttcttcaggatgccggcggaggcaaaactcaagcactactccaacgagcacaacaagcattgccgggtcttctccggctccgtcacgtcccacactgacaccaacgacatccgctactggcgcgactgtctcaagctccggtgctacccggtcgacaagctgatgcaccattggccatcacagccagaaacatttcgggagcgtcttgccaagtacgccgtggcagtgcaggagctggcacaaaggctcctgcgactcatcgcggaggggctcggcttggacagtcgattcttcgagggcgacctcaccg

SEQ ID NO: 10900 - DNA, 831 bp, Triticum aestivum
  Clone ID: PAT_TA_10900
gcaggcacatataccgagtacaccaatcagcaaccttcaagtatcctagtttgatctcgccgcgagcccgtgaagatgaagatggtgcttaaggtgccgatggtctgcaagaagtgcaaatcttgcgtccttacgattgtgtccaaggtcaaaggcgtcaagtcgatggcatacgacgaggagaagagcacgctgacggtggtgggggaagttggacgtggtggtggtccgtcgacgcgctgcgcaaggggaagcacccggcgacagtggtgacggtgggccaagcgcagaaggaggcggaggagaagaagaagaaggaggaagaggagaagaagaagaaggaggccgaggagaagaagaaaaaggaatgcatgcagaagcactgcctcaaggcttgctcgccgccactctactgccccaaggcttgctcgccgccacgccactgcccgccgccaccccactgcccgccgcaatcctactgctacgtcgacgactccggcccctgcaccatcatgtgagcgagagggcagatcatcgacccggcgccgccgtatatatacagccgatcgttgttgccggtgcaaatcaagccactcctccaggccaggcacaccaattaattcgtgcgtacgtcttgttcatcgttcagaagattcagagcttgcatgcacattatttttcttctcctgtatcttttccggttcctgtgatcaagaattgtatgtctcgacggagaccttcttttactactcacaagtcacaactcgtgtacttgcaatctgcaaatgagctgttggttcatggtaatgcgacgactggaatataagaaaa

SEQ ID NO: 10901 - DNA, 1023 bp, Triticum aestivum
  unsure (1)..(1023): unsure at all n locations
  Clone ID: PAT_TA_10901
ggcggtttgacgaggcgtgaccacgacggctggagccaagtccccggaggcaaacgacgccggctcgcgggtcgagggcgacgaaggagcggctcggcggcgtcggaccacagcagatgcagacaacatcggtggctcagaagtgcggctgctgtcgtggccacagccatggtggagatgggcggctcaccgcgaggctatggaggcgacgtccggctgggccaggcggctttaagcaaggcttcggccgagtttgaggcgaaggcgagcagcggctcgatgacggcgacttgaagcaggcggaggccaaggcggctgtggccagagcgaccgggcagggcgaggcgagttaaggtggaggtgggcgcagcagggcgagtccggctcgaggcaaggtcgtggctggcgacacggcgagccacagcagcggcgacaacggaatggcgacttgaggccgcagaggtgaggggttgagcccgctgtggaggtgcaaggcaagcaaggccactcgacggctcaagaccgtggtgatggacgattggcggctgtggaatttcggcagtggcgacttgacgcggaagcagaaccactgccacttgaatatgcggctgctcacttctagtgtcggctcacgcgcggcggctgtggccggcggctcgtagcggccgtggcagagtcaggggcggcgacttgaggtcattgggatggtagctcagagatgcatcggcggcgggcggctcgagacggacctgtggttgcggtggccgtggccggctctaagcatgccggcagctcgaaggtgaccacagctgctcggcagcagaggtggccccttggcggttgaaggatcggggtcggaggcagatccaagcaagtcaagggtcgtgcctggattccgggtcgtggcaggttttgacccatccacgtccaggtcttttctctaggtctttttgttcgttgggcgatagcagattgatcctactnataaatgcggcgactcatgctaaatatttggggttttct

SEQ ID NO: 10902 - DNA, 997 bp, Triticum aestivum
  Clone ID: PAT_TA_10902
aagatatcgatgtacggatgcttggatctggtcgtccatttctaattgaagtcctgaatgtgcgatcaattccatctgcgattgaaattcaacaaatttctgacaagattaatagctccgaaaagaaacatgtcagaatcagaaatctcaagttggtagacaatgaaatatgggccatgatgcgtgaaggggaagcggagaagcagaagcagtatgctgccctcatatggacttctagtcctctgacggatgatgacctgcagaaaatttctgttattaatgatatggaaattgtacaaaatacccccataagggttcttcaccgaagaagcccgttggggcggaaacggattatacattggatggagattgagaaagttgaaggcagctcaaactattacttgttgcatctatgcactcaggcaggaacgtacattaaggagtttgtgcacggtgatcttggacgcacaaatccgagtatcggttccatgctacgttgcagagccgagatactgcaactcgatgtcacggacgttaagatggacttgctgcaatagtatgcagctgccacatgataccatttggggcaattactttggtagtagaggcgcgctgataagccaagattcccgcggaagactatgccgctggcaagtgcgctaggaacggcgaattgtttttctcatcgagtgcgtaactggatgtcaattgtaaaatgtacaccagccaggggaacccagcaacaattttgagaaactggggggaatttggccccgttcggctccaatgtttgcctgtgcccagagcaacaatttagagaaaattgagaaactgaaccattcggccccaatgccttatctgttttgccaccacgtgtcgttgtgctgctaaacattcgtattcccagcgatttgtgacggagctacggcgggcttacgccggcccggaccatttcagatatattcattagcagcatcacaggacgacagaacaaatt

SEQ ID NO: 10903 - DNA, 1157 bp, Triticum aestivum
  Clone ID: PAT_TA_10903
gggcggtcctcctggccgcgttcgccgcagcggccaccatcggcctcgccggcgccagtttccgtgacaactgcgacatcaagtggacccccgagaacgcggccttctccgacgacggccacggcctcaccatgtcccttaagagcaactcctccggctgcttgctgcagacgaagcagcagttcatctacggcagcgtctccacccgcatcaagctcgtcccggggaactccgccggcaccgtcaccacgtactacacatcgtccgtgggggccgaccatgacgagatcgacttcgagttcctggggaacgagaccgggcagccctacacgctgcacaccaacgtgttcgccgacggcgtgggcaagaaggagatgcagttcgtgccctggttcgaccccaccaccgactaccacacctacaccatctcctggacgccctgcatgatcgtctggtacgtcgacgacaccccgatcagggtgttccgcaactaccgggacaagggcatcgcgtacccgatcaagcggcccatgttcggctactccagcatctggtcggcggaggactggtgcacgcagggcggccgcgtcaaggccgactggtccaaggcgcccttcgtcgccagctaccgcgacatgatcctcgacgtctgcccctgcgacggaagcgactcctgcgtctacggctgcgagggggccttcggccatggaggtcaggagcagaactgtgctggcctcagcgaccagcagcggaccaagatgctggagaagcagaagtacaacaggatatacgactactgcgtcgactacaaggacaacaagaagcccggccccgagtgcagcctgccgcagtactgatggactagctgttccagctgctgtctgatcgtggcacgcaccaaggaacaatggttgcccggccggtctaccactccatacacaatcgattgattggactgggacttcatttatagtattattattattatttgttctcaagatttttcattcttgtcttccaaattttgtttcttttgaacagctccatcatatacctatgtgtttgggtatatatatatttgcattatgctatgatatacatggatgagttttatgtgaccctgcttccttacaaagctccatcataaaaaaaaaaaa

SEQ ID NO: 10904 - DNA, 742 bp, Triticum aestivum
  unsure (1)..(742): unsure at all n locations
  Clone ID: PAT_TA_10904
gcaaaattcgaatcccagtcgcagctgcattgaccggcggaaccatgccctcctcatcgccgcgcctagatctcgatatttcttcacaaatcaccaatgaatctcggtggggagtcattcacggatctcttgttcagccggtcgcaaccgtgggcgtcctagatctggcattgccagagggaggggaggtgcggtgatggagggaaagattgtgatagcgattctccttcctcaagttctgcatctcaagttcaagaggcaacggaagattttttcaatgtcccagacattgaccaaaccgacagtcacagagagcatccatctgaatcgcaacacgctccaactctgtggcctcaaaggtgcgagcttaattgacccccacccctccttccagcgccccctcttacaatacaactttcagtcaactagtactctctttttcagtaaagttgttggcttgataatgatttgaggattcaaatcagcccgagcttggtagaatggtcaacaacgggttcagttctagttttgggattatcatgttcagttgattgctgtcaacaattcgtttattttggagcagttttttgttattcaaaagtagtttttggaggttacaagacctcctgttgtcattagcgctcataaacatgtcaatctggggccaagtatgcgatccaattttcgttttgtgtcatagccccagncttgggtttcactatttttttatagtcagactttg

SEQ ID NO: 10905 - DNA, 557 bp, Triticum aestivum
  Clone ID: PAT_TA_10905
cggcacgaggtttactgctgtactaaggatctagtagtattcagctggtgtggtgagatgtgggtgcagtgctttggcgttggtccgtgcattctatcgccaacggaggcagctgcgatgcgacgccactgaagcatggcactgccatgcgcttgcttccacttcctgctccagcggacggaacagaggtcgggccgcggcccgcagagcagatcggcggcgcgtcctcgtccttgtccgccgtcccaccggtgtctcctcgccgtcgctcctccggtgcgcgcggtgtgtgttgcaaggccgggtacatgggccatatcgcttcttcgcctctttttcttctattttttttataccttccctcaaaaccaaattctatttttctattagctggttatggttcaagggcaatgatgatcaatggccaacgtttgtggctgtctcatctccccctagatgtatatgttgtggccggtgatattgccgtgaccaatgtatatgttgtgaccttattgcatggaaaaacgtttgcactccaaaaaaaaaaaaaaaaaaaa

SEQ ID NO: 10906 - DNA, 328 bp, Triticum aestivum
  Clone ID: PAT_TA_10906
gcccccgtggcgaggtcgtgcgcgcgggtggtggtgggcgggctggccgccatggccgtcacctttggattcatgaggctcttccgagccagcggcgtatgagagattgaaaattgacaatgccttcatcgccgtcctcccgtacgtacgtcgagtacgggcatcgtccatgcacttgtcggaataaaaaaaaaatacacagtactagccaccgtacttgtaccaacggctgacttattttcgtttttgcaatctatatatatactgcatgctaataaagtccgaagcgtttgaatttcttcggttttgtcgtccatcaaaaaaaaaa

SEQ ID NO: 10907 - DNA, 640 bp, Triticum aestivum
  unsure (1)..(640): unsure at all n locations
  Clone ID: PAT_TA_10907
gagccaagccggggcccatggcgttcgccgcacggnaggagcctcgcctcccgcttctcccaccacctcacccgccgcctccacccgtccgtcccgcatctgctctcccgctccaacgacgatgaccccccatctcagccactgccacacccactcccgtcactccgctctccgctcccacccgcttccggagcggcccaaaccctacaccaccccttccccttctccctccaccactcggggctaccccgccgtagcttctcctcctccgcccccgcccccgccccggacccacccggagaggttgatgctgctgcgagcgtccttgtcgacgccgcggaggcggtggcttcgtcggtgccggcgccgttcccgggggaggtggcagccgccgccgccgactccttcttccccgtcgccgcgctgcagcacctcattgataccatacataccttcaccgggctcaactggggggcttctatcgcgttaacggcggtgctgatccggaccgcggtgattccattcacggttagccatcagaagtccggcgagaagatacatgcaatgaaaccagaggtggatgccattaagcatgcagtggatataaataacatggttgagaaagtcccttcgttgaaag

SEQ ID NO: 10908 - DNA, 633 bp, Triticum aestivum
  Clone ID: PAT_TA_10908
ttcggcacgaggatttgttgagctggggaaagcagtggacggaaagaagtgtatcatatgtgaagcggttaactcagagttcaacgaaattgtttcaatgtgtggtgggccagaggagaaaaccagagcaagtcaattactgaaacaacttataattgtgccagacagtccttcagcacgtatgatggatcttccaacaacaaggaagcttgccatgaagaacaaggttgtttttggtacaggtgaccgctggcgtgctcccactttgactgctaacatggggttcgtacgagctgtttcacagtctggtatgcctttgttgaccattgagcacagacctcgtgccctgatcggcttgtgaaggcagataaccccatagtttaagtattccaaaccgaatgtaagagtcctgaagttgtaaccagcaagtgtgcttgtagtcttagttcagtcgatcccatatttttgaaatggcagataataaggcataatggatatctcatgtctctgtacataagattgtactactagctactagtaaaattgataggctgaaacagtgatgtgtgtatattaagtacttcagtttgttggtttgtcaaaatgtcctgtgacataacctcttgtaaggcc

SEQ ID NO: 10909 - DNA, 607 bp, Triticum aestivum
  Clone ID: PAT_TA_10909
gcgggagtgaggggcagatggggatcctcgccgcgctgaacgcgtaccggacacaggcggcggaagcagcggcgggccaaggaggcggcggtggaggaggatcgtctagccagcagcaacacggaggtggtggcggcggcggcgagcggcatgagagcatgagcaccagcgagtcgtaggccgggcgggcctccgaggatcgcatcgcatcgcatgcattggtctctggtgtggctttgatctgttctttgtctttgatttctttttccttttgtggtttccttcctccactcctagacattagacaactcgcaaggattacactcggctgcgatcccatggcatttagatcatcatcgtcatacttagcgcacgtacgtttgtgcttgtgagtggaagagcgaggtgtgccattggagaagaggacggaaacacagcagcagcagcagcagcaagagagattgtttatttttgttcttttagcattagggtttgatcaaatgcgagcggaagagattttcatcaggcatggcattcgtcacctgccgtgatcgatcgatggttcatttttgttgtttgccaccaagctttgctagtcctagctctc

SEQ ID NO: 10910 - DNA, 771 bp, Triticum aestivum
  Clone ID: PAT_TA_10910
tgccgcgctagtgtccttctgtgctccttgcattcttggccgctattttggtcccgcccatacccatatgcgttgggcttcctggacttgcgaggcgacccgggggggtcccgacttgccgtttgtcgtaccagcccgcctcctttacgcagtgtttgccgccagtctgtcgctacggttaggttattactctcgccacaccactggcgcggcgtacccccaaactgatcgatccatccgcaatgggattcatggaacgaccacgtcaaaattggacaaaagggcacatagcgtcccatatacacagttaaatcccaaatgccctgccaggaagtaacagtatgcattgaaattggtctagagtgtgtggaccttgatcggaagaagagaccttccatcgaaagcattgttgagaggctcggtagatgctctgcaaacctggtctccaccacttccatgcgaacatgaaactaggatcttctattgatgaaagatgcacaacatggaagagaagctctttctctgttactgttgttgggaacttatcctcgacaaaaactctggtctccaccacttccatgcgaacatgaaactaggatcttctattgatgaaagaagggcaacatggaagaaaagagctttctctgttattactataatgaatttatttctgaaataatcatttgtgttgtcacgtcaccgtggaacttgttaaatttattatggtaactgatattccattatctcctataatccattgttttatactcc

SEQ ID NO: 10911 - DNA, 989 bp, Triticum aestivum
  Clone ID: PAT_TA_10911
gctcgtgctacgtcgcttcactgctataagtcgtttaagcgattcatgtgtaaatctcgtaacactacgagatttttctactttccgaaaataccctcgctcgacacgcatttgcccactcgctcactctctcatcccctcgtccactcgcactcatccctcccctcgctcttctccctcaccacccagatctcatcctcgccgccggcttctcctcaccaccctgtttcctctcctcaccgtgtgctgcaccgcgttttcctctccatgtcgttgccggcctctccccaccaccacctcgcctccggatcaattctatttgccggcgatgaatgcgacggaggtgctggatccgcgtgcgccgacgccggagccaaagcggcgctgcatgtggagctgcgctagagcagcggagccacgccggagcagcggagaggcgctagatgtggagctgccccgaagagaatcaacggagaggcgctggatgtgttcgcgcgatttctactcccctgattggtttctggtgccgtcaggcgagagttcgctgtagggagctaggatttcgtccatctgcagtgaatcggacgtgtccacgattcaacggccgcccggcactgttgccaaggctgatcaggttgggagctggtgtcagccggatgggcaaacgacagccgcaacctcctcacgcctgcacgcatgacgcttcaggatgcagttgatttcgaaggtatggtcctgaagtgtctggaatttggaggccctgtgcaaccggagccgctccggttgcacatgccaagatatgagcctgggggttgcaatggagcaccatcggtgattgcaatggagggcttctggcgctgcaatgaagcgccgccggtgcttcgactgtcgcgcggtgctgtgattggtgctgccatggaagctgttgcgctgaagctttttgatcgtgctcggtgttgccattttgagcagcgacccggatggctccc

SEQ ID NO: 10912 - DNA, 572 bp, Triticum aestivum
  Clone ID: PAT_TA_10912
gagaaccagctttaaactacttgccttagatatgaagaagtctgctaggccttactccgtcaacatcatcggcatgctgctcgtcatcttgatgctctgtgccgtgaacgtccagccaatacaggtaatcgataaggtatgggcaccgaaatggcgcccgcacggctcctgggattgccagaagtgtggcggccacatacgcggccccgtcaatgaaggcgagaagaacttgcccaccacatcagcactcgacaagctgaatcagctgcccaccacatcagcactcgacaagctccgtcactagctagcattgctcgacccactatttcattccctaattgcacaggctatgtttattttggtatgttttccctatttatgtcctgtaatatgtaaacaggttttcgtcccgtagtacgtacctgtgccggctgcttgcatttttattttctagctggtttcatgttagtgcctcatctcgcctctcaactttccccgtcaacgtatgttcttctattgaaactttgtacttcatttattttcaacaatggaaaggggattgccctgcttga

SEQ ID NO: 10913 - DNA, 718 bp, Triticum aestivum
  Clone ID: PAT_TA_10913
ccacgcgtccgcttactgccgcgactgcgagccacggggagagagaggagagaggcgaagcggctctcgtctcgctcgcccccttctgccccctccacataccactcggatccgaaactctcaaccccgctcccgcccctgctccactcgtcctctactcgtcgtcgtccactgcacggcgaccccagggccagcgcccgggggccggcggcccggagcgggggagaggcggaggggatggaccccgagaagcgcggctacaagttccaggagtttgtggcgcacgatgctgaagtgaggtccttggccatcggcaagaagtcgagccgtgtgttcattactggtggcagtgaccgcaacgtcaacctgtgggcaattggcaagcagactcctctcctgagcttgtcaggccacacaagctcggtcgaggctgtagagtttgatacagcagaggtgcttgtgcttgctggctcatcaaacggctccatcaagctctgggacttggaagaagctaaagttgtgcggtctctcactgggcatagatcgagttgcactgctgtcgaattccatccattcggcgaattttttgcatctggttcttcagatacagatcttaagatctgggacataaagaaaaaaggatgccttcatacatataagggtcacagaggagcaattaaatcaatccgatttacacccgatgggcgatggatcgtca

SEQ ID NO: 10914 - DNA, 716 bp, Triticum aestivum
  unsure (1)..(716): unsure at all n locations
  Clone ID: PAT_TA_10914
gtcagggatcattctcagccgcctcgttctggcccatcccacaattttgcaccagctgaagaggagaattcaatgactcgtgcaaatctaactgccccaacacaatggatactcaagctccttgatgactgctgctcctggtggagttagtcagggaacctcttcacttaaccatgatcaagctggcgtcagcggatcatatccaattgaagaatggctaggagtagaagaagcacatgtggcagatcaggacttcataccagctgacaacgcagaactgccgaattctaacaaccaatctgatggttatgaatatgctggtggcatctggtgattgaacttgagaccacagcaacagactctcctctaccatagtaaacatgacggtgggagccggcgattcaagtgttctgtgtgattaagcatttagtttgtaaaatatcagcagtgttgtgagtagtaacagacagtattgttctgtatattgctgaatttgctattggttgcggtaggcatttggtttgtattcttaaagaacaatcttttagaaaatgagggcagctcgctcttcttaatccaggagcaaatattcgcattgccgaacttggtgtaatcatgttaatcaatctttttgctaaggtgaatttcctgtgtaaaaaaaaaaaanaaaaaaaaaaaaaagnnaaaaaaaaaattnactcgagggggggncgtac

SEQ ID NO: 10915 - DNA, 1153 bp, Triticum aestivum
  unsure (1)..(1153): unsure at all n locations
  Clone ID: PAT_TA_10915
attgctcggttgtatggcgcatacatgccaagccagctatgggtatcccaacccaatgccgcccatcccaagcccgacaccacctacggcaccggcgctcaccctgaactactacanctattcctgccctaatgcggaggcaattgtganggangccgtaaagaacgccacagacaacaatcgcggcatcggtgccggtctcatccggctcttcttccgcgcctgtttcgtctggggttgcgacgcctcggttctcctagacgcgacgacggccaacccggagccggagaagcttggcattccaaacttccccagcctccgcggcttcgaggtgatcgacgccgcaaaggcgaacgttgagaaggagtgccgtggggttgtcccgtgcgctgacatcgtcgctttcgctgggcgcgacgccaccttcttcctcagcaacggcgtggtagacttcaatacgccggccgggccgcggccgcggtcgtccctccttcccccccccggcccccccccctcccgccccccccctgccgcctacgtcacggggctcgacccactgttcttacccgaggggctcgacctcgacgacatggtcaccctctcgggcgcgcacaccgttggaatctctcattgttcgtccttcgctgaccgccttccagccgacccgtcggaccccacgtccatggaacccgcgctggctagctcgctacagcagaggtgcagccgtggtggtgaccccgttgtggtgcaggatgtcgttaccccccgtgacctggacagacagtactatcagaacgtactcgaccgtaaagtgttattcaaataggacgcggcgctgctgtcgccgcagacactcaaggctgtggaacacaacgccaagaaccccgggaagtgggagcgaaagttcaaggacgcaatggttaagatgggcaacatcgaggtgaagaccaaggccaacggggagatcagaaagcagtgccggttcgtcaactagcgaccggttgatgagacaaacccttacttcatcttgactcctgaagccggagactgatcagaataagctcgtgcttttgttcgtatgtgttagcttaatttccgttgctgtttatttgctaccaaactttgtattattggtccatttttgcatcacatc

SEQ ID NO: 10916 - DNA, 1066 bp, Triticum aestivum
  unsure (1)..(1066): unsure at all n locations
  Clone ID: PAT_TA_10916
ggctgcaggnaattcggcacgaggggatttctgggcgaatcctccttgagggtcatattttcggaaggaacctattctggtatactattgtttttggaacaatagcagctataagtcgaaaagtagtggctgatgagcttcaagtaattgacccagaaggtgctatgtgcctcgttgtccagcaaacccattacatgccgaagcggtggcgtggtaaagagagcaatgagctggttcggaaagaatttgaaacactatttcagtataccatagtaatgctattagaagagatggcgtccattttcatcactccttacttgctcatttttgaggtaccaaagcgtgttgatgacattctgcacttcatatcggacttcacaatttatgtagatggagtgggagatgtatgcagtttaagcatgtttgacttcagaagacacggcaatagaaactatggttctccatttgatgcacctaaaaacctgaggagctcccaagggaaaatggagaaatcattcttaagttttcagagtgtttatccatcattggcatcaaatgcagagggcaaacaattcttacataacctacagaagttcaaggaaagacaaatacgtcaacaagctgttgcgcagtatcaggcaatggaagcatcaggctttgtggatagcacaggtcaaagggatgatatcttccatcaactactcccaagtattatccgtaaccatgcagaggccttcccacctgctggttataacttagatcccttggggattgctggactcagatcaaagaatcatccatatattctggattggtattacatgcgtcattcaccacacttggatagagttgaagctccccattttgacgaagcaccccttgaggctggtccaacccctagtcctctcgcgggggaatcttcggaatttnagaaaatgaanattataccccgatctgtacggaaggttcaaancatatggganactacatcnaacatttnttcccgcatctcctacaaanacaacggntannaagacattcacaagcaacgggtggacaanccctc

SEQ ID NO: 10917 - DNA, 1450 bp, Triticum aestivum
  unsure (1)..(1450): unsure at all n locations
  Clone ID: PAT_TA_10917
cgctcgctcccccacccccccgcagcggctcccggggtcgggcgccgcctgcctccacgcgttcactggtgctggcctctctgcgccgtcttccccccgcgcggcttagacctgcggcagcgaggcccgcgctcgggtgcatccccatgcgccaagacgacctgccccgcgcctcctaccgcgcccccgcgagcttgcccccctacctcaaggcgatcatagggggccagcttggcccgtggaccaaaaaggacatcgccgccgtagccgccccccgccgcatttggtgacgaacctcaccgcctaccggttcctaggcttggctcgtgctggcgacagatcccctctactcccgacagcatgaactcacctaaatccgtcgaccgcacgtcatggcatacgtgcatgtaatacgaacagtacgtctcgctcgccatgtgtttgattgcagtttgcctttggacgccctcctaagtcctagaaccactcaggcccgtggggccttggtaccgtctcagctcgacctactcttcccacgcaactttcggttgtggggtgcctcctcctcaaagtttatccttacaacggttttccaccctgtaaagatcacggatctcttccgggtcttcgaggtccgcggcttcaacaagggtgacctagtcgcgctctccggcgcacataccatcggcaaggcaacctgcccgagcctagaattccgcaccggggagcccgcctggttcgtcaaggcaatcaaagacaattgccccagatcaggggacaagaagcacatactcgatgttaccacccccgacgtgttcgacaacaagtactacggcaatctcctcctagggttgggtgtgcttgggcaccgacatggagctcctccaacaccaaggaaacaagattttttgtccgaaagctgggcccaaggacgagcatctagggtggtccatggggcactccgctgccgccatgaagaagatggcagatttgcctgtggaccccgacggcgagtaccgcgacaactgcttcaggcccaagtcctttgtgaggaacctcaccgcagacggtttctcggcctcggcttgagagatcatcggctcagatggatcaccagccgatcgaccgcataaattaatctgcatccgtcgaccgcacgtcatggcatatgtgcatgtaataagagcagtacgcctagcttatcttttgtttgattgcagttcgcttttgtatgcccacctagtctagagccactcggcctgtggggccttgtatcctctcagttcaacaactattccagacagctttctgttgttggggagctgctctcaagttttatcttacaattgttttccatcctttaggttttacgcctgtttctgtcatgaaaattaatggagatgtaagattgtgttttttagnctcangagaagtaagttatnataggttt

SEQ ID NO: 10918 - DNA, 722 bp, Triticum aestivum
  unsure (1)..(722): unsure at all n locations
  Clone ID: PAT_TA_10918
tcccggcggccggcggacgacggcgagagcatgcagcagtcacgtgcatggtcgtcccttgcgcgcggcatagcgcgccgcctcgccgggggagcgccgtcagctccgatttctcctctccagtccgcggcaatctccaccgggtcagcctgcctgcttgctcgccaggacggaggttttgttcatggtgggttcatggattccattcgtattggtggtgttgtgatacctaaccacaagagggtggagtacgcacttcaatccatccacggcattggccgggcacgcgcccgtcagatcctttcagagctcaatttggagaacaaggtcaccaaagacctctccaaggaggagatcatcaccctccgtgaggggatcgcaaagtacatgattgaaacagacctaagacggtttaagagtgcggcggtcgagagattggaagggattagatgctacaggggcatccggcatgcggatgctctcccggtacgtggccagagaacaaagaccaatggcaggactcgcaaggaaaagagggcttgggttgccaacaagtcgtttgcggcctccccggaataattagtcatgctgccattatttagctccttttttggttttgtttgtactgcattaccgcgctactgttaatcgacagttaatctgataataaatgctaggtgcctcccagccggcctctgcngactttccgaactttcaaattc

SEQ ID NO: 10919 - DNA, 1469 bp, Triticum aestivum
  Clone ID: PAT_TA_10919
acgcactgcatactcttagtaattagcaatggctcacctggtgggcatgatggcgcttctcctcctcctcgcagcgtcggcagagacagcccaggcgcgcgccgccagggggccgccggcggggaagtacgccgtgatcttggacgccggcagcaccgggacacgtatgcacgtcttccggtttgacaagcagatggatctcgtcaagatcggcgatgacatcgaggtctttgccaaggtgaatcctggtctgagttcgtacgctggacggcccaaggaggctaccgcggccctgctaccgctgcttcaaaaggccaacagcgtcgtgcctcagaggcttatgaagactactcccgttaaactcggggccacggccggactcaggctcatcggagataagcaagcaaagcagatacttgacgcggtcaggggcgctgtccacactaacaccaagtttcagtacaaccccaagtggatcaatgttctcgagggatctcaggaaggatcctacctatgggttgctctgaattacctgctggataagttgggaggagactactcgaaaacggtaggtgtgattgatcttggtggtgggtctgtgcaaatggcatatgccatttctccagccgccgctgctgccgctccacgagtgcctcacggcaaggatccttatgttacaaaagagtatctcaagggaagagattacaacgtttatgttcacagctacttacgctacggcgccttagcttctcgtgtagagatcttcaaggctaccgaaggaccatttagctactgcatgcttcgtggcttcagtggaaaatacagctacaatggtgaggagtacaatgctaccgcgtcaacgggaggtgcacaatacgggaagtgcagacgtgatgtagtgagggcactcaaacttgactcgccctgcccagccaagaagtgcaccttcgacggcgtgtggaacggcgggggcggccccggccaggccaacctctacgccgcgtctagcttctactacatggcctcgcaggttggcctcatcgacaacgatgctccaagcgggacatccaccccagcggctttcagagccgttgcccagaagttatgtagaatgagcttgaaagaagtgaaggttaagtaccccaaggtccgtgacgtaccctacgtttgcatggacctcgtctatcaatactccttgctcgtcgatgggttcggtttggagcccaccaagaatattacactcgtggagaaggtgaagcatggggagtacttcattgaagcggcgtggcctctcggagaagctattgaggccgtggcacccaaaaaaggcacttgacaatagatgccccatgatacacctgactttccttacaattattgttttttataaaggacgtttttattatctcaaaatgtcgcatcacgcgctcttaaaaagcattacgagtaacaaaaaaaaaaaaaaaaaa

SEQ ID NO: 10920 - DNA, 235 bp, Triticum aestivum
  unsure (1)..(235): unsure at all n locations
  Clone ID: PAT_TA_10920
gcaggnaattcggcacgagggagctctgggacggcgagnatatgagtagccagtggagaccgactggccggccgtacgtacgtaccacgagcggttgtatgtcggatgtcatccttggccattgatggctggttgatcgggggacagctttgcaccgatttcccttggaataaaaggaatgttnctgtattgtgtttcaatgaataaatcaagatgtttatgcctaaaaaaaaaa

SEQ ID NO: 10921 - DNA, 418 bp, Triticum aestivum
  Clone ID: PAT_TA_10921
gccgtggcgaagctgaggtgggcggtctctggtttaaaggagaggactccaacaagaaatgtttcactacggcatgaaaccgagagggaaggggagggtccgtcaggaaaagagaaatgtgtgtcatgatttatttttcttctctcttttgggatcgtgtgttgtggataacatgatagatactccgggcaatcacattttcccctcacatatgggttggatttgggggagtccgaactgtccagtcagctgaattttggggagcctgttgggcacccgtttgatgtccaaacacgtccagacgtatgagggagaaatgagcgtcgaccttggagacgacattactgcattgtagctcgtagcaactatttaatggctctttctaaaaagtttccattttagtttaacaaaaaaaaaa

SEQ ID NO: 10922 - DNA, 845 bp, Triticum aestivum
  Clone ID: PAT_TA_10922
cgtccgcccacgcgtccgcccacgcgtccgagctggctgagcttctggtgtctgaggaagtgccaaggcatcgccgcacgttgttaactgagaagagggaccgtggtgttgggaccgagcagcctggtccggtgctggagcagaaggtgtcgtttggaagagggaaggggaaagttgacaccgcagggagaagtgaagtcagtgaaccaggccattcgagtgacaagaatctggtcccagaaaaggaggagcccttgaatggctatgcagtcaagacggtgcttccgtttcctacagaaatcccgtcgtctagttatcatagtacgcaccaggatggaaatgagaggaaagatacgaagaagagcgtcaatgccgatggttcgggaaaagcagcaaagaggcaacctgatgaggggaacaggcagtattactcggggaagtcccagagtaatgtggatcacgttgctgaccgttgcttcgacctgcagcttatgggaaatagccaacgcgaagagtttccgaagttgcctcctgtgcggctcaagtccgaggataagcttgttaatatgaactgggaggagaagatcgatcatcatggatctggatccaacgaccctagtactgaccatgtctttatgattgggtcttatcttaatgttcccattgggcaggacattacatcatcaggtggaagacgcatggttggcagtagttggttatccgtcagccaaggcattgcagaggatactcctgacatggtttttgacacacttggtgatgatttgcttgagtatccaaatgagtattgggactctgatgagtatgacgatgacgacgatgttggc

SEQ ID NO: 10923 - DNA, 1036 bp, Triticum aestivum
  Clone ID: PAT_TA_10923
attcggacgaggcgcccgcgtctacgcctccgctcggggcgtccccgtggacaacaccacagccaccgccatcttccagtacaagaacgctgccgcaggcgcaggcgctggagcaccaatgttccctgctatgctgccggccaacaacgacacggccacggccaccgccttctccaacggcgtccgcaccccggggccgccgtcggcccccccgcctgggtcgcgggaggcgccccccgcggtcgccctcggcctgcgctgctgccggccgggcccgttctgccagggccccaacaacacccggttcggggcgagcatgaacaacgtgtcgttccagctccccaacaccgtctccctgctgcaggcgcactaccaccgcatccccggcgtcttcaccgaggacttcccggctcgcccgccggtggtcttcgactacacctcgcagaacgtcccccgcgcgctgtggcagcccgtgaagggcacgcggctgtaccgcgtcaagtacggcgccgtggtgcagatggtgttccaggacacgggcatcttcgccgcggaggagcaccccatgcacatccacggctaccacttctacgtgctcgccaccgggttcggcaactacaaccccaggcgggacgaggccaagttcaacatggtcgacccgcccagccggaacaccatcggcgtgcctgtcggcgggtgggccgtggtgcgcttcctggcagacaacccgggcgtgtggctcgtgcactgccacatcgacgcgcatctcaccggcgggctcgccatggcgttggtggtggaggacggcaagaccgagctccagaccacgatgccgccgccgctcgacctgcccgtctgcggcccgtagaggtttcctggtgactttctgtacatggcggggaacgtgagtctgtgtgcgtcttacgtgttgtgaattgtgatgctatctgtttgccattccaatttggtattgtaatttggattttcgatttgaaattgtaaagaaaaggcaaggttttccgttaaaaaaaaaaaa

SEQ ID NO: 10924 - DNA, 528 bp, Triticum aestivum
  Clone ID: PAT_TA_10924
ttcggcacgagggttctctacagcggtttatacgaccggaaatccttatggcatagcagaagacctcgtatttagcatgccttgtaggtcaaagggtgatggcgactatgaactagttcaacatgtggcaatggatgattttctctgggaccggatcaaaaagagtgaagcagaactgatcgccgagaaaagatgtgttgcccatcttataggggagggtaatgcattatctgatcttcctggggatacaatgctaccgggggagatgtagttctactgctatcgatcatacttgcaatctgcaaatggctactggtctatatatgttattctgttattagaagggtcacaaggttcccaacgggaagaacgatagttgcaagaaatgactgcttccaggctgctgcatctatattcttctataataagcacacataatttttttgtacactagtatttccgggacagaatgaatgtactagcatgaagattgagaaataaaaagttttctttctatcaaaaaaaaaa

SEQ ID NO: 10925 - DNA, 729 bp, Triticum aestivum
  Clone ID: PAT_TA_10925
ccgggccgggcttaccgccgctccagaacggaacgaacgaaaaatccccaaccaagctcgtcgccgatcatccctaggctcgcccgtcgccgatcaaccctaggcttggcgaatcctcctcccccaccgcataagatgcagatctttgtgaagacattgactggcaagaccatcacccttgaggtggagtcgtctgacacaatcgataatgtcaaggccaagatccaggacaaggagggcatccctccggaccagcagcgtctcatctttgctggcaagcagcttgaggatggcaggacccttgctgactacaacatccagaaggagtccacccttcaccttgtcctccgccttaggggaggcatgcagatcttcgtcaagacgttgactggcaagaccatcacccttgaggtggagtcgtctggcaccattgacaacgtcaaggccaagatccaggacaaggagggcatccctccggaccagcagcgcctcatctttgctggcaagcagctcgaggatggcaggacccttgctgactacaacatccagaaggagtccacccttcaccttgtcctccgccttagaggaggcatgcagatcctcgtgaagaccctcactggcaagaccataacacttgaggtggaatcctccgacaccaacgacaacgtcaagggcaagatccaggacaaggagggcattcccccgggacagcagcgcctcatctttgct

SEQ ID NO: 10926 - DNA, 694 bp, Triticum aestivum
  Clone ID: PAT_TA_10926
gccttttctctgggtcgtgaaggagtcccggccggccccccccggggccccgttggggcctggggccccgggggccccccccgcccggcgcgggctcgcggggcgcgccgcggcgccccgccgccccccgccctgtcgcaccgctccgtggcggggttcgtcacgcactgtggctggaactcggtgctggagtccatcgcgcacggcgtgcccgtcttgacgtggccgcactttgccgaccagttcctgaacgagcagctggctgtggacgtgctcggggtcggcctccggatcggcgtcacggcgcccgtgatgatcctgaacgacgacgcggccgcgccggtgctgcgtggcgacatcgcgcgcgcggtgtcagagctcatgcagggtggggaggaggccgaagagaggaggaggaaggccaaggagtacggcgcgaaagctcggaaggccatggagaaaggaggcgattcgtacgaaacgcttacgcagctcatcgaaagcttcaggcacggtggaggcaaagataatgaacattgcagcggcgtgatcgcgtgaatattgcacaattgtacgtagatacttgaatgcgctgcatcgatgtgcaaggatttttgggcgtaatcatgtcgctcgatgtattgatatttgtttgtctgaatgaaagcgtgacagctctttctttctttttctc

SEQ ID NO: 10927 - DNA, 376 bp, Triticum aestivum
  Clone ID: PAT_TA_10927
gctccctcctacacggccgccaaacaacaatagggcatgacctgacgttgaccatgacgatgcgcgacgcggccctctcggcgttgttgggcgagcagctcagttccggcgagctccgcctcaatctgatttggttctgtatgagtttgctgctttactagtgtcgttgtccccttttgggtgtgcgtccttagttgatcttagtttttaattctgtcatttaggcttgtagtctttgctggggcagcggtggggctgtcctccgcgtgctgatttggtactgtgtaagacaatttggtttctttgctatgtaatggagccggacctcttgtgctcttttcctctgaaaaatggttgttgggcgagaaaaaaaaaa

SEQ ID NO: 10928 - DNA, 2012 bp, Triticum aestivum
  Clone ID: PAT_TA_10928
gttgaacaggcctgtcgtaggcaaagcacgaatccggaaggatctcatgccgaaatggttcacctcacgtcgccgtgcttcgtttgcgcgaccacagcccgcgagccatgcgcgacgaagccggggggcgatccctccaccgccgccggcgaccccatcccccgaagccgccggcggtaccggcccacgccgccctccgcgatcccccacccggcacagaaatcttttttgttgttgtgagttatccgaagttcgcttcaaacatgagtgctgctaatcgttcccaacccatcaagttgaacaggcctgtcgtaggcaaagcacgaaagttgaaggatctcatgctgaaaagtgacaatcgagtgtgtgctgattgtagtgcacctgaccccaaatgggcgtcttctaatatcggagtatttctttgcttaaaatgtggagacgtccacagggcccttggacaagacatttcaaacgttttgtctttaactttggatgattggtctgatagtgatattgactccatgattgaggttggtggaaactcatatgcaaattcaatttatgaggcttttcttccaaaagatcacccaaaacctaaaccagactcaccaatggaatatcgtaccaaatttataagagccaagtatgaaacacaagattttctgaagccaagtttgcgcattagctcaaaggcaggtttagaatctaccaattctctgaacagtgtggataatagtttctctagcacttcaaggaagcatgccccagaagatacaagagaatttgttggacaactgaacgttacagtggtaaaaggttctgggttggcggtcagagatatgcttacaagtgatccttatgttgttttaagtcttggagagcagaaggctcaaacaacagttaaagcgagtgacctgaacccggtatggaatgaggttcttaatctatcagttcctcgaaattatggacctttaaaacttgaagtgtatgatcacgacactttctctgctgacgatatcatgggggaagcagagatagatctgaagccaatgatcacagctgctatggcttttggagacccgtcgcgtcacgcggacatgcaaattggaaggtggttcatgaccagagacaattgcctgttgagcgacagcattgtcaatatttcgtcgggaaaggtaaaacaggaagtttacctaaagctgcagaacgtagaatcaggtgagatggagttagaactggaatgggctcgtctagattaaataagcctcgctgtatccctgtcaaagttaactcagaaagcataaatgttttgtaatttatgctggatggcttcgaaacctatctagttaccgaagcttagcttttcctcatggccgaaatgtgtaaaaatgaaggctgtacaatgtcttgtaatttgtccatgtgattcggcatgttgtattgtcacattaaaaggacacatgtatcgtgcagagatgaagctaaaactcttgtgtttgctaaaatcaaaatggtgcttaaaataaaaaaaaaaaaaaaaaaaaaaaaaaaaaaaaaaaaaaaaaaaaaaaaaaaaaaaaaaaaaaaaaaaaggacaggccccaccggggcgggccccgccccctgggggcccgcccccccctgcggggatggaatcccatgtctcgcttttcggtcccgctcgccgctgggggcggcccggaacccaatcccccgggtcgcgtgccgcgtgccttccgcgccctgggcgtgattaccccgcggctggcttgggtgagccgtggcgcaacccaacccccttgccttgcctcccctcccccgcttggtggcctggtggaatagccccccgccccggtccgatccgtcccttcccaaccggggtgtgggtggagtggggaatgtgaatgggaaggggttgtgttttgtttcaagtccccttttttttttgtccgctccgttcgtttttctaccccgccggccgcggctcaatcccttcccttataaatcaa

SEQ ID NO: 10929 - DNA, 639 bp, Triticum aestivum
  Clone ID: PAT_TA_10929
cccaaacctcccagcgctcctccctcctcagcctcccggcgcatctccggcatggcccgcaccaagcagacggcgaggaagtccaccggcggcaaggcgccgaggaagcagctggccaccaaggccgcgcgcaagtccgccccggccaccggcggcgtgaagaagccccaccgctttcgccccggcaccgttgcgctccgggagatccgcaagtaccagaagagcacggagctgctcatccgcaagctccccttccagcgcctcgtccgcgagatcgcccacgacttcaagaccgacctccgcttccagtcctccgccgtctccgccctgcaggaggccgccgaggcctacctcgtcgggctctttgaggacaccaacctctgcgccatccacgccaagcgcgtcaccatcatgcccaaggacatccagctcgcccgccgcatccgtggcgagagggcctaggctgcaacccatgcttggcgtgttagatccctaataggcatcggtggaaatctgtgtgctactagtgtttcagaatgtgtctgtgttgttcttgtcatgtgtctaatctgatggtaccctcttgttgccatcagcaatggaaatgaaaatgttggcttcctgttcgcattcatctaa

SEQ ID NO: 10930 - DNA, 580 bp, Triticum aestivum
  unsure (1)..(580): unsure at all n locations
  Clone ID: PAT_TA_10930
ggtggtctctttcacggctgaatctctcaccagtttcagtacagtatggaggcacgagttcacgggcgcggagtacaaccactaccgcagaacgcagtcggccatggatgcgccggaccggcacactctcaggctgccagagcacgtcatgaaggagctcgccgccgtccggaggcaccggcgggcggctagcctcgccgcagagtatccggacaccgcggatcagaggacgccggggtggctgacctcgttcctgcggtccatgtcatggcagcggcagagccgcggggactcggacgccggggaggaacacggcggcagcaaacggattcatcccgtgtccggagcgccggttgaaagaccgagcgggtcggggtccggcggggacgagaagaaagagagctccgacgttgacgcgttaaaccgggtttgacctcttcgttcgttcttgtgtgtaatcttcgtctgagttccttatgcaaatagaatttttatagacctccatggcttgcgatcacgttgtttctttctctctttgaatttggaaggnaagaagatctccttggattcaaaaaaaaaa

SEQ ID NO: 10931 - DNA, 1248 bp, Triticum aestivum
  Clone ID: PAT_TA_10931
gccatggattcagagctatcaacagtgttcttcctgctgatagttttcgcagcgtgttgttgctcttcctcgagcgccacccaccatgacccctcggtcgtcgggtactcgcaggaggacgtcgcgctgccgagcaggatcctcgacctcttcagctcgtggtcggtgaagcacagcagggtgtacgtgaccccgaaggagaaggtgcggaggtacgaggtgttccggcagaacctgaagcacatcgtggagaccaacaggaggaacgggagctactggctgggcctgaaccagttcgccgacgtcgcccacgaggagttcaaggccggctacctagggctgagcgccggcgggcggccgcgcgctccgacgacggcgttccggtacgaggccgccgtggacctgacccgggaggtggactggaggaagaagggggcggtcacgccggtcaagaaccaggggaaatgcggaagctgctgggccttctcgacggtggcggcggtggaagggataaaccagatcgtgacgggcaagctggagtcgctgtcggagcaggagctgatggactgcgacagcaccttcgaccacggctgcggagggggcctcatggacttcgcctacgcctacattgtggggaaccaggggatccacaccgacgccgactacccctacctcatggaggagggcgactgcaaggagaatcagccccactccaaggtcgtcaccataagcggctacgaggacgtgccggagaacagcgagctgagcctgctcaaggcgctggcgcaccagcccgtcagcgtgggcatcgccgcagggagcagagacttccagttctacaaagggggggtgtttgaaggaacctgtggcactcagctggaccacgcgctgacggccgtcggatacggctcatccaacggccaggactacatcatcatgaagaactcgtggggcgggggctggggcgagcaaggctacttcaggatcaagaggggcaccgggaggcccgagggcgtctgcgacatctacaggatcgcctcttaccctaccaagaacaacggcacgggctgggggtggggggcctgattttgtcggcggcataaggtgtctctgaaactcattcgttcatagttcgttccaagtgctagcacgtggatgcagcatccccctttttttttctctcgaacacgaagcatcagcagtcaaacaagttagtagtctgtaaattataggctccggtagaaaatc

SEQ ID NO: 10932 - DNA, 964 bp, Triticum aestivum
  Clone ID: PAT_TA_10932
ggcgctagaattgattggtcctgcttacagaaccatggactcatttgttggggtacgagagaagacctgtatcatttttgtttacggacttctacttatgaggcagcataatccacaagatgcacgggttcgccttgcaagtggtttgagaatagcgcaccaacagttgggtaacatccaattggtttctcagtatttaacaatattaggtacattagcacttcagttacacgacactggacaagccagggagatcttgaagtcatcgttgacgttagctaagacactttatgacatcccaacacaaatctggatcttgtcggtatttacagagttatatcgagaactggaagaaaaggagaatgaaatggagaattcagaatatggaagtaagaaagagatcgatctgcagagaagactggctgaagctcgttctcgcgcttatcaccaggagctggtggagaaagtgaggatcgaagtcgagccgctgcacgacttgttccagaagcataacgatatgtcgggcctgccggcaaatgatgaccttgacatcccagaatcagtggggctgtccactccccagccctcgtctgtgagaaggctggtcgattcaagctcagtaaggcgcagcacaaggaggcgggtgtcctgagtcatgctggctgtccatcggagtgaatcgccatgctccccatagagagagcatgctggacatgttagcctataggcccctcagttgttgttattaagtttattattagtcaattgtacctcggccgcgaccacgctactgttaacaattactagcaaaagagatcatgcgttgcaccaggagagaaattccacaggcccctaactcaataaccatgactcaaacccccataggtaggttcaggttctttatttcaacacatggttctcatctgtgttgacaatcacaacgtgtttgaatgccctcaatctt

SEQ ID NO: 10933 - DNA, 1083 bp, Triticum aestivum
  Clone ID: PAT_TA_10933
ggctgcggcttaccaagcgccatcgcctggacagatcaggccaccgtcgactgctagccggcgcaccgacgacgagcgggccgtcgtcgacagctatccttcagagatagcaggccatggatccggcaacgggcgccatggcctccctgcttcccaagctagttgagctcctggacgagaagcaccggctgcaagcgagcatcagggaagacgtcaggtatctctaccgagagttgcagaggatgcagactatcctgactatcctcctggtatctcaaccgtggcacccgtaccagggcgccaggaagctctgggcagatgacgccaggaagctgtcctacgacatggatgttgtcctcgacaagctgctggtgctcgcccccgactcgcaaggctttaaggggctcatggagaagatgagcagcttgctcaacaaaggcaagactagccaccagatcatgaccagcgcaatcaggaccagcaaggctcgagtccgaatgatggccgacagatgtcaacgctacgggatttatgctgctgttgattatagccttgcagccatgaccagcgttgatcctcgtctcatggctctgtacgcaagagtgccagatcttgtcggcattgagggggaaaaagatgaagagctcatcaagttactgtcacatggggacaacgtgtccatcagaaacctcaagatagtctctattgttggatttggaggatcgggcaaaacaactctcgtcaaaacagtgtatgacaagatccaaaagagttttgaccgcaaagcatttgttccagctggtcagaatgctgacgtgaagaaggttttggcgggcatcatcgttgatctcaccagaaattaccccaacaaactgaaccaaaaacagctcatcgaaaaacttcaggaaatccttgagaacaagaggtacacatcccttagcaaattacattcacaatcttacgctggtgtttttccttatggtcggtatgcagttcaagactaatagcgtgtaaattataattttacattaattaatgaattcataaatactccttcgtaaaaaaaatataagagcgtttaga

SEQ ID NO: 10934 - DNA, 709 bp, Triticum aestivum
  Clone ID: PAT_TA_10934
cgtcgggacagaccgatcaagaagagcagaaaaagtacaacaaaagataccatagcgatgggagcggcggtgaaccgcgcgagggaggaggagccgttgtcgctggcgctggcgctcaccacggactcggcggcgtcgtccaccacgtcggcagactgggccggggggccggcggctcccaggaagagggcgcggcggggccgagtggtggccacgtcgggggagggggagttcgtctgcaagacctgcggccgcgccttccccacgtgccagccgctgggcgggctccggaccagccacctgcgcggccgccacgggctggagctcggcgtcggcgtcgccagggccatcaaggagcggaagaagcaagaggagaagcagcacgagtgccacatctgcggcctcggcttcgagatgggccaggcgctgggcggacacatgcgccggcaccgggaggagatggcgctgcgcggcggcgacgacggcgatcagtgggtgtggcgcggcgtcgggctgccggatcaggaggcggtggcgcaccaggccgccgccaattacgagccgcccgtcttgctcgagctgttcgtctaggtagctagctggatctgctagtagttatacaatttcttgatggaggaaatcacttgtaaatgtctttgattaggatgatattatgagatgtaggttaattgttgggcattgtaattac

SEQ ID NO: 10935 - DNA, 674 bp, Triticum aestivum
  unsure (1)..(674): unsure at all n locations
  Clone ID: PAT_TA_10935
ggnctgcaggnaattcgcaggctcccagcacaaacaactgctaagcccactttgatggtgaatcgagccgttttgccgcagcaccatcgtcgacttgtagggatcaagggccagcgtcaacgcctttgaaagaaatcgaaggaattagggctactaataattcaggtggtgcgtagatcacaagaaggcgacggttaaggaagatcgaggatgccaaagcagcggcacgggaaacgcctaggcgctcttgagctagagcctcggcctcggcaggatcacctgtaccttgtctttgatgactggtcgttcggatataccatccgcaaggtaaatacgtcgaatcgcttcaatccccccgtgcagcgcttgcctcggcctttcttcaaattggaggcgccgcacgagtctccggagtacttcgcgtcagcctttggcactaggattttgctgatgcatcccagggatcctgcgggtcataacttgtccggcagcttcttccccatgttggacgtccgctcgcggagtctcacctttggccctgggctcgagtttccgattcatcccgtctatctcgccgtcggcaataagctattcattattgccgaagcctcttttgagatgctctacttggatccacaatctggctccgagtggtcgtgggaactgctcccaca

SEQ ID NO: 10936 - DNA, 913 bp, Triticum aestivum
  Clone ID: PAT_TA_10936
attcggcacgagctctcattctcatatcttcaaacctcaagtactcaacacagaggaaagagtcttagcaacagatatggcttgccatcttagatcagttagtttgccttctaggcctcacaccaaggttgaagaggagctgcacagcctagaggcaagcatctcttcaccctccatgaccatcgagactatctccgatggtttgaggaggcttggagacatctacagcaccattgaagagatcatgtgccttcctagcaaccaaatttgctcttcccagcaaaggaagatgttggaaggtgaaaccgagtgctcccttgagctactagatctctgcaatgctatgtatgaggacttcaccgagttgaaggccattatccaagatctgtaagtggcgaccagaaaaggagatgacaccgttgttcaggtcaagatccagtcttacacccgcctggtgaagaaggcgaagaaacatttcaagaaggccgcgaagaaggttacatccgacaaggaggactgcaggatggtcaggctgttgagcgaggctagggagatcaccacctctctcctcgagtcaacagtacacctcttgtccaagcaaatcgcagtgccaaaatggtctctcgtctccaaagcattccagaagaagaactcggttgtttgcaaggaggagcagttgcaggtcctagagtgcagtgttggagatcttgaggctggagcaggaattctgttccggagattggtccagagcagagttactctcctaaacatccttagctcatagatacactcaacatcagctactcttgcactatgcgattggcttccaccttttaaaggattgctgatctttcccagtgtgtgtgtatatgtagaattgtacagaatacttcatacagaaaggaaacaaaag

SEQ ID NO: 10937 - DNA, 644 bp, Triticum aestivum
  Clone ID: PAT_TA_10937
gctgcgagaaaacgacagaaggggaggggagagagagagcacacatggaacccaccagtaagtgaaggcgaatagtactaaacataatattacatgttatccattaattaggctgtggtaatataaaaacattatgtgaacaaagggggtacaacaaacattgctattctacgtatgttgcctattgacgtgcggcttgaaggcccggtcgcatgttcgatcctcgtcctttattttttaatttgtatatgggtccaaatttgtttcatgacatgtgggcccctcggtgtgtagtttgtagcactttaatttgtgggtcaaaatttgttccattccaagtggactatcggtgtgtagttttgtagcttatttataataattaaagagaacaacatagttttttcaataataccatggtgcgacgttgaaggtgagaaaggacgtgcgagagactgatgacccagccagagggaaatcaactaggggagttgcgtgggttgcaacggtgtttggagtagttgtgggccgaatgctacgaaaatattatctaaaccgaccggaataaatgcctacacaaattaatccaaggttggagtgcccctcggaatataaattgcccctgctttgcgagggatggagaggta

SEQ ID NO: 10938 - DNA, 648 bp, Triticum aestivum
  Clone ID: PAT_TA_10938
cgcgttcgcacgcgtggggcctcgaacccttgctcgactgcgactgcgattgcgtcccggcggtagccgctgccgtccggccgcgctgctatggcgagttagacgtcgcggccctcattgatccccgttacggatttccccttcttccccggggatcccgcctgccctaccaccgaatcgtgctgctccattgccttggaaggtcgccgccgccgccgcccgttcctccttccgtcacaatacaaggtgatcaatggcgtcaggtgcacctggtatcatgctccgacacctttccaaaacacttgctgtaagcccagcagtggcatctggtatgaccagccagcatcaccagcttcaacagcgtgcaccagtgggtggcacatccaaaggcaaggctaagctcaaagccggcctgcctttgaagcgcagcgtcatagcaaagaaggggggcgcgcctgccactgctgggagcggtggtgctggccgtggtcgtcgtgaagccattgagcgcattactcagattgcagagtcttgtctgaagtcctctactcctctacggcacttgtcccccaaggagtgtcttcgcgaggcaaaacgtgaggagcttggactcatctccaaggaacgacaacgtgaacttgatattgc

SEQ ID NO: 10939 - DNA, 620 bp, Triticum aestivum
  Clone ID: PAT_TA_10939
cgtccggctcctcacacctggacagtcgacagggaggcgcacgcgactcactcactcacctcgtctcgctcttggagctctcaccagcgcctttctccccccaagcaatggccaccggaagtaatagccaagacattagggcgagccccgagctaccgaagcaactgccctttgactttctgaagaaaattacaaacgatttctctgctgagcggaagattggtggaggtccatttggaagcgtttataagggagttgtgccagatgatggcagagtgattgcggtgaagaaacttcaggaaaacgcgccgatgccgcctgacaagacattcaacaacgaggttcagaacattatggcgctcaaacatgaaaacatagtcgagttggttggattctgctgggaaacacagaagaagctggtgcagtttgatggaaggtatattcaggcagacatcactgaaagtttactctgctatgagtatttacctaacgggagtcttcaacagaatctttttggaacaaaaacagctgaggctgtctcttcagctgaacctgctatcgattgggccgcacgcttcaagataatcaagggaatttgccagggtttactatttctacac

SEQ ID NO: 10940 - DNA, 795 bp, Triticum aestivum
  Clone ID: PAT_TA_10940
cgtccgcccacgcgtccggctcgcctctcccttcgtcgtcctcctcctctcaacacaaccgcgtgtgcggtgctctcaacaagcaatggccaccggaagtaatagccaagagattaggccgagccctgagctaccgaagcaactgcccttcgactttctgaagaaaattacaaacgatttctctgctgagcggaagattggcggaggtccatttggaagcatttataagggagttgtgcctgatgatggcagagtgattgcagtgaagaaacttcaggaaaacgccccgatgccgcctgacaagacattcaacaacgaggttcagaacattatggcgctcaaacacgaaaacatagtcgagttgcatggattctgctgggaaacacagaagaaactggtgcagttcgatggaaggtatattcacgcagacatcactgaaagtgtactctgctacgagtatctacctaatgggagtcttcaacagaatctttttggtatgcaataaacatatccgacatttgcatttctctttacatttccatctttggagctagggcatcacctttagcttttttacattatttatttatctatatgaccctttagcattttgcgttcatatacaggaacaaaaacagctgaggcagtctcttcagctgaacctgctatcgattgggccgtacgcttcaagataatcaagggaatttgccagggtttactatttctacacaagttggatattcccattattcatatggatctgaagcctgaaaatatattattagatgaaagtat

SEQ ID NO: 10941 - DNA, 759 bp, Triticum aestivum
  Clone ID: PAT_TA_10941
gcgcctctcccttcgtcgtccctcctcctctcaacacaaccgcgtctcctctcctctcaacaagcaatggccaccggaagtaatagccaagacattaggccgagcccggagctaccgaagcaactaccattcgactttctgaagaaaattacaaacgatttctctgctgagcggaagattggcggaggtccatttggaagcggttattacggagttgtgcctggtgatggcaatacgcctgctgtgaagaaacttcaggacaacgcgccgatgccgcctgacaagacagtcaccgacggggttcagatccttctggcgctcacacacgaaaacatagccgagtcggttggattctgctgggaagcacagaagcagctggtgcactccgatggaacggatgttcaggcagacatcactgatagtgtactctgctatgagtatttacctaatgggagccttcaacagaatctttttggaactaaaacagctgaggctgtctcttcagccgaacctgctctcgtttgggccacacgcttccccacaatccagtggcttctggaggatctagccaatctactagggttggctattcccacccgtcgcagctatccccagcctgtctgtagatgattgcatgcgatttcgccgctgagcggaagattggtggaggaccatttggaaacgtttataagggagttgtgccagatgatggcagactgcttgcggtgaagaaacttcaggagaacgcgccgatgccgc

SEQ ID NO: 10942 - DNA, 647 bp, Triticum aestivum
  unsure (1)..(647): unsure at all n locations
  Clone ID: PAT_TA_10942
aatgagcatttgttggaattcgcctggnggctggccaatagcggatacaccttnttgtggaacgtacggcctgaccttgtcaagggccacgacaacgccgtacttccgccggagttctccgcggcgacggaggggcgaagcatgctctcgacatggtgcccgcaggagaaggtgctggagcacgaggccgtaggggtgtttctcacacactctgggtggaacactcgtcgttggaaggcatctgcggcggtgtgccgatggtttgctggcccttcttcacagagcagcagaccaactgccggtacaagtgcaccgagtggggcatcgggatggagattggggaagaggtgacgaggaccgaggtcgaggccattctgcgggaggccatggagggggagaaagggcgagacatgcgacgacgtgcgctagagctccaggagagcgccgttgcctcagcgcggcatgacggaaggtccatgcgcaatgttgataggctcatccaggagatgatgctggcttgacacaagcaaactggtaaataataaacggttgctggttgtgtgcatcgtaacgatgcagatgccagtgttgtcatttttttcgtaatgatgcagatgccagtgttgtcnttttttcaaaaataaata

SEQ ID NO: 10943 - DNA, 929 bp, Triticum aestivum
  unsure (1)..(929): unsure at all n locations
  Clone ID: PAT_TA_10943
agcatgtatcgatgcaattacagagcaccagaggcttaacgctctgatgaagggagagcttataaaaggcttgctgccacagagtagtgtccgtgctgattatactgttcacagagttcaagaacttgctgaaggaacgtgcttgaagaattatgattacatgggctatagagatggctatggtaaatcagagaaaaaatggaccagcgagctgccaactgactcacaccttcttctctacttgtttgctgcttttcttgaacatccaaagtggatgcttcatgttgatccaacctcctattctggtgcccagtctagcaaaaatcctttatttctaggaatcctcccaccgaaagagaggtttccggagaagtatgttgctttgatatctggcgttccagcaattattcacccaggggctcttgtactggctgtgggcaagcagagtcctccaatttttgctttatactgggacaagaaactgcaattttctcttcagggaagaacagcactgtgggacgccattttgcttctatgccaccaaatcaaagttggttatggcggtattgtcaggggcacccacatcgggtcttctgccttgaacatcctttccgttcttgattcagacatggagagctgaagaagggctgcctgctcgtcgggaggaaactgttgtagcttgtagtactctgaactgaaggagataaattatgaatatcccagttactggtgcgaccttgttatcaacaccagcaatgtctcgaactaacttagtgttagaatgcggtatggcctagtcgagcggacacctgatatttatttctaagttgtatcttaaatcgctgactgttcaaactnccttaatgtaatgcttatgtgcttgaatttcctactacatcatcttcctatcgagagggaaaaaaaaaaaa

SEQ ID NO: 10944 - DNA, 722 bp, Triticum aestivum
  Clone ID: PAT_TA_10944
cggcccgccggccgccgccccgccggcggcggccgccgccgcggcggccgccgcgctgccgttcccggggagccccttcacccgtagctcacccccgtcacgagttcacgtcgcctcctccaatcccatgcccgggacgcccgctcccaggagcctgcccgttccctgccggcgtgcgccactgcgtcggtggcccccccccggccgcgcgggccccggcgacgccgcgccggccgccccggcggcggctccggctgatgctaggcttcctagaaggcgcccgcgtgggagcttgcctggtccgttttctggtgctaggtctgagccttggacagaccgggtggcctacgggggggcctctgtttgtcgtcccggcgctcggcgccgcgcggggcgccaggtggttcacaagcttggcctcattctcggccttgtcctccgggatgaccttcgggtggacactggggcggacgcctgtgctggagtctgtcttggaagccggccttgctaagtttcctttaaatatactaggtttgagttttgactacattgactatttgaaccttgtagactgcttatattgaacagtatttgtgcattgaaatagcagcttactcagttcataacttggtttgtatgcactcaaattgtatcacaattcacgataccagattaccttattgttaccaaaattgatatcgttatagaaaaacgatacattg

SEQ ID NO: 10945 - DNA, 483 bp, Triticum aestivum
  Clone ID: PAT_TA_10945
cgtccgcggacgcgtggggttttcttcagcatgaacatcatcttggtcggcctattaaccaacgcgtccggagccttttgatggatttcctgtatttttttgggaatgtgtttgatccacgccatatgcgtatttccatccaaggaagtggaatttatttgaaccgagaaagagggcacagcattgatccaattcatattgatgaccctctttgccctgctaacaatgtgggccggaattgcttccggatccaccaatgcatcaaggcttttgctgatgcttttgcagttctagagaacgagctactacagttcactgcagaatgtaacgtgcctgcatcatcatttagcctactgaagaaaataattcccaagtattgattctaatgagttgtagcaatgaaaagaacctgtgagtccacaagctacaggaactgttggttggaattgcctctgcttgtgttctagacacttaagtactact

SEQ ID NO: 10946 - DNA, 697 bp, Triticum aestivum
  Clone ID: PAT_TA_10946
gcacgaggcttcgttccttcctcccctctcaaaaagttcagcctccacttcccctcctcgtcatcttcctcgcagctgcgcttctcccaccacacccgccaacacagcttggcggcccccgcgtccggacctcgagcgagcaagcgcgcaaattccattccagggtttcgcttcgatcagactaggtccaatcgagccagcgcgcgcgggccctcgttagcggccgtgccggatcgattccaagaggacggccgtcgccggcggcggcggatcgaggcgcggagtctctgcgaagagcagcgccgggggctcggatccacgcgctcggaggagctcatgaggcggcctgccacctgtggatctcctggttccgcctcggcctccggttcgggcctctgctaggcggccggggcctgcgacggatcgcgcgggcggtgaggaggaggctgtggcattggagggtgagcggagatggtgagcggccacctattccactgccgtaagaattcgtggccgccggaggagtatgtgggccggaccgccctgcaactgttggacttggacggcgggtcgccgccggagcaggcatggcggaggaggttgaacagtcacgccaacctactcaaggaattcagcgtcaccttcatggaagcaatgaagatgatgaccctcgggatgaggctttggtcatatgtcc

SEQ ID NO: 10947 - DNA, 579 bp, Triticum aestivum
  Clone ID: PAT_TA_10947
ggcaacatcaagtatgcctccacctgcgccgtcgtcgcctccatggcctccatcgtcctcggctacggtacacatgttgacattatcacctccacgcctgattctgtctcgcgtttggctatatgaagtgtttatttcgtggccgccatagacaccggtgtgatgagcggggcgtcgctgtatatccagaaggacctcgagatcacggacgtgcaggtggagatcctgatgggcatcctgagcatctactccatcatcggcacattagccgccggcaggacgtccgactggatcggccgccgcttcacggctatctttgccgccttcttcttctttgctggtgccttgctcatgggcttcgcaagcggctacaccatgctcatgctcggtcgcttcgtggccggcatcggcgtgggctacgccatcgtgatagcgcccgtgtacacagctgagatcgccccggcgtcggcgcgccggcttccttgtgtccttcacgggggtcttcatcaacatcggcatccttcctcggctacatctctaactaccccctcgctcgcgcttggcggttcaacttgggtg

SEQ ID NO: 10948 - DNA, 935 bp, Triticum aestivum
  unsure (1)..(935): unsure at all n locations
  Clone ID: PAT_TA_10948
ctccgccccggntctagccgtcgagcgatggcctcgacgagggatctcgccatagcgtccatctccgccgccgcaggcgccgtagctgccgcggccgcggttctatactcttacacggcaaccaacgccaagccccagaagccggccccgcccccgccgttcaccgagccactccccgtcaacggctgcgccgccaggcatccgccagcgcaggaccccttcaaaaccacgaagagggaagggttcatctcatgggacgactacttcatggcgattgctttcctttcagccgagcgttccaaggatcctaaccggcaggttggcgcttgcttggttagccaagagggcattatcctaggtattggctacaatggattcccaagaggctgttcggatgataagcttccttgggcaaagaaatctgcaagaggggatccattggagacaaaatatccctatgttgttcatgctgaagttaatgctattttaaatacaaaccatgcttcagcggctggacagaagttatacgtcaccatgttcccctgtaatgagtgtgctaagattatcatccagtcaggtgtatctgaagtcatctattttgtagagaaaaggatcgacaactcagatcatgtttatgttgcttctcacaacttaattatcaatggctggtgtgaaggtcagggagcatcacccccttggggcacattcacccatcttccttcaggagccaagggtctaatgaatgaactgtgcgcccttaggtaatgcaaatgtgaaccaatgccttaacaattatgtcaatcattcaaaggttgtcatgctgggttatatactcccccaggggcctagctgttgtaatattgtaatcagtcgaattactaggtggagagaaatttgtatgtgctcagcatcanaaccattcttctgtaaactgg

SEQ ID NO: 10949 - DNA, 1785 bp, Triticum aestivum
  Clone ID: PAT_TA_10949
gcgcagagggtggaactccgcactgcggcgcgcgctcgcctcgcctctgccgggctgctgcgttcatcacaaccaccacgccagcgcagggccctcccccatccaaaccatctccacactcctctcgccaggcccccgccgtcgactccacactctcaacgtctcggccgccgcgacgggggcggatggcgacggcgagcggcctctccggccctctgcagctcctctccttgcggcggacacccgccaagaacctctcgccgcggagagcagccgcgggagctctgtcaggttcacttattgtgaagagattttctttatgcaacgggagaagtcatcaccaatttttaccattgaaacaaaggggaaggttgcaagcagcagaaatacctgttactccaccactgattgatgatgaggaaaaacggagtcaactctctcaagactatggtttcaatcaaattggagaacagcttccagataacattactcttaaagatgtcatggatactctgcctaaagaggtatttgaaatcgatgatgtaaaggcttgggcatctgttctgatatcagttacttcatatgctttcggtcttttccttatctcaaaagctccatggtatcttcttcccgttgcttgggcatgggctggtacagcagtgactgggttttttgtcataggtcatgattgtgcacataaatcattttcaaggaataagctagtggaggatatcgttggaactctagctttcctgccattaatttacccttatgaaccttggagatttaagcatgacagacatcacgccaagacaaatatgttagtagaagatactgcatggcaacctgtttggcaaaacgaaattgaatcgtcttctttcctaaggaaggcaattatatttggttatggtcctatcaggccatggatgtctattgctcactggttgatgtggcactttgatctaaaaaaattccggccaaatgaactccctagggtgaagataagtttggcgtgtgtctttgcattcatggcaattggatggcccctaatcattcttcaatcaggaatagctggatggttcaagttctggttcatgccatggatggtttatcacttttggatgagcacctttacaatggtgcatcacactgctcctcatatacctttcaaatcatcaaaagagtggaatgctgcacaggcgcaattaaacggcacagttcactgtagctatcctcgatggatagagatcctttgccatgacataaatgtacatgtcccgcaccatatttctccgagaattccaagttataaccttcgtgctgcccacgactccattaaacagaactggggcaagtatatcaacgaggccagctggaattggcggttgatgaagacaatactgactacgtgccatgtgtatgacaaagagagatactacgtttcttttgacgagctcgtacctgaggaatctcaaccaataagattccttaagaagttcatgccagattatgcttgatgcaattgctaccattgactagtcagagagtatttagacattaagaacaatcacaaccattattacactacaaaaggctcatcgcagacggctcaggcatggcttttattgtgagccggcagggatactccttgttgcagatggcttttattgaaagccgcctggagttttaccttttctcttaaaaaaaaaaaaaaaaaaaacaacatataacagtatattataatgtcatatattaaacatgcaagaggaaacagcgtatgttttc

SEQ ID NO: 10950 - DNA, 731 bp, Triticum aestivum
  Clone ID: PAT_TA_10950
ccggtgcaccgggcacatgtgcccgataagggtgcactggcacgtcaagaagagctacaccgaagtactggcgggtgaagctgtcgatcaacaatttcaataggttcaagaactacaagtgactggaacatcgtcgtccagcacccgaagtctacaggaagttgacccaagttttcagcttcgcctacgagccgcttgtgcagcgcggcacgatcaacgacacaggcctcttctgggggctcccacgcttcaaccagatgttgccccaggatggtactgtgcagacagaggtcctgctgaggaagggcaaggatttcagcttttctggtgggtgggcactgcctagaaagatatacttcgacggcagcgagtgcgcgatgccgccaccagacgacttcccccagctgcccagcagcagccctgttcagcgcttctcaggagggcacaggtggctggcctcaggggccgtcttggtgcttggacttctgctgacttgagcagctctggcgccgcccccgggaacgagacgtcatcgacatcttcattgcaggtcttcgggcgatggctctctgcttggcgcctccacttcctccaccacctccagagccggattaggcacttgataccgacgcgctgaggcatggcaaggccacttgaggcggctcccttggcatgtgcctcctttttttgaaccctattgtcctatgtttgtgtactctgtatgtgtggtg

SEQ ID NO: 10951 - DNA, 333 bp, Triticum aestivum
  unsure (1)..(333): unsure at all n locations
  Clone ID: PAT_TA_10951
gttccctgtnccgatctggtcgcctgtatcccgctctgcttgcggctcgcattgaccaaggaggccagcgtcttgtccatcctcggcccacctgccgcgggtgggtaaggccaactgacttgccccagcctaatctgccacaaccacctccagggcgctcacgaggctctcgccgcctagatcgagaggatccctctcccctctcttctctctgtgtgtgtttccagtcaatcatgttgggttaaattcgtttttgtctctggtgagaattttctgtaaattattgtaactgatgaaaatcaaataggggagcgatgtgggacaaaaaaaaaa

SEQ ID NO: 10952 - DNA, 899 bp, Triticum aestivum
  Clone ID: PAT_TA_10952
gcgcgatggccactcgtttgcagcgctagctacgcactaggctgtggacaacccaaaccccaaccccaacccagtagatccagattcctgtcttgcagtcgcagctcggtaaggaggaggccagcgccatgtcggcgctgttcaacttcaacctccttcctcatagtggtgctgctggtgatctgcacctgcacctacatcaagatgcagttccctgccatcctcaacgatcgcaccgggttccgtggtttcttttggaaagcagcctagaataggtgagcggtttaggcccttgggtggcatttgggtgcatcttggtgggggtatccaccattcttcttctgaaggcccgggcaatcatgtccaaggctttggcaatcatgttccctagatgttaaatataggaaggtcatgtcacactgtatttctgttcatgcctccagagaagccttctgcttcagttactgttgtgggcgaaagcggcctcttaataccgagcatgcagggtatgatgaatgctcacacggacgggtgcacttgccgatgcagacagacatgacgattgtgtttgcaaatgcaaggtgcaagaagtttgctatgaaatgatggaggaaaaaatttcacaactaaatgtttgtttgggtttatgtaaagttgtgtagaatgttgttcgggaatcctgcaaaaccgattgtggatttctcgttatatacctatttcgtctctcaataaaaaaaaaaaaaaaaaaaaaaaaacccccgccggcaacaaccttaatccttgtgaaatcacagtggattgagttctaattgccccgggatcctcccacactgcgcagtccccatagggaaatacagtggtatcttttgcaagaagtttagtcaacgaatggaaccctt

SEQ ID NO: 10953 - DNA, 668 bp, Triticum aestivum
  unsure (1)..(668): unsure at all n locations
  Clone ID: PAT_TA_10953
ggtggcgctatgaagacctcgacgcctactgccgtgaccacaaccacaacaactgcgccggtaagaaaggtactaactatatataaatcccctagctttagaaacgttggcatcttttcttatgcggtcaacccagaccatcaagaacaatcatactgcacactacattgtttggacatgtgattcatatgatagtaacgatttataatatgagccagacatgggtgcagtggctagatagcttcagaattcagactttcagttcctggaagctcgactctgcttcgttatttcataatggaaatgcaccagttgtttggtgcagtctagctcttcattgagctggtgttttttatatgttgctcagtgataatttgtacgctgtggttaatttactagatgaactgcacacctagaagcagcactatgcaaagatccatcgcctcgactgctcgctctgcaaagaaccaccgtctcgactgctcgcgacgcccgtgtgtggttggtgctgcgctagcggtggagtgccatgctcatgcgtggtgcaagcagcggccaaagcctcatcggccgctgcgagtacggcgttggcaccaggttcatggcattgtaaaaaagaaatctnattcaagatcaatggaaccttttctactgtatatacaatcnac

SEQ ID NO: 10954 - DNA, 590 bp, Triticum aestivum
  Clone ID: PAT_TA_10954
ggcacgagggcaacacacaagtaacacacgggagcacagatacgttcggccataccgaagatggctaagcttgccgcattggctatggtagcgttgcttggctgcgtggcgcggacgtgccacgcttcagggtatggtgggtatcccagcccgggcacgccttagcagctaccctccacctccacccagcccaacgccaaccccgcctagcccgagccctcctcctgctgcgccggcgctcgcgatcggacactactacaagacatgctacaaagctgaacagatcgtgagggattcagtgagaaaggcggtgtatgccaaccgcggcatcggcgcccggctcatccgccttttcttccacgactgcttcgtccgggggtgcgacgcctcggtcctcctcgacccgacgccggccaacgctcagcccgagaagctcggcatccccaacttcccgagcctgcgcggcttcgaggtgatcgacgcggcaaaggcggcgctcgaggaggcctgccctggagtcgtctcgtgcgcggacatcgtcgctttcgctggccgcgatgccactttcttcctcagcaacgggagggcgt

SEQ ID NO: 10955 - DNA, 622 bp, Triticum aestivum
  unsure (1)..(622): unsure at all n locations
  Clone ID: PAT_TA_10955
ctaccttcccgggtccacaagacgacagaaaggtacggctgcgagaagacgacagaaggggggccgtcaaaatggtgaatgttccgaagaccaagaagacctactgcaaaaacaaggagtgcaagaagcacacacttcataaggtcactcagtacaagaagggtaaggacagtctgtctgcccagggaaagcgtcgttatgacaggaagcagtcgggatatggtggtcagaccaagcctgttttccacaagaaggcaaaaaccaccaagaagattgtgctgaagctgcaatgccagagctgcaagcactactcccagcgtgccatcaagaggtgcaagcattttgagatcggcggagacaagaagggcaaggggacatctcttttctaggctgctttcacctatctggagtggtggtggtcacgaagtattactacttgtgttaagggttcgttgttaggagttaaattaatcagaccttgtcatgtatccaaactcctgtgtcttgcatttaagcaagaggcgagttttggctaagtgaagttttgtagcttgaatcctctttcattccgtataatgtcaatcaactaccatggtgttaaaatgtttcaaaaaaaaanaaa

SEQ ID NO: 10956 - DNA, 853 bp, Triticum aestivum
  unsure (1)..(853): unsure at all n locations
  Clone ID: PAT_TA_10956
gccggccgggttgggacgcttccgccgccgccgacgccgacgacgacgctaaccgaccgagcgcgagcaccgcaccagccgcggggccggcgccggcgccgacggcgaagggaagcacgccggcgccccctcccccccgccgccaaaatggtgaacgttccgaagaccaagaacgagactcctaccgcaaaaacaaggagtgcaaggaagcacccacttcccaaggagacctactgcaaaaaggaaaggagcgcacagacagcccaggcgttcatcgtctcactgccagtacaagagagggggaagagagaggacagactgacccagggtaaagcgtcgttatgacaggaagcagtcgggatatggtggtcagtaccaagcctgtatttccaaccaagaaggcaaaaaccaatcaagaagatttatgctgaagagtgcaagtgccagaggctgcaaagcactactcccagcgtgccatcaagaggtgcaagcattttgagatcggtggagacaagaaagtgcaaggggacatctcttttctagattgctttcacctatctggagtcgtgtcggttctcaagaattattactacttgtgttaagcgtttgttgttatgagttaaattaatcagaccttgtcatgtatccaaacccctgtatctcgcatttaagcaagaggcgacttttggctaagtgaagttttgtagcttgaatcctctttcattccgtataatgtctttattttaaaaaaaaaaaaaaaaaaaacgtcgctatgtaagaaaaactgagtccctctggccttgagaatcccttccactgctanacaaaggcgacattcctcaaaattgaggta

SEQ ID NO: 10957 - DNA, 587 bp, Triticum aestivum
  unsure (1)..(587): unsure at all n locations
  Clone ID: PAT_TA_10957
ggagttcatgccaggcgccggcagcggcagcatggggctcacccncggcgggatgatggtctccgaggggatgcacatgcnccaacaacaaagaagcgacgtccaccagggcggcgacgagctgtcgggcgtggtccgggccggcgcgtccgggagcggcggcggcggctgcaagctgaactacccgccctacaccggggcgccatcgtcatccgcggcagccagcaccgacatgccaccggacggagcctcccggagcagccgcggcgagggcctagacccatggctttgtacatccgagtagtgaagagaaagagaaaggtgcatgtgatgttagccgctctctgattaatttgctccccgcctccatgcatcacaaacaaccaaggtctggttaatcatctttatttagtattacaccttttgtttgttacttattatcgcttctatctccgtcaccatcgatcggccttgtacatttaaaacatcatctttggttcgcttctctcttagatattactactacacatgtgcaaggagagatagagtaatggtgcaattacagacattgatttaaaaaaaaaaaa

SEQ ID NO: 10958 - DNA, 591 bp, Triticum aestivum
  unsure (1)..(591): unsure at all n locations
  Clone ID: PAT_TA_10958
agcacgaaccctcctactcttccaaacccgggcattttcccttcccctttcgagcttcccatggccgacggcgagccggaggcgccggcagaggataaacatccattcccggaggcgtcgtcagccgatatggagaagcacccgccgccggaagcccccgaggcgtctccggccgagacgaagccagagaagaaggcggtgacggagacgcaggtgaaggaggtgagcaagtcggggccgaaggagatagagaaagaggtgaaggtgacagtggagaaggagaacgaaaatgtggagatcgaggcgacgctgcggccgaccggagctgggacggaggctccccccatccttgcggtgccgatgttggccgtgccgtgcttcatagctcctccagggtttgcgggccagtttgcaatgagccatcaagcagctttggcaagtgttacagctcaggcacatatacaattgcaatcaccagccccatctgcatattcagaagggctgccgagtccatttccacatcctataacacctaaagctattcggncactgcagcaagcaccatcagtaactcaaggaagtattggaaga

SEQ ID NO: 10959 - DNA, 450 bp, Triticum aestivum
  unsure (1)..(450): unsure at all n locations
  Clone ID: PAT_TA_10959
gcccgtcctcgccgctgggtcttccagcttcagcagcgcgcgggagatcaaggacgccgtcgccgtcgctgtcgtagcgttccagaggcagcgctccgtcgcgtccacggccgacggcgagaaggacgtccaaggctcgccgacgccgagcgagctgtccacgtccagcgatttgctggacgagcactggtttggcggcacggatgccggatcgtactactcgccgggcatgttcatggagccgccggagcggcctggaaaccgcgagctcggtgccggcgaggtcgagacgctgctatggtaaagtttatagttggctctgcacttctgtcccaccaaatatgggaagaaacagagggcaatattttccctcatatggtcatgtgtgttcgttcatattgaaagcctccggtttctactttgaggaagggcatatttgcnnaaaaaaaa

SEQ ID NO: 10960 - DNA, 754 bp, Triticum aestivum
  Clone ID: PAT_TA_10960
ccacgcgtccggcggctcgcccctcccccggtcgatagctctcctcctctctcgtcgtcgtccgcctacaaaaccagacgaggggaagggaagcttctctcctcctcccaccccaccccacccccacccccgtcgctctcccaggccctcccgcctcgccgcgctagcccagggggagctagcatcagcttcccctgctgccgctgctgccgcttcgagtagccgccgccgcgagattccagtggcgggcgggcgcccccaatggacgaggagatcggcgccgccgccgcgccgcagggccagtggaaatatcacaaagctctttccctactagcgtttcagagctttggtgtggtgtatggagacctgagtacgtcgcctctgtatgtcttcaaaagcgcactgtctggactggacaagtacagtgatgaggcgaccgtctttggattgctttcactgatattttggaccttgacactcattccgttgctaaagtacgtcataattgtcttggctgctgacgataacggcgagggcgggacgtttgctttgtattcactactctgcaggcatgcaaagatgagcctgcttccaaaccagcaagcggcagatgaagagctgtcaacatattatcagcctggggttgatcggactgctatgtcctctccattcaaaaggtttctagagaagcacaagaagctgcggacatgtttgcttctttttgttctgtttggagcatgcatggtgataggtg

SEQ ID NO: 10961 - DNA, 578 bp, Triticum aestivum
  unsure (1)..(578): unsure at all n locations
  Clone ID: PAT_TA_10961
gcaaacatttaggcacgtctggttcttctggtctgatctgggaggagaggcttatgcctaaagaccaggaaccagaggaatcaaggggcagctggggaggcagaggtcaacagcttagaactcaaggagctaaggcactcctgtagcatcgggtccaggggaggtgtgcagcgtaggtgcagtgacggtgcagagcgcggtggcatgcccagcaacatcaaccaggcctttcatactcggcatgttccgccagctcttgatccaccttcacccaagtttgctcgatgcatgttctgtggaatttttaggaaggaaggtccctcacaaccttccgaacccagcaggtactagggtggtgcatatacttttgagtgtttgagaatagggatataagacattttatggctgattgaagttcgggtgtatcataataagcatatgtttggttttgcatgaggttatttgaataggtttgcatgtttcattgtgtgcctttgctacctttccttttcttctcagtattatattggaagtgagaaaaaataacatgtncttgnacagtttgngcannnnaaaaa

SEQ ID NO: 10962 - DNA, 329 bp, Triticum aestivum
  unsure (1)..(329): unsure at all n locations
  Clone ID: PAT_TA_10962
acgaggtctactgccgcgcgcgcgatcttttttcctcgtttcttttatgttttgctttgatctgtgtagtgaagtggattaaaacgctcccgtgtcacggctgcatgcatgcagatgcacgtggctgacagcctagctgcgctgtgccgctgtgtgtgtatgtgggtgtgacatgggatcaagattctctctctctctctatctctctcctttctcaatctctctcttacttgctgttactgttgttgtacctctctctctctctctcatnctttgtcagcaaaaggtatagtgttatgaagttcataaaagtactgtgaaaaaaaaaa

SEQ ID NO: 10963 - DNA, 562 bp, Triticum aestivum
  Clone ID: PAT_TA_10963
ccacgcgtccgcccacgcgtccgcccacgcgtccgctcacataggctcggatccaatgtgagccagcgcgttattagcacagaccaacttcattcagttcaagtactcggcatgcaccaaactctggtgagactagtagggatagtaggctgcagcttggtaccatctcaactctatagagcggtttgctggtactcggcatgcaccaaactctggtgagactagtagggatagtaggctgcagcttggtaccatctcaactctatagagcggtttgctggctggctcatggcgaagggtcctgcaactaactgaaaagaactgactaacaggctcttgtatatgcgtctggtaatgtataatggaaactgacatccgacctatttgtagccggtctaggtctctgtcggctgagttcttgtatcgagtctgactgcaactttttttcccccggtaactttgcggtgctgtggtttctctttgtttccgtgactccggttgttgtaaatgccagtttcacctaaagaagagctctgtttgatttcaacatctctgttgtgct

SEQ ID NO: 10964 - DNA, 702 bp, Triticum aestivum
  Clone ID: PAT_TA_10964
tattaatgcatcacatgctaatctgaaagcacggaagcgcatgaactctgatcaggggtcataccactatgtgaacccaaacccattgaacatggacttcctagcacacattgaagaatcttgcaagattgttacatcgtcgtatggagtattcaagaggaaagcaagagaacagggatggataatgtctgactcgctactgaacccgggccgtgctcggctgtgtggagtagcaccacagtgatataagcattatcatttgtccaacaggataagatatttctttcatacattggatctgagcctatgtgagccagcgcgttaatagcacttcattcagttcaagtactcggcatgcaccaaactctggtgagactagtagggatagtaggctgcagcttggtaccatctcaactctatagagcggtttgctggctggctcatggcgaagggtcctgcaactaactgaaaaaaactgactaaccagctcttgtatatgcgtctggtaatgtataatggagaccgacatccgacctatttgtagccggtctaggtctctgtcggctgagttcttgtatcgagtctgactgcaacttttttcccccggtaactttgcggtgctgtggtttctctttgtttccgtgactccggttgttgtaaatgccagtttcacctaaagaagagctctgtttgatttcaaaa

SEQ ID NO: 10965 - DNA, 2142 bp, Triticum aestivum
  Clone ID: PAT_TA_10965
ggggcggcggcggcggcgacggccacgcagaccatcacgctgcccccgcaggggtcgccgtgagggacgcggtgcgcggcgccgtcagggacgccgagctgcccccgagggcgccggcgatgtcggcgcccgcgcccgcggccgccgtggacggggtcctgtgcttcgaggaggcggaaggcaggcggtggagctacgtcgtcgagggcgccgcgtcctccgccgggaagacggggagggtcagcgccagggccaggggcggctccgccgcgccggtgggggccaccttcagggccgtgccgctccagtccccgctgccgcccgccgaggaaattatgtccttcataaggtcatatgttgtgcctgaaggttttccagacagcgtgactccttcatatgttccatacatgacatggagggcactgaagcatttctttggcggcgcaatgagtgtatttacaacaagagccttgttaaactccgtaggagtctcacaaagcagggctacgtctggtgctgtggctattaactggatactcaaggatggtgctgggcgtgtcggaaaaatgcttttcgcgcgtcaagggaagaaattcgattatgacctaaagcagctccgcttttctggggatctcatgatggaactaggagctgggatagagttagctactgctgcgttccctcaacttttcctaccgttggcttgcatggcaaacgttgtcaagaatgttgctgctgttacgtcgacctcaacccgcacaccgatttacaaggcatatgccaaaggagaaaatattggagatgttactgctaaaggagaaagtgttgggaacattgctgatctgttgggtactggtatgagcattctaatgtccaagaggaatccatcattggtggcttcatttgcagtcttgtcttgtggatatctgcttagttcatatcaggaggtgagatctgttgtgctgaacacgctaaatacggcaagattcactgtggcagtggattccttcataaagactgggcatgttccttcattgaaggaagggaacttagaggagacaatatttaatccgccttggaggcatcaacctgtggccataggatcaagatttggagaggcatttcaggaacctgcttcatttgttgctacaaggcctttgttcgaggatgagaggtacatcgttacatataaccctgcaaaggacaaggtttatgctttgctcaaggaccaagcaaagcaagatgacattctcaaagctgccttccatgcacatgtgttgctgcattttattaatgcgtcacatgctaatctgaaagcacggaagcgcatgaactctgatcaggggtcataccactatgtgaacccaaacccattgaacatggactttctagcacacattgaagaatcttgcaagattgttacatcgtcgtatggagtattcaagaggaaagcaagagaacagggatggataatgtctgactcgctactgaaccctggccgtgcccggctgtgtggagtagcaccagtgatataagcattatcatttgtccaacaggataagatatttctttcatacattggatccgagcctatgtgagccagcgcgtttttagctcagaccaacttcattcagttcaagtactcggcatgcaacaaactctggtgagactagaagggattgtaggctgcaggttggtaccatctctactctatagagcggtttgcttgctggctcatggcgaagggtcctgcatctaactgtatagatccgactaacaggctctactctaggcggacggtcatgcatagtaggctccagcttggtaccatctcgccgctgtagtgcggtttgctggcctgctcttgtctatcgcccctgacctttacggtgctgccctcggtaactgtccgctgcgttcgtgtctcgtggtttacggccgccgcttgtcccccacccacttggcgccgctctgggtccccgtcggctccgtgcctccggcgggtctgactgccactttctccccccggtgacctcgcggtgctgtggtttctctttgtttccgtgactccggttgttgtaaatgccagtttcacctaaagaagagctctgtttgatttgaacaaaaaaaaaaaaaaaaaaa

SEQ ID NO: 10966 - DNA, 940 bp, Triticum aestivum
  unsure (1)..(940): unsure at all n locations
  Clone ID: PAT_TA_10966
agagagnanagaggggcatggcggcactgatcactcgggccacttcagtggcgctggtgtccgagatgatggcgcagggccgcaagtctgccgctgccctcgaggccctgctccaggtccaggaccatgccgggatgcgtgagctcaccgctgaaatcctccgctgctgcgaccgcgccctcggcgccctccacgggaaacctgctggccggcataagcgcaagccggcccgccatggcggcgcagccactcagacaaagcccaaaacaaggacgcgcgcgagcagcggagagacgaccagggtggagtggaagcggaactgggacgacgggcttcatgtggaccaagtacgggcagaagcacatccgaggcagcgaccaccctaggcactacttcagatgcgcctacgcgctccacgacggcggctgccccgcctcgaggcatgtccagcgatccccggagcatgaccctcccctctacgtcctcacctacttggccgaccacacctgctgccgccacggcgtcgcggccgccgtcgtgaagaacgtcaagatgcagccgccgctcgtccttgactttgggtcggcggccgcaccgtgcagccgctctccttgttggctcaactacggcgatactgtttggggtgagacctcacgctcgcaggagctccgagctgaggtgaccaaagttgagtcaacgccgtcgtcagacttgctccccgcggtgccggcggttgtggcgcagatgagctcgtcggcagacgacgcccgttgctcctctccccctgctgcatgggacccatcggctgccgattgggagtacttcgtgaacaactcttcggattatgttagagagttcttcgatttggaagacgttgtcttgtaacaatagcatgtaactcctttaccaanagttccttgtgtcgtagtactacgactga

SEQ ID NO: 10967 - DNA, 552 bp, Triticum aestivum
  Clone ID: PAT_TA_10967
cccgggccgcgcccggccgccgtggccgcgccgggcggcgccgcgcgggcggcccctgcgtccggcgcgcgcgcatgccctgcctcgtcgaggagctcctccgctgtctttccgcgggggggccccgcccctcgtccccctcctgccccccccccgccgcccccgccgtccccgcccccgcccccgccgagctacggctcccacccccccccgctccccccctgctccccccccccccatgccctccccggacccagccaccgtgctcgcccgccgccgcgcccctgcggccgcccgccccccgtgcccccccgcggacgcggccaccacgccggcgcttggtacacctggcggggtccccccgccggcggccctccctgcgcatgtcgccacacctcctgcacctggtccccccggcccgttcccccccccctccgccgtcccctcccctcactccttgcccctggagccacgccgcccctccccgttccgcctccccccctgcggcgccgccccgcacgcctgcccctgggcgccgctctggtctacaca

SEQ ID NO: 10968 - DNA, 723 bp, Triticum aestivum
  Clone ID: PAT_TA_10968
gtgcagtgcgcattgggatccgaggcctctttgctctctgcctggccaaggagaacagacagcgcgccgtatcagctggtgccgcatcagctctggcccgccgagtggcggagggcggctgcgtcggcgagctggagcgtgcgctagcagcggtggagcgactgtcccggacagagggtggccgcgagccggcggtccccggcgctggaggtggtgccgcggtggtgatcgcgctagtgcgcgccatgtccgggcgcgccgctgagcatgctgcgggcgcattgttggccgcgatgggcgggtctgaggggctgcagctggaggccgtccgagcaggtgccatgagtcagctgctcatgatggtgcaaggcggctgctcggagcgtgccaaacgcaaggcgcagcacctcctgaagctgctccggtctgcctggccgaccaccgattccatggccaactcggctgatttcctccaaccatactaaccccgcattgcatcccctttctgaatctgaaccaccacggcactagggcggggtggcggtgcctgtatgtaatggcggtagtaggatcataggagagattttctcccctaaagaaaatttcatgaggctagggccgggcagcggtgcctgtatgtaacggtggtagtatgattttattgacactcttgctgtagaaattcatgtttaaaaagtgtacatatacatatgtaccttgttt

SEQ ID NO: 10969 - DNA, 907 bp, Triticum aestivum
  unsure (1)..(907): unsure at all n locations
  Clone ID: PAT_TA_10969
cgtacacagtggggcgtgagggcgnacatggcctgtcagctcgtagatctcagcagggagcttgagccgtatcatgagtacggtgtgtcagaaaccttctaccatccccaacacttcggggcactggtcttcatggatagaaacaagataccatctggttatatcaaggatgatatgttgaccctgcgatgcacgatcaccgtactcaaagaattaccggcgccaaccatcccagctgaagaagtgatcgcccaaccatccaccaacttgcaccggcacctcggcgaactcctgcagggcgagatgggagccgatgtcacattttcttgtgtgcgacgagtcgtttgctgcacacaaagtgcatacctgccgcaaggtctccggttttcaaggcccagttcttcggtgacatgaaggagacgtgctcggcacgcgtggagatcaaggacatggaggtggcggcgttcagggccatgctgcacttcatctatactgacacgatgcctgagtttgatcgaccacttgaggaggtgacgactatggctcaacatttgcttgtggctgctgacatgtatggacttgagaggctcaagctgatttgtgaaataaagctctctattggcatcaccgtcgacaccgcagcgaccactcttgctttggcggagcagcacaattgctccaagctcaaggccaaatgtgtcgggtttatcgtcagcacgcctgctattcttgaggctgtgttgccgacagatgggtataagcaccttgaaacaagctgccctttgatcctgactgagcttctcaagtctgtccatgtgagtaagagttgaagggtagcatagtgcgatactgcatactgcatagtctctgtttgtgcttgcatccatgtgtggtgtagtaaaactta

SEQ ID NO: 10970 - DNA, 672 bp, Triticum aestivum
  unsure (1)..(672): unsure at all n locations
  Clone ID: PAT_TA_10970
gggtcagtcacaataacgcagtcccacaaagcaagtggaagaagcaatggactaatagagtcaaattgttcttcgatggtcctgccaaagccaagaagagacaagaattgagaataaagaaggctaagaatgtcttccctcgaccaaccgaaatgttgagacctattgttagactctccggaagaagatataacagaagagttgctttgggtagaggtttctccgttgaagaattgaagcaagctggtattccactccaattcgccaagactgtcggtattgctattgataccagaagaaaggatttgagcgaagaaagactccaagctaacgtccaaagactccaagaatacaagcaaagagttgttcttttcccaagaaagaagggtaccgtcaagaagggtccaattgctgatagccaagttgctaaggctgaatcccaagtcaagggtgtcgttctcccaatcaaggctgaagtctctgttgttgaaactagagaaattgccaaggatgaaaaggaaagatcccgctgttaagtcaatcgtcaaggccagaaagtccatcaaacaatatagctaccttcaaaagaagaagaataaggctcctactgctccagccggtgccgttgttgcnacgaataaatttacaaataaaacattnctttaaaaatca

SEQ ID NO: 10971 - DNA, 1683 bp, Triticum aestivum
  Clone ID: PAT_TA_10971
cccggctcttctttctcctcgtgctcgtcgccagcgacagcgtgcgtcccactcccacccgacgcatctcttcttgctcggtcctctcctcaggatcctccatcgcggggagctccgcaggtcaggcctgaatcctgcagcaaccgccttcagccgatgcttctggcggactcgggggttcttcccagccatgtcacggatcggagatttgatgccgagggagcggtctgtcaattcaacaagtcactcaaggaaggctgatggggattctgcgaatgtgagtggtacaccacatgacactgccaaacattgccacgatgaagagttgggaaacataggaggacaactttgcaagaatgatggccactccttcaaggagagctgcagtatcacaaattctgaagtcctcaccagagtgaaatggtcagaggaggaagataaggtgctcactcaaatgatcaacaaacatgggctgaaaaactggcaaacggtcgcacatgctatacctggccgaagtgcaccgcaatgccgacaaaggtggagatacaaaatagactctgcaataaacaaggaggcgtggtcggaacaagaggagttgagactgattcgtgctcatcaaatctatggaactaaatggcgtgaaatggtcaaacattttcctgggaggtcgtatggtgcgttcaaagaatactggaggggtcctatgaaaagaaaattgaattcatatttatcgtcaggtttgcttgaacaatttccagacattctggaaaacctgtcaggcacacagaataatagtttggatattctgaaggggactaaagtttctgatattctgaatgacactgaaggttcgtctgagagaaatgaaatgtcgtcagctgtaccaagaatttccatatctgaagtaggcttcacagaagtaggtgaaaatgctgatgtaccagggggagaaagtgcagatttcatgtatgctagagtggcatcagccaaagccccctgaaaacataatcgcaagatctgagcagcatgcgaaaaccaggaggaagttggatttattgtcaagcccagtggaactcaagtcatccagtcatgaagtaaattctcaaaggcctctacagcaaagggaacaaatgagtccagctgttggtggtgtctctccatcaaatggatgccatgatgttttgccaaaaatcctatcagaatgtgcaaagccggttttatcaccaactggtagctaccagcccagtgatgttcattctgcgggaacctcagatccatgttcattagagttagacatatcagatcttatggaaatgtcatactttgataacttgttgatctttcctcctggttctccacatgatggtaactcaatataaaatgaggaaagtgacaatgaccaaaattacaacctcagatatattcactcttttggcagaaaaggtgatgaactaaactcactgttactgctatcgtcctgtaaactgacagttcctgtatcatttagacgaaaatctttagctgaacaaaaagtacaatgatgttcatgtcatagtcacttgtttgaagcaggtaaccatgttcttttgttctgcatcttgtttgatactcccttcgacctataatatagtgtatattgtttgatactctgttcgtcccataacagtgtacagtagtttttgc

SEQ ID NO: 10972 - DNA, 570 bp, Triticum aestivum
  Clone ID: PAT_TA_10972
gggcggccggacggggctcacggcgctcaccgcgtccttgtacttcacggcgggcgctgttcatcacgccgctgctcgcgtcgatcccgtcctgggcggtcgggccgccgctggtgctggtgggcgtgatgatgatgcgcgccgtggcggaggtggactgggaggacatgcgacaggccgtgccggcgttcatgacgctcgcgctcatgccgctcacctactccatcgcctacggcctcatcggcggcatcgcctcctacatgctgctccactcctgggattgggcgtgtgaagccgccgggaggcttggctgtcgtcctcgtcggaaagtgggtggcggcgaggccacgcgagccgatacaccagtaagtaacgaaagtgccagtggcaacggggagcatgggaagggcgtgtctcacgtggaattatcctagtaccactttctccttcttattttctgcttgtactgtagttatgttttgtttgcgagttgttttcttagaaagaaggatcaacttacaagtcagcaaaagaaaaaacaaacaatcaaaccactatgaagtgacttgc

SEQ ID NO: 10973 - DNA, 729 bp, Triticum aestivum
  unsure (1)..(729): unsure at all n locations
  Clone ID: PAT_TA_10973
acagtgcgtccgccgccgcaacccaacccaacccaaccccaccccaccctcccgtctcaaaaccctaatcccaacgccgccgcggcgccgccgatcaagccgacgacaggcagcccccctatccggccgctccgtacgcacgccccggcccgtcgcgcgcagatcggcggccgtcccccgagaccgctgccgccgcggggctagatttagattccgatttcggggtcccctagccgccgggattcctcgcgtccccgggtatggtgggcggaggcaggaggggaggcgcggcggacgaggccaagctcaacaccggcaacgtgttcgcggcgctcgagaccctcaagaagaagaagaagggcgacaaggccaaggggggctcctccaagggagggaagcagggcgacgagcccacgccgcagcagcagaaggagctcttctgggcgcccgcgccgctcaacaccaagtcgtgggccgacgtcgaggacgacgacgacgacgactacttcgccaccaccgcgccccccgcgcccatctgggggaacgaccacgccgccgccaaacggccaaggaggangaggaggacnaggtggatgctgtncaccccgcctgccggaggaaattgaaagtgaggatgangagcnttgatgatgangctnangaanggngccnaggatnaaccntganccnggaannggnaanctgntgatcctgangngaaaaaaagnt

SEQ ID NO: 10974 - DNA, 1104 bp, Triticum aestivum
  Clone ID: PAT_TA_10974
ctggtgccgaattcggcacgaggttccaccaccaccagctgcggcggctgcggcggcggagactccgaggaaggaaggaaggaaccggagaagcccaggcgagccgggatgaaggcgacggtgaagggccgctacgagggcgacaaggccacggcggccgccacggtcgcgctcgccgccgccggcgacctccgcctccgcgcctccgccaccgacgccgccttcgccgccggcccctccctcgacggcctcaccctcaccctcgagaagcccggcgccttcctcctcgacctcaagccccacaaccaggatgtgcgcttccagttcatgaactcggcgacggtgctcgacaagcgggtcagcctcacctacacgcactccacctccctcgcgcccgccgcgcccaagcccgccatcccggccccggccgccggcgccgcgcccgcgcccccgcctaggggcccgcctcccggccgcacggcgctcgacctctccatcgccttcgaccccgccaacaaggtcagcgtctcccacgcgctcggcgggggcggctgccgggtcaagtacacctacgcgcacggcgccggccgcctcaccaccatcgagcccgtctacgacaccgccaagaacgcctgggagttcgccgtcgcccaggaagttcgacgcccggggacaccgtcaggggcacctaccagggcctccaccaagcagctcgggctcgagtggaccaggagctccagcatcggcggctccttcaaggttgcgacgacgttcgatctgtccgatcaaagcaaagcaccgaagctcgtagcggagagcacgtggaactatgagatctgatcgcctccgcctccgcctgccagcgagcaagcgggagttcctgctcatagagcagcaccatgtgtcatcatactgtctactacaactcaacaggcagactgcccctctctgggtgcaccattattcggatcctattaccgctatccattttttgcttgtcgtgtgacatctgagtcgtcgctggcgatgctatgacatgaacatgaggtttaagtcaaatgtcttgtgccgagaatttccaaaaaaaaaaaaaaaaaactcgag

SEQ ID NO: 10975 - DNA, 636 bp, Triticum aestivum
  unsure (1)..(636): unsure at all n locations
  Clone ID: PAT_TA_10975
tcggcacgagggcggcgctgggnagcagcggcggcgtctccctcaccctcggcctccaccagaacaaccgggcctacatcgccgagcccctcccggcggcgctcccgctcaacctcgcgcaccggttcgggctggaggacgtcagcgacgcctacgcgatggcggcctcgttcggaggccaggaccggcacttcaccaaggagatgggcggccatctgctccatgacttcgtcgggtgatcgatgaacaaacacatgcatggttgctccattgctgggctcgtcagcatgcaacaacatgcagatgagatattgtatgctggctgatctggtccacgtgtattgtactagaagtaggatgatgaaggaaaacaagctgggtgcattggtacatatgcctctcgcgtaggccctggaatgctgtcaatatttgacacagtggggctacatcgagagcatgcagtgcagagagaagcactacctttaaaaggctgttgtagcacgcagttcttccctatttgttctgatcctagattaagctgccttattaaccctgtatcccacccattgatcgacttgcatatgcgagtgctcccaccgtggcaaataaagggtgctccatttatgaaaaaaaaaa

SEQ ID NO: 10976 - DNA, 260 bp, Triticum aestivum
  Clone ID: PAT_TA_10976
tcggcacgaggcactaactgaaggcacccagtaataatgcaacttaatcgaacacagttggtttcctcccttatttcgtcttccctatgatttgtaaacgcatggtatttaattctttctagtgcaaatcaacaccaaggcaccttccgcccagctgcctggatctgcgcaacaacttatataagcaggatccttcttcaattgccttcttgtgtgatggtttttacgatattactcaatgactattttgaaaaaaaaaa

SEQ ID NO: 10977 - DNA, 731 bp, Triticum aestivum
  Clone ID: PAT_TA_10977
tcggcacgaggatttacagtcgacgacaggggcaacatttatgttgcagacgctatgaacatggcgataagaaagatcagtgatacaggggtcacaaccattgctgggggaaaatcaatgagaggtggacacatggatggacccagcgacgatgcaaaattttcaacagattttgaaatccgctatgtcagcagcagctgctccctcttggtcattgacagaggaaaccaggcaattcgggagattccgctccagcctgatgactgtgaatatcaggatgaagctggtttccctctaggtgttgccttgctttttgctgctggtttctttggttacatgcttcccacgcgtccgtacagtgaccttgttggttctgaaatttcaaccatgcaggaacctcagacgcctccaagacccagcaatgcaagcatccctccatatcagccataccaaccataccagcagccattcaagccttcgtttggcccgccgctgatcccaaatgaagaccaagctgaacattaagagggattcttcacctcagtgggcaagctcatgggaggagcaaaatcatccgtggcagacatgttctcccgaaagaagcgccccgcaagacagcaccatcagcagcaccagcagagaagggctaacccttggccagtgcaagaaagctacgccatcccgcacggggaaacgcctccaccgctggactcgagagggccaacccctca

SEQ ID NO: 10978 - DNA, 890 bp, Triticum aestivum
  Clone ID: PAT_TA_10978
tccgcgcacgctaccggggaccctagctctcttctcttctcttcttcggtttcttaccgctctccaggccagagatccagcgagagaccgctccgtcccacgcggcctctccgctccctcccctctcggccccgcggcccgcccaggagctccggcaggcgcccgctgcggcggaagcgccaggggtaggggacgccgccgcggcaatggcggcaatggaggccgccgccgacgcgatgctcgccgccgccagccgcgccttctgcagctccgtcgcggtcttcttccagatccaggggtgctgtatctgcttactacttgcttttggttgggctgttgcttcactggtcagaaaaaaggaaattcgcaagatgcggcgcaaaatggcatctggacatagttttgcatttctttgtgatgacgtagatgagcttgagcactctgtccagcagaaattacctatggtctctgtagtcatgcctttgaagggctttggggaacacaatttgcaaaattggagaactcagattacatctctttatggggggccattggagttcttgttcgtagtagaaagcaaagacgatccagcttatcgtgccgtctcccgtttgattgtagagtacaaggacaaattggacgcaaaggtcgttgtagctgggttttcaacaacgtgtagccagaaaattcataatcagttaattggtgttgaaaagatgcacaaggacagcaaatatgttctatttctggatgatgatgtcagactgcaccctgggacagtcggagctctcacaaaagaaatggagaagaaccctgagatatttatccaaacgggatacccccttgacttaccttctggcagcttgggaagctattgcatatatgaatat

SEQ ID NO: 10979 - DNA, 954 bp, Triticum aestivum
  Clone ID: PAT_TA_10979
ccggatgcaggcaattccgcacgaggcgtctgtcccccactacattccgatggcgacggcggtgtcggcgcccgtcttcacggcgacggtgcgggtctccaatatcccgccctcaacggcacctaaaatgctccatgcagtctcacttgcggacatcgccgatgccgttgaagattacatcgatgaatgactcgctgggtgcaatctccactgctcacttggtccaatcggatcctcattcaatgaaagcccggagccctgagtgcctccagctagctgctttgcattcgatggcggtcgactttgccaaggcaggagctccaactgaaatgccccggtcactgagaccaaaggagtaccccgacttcatggaacggtgggacaaaccaacgtacatctccaacggagctctcggcaagctctaccgagcggctgcgagccgtatgcagagcgctcctgccccctcgtcctcggctcaaccgagccccgcgttcgatcctgacctggaggtccctgggttcggggaattcctggcatcggcggaggagtcctaccacctgtacgccgagcagctgagcaccctgatgagctactatggcgcggagcatgaggtcgagatcctggcgggcaacatcgggatccagtacctggagcacgcagcaggtggccggcgcggcggcctgagtcgtccgcccataatcgactagtgggagttcgcaagaagatgtagtcagtggaatctcactgtgtgtcacaggcaagcttgtctgatgattgcgccggcgtggtacgttgtgatgtaggagcagcatcaactctggggcatgactgcagtgcagagcattctgaggtgagctgagcggtagagctgtgcctgcctcgctcgtatggacggacagatttgctggatgtgtgtggtcgggctttgcgggaggttaatcatgctccatcact

SEQ ID NO: 10980 - DNA, 1035 bp, Triticum aestivum
  Clone ID: PAT_TA_10980
gtgatcagacaccggactgtgaaggtgaacggcatatcgatgcatgtggcggaagccggccccgaggtggacgccaagggggcggtgttgttcctgcacggcttcccagagctatggtactcgtggcgccatcagatggaccacttgggggctcgtggttaccgctgcatcgcacctgacctccgtggctatggtggcaccactgcacagccggatgtggcctcttacaccgcctttcacatcggtcggtgaccttgttgcgctcctcgacaccttagggcttgcaaaggtgtttgtggtggggcacgactggggcgcgctcatcgcatggtacctgtgcttgttccgtccggagcgtgtgacggcactcgctaacaccagcgttgccttcatgcgcaacatcatgatccgcaacggccccgacttcgtgaatcccatagagtacttcaatcgcgcatacggcccctactacgagacgtgtctctcccagggacaccacgtgtcgccgcaagccaagccccgcatgagcccgctatgggccccctgcgtcagctgcggcgtcttcgctgttgacgcggtggccgccgccaagtacccgtcgtcaccgccacgtacccgacatcaccgcttcggccttggctcaccgaggccgacatgggacaacttgtcactcccttgaaaagacggcttcactggtgcaatagtactaccccacttgacaacagctccatcggccggcgccatggcgcacccgccgaccgggcccactgggggtctcggggcctgcacctccaaccttgaggggtcccgggattcccgccgtggtggtggggtttcgcgcgatgtgccgctccccgatgaggtggtcgtcatccccggctctggccactttatccagcaggagagggcccaggaggtcagcgaccatatctacgacttcatcatcaagttctgatctcgaagtccagatgggcgcaagtatccatgtgctttgcagttgttgtttgatcttgcatgtatctgtttattgtaacg

SEQ ID NO: 10981 - DNA, 699 bp, Triticum aestivum
  Clone ID: PAT_TA_10981
gccgccggggcggcccaccactcaatgactccggcccctgacggctctcgcgacaacgacgcgggaatccccgaggcggtgcccggtacggcgcacaccctcaaggacgcatcttcagcaagggacgacaggaggggtgcaaccgccgacaggcgcctacacctccatccccggccccacgacgcacatggccccccccgcccagggttccgacgccgctgcgtccaacgccccacgctcttccgacccctcacccaactgcaaaacctcctggccgtgccgcacgggcccccggacctgccccgcccaagggtctttcccggcagagctcaagatactcatatctctcatcatctccaagtttgcgctcaagctctcgccgctctatcaccattctccagcgctgaaactcatagtggagcccgagttcggcgtcgacctcaccttaaccaaagtgcagactgcttctactactactacatactaagagaggcaacgtggcctggcatataataatgttagcatccgtcctccgctcatgcaaacgaaatttgtacgtacgtacgtcgtttaatcaactgaatgcagcttgcttgcttggagagaatgtacagatacacacgttcgaatttgttcagatatgatcgttccgtgggtatgttaaggttcaaaaaaactatgttagcatccgtcaaaaaa

SEQ ID NO: 10982 - DNA, 451 bp, Triticum aestivum
  unsure (1)..(451): unsure at all n locations
  Clone ID: PAT_TA_10982
ggctgcaggnaattcggcacgagggtgaagttcaataatggtgaggactacccagctaaaccaccatcagtcgtctggcaggactgtccggtggaacccgagcccaaactcgagcatatttcatcaacaaagctgggcgatgtactgactgaagtgaaaaatgtgatcgcgagggaccacggaaaaggcaagaagaaatccgaaatggcttgaaattaatggcaagaagaaatccgaccgcgatggtaaggattgaaatcagatctctacctgtgtttgtgtctcctctacattgatcatcatcagccgcactgtatgatcctgcgacacaatatgtttatgattcccggaactccatcatttattctgtaataattcgtggcatggattaatgcctaagacttaatttcatacagtatgatattatcgtgatttgttattaaaaaaaaaa

SEQ ID NO: 10983 - DNA, 798 bp, Triticum aestivum
  Clone ID: PAT_TA_10983
cgtccgatccccaatccctaatccaccgcttgcctgccctctcggatctctccggccgtcaaccaccgctgccgcccgccgaccaacccaaaccccgcgcccccactcgccgcgcgcccctccaagcccctcgcaaacccctccctcccctccgcacgttcccggcggcgcaggcggcgcgatggggaagagcgacttcctgacgccgaaggcgatcgcgaaccggatcaaggccaaggggctgcagaagctccggtggtactgccagatgtgccagaagcagtgccgcgacgagaacggcttcaagtgccactgcatgtcggagtcgcaccagcggcagatggccatcttcggccaggcccccgaccgcgtcgtcgagggcttctccgacgagttcctcgaggagttcctcaccctgctccgccgcgcccaccgcagctcccgcgtcgccgccaccgtcatctacaacgagttcatcgccgaccgccaccacgtgcacatgaactccacccgctgggccactctcaccgagttcgtcaagttcctcggccgcgagggccacgccaaggtcgaggacacgcccaagggctggttcatcacctacatcgaccgcgactcggagcaggccatcaaggccaggctcaagcgcaagagggtcaagtccgacctcgccgaggacgagcgccaggagctcatgattgcccgtcagatcgagcgtgcacagaaagcccaggctaatggcgaagaagacgatgatgctaatgctgatgatgacctcggcagcgaggatgatgagtt

SEQ ID NO: 10984 - DNA, 792 bp, Triticum aestivum
  Clone ID: PAT_TA_10984
ccacgcgtccggctgagaacatcaatgaagatagcagatcagtggatcaaagtcatcaaaaggaagagattcttgggcatacagtggagtacggacatgaaagcaagggtggtgtggaaaaagtggagacatcacccagagtgggtaacgatggatgggagtcatcaggggatagaaggaatagagacgctccaccttcacaaataccagatacaccagacagagggagggacagcagttggaatgtgaaaacacaagaggttgaaggatctgagcagtactcgaggagccgtcagttgcgagatcctaaagaggcaaatgtctctgaatggaggagcacacaggaaaggttagatggctcgagttttcatggtcgggctgggtaccggcaggattccaggggtagatctgagagtttcagaggttcttcaacctatggaaatcggtatgacaggtctgattcaatagagatcaggccaaatagcaattttgattttgggcgagagggctctgtttctggaagaagatctgatgtgggagctcctggaacgactgatgatagtagtaccaatcatcctgaagcagatcaaagtggtggcaccagcatggtttctccatttactcagcaagggcctaaaggtgatagatcctctagaggaagggggaggccaaatggaagggattctcagagaattggagttcccgtgccacttatgccgccaccttcatttggtgcactcaccctgccaccagggcaaatgcaacatatggggccaaatattccccattctc

SEQ ID NO: 10985 - DNA, 719 bp, Triticum aestivum
  unsure (1)..(719): unsure at all n locations
  Clone ID: PAT_TA_10985
cttgtcttccctctcttccaacaccatttcttcttagctcctctccgtccctgtctgccaccacttctgtccctcaaacttgtctcactccaaccataaaccctcactgtcttgggctctctctgccaagtatccaattcctaagtacatccgatcactcacatttgcagtgatgtcgagccgtaggtcaaggtcaaggcagtccggctcgtcgaggatcactgacgagcaaatcagcgaccttgtctccaagttgcaggacctccttcccgaggcgcgtctccggggcaatgatagagtgccatcttcaagggtgctgcaggagacgtgcacctacatcaggagcttgcaccgggaggtggacgacctgagcgagaggctgtcggagctgctggcgacctcggacatgagcagcgcgcaagcggccatcatccgcagcttgctgatgtagagccggctcccatgcagtgcgcaggcgcctcgtcgctgtcttgctgagcgcacaagcctgaatttgagcgtttgtagcctagggagcgatctttaattagtaccggagttgcaggttacctacttaatccgcgtgtgtgcgctgtcgtcgtgtcatcatcgtcttaatcaggcccatcttttttgtgtgtgtacttaaatcaaatcgttaaatcaaaccccgcccgtggttggtgcaagttgtgcgccactcagtgcgtacgngcaac

SEQ ID NO: 10986 - DNA, 596 bp, Triticum aestivum
  Clone ID: PAT_TA_10986
catcgatccaatgcctacgaatttctctcatattgttcttgccaagtcactactgctatcgttactgttgcacttgctacaaaatcactgctatcactattaccattactattgctgctgctactgatatcaaaactatcatactactttactattgatcactttgctgcagataattaatctccaggtgtggttgaattgacaactcagctgctaatacttacaatattctttggctccccttgtgtcgaatcaataaatttgggttgaatactctaccctcgaaaacggttgcgatcccctatacttgtgggttatcagacaaggtgactgtcgaggatcttggagaacgcatccaagattttgcgatagccatggcagagctcgtgggtgtcgatgaggtcgagagggctggagttccatagggggcaccaccgccgggaaaggacggttcgcgccccatatttgactgggaggagggagatgatgactctcaacatatcatcggggaggctgctgattaagtctaggcctgctggagtcacttgcggttctagctcgccccgcctccgctttttggcagccgcctggacccg

SEQ ID NO: 10987 - DNA, 701 bp, Triticum aestivum
  Clone ID: PAT_TA_10987
tacggtcctacattcccgggtccaccgacagaaggggcgtacgtgtaatgtgtattgctatgtgtgggatctgactatctagttgtttatccttagtagcctctcttaccgggaaatgtctcctagtgcttccactgagccctggtagcttgctactgctccggaacacttaggctggccggcatgtgtccttcttcgatcctgtgtctgtcccttcgtggaaatgtcacgcgatgaataccggagtcctgttagcctgctacagcccggttcaccggagtccagttagcccagtgctacagcctggattcactcgctgatgaccgacacgttcgatgctgggtcatggatgcctgtccctgtaggtatgtgccactttgggttcacgactagccatgtcagcccgggctctttatcatatggatgctagtgacactatcatatacgtgtgccaaaagacgcaaacggtcccgggcaaaggtaaggcgacacccgtgggaataccgtgcgtgaggccgcaaagtgatatgaggtgttacatgctagatcgatgtggcattgagtcagggtcctgacattgaattggaagcatcattgtgtgcttgaattttcctgacggccttctaaattttcattgatagagtagtaatctccggggccgggttatttttccctccaatgacccggagttcttgaatgca

SEQ ID NO: 10988 - DNA, 679 bp, Triticum aestivum
  Clone ID: PAT_TA_10988
ttgtagatgtctgtactcagacatgttaagctttcgcatgtgttttaacttgtatgctatgaatgttgggtcatgagacccgtgtttgtattatctggcaactcggagcctaatgaataaatactctgagtcatagagtcttgttgtgatgccatgttgtatttgcacatatcgagcatattgtgtgtatgattggaatgcttggtatgtgtgggatccgacaacctagttgtttatccttggtagcctctcttatggggaaatgtagtctggtgcttccactgagccttggtagtctgctacagcccggtttaccggagtcctgctagcccggtactactgctcatgacacttgactggccggcatgtgattcacttcgttcatgtgtctgtcccttcggggaaatgtcacgcggtgacttccggagtcctacctagcctgctacagtccgggttccatggagtcctgttagctcagtgctacagcccggattcactcgctgatgaccgacatgctcgatatgattcatgtatgcctgtccccatatgtctgtgccactttgggttcacgactagccatgtcgggccagattctctgtcatatggatgctagcgacactatcatatacgtgagccaaaaggcaaaaatggtcccgggccatggtaaggctacacccgt

SEQ ID NO: 10989 - DNA, 706 bp, Triticum aestivum
  Clone ID: PAT_TA_10989
gtctccgcctgccctaatctctcacgggtgggcggatctggagcccgttcggggcttcggagaggggaatccgtcgctgtcgtcatcatcaaccttcctccatcaccaatttcatgatgctcatcgtcgtggatgagtaattccatcgtagtcttgctggacggtgatgggttggatgagatttaccatgtaatcgagttaattttgttagggattgatctctattatccattatgttctgagattgattttgctatgactttgctatgcttaatgcttgtcactagggcccgagtgccatgatttcagatctgaacttattatgttttcatgaatatatgtgagttcttgatcctatcttgcaagtctatagttacctattatgtgttatgatccgacaaccccgaattgacaataatcgggaccactctcggtgatgaccgtagtttgaggagttcatgtattcactaagtgttaatgctttggtccggtactctattaaaaggaggccttaatatcccttagtttccaataggaccccgctgccacgggagggtaggacaaaacatgtcatgcaagttctttttcataagcacgtatgactatattcggaatacatgcctacattatattgatgaactggagctagttctgtgtcaccctatgttatagctattacatgaggaatcgcatccgacataagtat

SEQ ID NO: 10990 - DNA, 726 bp, Triticum aestivum
  Clone ID: PAT_TA_10990
agggtaagaaaaaagatgtcatgcaagttctttccataagcacgtatgactatttacggaatacatgcctacattatatcgacgaactggagctagtgccatatcgccctaggttataaccgtctcatgatgaatatcatccaacaagtcaccgatccaatgcctacgaatttatcttatattgttcttgctaagttactactactatcatcactgttacacttcctaaaaaactgttgctatcattgttaccgtttcctttactgctactactattatcaaaactatcatattactttgctactgatcacgttgctgcagataattaatctaggtgtggttgaattgacgactcaactgctaataccttgagaatattctttggctccccttgtgtagaatcaagaaatttgggttgaatactctaccctcgaaaattgttgcgatcccctatacatgtgggttatcactactcagccaactaaatatgttcactacttttccaccgctctgtttatttctcagcatgacgccagttcagatccacctgttgtgcctgaaccatacagtgctctgctcaggctgactacagatgttgaacatatcccaattttttcccctgctattgatggtgctgacggtctagcagttttctctgacacccctcgggctaccaacctcatgctgcctccttcaggggctcataagggtaaagatccagctccg

SEQ ID NO: 10991 - DNA, 441 bp, Triticum aestivum
  Clone ID: PAT_TA_10991
gggagttaagtgttgaacatgatttggtaaaggtatcgatgagaggccatgtaggagtacatggtgggttgtttcattggaaccgatcctaagaactgagatctgtatgtgtgattaagaatcagctactaccatgcattgggccctgaaatatgaccccgctcgacttattaaccacccttgtcctctgtccaggagttgcaaggtgtttgtagtataatggaggccgtgcacagcgctgacccttggggtgggctgtgatgcggtaggtacgtggccaggtatgtcgggcgcccgtttggtgtctcgaaaccctatacacatcgttcggggccgtatgtggaaacctcggtcggactccctacggatggaacctgaataggcgataaacctggactagggatttgtgtggttagtcaggtcgtggtctacacccatgtg

SEQ ID NO: 10992 - DNA, 692 bp, Triticum aestivum
  Clone ID: PAT_TA_10992
gtcaatccctaaaacttttcgggagggctgatctggagtccgttcggggcttcggagaggggaatctgtcgctgtcgtcatcatcaaccatcctccatcaccaatttcatgatgctcactgtcgtgcgtgagtaattccattgtaggcttgctggatggtaatgggttggatgagatttatcatgtaatcgagttagttttgttagggtttgatccctagtatccactatgttctgagattgatgttgctatgactttgctatgcttaatgcttgtcactagggcccgagtgccatgatttcagatctgaacctattatgttttcatgaatatatgtgagttcttgatcctatcttgcaagtctatagtcacctactatgtgttatgatccggcaaccccgaagtgacaataatcgggaccacttccggtgatgaccgtagtttgaggagttcatgtattcactatgtgttaatgctttggtccagttctctattaaaagtaggacttaatatcccttagtttccactaggaccccgttgccatgggagggtaggacaaaagatgtgatgcaagttcttttccataagcatgtatgactatttacggaatacatgcctacattacattgatgaattggagctagttctatatcaccctatgttataactatttgcatgaggaatcgcatccg

SEQ ID NO: 10993 - DNA, 648 bp, Triticum aestivum
  unsure (1)..(648): unsure at all n locations
  Clone ID: PAT_TA_10993
cgggtaaagtcaggccgccttcttcgagctggcctgggtgtcagccagcaaggggaaggcggccccacgtcttggattcctgagagccggacggcctcgtaattttttcagaagggccagnggaagccggctaggctacccatggctatttaccccgacagttgtcgagatacacgacgtgtacatggtggtaagtggcgagagagtgtgtgaagaagtacacccctgcggggttataaatgatctattcgaatagccgtgtccgcggaaaaggacttctgggttccctatacagttcatagacaagtgaaagtggatactcttaaaatgcgcaagataagcgtgagtgctatggatggcgttctcgtagggagacgggagcggatccatagtggtgtattgattggtgaatatgtggactcgtgtgcgccacctcaaaagagttacttgcagtcgtagttcaggatagccaccgagtcaaagctggcttgctgcagttaaaccccaccatccccttgttgataatgatgcatatgtagatagttctgatgtaagtcttgctgggtacatttgtactcacgtttgcctaatttatgtttttgcaaagagacttcagtttcaatagtagtccccgtcggccggcgaatt

SEQ ID NO: 10994 - DNA, 952 bp, Triticum aestivum
  unsure (1)..(952): unsure at all n locations
  Clone ID: PAT_TA_10994
gaaaaggaagaatgccggcagctggaattctcagctagaaaaggattaaatattagagacctattctgcacaactccaacgtatctactttttctaatgcttttccttttgttttggactctaatttgcatgatttgaatgaaactaacccccggctggcgctattttcaggagaactaccatggtgttgtttttgtgcagaaataaaagttctcggaatggaacaaaactttgcaaggattttttatatcaataaagagaatttttgaagacaagagtcaccctgaggggggcacctggttgggcacaacacactagggcgcgcctgccgcccccccccccccccccggcgcgtccagaaaaaatcagggcgaaagaattatcgtgatccatgagatggatccgccgtcacctcctattcttcatcgagaggccagatctgaagtccgtttggggctccgaagagggggatcttcattcttcgtcatcaccaacccttttccatcgccaatttcatgatgctccccccgngagtgagtaattccttagtaggctcgctggtcgatgatgagctggatgagatttaccatgtaatcgagttagttttgttagggcttgatccctagtatccactatgttctaagattgatgttgctatgacttcgctatgcttaatgcttatcactaaggcctaagtgccatgatttcagatctgaacctattatgttttcatgaatatatgtgagttcttgatcctatcttgcaagctatagtcacctactatgtgttatgatccagcaaccccagagtgacaatagtcgggacacttcccggtgatgaccgtagtttgaggagttcgtgtattcactaagtgctaatgctttggtatggtactctattaaaaggaggcattaatatcccttagttttcattaggcccgtcgacgccgaat

SEQ ID NO: 10995 - DNA, 487 bp, Triticum aestivum
  Clone ID: PAT_TA_10995
aagcaaaaccccttgttcattccgatacaatcccattctctcgctcttgctctcttttaatgcattaggacaacaacgattcaactgttacttgctgcggtagctgaacccctttatcctttgcatgacctgtcattgccacagtaaatagatgaaacccactagcatgagtaggagttgtttgagccctgatgtgcctactcattcatgcttgtttgtcatgcctgctactgcttagagttgagtcaggtctgattcatcggggatgaatcagaggtgtgtgaacatgtcctactgtgtgtgagctaagtgtgtgaacacgatttggtaaaggtagcggtgagaggccatgtaggagtacatggtgggttgtctcattgcagccgtcctcaggaactgagttctgtgtttgtgatccatgattcagctactaccatacattgggccctgaaatatgaccccgctcgacttatttactgcccccgtc

SEQ ID NO: 10996 - DNA, 1063 bp, Triticum aestivum
  Clone ID: PAT_TA_10996
tcatatcgatacaatcccatgttctcgctcctgctctcttttactgcattaagacaacgcgtttcaaactgctgtgtgctacggtagttgaacccatttcctctgcatgacctgtcattgccacagtaactagatgaaacccactagcatgtgtaggagttgattgagccatatgtatgtgttgttcctaccttgctatgcctgctatgcttagagtcgtgtcaggtctggttcatctgggtgatgggctagagtgaaatgattatgtcggtaatgagagtggtgtggtgaacacgatttggtaaaggtatcgatgagaggccatgtaggagtacatggtgggttgtttcattgaagccgaccttaagcactgagatctgtatgtgtgatttaagatacagctactaccatgcattgggccctgaaatatgacgccgctcgacttcttattcaccctagctctctgtccaggagttgcaagtagtttctggtgtttgtagcgtactggaggccgtggacagcgctgaccgtaggggtgggctgtgatgcggtaggtacgtggccgggtgtaccgaatacacgttaggtatctcgggaaccctgttcacatcgttcggggccgtatgggaaacctcggccggactccctgcggatggaacctggataggcgataaacctggactagaggcttaagtgtttaggtaggtcgtggtctacacccccgtcggctttcgcttgaagtctgccgagcacatgtcgtgtgcagacgctaagtggtggaaacatgtatgaagaagtacacccccgcttcatgcttatttgtcatgcctgctactgcttagagttgagtcaggtctgattcatcggggatgaatcagaggcgtgtgaacatgtcctactgtgtgtgagctaagtgtgtgaacacgatttggtaaaggtagcggtgagaggccatgtaggagtacatggtgggttgtctcattgtagccgtcctcaggaactgagttctgtgtttgtgatccatgattcagttactaccatacattgggccctgatatatgtc

SEQ ID NO: 10997 - DNA, 813 bp, Triticum aestivum
  unsure (1)..(813): unsure at all n locations
  Clone ID: PAT_TA_10997
agcatatgagcntacgtgtcaaggacaaggagaactccaccagcctgtgacatccggcatgaccgcctccaccgcgcccagcgcgccgaagcggtccgcccacgcggccaggagcggcatctccacggggtcgatggtcttgacgccattgatcacgtccacggagcgcacccacgggaggaggccgccgagcaccgtgtccacgtaccccggggcgtcgcctccaaagaacggcttccctccggcgacgtcccgcagggctccgtccagggtcgtcaaggcggcggccaccttcttcttcccctccgctttctcctcctccgtcttgctccacgacgcctggtacatggccttcagcagcgtgtcgtcgatgaaggcggcccagaagcgggcgacggcgcgctcgtagggacgagccgggaggagggcgtcgccggcgaaagcctcgtcgaggtactgtatgatgatcgtcgactcgcagacaggcttgccggcgtggatcagcaccggcaccattttgtggaccgggttcgaccggaggagcagctcgctcttgttggcgaagtcctcctcttggtactcgtagctgctgatgcccttgatgctgagagcgaggcgcacccgcagcacggccgggctcgcccacatgcccagcagcttcaaatcgtctcctgctccggccgccattgctgctgctgctgctgctgctggtgtggtgtctctcgactgctcaaggtggtctctactttgcacgtagtagatgccggttgttttggtccgcccgtcccgggcccggccggcnctcgagcgggc

SEQ ID NO: 10998 - DNA, 1395 bp, Triticum aestivum
  Clone ID: PAT_TA_10998
ccctagctcattctgatacaacccccctctctcgctcctgctctcttgtactgtattaggacaccaacgattcatctgttacttgttgcggtagttgaactccttatcctctgcatgacctgtcattgccacagtaaatagatgaaacccactagcatgagtaggagttgtttgagccctaatgtgcctactcattcatgcttgtttgtcatgcctgctattgcatagaattgtgtcgggtctgattcatcagggatgaatcggaggtgtgtgaacatgtcctactgttgagagctaagtgtgaaaactcgaagaggaggattcatcatgttttacgatatggagccgtcgccaagccctaatctctctcgggagggctgatctggagtctgttcggggctccggagaggggaatccgtcgccatcgtcatcatcaaccttcctccatcaccaatttcatgatgctcgccgccgtacgtgagtaattccatcgtaggcttgctggacggtgatgggttggatgagatttatcatgtaatcgagttagttttgttagggtttgatccctagtatccattatgttctgagattgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaagggggggggcccttttaagggtccaagttttacttcccgggccttgcaaggtataagtgccttcgagaacatatatcctgtcctgacagagttcagaaaagtgcagcaatgatggtataattcctgagagtgcatgtttaatggacattgctatgttgggaataggataggaaatgccatgttccattgacaagttgggccactaaaggtgactttggaagtaagcagaattggagatattgttgcttgctgccagctccaacctcacaaagtctaggcatagcctgtcttctggtggaaaaacctatatacatatactgtccatcagatttagtgtacctgttgtcgtaatcgactagggtcttctttttgtgatggatcatggttgatcgtcgcaggcctattctgtcatcgttcctcactcgaaacactcttgttggaagttgagtaaaacccaagcaaattttgctcctggattctagagcctttttctcccgatgatgaaaagggcagctgatgtatatgtacttgtagacgcgtttgcgccctgttaaaaggagggctttatgttgagccaaatagcaagaggaaaatttgtgttatttctttccctttgtgtcgtcttggtcgtcgcattcctgtaaggacataacgtcttaaatcggccatttaacatttgttg

SEQ ID NO: 10999 - DNA, 1556 bp, Triticum aestivum
  Clone ID: PAT_TA_10999
ggaaggccgacgaccaaaccctaggcgagcggcagcctccgatcccctctccccgatctctataaaaccaccgccgatttcgaattctctcttccccgcgggagaatcaccacaagctcctcctctctcggcgcgcccggaccgggctcctcccgcggggtcggggggcggcggcggtggatggcggaggcggcggcgctggaggggagcgagccggtggatctgaccaagcacccctccggcatcatccccacgctccaatgacaggaatattgtgtcgacggtcaacctggactgtaagttggacctgaaagcaatagctctccaggcacgcaatgcagagtataaccccaagcgttttgctgcagttatcatgcggataagagaaccaaaaactaccgcattgttttttttttcaggaaaaatggtttgcactggagcaaaaagtgaacaacaatctaaactcgcagctagaaagtatgctcgtataatccagaagcttggatttcctgcaaaattcaaggacttcaagatccagaatattgttgcctcttgtgatggcaaattccctatcaggcttgagggcctcgcatattcccttatcggctttctcatggacagtgatgggttggatgagatttatcatgtaatcgagttagttttgttagggtttgatccctagtatccactatgttctgagattgatgttgctatgactttgctatgcttaatgcttatcactagggccagagtgacatgatttcagatctgaacctattatgttttcatgaatatatgtgagttcttgatcctatcttgcaagtctatagtcacctactatgtgttatgatccggcaaccccgaagtgacaataatcaggaccactcccggtgatgaccatagtttgaggagttcatgtattcaccatgtgttaatgctttggtctggtactctattaaaaggaggccttaatatcccttagtttccgctaggagcccgctgccacgggagggtaggacaaaagatgtcatgcaagttcttttccataagcacgtatgactatattcggaatacatgcctacattacattgatgaattggagctagttctgtgtcaccctatgttatggctgttacatgatgaaccacatccggcataattctctatcactgatccaatgtgtgcgagctttccatatattgttcttcgcttatttacttttccgttgctattgttataatcactacaaaataccaaaaacattatttttgctgtatttagttttgttgccgctaccgccactatcaaattactttgctactaaacactttattgcagatactaagtttccaggtgtggttgaattgacaactcatctgctaatacttgagaatattctttggctccccttgtgtcaaatcaataaattcgggttgaatactctaccctcgaaagctgttgtgatcccctacacttgtgggttatcaagactaatttctggcgccgttgccggggagcatagctctattctttgagtcacttgggatttatatctg

SEQ ID NO: 11000 - DNA, 866 bp, Triticum aestivum
  unsure (1)..(866): unsure at all n locations
  Clone ID: PAT_TA_11000
ttacaataattaataagatggttgtattcattgcaaagaccgggttttaaacctcctttcacaaaaataataataataatggtaatcttttctactaattagtttgccgcaacagcagcgtgcatcgtgatgaagagctccacgagcttgctcacgtccggcatcacggccgccaccgcgtccagcgcgccgaagtggtccgcccacgcggccaggagcggcatcgtgacggggtcgaaggccttgacgcccagcatcgcctccatggcgcgcacccccgcgaggaggccgccgagcacgatgtccacatacccggtgctgtcgcccccgaagaagggcttccccttggagacatccctcagggccgcctccagggtgttctacgcagcagtcgcccgtttgttcccctccaccttctccgcctccgtcttgctccatgacgcctggttcatcgccttcacgagcgtgtcctcgatgaaggcggcccagaaccgggcgacggcgcgctcgtggggatcggccgggaggagggcggggccggcaccgccgaaagcgtcgtcgatgtactgtaggatgaccagcgactcgcagacgggcttgccggcgtggatcagcacggggaccttgttgtggacggggtttgaccgcaggagcagctcgctcttgtgccggaggtcctcctctgcgtactcgtagctgatgctcttgatgctgagagcaaggcgcacccgcaggacgtacgggctcgcccacatgcccagtagcttcagatcgtttgctgctccggccattgttggtgtggtgtctgtcaactcaaggtttcactgaactttgcacgtacgtagattgtattttggtgcctctgn

SEQ ID NO: 11001 - DNA, 2582 bp, Triticum aestivum
  Clone ID: PAT_TA_11001
cccacgcgtccgcccacgcgtccgcgctgatatgatactgcgggatctacaaaataaccctgagatgtggctgcaagtggtgcacatcctgtagaactcccagaacctcaacaccgagttctttgcccttcaaaattgccatggtgttgttttatgtgcagaaaaaaaagttcccggaatgacctgaaacttcacgagggtggggggcacccccccccgggggtgcgccccctacctcgtgggcccccctggagctccaccgacgccaactccaactccatatattcacgttcggggaaaaaaaatcgaagagaaggattcatcccgttttacgatacggagccgccgccaagccctaatctctctcgggagggctgatctggagtccgttcggggctctggagaggggaatccgtcgccgtcatcatcatcaaccttccttcatcaccaatttcatgatgctcaccgcggtgcgtgagtaattccatcataggcttgctggacggtgatgggttggatgagatttatcatgtaatcgagttagttttgttagggtttgatccctagtatccactatgttctgagattgatgttgctatgactttgctatgcttaatgcttgtcactagggcccgagtgtcatgatttcagatctgaacctattatgtttccatgaatatatgtgagttcttgatcctacaccttgcagggttaataacatccaatggaatagccgtgtccgcggtaaaggacatctgggttgcatatatcagttcatagacaagtgaaagtggatactctaaaatacgcaagataagcgtgagtgctatggatggcgttctcgtagggagacgggagcggatccatagtggtgtattgatatggtgaatatgtggactcgtgtgcgccacctcaaaagagttacattgcagtcgtagtttaggatagccaccgagtcaaagctggcttgctgcagttaaaccccaccatcccctttgttgataatgatgcatatgtagttagttctgatgtaagtcttgctgggtacatttgtactcacgtttgcctattttatgtttttgcagagagacttcggtctcacttgtagttccccttcgactccgacgtttagcttgttacctcagctacgatcttgtgccccgacaggatctggtagatagtcaggcttctcagcctttttcatttgtagatgtctgtactcagacatgttaagcttccgcttgtgctttgacttgtatgctctgaatgttgggttgtgagacccttgtttgtaatatctcgctcctcggagcctaatgaataaatacttgagttgtagagtcatgttgtgatgccatgttgtatttgcacatatcgagcatattgtgtgtatgttattgaaatgcttggtatgtgtgggatctgactatctagttgtttatccttagtagcctctcttaccgggaaatgtctcctaatgcttccactgagccatggtagcttgctactgctccggaacactttaggctggccggcatgtgtccttcttcgttcatgtgtctgtcccttcggggaaatgtcacgctttgagtactggagtcctgttagcccgctacagcccggtttaccggagtcctgttagcccagtgctacagcccggacccacttgctgatgaccgacacgttcgaagctgggtcatggatgcctgtccctgtaagtctgtgccacggctagatcgatgtgacatcgagtcggggtcctgacacttccccttggagatatccctcagggccgcctccagggtgttcaaggcagcagtcgcctgtttgttcccctccactttctccccctccgtcttgctccatgacgcctggttcatcgctttcacgagcgtgtcctcgatgaaggcggcccagaaccgggcgacggcgcgctcgtaggggtcggccgggaggagggcggggccggctccgccgaaagcctcgtcgatgtactgtaggatgaccagcgactcgcagacggggttgccgccgtggatcagcacggggaccttgttatggacggggtttgaccggaggagcagctcgctcttgtgctggaggtcctcctctgcgtactcgtagctgatgcccttgatgctgagggcaaggcgcactcgcaggacgtacgggctgtaccacgcgcccagcagcttcagatcgtctacagctccggccattgctggtgtggtgtctgtcaactcaaggtctgaactttgcacggagatacaattttggtgcctcccaaaaatattactattgctatcgttaccgttacttccatagtactttgatactaaacactttggtacagatagtaagttatccaggtgtggttgaattgacaactcaactgttaatacttgagaatattctttggctccctttgtgtcgaatcaataaatttgggttgaatactctaccctcgaaaactattgcaatcccgtacacttgtgggttatcacaacccagcttgcggaacacttaagtcaacatggtgcatattgtggcgtaatacacgaacaaggaatgaatccattcaa

SEQ ID NO: 11002 - DNA, 2197 bp, Triticum aestivum
  unsure (1)..(2197): unsure at all n locations
  Clone ID: PAT_TA_11002
gcacgaggcattccaactaccctctttgcatccctaggccagtggcagcctcccattgccccccttcccccctctctcggaaagccttccgtcctctatttttcgcctacccgctactttcgcgctcctgcatccatctcttgccctcgcgaaaataccctgggtccctccgccctcgcggcgccctggccgcccagttcccgcgcggccgaggcgcggcggcggggacgacgggagtgggcggcgggtgcggcggaggcggcgctgggggatcgtgtgcacctgccatggctcctctccgcgtccgtccacatgctccagtatattgtgtcgaggaacaaagtgcactgtaaggggcaccttaaagcgtaagatctccaggcgcgctcctgaaagtatcaccccaagcttttggttgcagctactacgggcatttgagaaatcaacatcaaacccattgatctttgcttgaggaaaaatggtttgcacttgagcaaaaattgaacaacagtctaaactcgaatcgataaaagtatgcatgtatttttaagtagcttggtttgcatgcaaaattcaaggactgcatgatccagaatattgttgcctctctgtgatgtctaattccctatcaggcttgatggccgcgcataatcccatggcgctttctcaagatttgatcctgagctttttccgaggtcgggattaccggatggtgcagctgacgattgtcctcctatttatagtttatggtacgattgttcagtctagaggaaaggtcagagaagagacatacatggccatctaaaaaatctatcgcttcctaacagctgttcagaaaagtgcagcaataatggtgacttttgaagtaaagcagaattggtgacattgtttctagttgccagcttcaacctagcaaagtgtaggcatatgcggtcttccgggtggaaaatccctatatatggatatactctccatcagatttgtagtacctgttatcgtaatcgactagggttcttctttttgtcatggatcatggttgatcatcgcaggtatcatcgcaggtctattctgtcattgcatcgtccctcactcgaaacactcttgtggaagttgtgtgaaacccaagcaaattttgctcctggattctagagcctttttctcctgatgatgtgatgatgaaaacgccagctgatgtatattcacttgtagacgcgtctgcgccctgttaaaaggtaggtttcatgtcgagccgaaaagcaataggaaactatgtgggatttctaagaaaaataacagaacaagtcgacacaacttcagaataccgtgaacgaggacgcaaagagatattaggtgttacaggctagatccgtgtgacagagaatcggcgagccggcagccacgcgctcggcccacgaggggtgggaggcgtacgcttccctcctgcacgcgccccttgcctgttgtggccacccctggcaggcgctccggtgcgggccttctgctagatgacgtctttcgcccgaataacaataggaaaggaggcactgggctagtccactgtacgacccccaggtaatacttgggaggacgtctactaaggctctggccgtgatatgagacctcgggagctctgatctgtttggtgtagacctcgacgtcgactattgtcttgggcaatatgttgtgatcctgaccagggagtgccctatgtagatagacaggcttcgagaatccttctttctttcttgggtttgaaaacagtcttgatgcttccgcatgtgcttgtattcttgtttgacgtgagtgtcgggacatgtgtcccctatctgtatgaacatgttttgtatgccattcaggagacttaaaatgtggcccttgactggtacattttttgtgcggcaccctgcagtttatacttatatcgagcataatgtgtgtatgattgaaatgaataatatgagaaggatacgacaatctagtcgaaccatctcgttgcacgtccggaagtggactanccggtcaacgaggtctcacgcnctanggccgngtacaatgaaangtgtcaaaagcggttatcntatgncacagcatcagtcngcnattcaaacgantccntaagcacttaatctgaacangtanncggtacangaccatcgngncaaaccacagcattccagagccaaacngcttaatgttn

SEQ ID NO: 11003 - DNA, 1691 bp, Triticum aestivum
  unsure (1)..(1691): unsure at all n locations
  Clone ID: PAT_TA_11003
cgtcctcccacgcgttcgtttttttttttcagtagaaaaaagggagcaattgaatgaatcaatgtctgatgtacaatgggtctgaatctgatggtacagatgctacaactatgctgtgacgaaatacacactttagcagttttcaagaatgttgaattgaattgagccaagatacacaagcccccaccgacgacgacacatggtggacgccagaagaaacaatgggacaaacgatcaattgtgcgacacatatgtaccggtttttcctgatcgtattggagggtatcgactgggcgctgtcaataaagtttattgtgcttgctgttgtctctcttgagttgtactttcagctttttaccacctaattggaacccattcatcatacttatggctgcctgcgcaggagcaggagaatcgtagcttacaaaaccgaagcatttactagcaccggtcgttttgtctacaaacactttggcactcaatactctaccaaaactctgaaatgcatttgctagatcttggtcgccgaattcttgcgggatgtgatagataaacaagttggctccaggaggaccctctagctgaggaccagtgttgctgctggtgcttgaagatgtgggagatgtagcatttgcattcggaactttattgactgaattatgagagttcatgtaaggacgactattgatgccaccaccagcatatgacccacgcgtccgcatcccaggcccagctggataagggctgcccaactgcattgaattgaatgaccttgcaactgaattaggggatagttcaggattaacgccccgtattgagcttccttgattgacaggctgaaccatattcttggaagcctgcttgattttgcattggagataaagggtactgcataagcccataggttccttgtggctggtagccaaatccgttatatggaggcacatatcccatctgtaaggcaccaaataatgaactctgttgcatggcatttgcatttgacatttttgacggcgggaattgtgccctttgtgcttttcgagcctgcccttctttttctgtgtcagcccatttttacaaaccaaagggacacttgtaccctctattttgtgcttncccatttaaagcttcgatagctgcccacagcctggtcttttgtttcatacttcagaaaggcacagccggctttgctcgtctgttgtgaacctctcaaaatctgcaaatctttgatatttccatattgtgaaaataaatcagtcatttcagcatctgttacatttttggggagcattccgatgaaaagtttgtgctccagcctttccaactctccatcggcatattttacttgcaatggacttggggccccaggaagcgtgcgtttgttgtgatatgcattcactgccttgtcagcctcctcccttgatgggcagatcaggaagcagcaacctcgggacgccttggtggccttgtcgcggatgacggtgacctcgtcgacgacggcgacgtcgcggaacatggcggccagctcggcctcggtcatgagcttgggcacctggccgacgaagagcttgacggagctctcgtccctgccgccgccgtcctccccgcaggcatgccctgctccgggccccgcggccgcggcgggctgctgctgctgctgctggtccctgtcgccggcgtcctccgccatg

SEQ ID NO: 11004 - DNA, 627 bp, Triticum aestivum
  Clone ID: PAT_TA_11004
gcttcagcttgttggttgacagacacttcccttctcacattccacaagtccatggcgatgaggaagaacaaggttcacgagttcgaggctgatgtgcccgccgccgacctatggggactctacggcacactccgtgcggcggagctgctgcccgagcttctcccgcaggtgctcgccaagatacagctcgtgagcggcgatggcgacgtcggcaccatcttggagctcacattcgctccagggatccctggcctggagacatacagggagaaattcatcaaagtcgacaatgagaactacatcaaggaagcgcagacgatcgacggagacatcctgaagctcgggttcctctattacatggtcaggttcgagatcatcgccaaaggacccagttcttcagtgataagatcgaccattgtgtatgagataaactatgaaactcaccccgggcttgaagccatggtcagcaccggacctctggctgcaactgctgagaaatttgcagggtacctcagggagcagaagatcgctcagagcagttaattcttgcaacatctcagagcaaaagtgtatcaatgctttgagagaaataatgtctgattccacgttgtgtgtaaaaaaaaaaaa

SEQ ID NO: 11005 - DNA, 1818 bp, Triticum aestivum
  Clone ID: PAT_TA_11005
gccgcgacacgccggctcggaggcctcctcctgtcatgaatctggccgcccccgtctccacctccacctccacggccgtccctccccatgcccatgggctcatgccattaaacctcgcccccccctcctcctccttcctccctccctcgctctacgcctccctccggaagaagatctcgccgatggcatccgcccccgcctccgcctccgcggccctctccaccgccgcccccgccgacaacggcgccgccaagcccgccgaccagggacccgtgcaggtggcgaagggattgggagaagttaaaaacaacaattttttcacacgaagagcatcgctctcgctgaaacacgtgggcaataaaacttggtcagggccttccccattttggtggccctggattttgtcaaagaggtggcaatcgggcttatcaaagctggaaagaatcattatgcagggggatatggtgtgcctgaactgaactcagctgttgctgaaagatttctcaaggacaggtgggttgcaaatcgttcctgaaaaggaagttacttttaaatcggggtgcacggaagaaatagctgaaacaatattgggtcggataaaccctggggactgaagtgatcttgttctccccattatgtgattcttatgacgccactgtccacggctcccggtgcggattcagacatcacaatccgccccccggagtttgcagtccctcttgaagagctaaaggccgctgcctgcccgaagaacactacatgaataatgagcacgacacgaaactgtgcgaggttcaccttctccaagggaggagctcgaattcattgctgatctctgcaaggaaaatgacgtgttgctctttgctgatgaggtctatgacaagctggcgtttgaggcggatcatatatcaatggcttctattcccggcatgtatgagaggaccccgtcaccatgaactctctggggaagacgttctccttgaccggatggaagatcggctgggcgatagcgccgccgcacctgacatggggcgtgaggcaggcacactccttcctcacattcgccacctccacgccgatgcaatcagcagcggcggcagctctgagagcaccagacagctacttcgaggagctgaagcgggactacggcgcaaagaaagcgctgctggtcgacgggctcaaggccgcgggcttcatcgtctacccgtcaagcggaacctacttcgtgatggtcgaccacaccccgttcgggttcgacaacgacatcgagttctgcgagtacttgatccgcgaggtgggcgtggtggccatcccgccgagcgtgttctacctgaaccccgaggacgggaagaacctggtgaggttcaccttctgcaaggacgacgacacgctgagggccgcggtggaccggatgaaggccaagctcaggaagaaatgattgggggggcggtttcgtgtagctgttgattgattgtttgaataaaggcctgcctgatctgatccgcattccggtgcgatgcatgtaacacttttccggcgacggcggtgatctgcatgtcattaacacttcactggcggcggttatctgtatgtcctgtccgtgacttcaaataataaatacaaacaaaaacgccgggggccgccgctacccattgccccgggcggctcccggtcgcgcccgtccgcgtccttttgcgctcctacactgcgcctgcgttaccgcttgtctccgctcgggccccttcccccggcctgtcatcgccccgccattccttctgagctccgccctctgcttgtgctgcccctctcctacaggtg

SEQ ID NO: 11006 - DNA, 1725 bp, Triticum aestivum
  unsure (1)..(1725): unsure at all n locations
  Clone ID: PAT_TA_11006
ccggtccggaattcccgggtcgacccacgcgtcccacgaggcagcttcagctgtgccggccggccgtctcgccccggacggagatgggtgggggcgcaaccaccatggaggtccgcgacgacggcgtcgccgtcatcaccatctccaacccgcccgtcaacgccctctcctttgacgtcatagctagcttgcagagaaactatgaagaagctctaagaaggaatgatgtcaaggccatcgttctcactggggccaaagggaggttttcaggtggatttgatataaatggattcggaaataaaccaaaaaacgagaagcccgggtccttttctattgattttctgactggcgtagtggaagatgctcagaagccgtcagtggctgctatagatggtgttgctctaggtggtggcttagagcttgcaatggtttgccatgctcgcgtttctacaccgtcagctcaattaggactacctgaacttcagcttggtatcattcctggaatgggaggaacacaacgattgccccgccttgttggcctgaaaaaagctcttgagatgatgttgatgtcaaagtctataaaaggagtagaggctcacaaattcggtttggttgatgccatagtttcagctgataagctgatcagcactgcctgttcttgtgctctggaaatccacgaacacaaaaggccatggttaaagagtctcctgagaacggatagacttacagatattgtggaagcaaagaaaattctcaaatttgcgagagttcaagccctaaaacaggctgctaatcttcaacatccattagtttgcattgatgttattgaagaaggaattctttttggccctcgtgccgccctcatgaaggaagtgctttctggaaaaatgcttgagcagtctcaaacaagcaaaagcttaaggcatttttttttcgcccaacgtgcgacttcaaagataccaaatattaccaacttgggtttgacaccacggagaatactaaaggcagctattgttggtggaggtctaatgggatccggaattgcaactgcgttcatactgagtgacattgtggtagtcttgaaagaagtaaatgagaagttcttgaatactggcattaacagaattaaagccaatttgcagagttttgtcaaaaagggacgaatgacccaagaagattatgaaaagaaactttctctgctgtccggtgttcttgactacgagcaatttagagatgcagatgtggtcattgaggccgttattgaggatctattgctgaagcagaaaatattctctgatcttgaaaggagctgtcactctaattgtatatttgccacaaatacttcgacgatagacttgcagttaattggccaacagacagcttgtcaagatcgaattgttggtgcccacttcttcagtccagctcatgtcatgccactgttggaaatagttcgtactcagcagacttcctcacaagttattgtggacttgctagatgtgggcgaaagaagatacggaaaacaccaattgttggttggggagctgcactgggtttgctgtncaataggatgtttttcccttatggccaggtggctggtttgcctgttgattatggtttggatgtatatcacatagaccgtgtgataacacaatttggaatgcccatggggccatttccattaccggcccggtagctttggnttncngtgccacgggaacaatataa

SEQ ID NO: 11007 - DNA, 425 bp, Triticum aestivum
  unsure (1)..(425): unsure at all n locations
  Clone ID: PAT_TA_11007
agtcgaaaacacgcggcaaagtnngggaggcagtttctgcaaggacgcggttgagaagaagcttacagaactcagcagctacttgcaaaacctcagcccttgcagaatcactgggttggaacttggaaatggcgtttccaaggagccctgattccagtatgagcagctatgcttctactctgacgctgagcagctgccccagctcctacatctccataggcagcagcaatccaagctcatttacggccgtcgcaataatccccaccggtgccggtgatcacagcccagcactagcagccacaggagctcctgaattcatacagggaaacaagcttcagcagcatcaggatcctccggaatcagaagcaaagttccctaagcaagaaattaacggctgggagcatccagacctctgttgaccatcc

SEQ ID NO: 11008 - DNA, 463 bp, Triticum aestivum
  Clone ID: PAT_TA_11008
cgaggagcaatccttggtcatctttgtcccagtctgacaagttaaggaatggagaaaggtccacggtaaggtcgttagagaattggaaaagaagttcaacggtaagcacgttttggttgttggccaaagaaaggctgtttctaagccagctgatccaaccaaggaacatagaccaagagctcgttcattggctcaagtccaagaaagattgttggaagatgtctgttatccagtcgaaattgttggtaagagaaccagaactcgtgttgacggttcaaaggtcaccaagatcttccttgaaaataaggataaggctaactttgatcataagatcaagactttcaacaaggtctgcaagagattgaccggaaagaaagtttcatacgaatttgccaatctttaaattttccaaacaatataaaccaaaaaattcttcaattgtaatttattaataaaaaaaaaa

SEQ ID NO: 11009 - DNA, 1866 bp, Triticum aestivum
  Clone ID: PAT_TA_11009
cgcgtttcttctccccctgccggttcccgcttccctccattcccctcgcgcgcctcaggaatccgagctccgccaccgagggcgcatactaccacgagagtgtagaacatactcggttttttcttcccttccgtttcaggttgccgtgtcatccaccacaggtttcatctccatactatttcttgcggaccggtgaacaaaacaaactcttccagttggttacagcacgacatgtgaaatgagctcttctacaagtggcttgttggaggagtatgccatatatttgtaagagggatttattcctcttcgactcatgggcgactggattataggagcgttgatcaatattgtgggtagtgttgccataaactttggtactaatcttctcaaactgggccatgatcagagagaaaagctctactcaagtaacaatcaaagcgatggcaaattcgtcccaaaatcagttatgtattttcagacttggagaataggtatactctttttcgctgtggggaactgcctaaacttcatgtcctttgcatatgccgcacagtcacttcttgcagctcttggatcaattcagtttgtatccaatattgcatttgcctacgttgtgttgaacaagaccatttcagtgaaggtcatggtagccacaacttttattgtctttggcaatgtcttcttagtttccttcggcaatcaccaatctcctgtttatactccggagcagctgattgcgaaatacagcaacttggtctttgttctctattgtatgtcattggtctttgttgttgcactcagtcaatatctctataggagtggagagacaattctttcagataatgcaaaagatactagcacacattggcgaacactgctgcccttttcttacgctattgtatctggtgccattggatcttgctccgtcttgtttgcgaaatcattgtctaacatgctgaggctgaccatgagcagcagataccaattccacagctggttcacatactcaattcttctgttatttctctgtacagctggattttggatggcgagactgaatgaaggactgtctctgtttgatgcaatactgattgtcccaatgtttcagattgcatggactttcttctctatttgtacaggatttgtttactttcaagagtatcaagtgtttgatacactcaggataataatgttcgtgctgggcatgacatttgtcttcataggcatatccttgctagcacctgatgaaaataaagctgacaccaaagatggctctaacgccacaaaggacgcggcaattgatatgaacagtgaagcacatgtatcaggaaattgcaggccaagaaagttgccgatggaggagacggaagtagatgatatggactcattctcaacctcagtaaaagtgaaagcaaaatgcatattgtcgagagcaaagtcggcttgctccatgtcacttggccttggggaggagaccatcagcgcttcttcggtgcttgcaatgccaatggtttcctcaagaacaacagggtttaggggaattcaaactgaccgatcaaagtacattcccctggggtccactgattgggataatctatagctggtgatgttctatagatacacaatacaaatgttattttttatattgccaattggtaattgtttgtacttcccaaggcaattgtctgttctgcctcgtagtactaattagctgtaacatcagtgtatagtttcaacatttccacttgtaacattgtccatacccatgttgtaattgaaacagctgcctgcactacatgtataaacacaccatgttagaataaacttcattgattcaattcataaaaaaaaaaaaaaaaaaaaaaa

SEQ ID NO: 11010 - DNA, 983 bp, Triticum aestivum
  unsure (1)..(983): unsure at all n locations
  Clone ID: PAT_TA_11010
aggcgcctcagcaccaactgcaaggaacagcagagttatctcgggaaagattagctgccttttgcgaccatgatgaagctgaggtgccccaaccccaagaggctcttcaggaggagctcctccaagatcagcaggtctagtagcagctgcagcagcagcagcagcgacaacggcagcgatgcctccggtggcatccgtggcggcggcggcagcggggagatcgagtgggaggtgcggcccgggggcatgctggtgcagaggagggacgggaggggcgacgtcgaggtcatcacggtcagggtggccaccgggcactcctggcatgaggtgtccattggagctacctgcacttttggtgagctgaaggtggtagtatccatggtgacggggctggagccgagggagcagaggctgctgttcaggggcaaggagagggaggacagcgaccacctccacatggttggggtgagggacaaggacaaggtgctgctcctcgaggaccctgccctcaaggacatcaagctccaggcagcgctcgcggcccaggccgtgcagagcccgtatcacactttcatcaaggtgtaggccggcccgcctcacccaccgcgctaacagttatctaaatcaaccacactatcaggcatcagctagtcaggtctcacaagattgctaacaaaaagcatatctggaacctgatgcatggcggtgttcgctcctgctgatcagttcttaagcaccactccatgggatggaagggcaaaggccctcgtcgtgtgagagttagagtactatcaacttttaattaattataattgcatggttgtgcaatttgtagctagttgcaagtttaagtcctttcttctagatgctgtaagggccagcctcctccaggaattgcnagtctaactatggatgtcatgcgnggtattatgttnattggagagtgcaatctnggataaggcctgtgccctcnggcatagtgt

SEQ ID NO: 11011 - DNA, 922 bp, Triticum aestivum
  unsure (1)..(922): unsure at all n locations
  Clone ID: PAT_TA_11011
ctgttttttcagtctcaaggtcgtgaatctatagctgcaaagcttgtagctaatatgattactgaagctggtgcaaaccgtgtccttgtttgtgatcttcattcaagtcaggccatgggatattttgacatcccagtagatcatgtttatggccagccggtgattcttgattacctcgccagcaagacaattagttcaaatgacttggtggtggtgtcgcccgatgttggaggtgttgccagggcacgcgcttttgccaaaaagctatcagatgcacctctagcgattgtagataaaagaaggcatggacacaacgttgccgaggtaatgaatcttattggagatgttagaggaaaagtggccgttatgatggatgatatgattgatacggcaggaactattgccaaaggagctgagctgctgcatcaagaaggagcaagagaagtatatgcatgttgtacacatgctgtttttagcccaccagccatcgaaagattatcaagtggtttgtttcaagaagtaatcatcacgaacactatccctttaaaggaggagaagaatttcccgcagctgaccattctttcagtcgcgaaccttctaggcgagactatctggcgtgttcatgatgattgctcggttggccatgcgccatactccaccttggatatcgactgacgcttgtgttccactcgcgacgcttccgtccaccgagggccctcgtttcatgcctaggtgagaacgggtgccatagagggtcgacctgccgtggtgtcaacaacaactaatacagttgatagacgagatgcccaagtgataatgagcagaatgtactctttcttaatgcaggaatggtgtacaagtgccctttttttgcatgttctccaattntttgngaatagctcagtagcagaaaaaaaaagac

SEQ ID NO: 11012 - DNA, 1373 bp, Triticum aestivum
  unsure (1)..(1373): unsure at all n locations
  Clone ID: PAT_TA_11012
gaattcggcacgaggccggcggtgctggttccttcctttagcgggcggtggcggcggcttgtgggttcgattgctgcctctttgatgaggggccggatcctgcgctggtattatcttcttcccctgcatcggttgtctcgactcatggatttgcatcgtctgcatcgctcttcttctctatgttcggagaactcctgtgatcttgtggctcgctactcagagctagaacagaaacatactcaagtcgagctgagcttgaagttggttcaggagaagctgacaaaggcgaaggaggagactggaggtaaggtaagggaggcccagcagaagaaagaccttgagctagctgagaagatcaagcttgctgacgagaagttagcttcagtcaccaagcttgaacaagacaacaccaacctgaaaactgcccttgggattgccaacaaggaggtcagtcgactgagaactgacaaagctgccctgaccgaccaagtcagcaaattgactgagaagaaaactgcactggaggccttcctgagtggccttgccaagaagctgtttcttatgcttgaagaattttgtcaaaactttgaagaagaaaccagccgactggagccaaaccttgaccccgtcaattctccggtgaatgacgaagttgccatggatgtcttccgactggagtctcgtgttgcagctgtcgtggactatctcgcaaggctgaaggccgccacatctcgcatcgactcgacgctctggcctgaggagacacttcagaatgaccttgagtcgctgatggcccgcttgaacacgatccctgcgtcgagtgcaggagtggaagaagtcctcggctcggtgtggtgcagatgtcgctctgtgtctggcccgagtccactgcaaagatgcacgagaggagaagctggcggctcttcgggtggccaataccaagaagcacgacttcaggtcctttatggagactttccttgcagctgccactcggatcgccgacggaattgaccttgatgaattcgttgcaccttccagccctccacaggaggggtaaaaaacttcttctggctcgacgcttttaaatttgcctcggtatgccgagtggaattgtaaccgacaaaccttaacaggcttgacgcctgagcactttcggttcctttagatatcgattcaaacttgaattgggtgcttggttacgattgcctttggctcgaaatgtcttttgcaggtttgaagcaaggcgcctttactgcaatcgacttattctttaatccacttaggcnagcactaggctgcagctaagcccccgagtgagagggttgctcttcactcggtaggattttgataacttaggccagtgcttggactgc

SEQ ID NO: 11013 - DNA, 272 bp, Triticum aestivum
  Clone ID: PAT_TA_11013
ttttttttttttcgcgcatatttgacttttaatttgataaatacaatcctaaaaatttacacgcttgcacacatagagagagtatccaaaatatacaacatcaaaacaccataaccatatggcaactttgcaaaacattctgaacttaaaatgaatagttctcaaaagcccaagctcagcaagacaagcaacactcctgccaacaacgtcattggtacggtggaagtttgcgcattgaatgccgagcttggcgacgaggtaggcgggggcac

SEQ ID NO: 11014 - DNA, 699 bp, Triticum aestivum
  Clone ID: PAT_TA_11014
tcaataaattgctttatatataatataaaatacaaatcatcgtggttccgaccaaattgaggtcgagaattaattaggatcaagtttgtttgcaagtagattttacatagagattcacctcgcccaaacattaaccaagcacgctgtagataatttccattttccggaggattaccgaggcccgatcctgcaccaccttccatgcgtcagcgacgtggtactcctccgtgagcgtgctcccgacggcgcacctgagcatgtagacgccgcctacgttcgcggagctcatgtatgggcccgggccgaccgcgttcacctcctcgagcaggccccggttgagctcgttggccgtcttctcgccgccgaacctctccggcgaccggagccggaagcacaccagcgcgaactgcctgtccgtcaccacctcgaacctctcgtcggcgcgcaccatgtcctcgaacgcctcggccatgcgcacgtgggagcggatgtggtcgcgcaggccgttgacgccgtagcagcggagcacgagccacatcttgagcgcccggaaccggcgggtcagcgtcatggtccagtccttgtagtccaccacgtcgtgcccctccgacgccgcgtccttgaggatgtactcctgctccgtgcccagcgccgcgatgagctcgctcggcctcttcacccacatcgcgcagcagtcgt

SEQ ID NO: 11015 - DNA, 857 bp, Triticum aestivum
  unsure (1)..(857): unsure at all n locations
  Clone ID: PAT_TA_11015
ccccggccgcggtccccccgagggcgccgcccccgagccccccggcccctcccctccccgtgccgccccggcgcctgccccccccctcccgccgccgccccgcccccccccctcccccgcggcgccccacccgcctccccccccccccccccgcccccccgccccccccccggcggccccgccccctggggcccccgccccacgcccctcctcatcctcgtcggctccgcccaatccagtcccctgcgaggccaaacccttcttcgcccagcccccaccggtcccgcggcggcgaggcgggaggtgagcgcgcgggggagcctgtaccgttcggggccgatatgttcgcgagcaggccggcggtgcacccggtggaggcgccgccgccgacggatccggtggagcagcccacgggggtgctcatgaaggacctgcccgggatgcccggcacggccggcggcctcgcgctccgcctcgcgcagttcgccttcgccggggtcgcgctcggcgtcatggcctccaccaacgacttcccctccgtcagcgccttctgctatcttgttgcagcaaccatattgcaatgcctgtggagcttctcgcttgccattgtcgatatctatgcattgcttgttaagcgttgtctaaggaaccgccgcgctgtttgcctgttcgcgattggagatgggatcacggcagcactcatcttcggcgcagcatgctcgtccggcaggcatcaccgtcctgatcgacaacgacctgaacatctgtgccgagaaccactgtggcagctttccaaaaccgcgacgggattgnatttnatagctggttgntcccaaaccctccctttcccggggaaa

SEQ ID NO: 11016 - DNA, 902 bp, Triticum aestivum
  Clone ID: PAT_TA_11016
ccacttccgcctccgccccttcggactaaaccgtctcagcggcaacccgtggtcgtcttcgcccacggcgccggcgccccctcctcctctgattggatgacccgctggaaggagatggtgaaagatgccctggatgccgttgaagcggtgacattcgactatccatatatgtcaggtgctaaacggaggcctcccccaaaggcggacaagctcgtcgaccaccatctcagtgtggtgaaggatgctgtagcagagcatcctggtcacccgcttgttcttatggggaagtctatgggttcgagggtcagctgcatggtagccagctccgatgatatcagtgtttctgcagtcatttgcttgggttatccactgaagggagtgaaaggggcactgagagacgagatactactgaagctgatggttccaacaatgtttgtgcagggcaacaaagatggcctatgccccttggacaagcttgagttaactcggaagaagatgacctgcaagaatgaactgcatgttgttgatggtggtgaccactctttcaaagtcagccaaaaataccaaaaatctgctggaataagtcaacatgatgttgaattagaagctgttaaagcaattgcacagttcgtccagaactccatcgcagaaagcttaacctagctgttccttcgaaattttcttataacatctaatggtaggttcctgatcctaagattctggccttttcttaggggaaagattctggcttttgaatgatctaatgtgatcatgtacttggttcgttgactggatggttacatgtaaaacaatgctattgtccccctgaaatgtaatatgcttgtaattatttgtgttgtttgttcatggaatgcccttttgcctaaaaaaaaaaaaaaaaa

SEQ ID NO: 11017 - DNA, 741 bp, Triticum aestivum
  Clone ID: PAT_TA_11017
aactgtgtcacacaggttcagtacagcaaaggcctctggccccaagttcaggaaaaaaataaaacgaaactcgtcggaaactgaaagcataccacatgggaggtttagtacagcggaggcctctggccccgtctctgcttggggccaaacgatatgcgacgcggtcttcccatcgggtttcagcaggcctcggtctcctgcggggctcgcgtcttcctgcctgggctcctcctgcggtggctggccgcctcagcttggttggcctccccgtgcttggcccgctcaagtgaactgcaccttcagtccagccttgtgttttcattgccatctaactggtagacaatgtgtagatatccaggtcatcgccatgaagtcgttggtgctgctcttgaagacccagacacccagcaggaagatatctcttgcatatcctcgcccagcccccagctgctgcaagcttcccacaccctccacatggctcaagttcggacagccatgtacacgcagctctgtcacttgagggaggttggagatcctctccaagctttcacatttctgaataataaggagctcagacagcagtgggaagtcctccagggccttcaagttgtttgttccaattaatctgagctccttcaagctggcggtatcctctccaagccgtcgcggaagagccctcaatttatggcaattgaagagatccaacaccatcaaacgagggaacagttgatatcctgcaga

SEQ ID NO: 11018 - DNA, 1109 bp, Triticum aestivum
  Clone ID: PAT_TA_11018
ttttttttttctttttttttttccagaccgaatgaagtgtattatcttggactaaaagaacactcaacatttgagtttggagtacatattgatatccagatctagctgggatgatcaaactccagatgctatgctacatggaaatcttttcaagtagcaatgagataatctgacaggtacaatatgtgatgcaggagcacagatgcataaaaatgactacgatactttccgacctatccagccaaaaagcagagggtaccatgcgaaaactacatacaacaattatgttccaaaatgaatggatgctatgattaggtaaaaaggaaatacagaacgttgaccgccaaagtatctcccttcttttcattcttcttggtcccatcctgtgaaagttagtatgaccaagtttttctgcaagaagatgatgtgttaagagcacacttcagagttcctacattgatagccaggttgaaattgccagcaatatgcccatagttcccagaccatacatcacaacaacatcagaatttttgccttccagctgctctagcaggacctctgtccatccatgggacattaattgtgcctcattcatctcttctatgttcgatcttcttgcactagcctcattctgtaacatgacatgatcaagtatattatttcctgcagaaagggggagttccgcgtcatgtgcagctagaaagcctgtgtaggctgaatcagtgtggatagtcttcatgactgatccaaagaaatttgtcactgggacctcgtttaaggcacgcttgtaaagatccattcgataatatgcagtagacagcagcatggaaggatcatatgaattgaaaagactgttcaatgaagcattgctatacatattcagcttctcaaagaaagcaagtgtatggaaggtaaacctatccacaacagaaacaccaatgtctgagtcgagatggtgagagtaagagttttcccccttcatgctgctaccaatcgccaaaacaccgggtgattgaagctgtgaaaaaagagtagcagcctggcaggtatctaccattatcaacaactctttaaatctatgcttctccttcatttgctttactgcatct

SEQ ID NO: 11019 - DNA, 505 bp, Triticum aestivum
  unsure (1)..(505): unsure at all n locations
  Clone ID: PAT_TA_11019
ttttttttttttttggcttaatttcccttgcgccaccccggcgcttgccttctcgtgcccgttctcgcctcttccttacacatgcagttgacagaacaagcatttgaacgaagaaaaagaaaaggaagcaaaaggaagaagagactagatcctgatgacaagtcaaagaagcctactagtcggctcaccttgtctcgtcatccatcggaaagaaattcagaagagccaatgggacaccttcttggggaatgacacgctcttccgatggtgttcaggctcggcttccacccccggcacgacagctcccggctcaaagaactccggccggtgctcctcgaacccgtccgccgtcgccgccgcctcctccctcctctccattccgccgccgccgccgcctccttcttggccgaccgattngcgtcntccgggttcccgggncttccggggacnacagttctcctcaaacccgcccnggatngactggacgtgcancacggacgcctta

SEQ ID NO: 11020 - DNA, 768 bp, Triticum aestivum
  Clone ID: PAT_TA_11020
tttttttttttttttttgaaaaaactacggttcattatcaaaatgagttagcctcgcatggtatcaagttgagagttcatcatacagttccttgcactaattggcgctagcttgcaaacctagcacaggccatacaagagccatcgctgaaagatacaaacagcagaagatcaacaaaattgtcatcatcgatcccagagtgtttccaccactacacgtacttgcctctgtacttgggcttggaacctctatcagactcgggcttcttatcatgctccgccgggctgaacacggcagtgtgcaggttgccctcctccatccatttctggtggttctccctgaactcctggtgccgttcctcgcccatcctctccacctcctccgtgtagggccccaccttcaccatggtcagcaggacccggctgtaccgcaggctcaggatctgctcgcaggaggacaccagcttgaagcaggggtgctccggaaatttcgccacaccagcagcatcatcctcccgcaacattggatagaagaagacgagcctgccgccaaccaccagcattctcgcagcaaggtggagcaggtcatgaacacattccgcaagactatatggtgcggttgatggaatgtggttctctctcttctcgtccggaactgtgtacggagggatgattccttttaggagcttccgaccacccgacttgcgcccaccagctcggacaccatatggggggtcgcaaatgattgcatcaaatatctccttcaagc

SEQ ID NO: 11021 - DNA, 1344 bp, Triticum aestivum
  Clone ID: PAT_TA_11021
ccgtcccactcgccccccccccctccgccccccccccccctcctcgtccccgcccgctccccccagccggcggcccggcgcccactagctgctctccagatgcatcctccccatgatcctgggatggagggagtcgtggtggcaggggacagatgcgtgatgaggaggaggccgtggtcaattggtcatggtggcgtgacggaggtcgtggctcgccccccgccgcctctctcgcgggcccattttccctgcccccttcccggcgtccttacctctgccatggcctccaccctccctctccatcgtccttcccgagctcttcctcttcgggggctcgccgccatccgatgccgcgcgccatgattctagatcggccgcaggccgagaaggagcggttgctatagtgagggcagcacgccacccgcccccgcgcccctgggctgagggggagaggtcaaggacggttgcccgttcatggaggagagatgcgacacagaggatgaagatggacctggcagcagggatcatgggagcaacgggggtggctggccccccgaagctagacgagaaagggggcagcagtgcagggacggaagagggtgtccatgtgctatccatttctgctcatcttcagcttgcagggcagcgccgctgcgccgcttatgcgtctggccggtctgcagggccggggctctgcagcggcgggggcggcctcccccgcgggtacgcattgcattggttaattttgttgtgctcatgtttccgtttcatgcctcaagctcaagacgcgcgaggtgatggtttggttgggatggtgctgctgctccgcaagtacgagcttctgcactgtgtcttgctctctcaacttgcctccccttgaatgaatggacgcagaataatgtgttgacaagctacatgaggttgggcttcccacgcgcccgctgtttgtgtgctggcaggaaggaagaactaagaaaaagtgtgttgtttcgctggattcttcttcctttgatttcaccaaactttgtggcagtggttggcttctcgactccgacactctgtatggactagcccggtctttgcccagaagttctagaaggtacaatgctgaaaattcagtagaacatggtgctcctataaatactgataatccggaacctggcaaccattggcttttgaagtttggcagtttgttaaagagcaaattgatccaagtgaattgatccaagtaaagagcaaaactgaagtaccaatgtacctcttataaatttggtcactattgtgctctctgacaggaatgcaagttttgtgttaaaaaataaaaaaaaaaaaaaaaaaaaaaaa

SEQ ID NO: 11022 - DNA, 304 bp, Triticum aestivum
  Clone ID: PAT_TA_11022
cgccgctgcctctctttatttatacaccttctttttgttctgccttgtaacaacttacattgccaggaaagtacgcataataacatgatgagatgatcccaatctcttagtaactctccttaaatccggtagtaaacatctccatttattcactgaaacacaatgcagaacatgattttattcaaagggaaatcgtcccccgatcaaccacccatccatggccaaggatgacaacccaacagaacccgtcgcaccggccagccagcctctccagtgatcactcatatctcaccgtcccagagct

SEQ ID NO: 11023 - DNA, 1160 bp, Triticum aestivum
  Clone ID: PAT_TA_11023
cgcacggcccgcgcgacctcgaccccgcgctcccctccgccgccgtattgattccgccgcgctgctgggagctatggcgggcggctctaggggcggcttccccgcctggatgaccgccgccgccgcgcgcatcgacctctccggcggcgccgccgccacgtccggctcgcagcctccccaacccggcccttcgcccgcggtggtggccgaccaggagctcgggatggccgaacgcgccctctccgccgcaagcgccgccttcatctccgccatcatcgttaaccctctcgacgtcgccaagacgaggttgcaggcgcaggcggcgggggtgccttactaccaagcaccccagatggcggcgctcggcccggatgcgatactgtctgagttgcgatgctctccatcatgcacacgtggtatcattttgggaagcgaacctatttgcccacccgattgctttcagtacaagggaacagttgatgtattcttgaaagttgttagacaggaaggatttggtagattatggagaggtacaaatgctggcttggcattagctataccaactgttggaatatatttgccttgctatgacatattccgcaacaagattgaagattttacaagaagcaatgctcctgggttgacaccatatgccccactagtagcaggatcagttgcacgctcgctcgcatgcattgcttgttccccaattgaattggcaaggacaccgatgcaggcgtataaggaatttcagcctggagtaaagcctcctggaatgtggaaaacattgcttggtgttctttcaccacatgcaagttcaagtcagaatgtgcaaaactatcgtgttctatggacgggtgtgggggcacagcttgctcgggatgttccattctctgctatatgctggtcaacgctggagccgattcgaagaaagctgcttggtcttgttgcagaggacggtgacgcagctagtgtgttgggagcgaactttgctgctggctttgtagcaggtagtcttgctgctggtgttacatgccctcttgatgttgccaagacaaggagacagatagagaaggatgcccagaaggcaatgagaatgaccacgaggcaaacgttaggtgatatattgaggtctgaaggttcaaaagggttgttcactg

SEQ ID NO: 11024 - DNA, 538 bp, Triticum aestivum
  unsure (1)..(538): unsure at all n locations
  Clone ID: PAT_TA_11024
ggtccggggttcgagcggacgcgtgggcggaccggccgcgcgcgcgccaagcgtcctcttcttctcggcggcggcggcgaaaggcgaacgagcgaggaaccctaaccctaaccagttccgatccgcaaggcctgcgtcgatggcggcttccctccgcgcggcggcgacgaggatgctgcgcccggcggtgcttccaggggaggggcgtcgcctgctcgtccacacccagcagctttccaaatcaacccgcgcctacgaggaaggaaaccatgccttgaatgaataccgtgcgtcgcttatccagcagaggaaggagcagctgtacgttctcattgccggcgccgaggccaattcccgcaccttcttgctgaacaaaagtctgctcaaggatctctctacacaagtcaagcctagaccagaggaccctcaatggcgcaagatatgtagaaccaagaaggtgaccaacttcactaggtcggcgggtattcttgttatttctgggctcacttattatgcctngatttcccgtcctgaaatc

SEQ ID NO: 11025 - DNA, 544 bp, Triticum aestivum
  Clone ID: PAT_TA_11025
gccggccggttcgagatacaggacatgagcctgctgctactgctaagggagttcacaagcaagatgtgcagaagtgaaggggttgaagaagagatgcatcttgtttgactatcagttcttttccagcaccatgttatgtatgtctcttgaaatgactgtatatggtctgccacctatatatgtcttgtctatgatctgccacctatatatgactgtatgatctgccacctttatatatgatatgacttagtagtgttaaaaaaaaaaaaaaaaaaaaaaaaaaaaaaaaaaaaaaaaaaaaaaaaaaaaaaaaaaaaaaaggccccaaatggccccaaacgccttcaccccaaaaaaacccccccccctacccgaataaggatttctatacctatcgtgaaacttcaaaatcgtccaaaatccacggtcaccctttctccatgtaccttcttttataaattgcaaaacctgaaaaacccggtccaaccctttacaatcccaaaaccttgaaaattcccgaacttaacccaacttgaaccacatc

SEQ ID NO: 11026 - DNA, 1181 bp, Triticum aestivum
  unsure (1)..(1181): unsure at all n locations
  Clone ID: PAT_TA_11026
ggcgggccgaacaaagcgatcggctccttctcgtcgtcttcttctcctcggcggcggcggcgaaaggcgaacgagcgaggaaccctaaccctaaccctaagcagctccgatccgcaaggcctgcgtcgatggcggcttccctccgcgcggcggcgacgaggatgctgcgcccggcggtgcttccacggggacggggcgtcgcctgctctgtccacacccagcagctttccaaatcaaccctcgccttggtaggaggaacactgtccgcctctaatccagcagagggaccaggtgtacctccgagctttcgaaatccttgtaaggagaaacacccgtgcacgagctagtttgagcaagaagaaggaggagctgtacgaacctcctcgccaagcgcccacgactaattccgcggccctcctcgctggaacaagaatctgctcaaggaattctctctacagcaacagtcaagcctagactagcaggaccccccaagtggttgcaagataactataaacaatcatggtgactgatttggctgtgactgtggtttttcttcttacttctgctctcacatactgtgccgtgaaaactggtcctgaagtagaaaaatatgatggacaagttgctacggtgctgaggctactcataaggcaagaacatgcaacctgcttctaatgctaagggagttgacgaggaaaatgtacaggaatgaaagagtttcagtagggttgcatagttgtgtgagtgagaaggaaagaaggttattgctctgtcaccagtgtgtggggtagctatcttgaaataagtatattaggactgcaagatttatgagggtgagatctaactagatggttatcaatcagtaagaaaagctaatttaaaatacagcacaagtttatgttggtcgattgaaatatatatccatctatgatctgccacctagaagttagtaggtgtgtacctcgtggatctgtgtttccattgtaggatatgtgtgatgttgctggcctgcgtatgttaccctttgagtctaaaacatgagaagaaatgtgtgatgttgctggcatgctatgttacccaagaaatataaaacttgagcaggattaaaactggacgatctgcgacgccctgggggggtatctggactccaattccggccctatanggaantcgnattaacn

SEQ ID NO: 11027 - DNA, 578 bp, Triticum aestivum
  unsure (1)..(578): unsure at all n locations
  Clone ID: PAT_TA_11027
ttgaaaggtccngcagtagcttngagatctgtgcgttngagatntagtagggtattaatcacatcttnagganttgccaaaggtgtatattaaccggttggtatancatatatctcttgcccggctgtgtcttgcctgctggagttctctacagcagcaccagctatccaaatttgggcattgggaggccctatatggctgctgaatgccatacaaaatgaagaacctgaactgtcaagaacttccccagcttcaggccaacgtttctgctccattgagctaccaggaagcaggatctacaaccgcttgtctcggtcgtcctcgcttgtctctgacacggcttgctcggatgaaaactctggctccccggattgcatgccgaacttattgatcatccactgaagagactcgattacctgccggtcgtacatctgcttctgctgcaccatctcccggaactgcttggcctcgcgctccaccagcgccttctcgttccgcaggcacgcgatcttggccatggcctcatcagctgcagaggccgccgcgcgcctctccttctccagctcctctagcgccgc

SEQ ID NO: 11028 - DNA, 2630 bp, Triticum aestivum
  Clone ID: PAT_TA_11028
gcacgtgcaagaggagaggcgccgtcggaaggttcaggatttcctcctcggcgagaaatccttgaagttctccaggtttgcaagttgcgttctcttgctatttcaggacccggcaattgtgagagactcgcaactttcagccttcagagggtgttgttgctgtgatgggtaatcagtagggcacccccggggacgatgactacaatcggtgccccagggagcagcgtgcgtctaggtaggcccatggggttgaggatggtagctgcgccgacgtttacatatgtgacacgcgcttgcccgacgatccctcctggtggccctccgccggtggtattttgtggcgtggggtagttctgtcctccttctttggcctccggcgcaggccgccagccctgcaggagcaagtcatcgggtgccggatgcttgggacagtagttgtgtcctcgtccatccgccggcccgactgcgcaataggagggacgccgtcggaagggaatgcctgccaatccccaaggttcaggatttcctcctcggcgagaaattctaccagttctccaggtttctctggctatttaaggatctaacaattgtgagagactgggaactttcagcctgccgagggtggtgttattgcgatgggcaatcagaatgggacccccgggaacgattactacaaccggttcccgagggagcatcctgcttccaggtatgccgatgggattgaagatgatagctactcagacttgaagaaatctgacaagccctggcccgatgctgactcgtttaggcccaccgccgctggtattctgaggcaagggttggatccgacatccatctctgtcctcgggcgcaagacggcggacctaagggagcactatatccttggccggaagcttgggcagggccagtttgggacgacgtacctctgcaccgagataagtacagggtgcgacttcgcgtgcaagaccatcctcaagcgcaagctcatcaccaaggtggatgtcgaggatgtgcgccgtgagatccagataatgcaccatttgtcgggacacaagaacgttgtctcgatcaaggatgtctatgaggacgtgcaggcggtccacattgtgatggagctcttgcccggcggggagctctttgaccgaattcaggggaatggccgttacagtgagatgaaggctgcagagattacaagaattgttgtcagcattgtggctatgtgccattcacttggtgtgatgcaccgcgatctcaagccagaaaatttcctcctccttgacaaagataatgacctgtccataaaagcaattgattttggcctgtccgtctacttcaagccaggccaggtttttagtgagctagttggcagcccgttctatgttgctcctgaggtgttgcacaaacgctatgggccagaatccgacgtgtggtcagctggagtgatactctatgtgttgctaagtggggttccaccattttgggcagatacacagaaaggcatatttgatgcagttctgaaggggcaccttgatttggaatcagacccttggcctaagatatctgacagtgcaaaggatcttataagaaagatgctttgcaattgcccttcagagcgtttgaaagcccatgaagtgctacggcatccctggatctgccaaaatgggatggccactgatggagttttggatcctagtgttatctctcggctcaagcggttctctgcaatgaacaatctacagaaattggctctgagagtgatagctgagcgtctttcagaagaggagattgctggattaagagaattattcaagacagtggacataaaaaatagaggtgtaatcactttcggtgagcttaggaaaggtctgacaagatatggcaacgaattggtggataccgagatttgtgatataatggaagcggctgatacagacactgatgtaaccataaactatgaagaatttattgctgcaaccatgcctctaaacaagatagagcgggaagaacacttgaaggcagcttttacatattttgacaaagatggcagtggctatatcacagtcgacaagcttcaacgagcctgtgcagaatataacatggagggcactctccttgaagagattattttagaggccgatcagaacaatgacggtcaaattgattatgccgaatttgtagccatgatgcaaggcaacgccaatggtggcaatattggacttggacgtccaacaatggaaaccagtctgaatgtgaccttgagagatgcagctcaagtacattaatgcacagattttgttctcttctcattgccattatgtccacaacccaaattgggttgtgggcatgtacttccgaagtacgggaagagaacaggtcgattctttcggcggcatttatcgaaaataagctggtctagctagcagtacagtcattgtgagagacagcgtcgtgggttccatatagtaagtagttgtgtcctggttcatatgactgcaagactggctgctatccagcaggtggaagtaagagggcgtgcggcaagttcgtttgttctttgtgtgatcagttgtgtactttgtgtctaatgaaaaacttgtcttcatgaaatgtcatattccccaagtttgttc

SEQ ID NO: 11029 - DNA, 747 bp, Triticum aestivum
  Clone ID: PAT_TA_11029
tgcatattttggtgacggtaatatcatggttatcgatccaacatacaaggaagaagctgttatgggaggaaggatgacagctacgattaattcaaatggtgatgtctgtgccattcagaaagctggtggagagggtgtcatgtcaagtgttatcatgcagtgtttaaggattgcttcggttaaagctgctgatataacaagcaaaataaagaccaaggttgataagtacactactgataaggcattgcagaaagtaaagcgtactccagcattagttgctaaagaagttgacgttcctgatgtcactatgaaggagagcacacatactgcattggaaaaccaaacctcgaaggcgcccaatgatggtcagcagataagtgaagattcaccagctgtagcaaatgacgaaaagcatgaagctgccgaaccaatggtgactgaatctaatccggaggtgaaaagcgtgtcaaattctggaagtgctggagtgtcggatgaggtcaaggaaagccgatccccggagagtttaatagatgctgtcaaaccaaaacataaaaggaagaagaaccaccatggaaagagttagattgtgactgtagcctacaggtcttaactacatggtggttgcagacagagttatctagctttcttattctcttgtgatggggcacatgctccagtagtacagtacattattagattttaagcaacgagtaatagtgctgtcttttgcagttttgctatgcc

SEQ ID NO: 11030 - DNA, 1497 bp, Triticum aestivum
  Clone ID: PAT_TA_11030
gaaaaaccctgcaccccgcctcggccgcgtctaaaaccctacccccccccgccggcgagcaacgagatgatggacccgcggtggcgcccgacggtgaacgagcgggagttcatcgagcaggccctccagtcggacctccgcgtcgacggccgccgccccttcgatttccgcaagctcaaaatcgcattcggaagggaggatggctcggcggaggtggagctcggcgaaacgcgtgtgatgggttatgtgactgcccaattggtccagccgtacaaggacaggcctaacgagggcacgctggccatattcaccgagttctcgcccatggctgaccctgcctttgagccggggcgacctggggaagcggcgattgagttgggccgtgtcattgatcgtggcctaagggagagcagagccgtggatatggaatccctgtgtgttgttgcggggaagcatgtctggtcggtgcgtgttgaccttcacgttttggacaatggggggaatctcattgatgcagctaacatcgctgcattggcagctttgtctacattccggaggcctgaatgtacggttggtggggatgatggtcagcaagttacagtacatgactctgaggtcagggacccacttcccctaacaattcatcatctccccatagctgtaacctttgcatattttggtgacggtaatatcatggttatcgatccaacatacaaggaagaagctgttatgggaggaaggatgacagctacgattaactcaaatggtgatgtctgtgccattcagaaagctggtggagagggtgtcatgtcaagtgttatcatgcagtgtttaaggattgcttcggttaaagctgctgatataacaagcaaaataaagaccaaggtcgataagtacactactgaaaaggcattgcagaaagtaaagcgtactccagcaatagtggctaaaaaagttaacgttcctgatgtcactatgaaggagagcacgcatagtgcaatggaaaaccaagcctcgaaggcacccaatgatggtcagcagataagcgaagggatccatactccaaaggagtttcattaagctccctcagaatcgctcagtttcctgatcccccagctataccaaatgacggcaagcatgaggataccaaaccaatgttgactgaatctaatccagaggtgaaaagcgtgtcgaattctggaagggctggagagtcagatgaggtcaaggaaagcagatcacctaagagtctaatagatgctgtcaagccaaaacacaaaaggaagaagaaacaacatggcaatagttagattgactgtaaccttaaagttcttaattccatgatggttgtagacacaattagttagctttcttattctatattgacggtgcacatgctacagcgttacattattagattttaagcaacgactaatagtgctctcttttgcttttttcttgtgcttttctcgctcagcttttttgccctgtatcttt

SEQ ID NO: 11031 - DNA, 697 bp, Triticum aestivum
  unsure (1)..(697): unsure at all n locations
  Clone ID: PAT_TA_11031
cttattttttnttncttnacaaaatcgatgggaggtgaaagaaaacgttcggtactgtcgttgagaattaaatggatatttaaaagatacggagacattctcttgtagtctcactaattgctgcgtatgatctggagcgccctgtgtaggttggccacgacatcagacatggccaggcgccggttctgcccgcgcgggcacaggcagcggctcgccgtgtatgccacgagatccagcgcctccagctgacgcggcgtcggctgcagcgccgggtggccatccagcacatcccgcagctttccgttgtgtacgctcgggagcgcggagtccacgaggaggcccagcgtgacgccgtagatgtccggcggcctccccgtcagcgcctccagcaccaccaccccgaagctgtacacatcgctccccgtgctcacgcggtgcgtgccgctgtactccgggtctatgtacccgggcgtgccgacgacctcctcgacgagctggccgccgtgctcctccacacccgccgcctgaaacaccgctgagccgaagccggacaggcgcggtgtccagttggcgtcaaggaggacgttggacgagctgacgttgcgatggatgaccagcggatccgcgccgcggtgcaggtactcgatggcccgggccacgcccagcagcacctccacgcgcgtctcccaggaccctc

SEQ ID NO: 11032 - DNA, 1045 bp, Triticum aestivum
  Clone ID: PAT_TA_11032
aacaccacagccacaggtggcacaacagcagcagtaccacaacatgcagcaagttccagctcagatggttcaactgcaaacatcttctccgcaggcccaaagtgcacctcatgtcgccctgttctatcctccttacggatcccaacagcccgcatgtggtaacaccgaggcactttctagaggcatggttgtgcagcctgcctattctacgatctcttcttcccagcgaaagcaccatgaagctgctcctgtttacgtgcaaagcagcgccattgctgttcctattgcagaacatcacatccagcaccagcagacccagcagttccattcgcctggcaatggctcatttgcacctcagcaatgcaaggttggtccctattcagtccagggtggtgcccaggcctacaacaccgtatatgggagccctcccaacagtgctgccacttttgttgctgtccttcctcagcaagcacagcaggccagtgctccgatgatgctccatcatctaggaccccagcccgtgcagaatcaccctgcagacatggctgacaaggctgctcgaatgggttacttgaacgatcatgctgagaacatgccgcgccgaatggtggctgcaggccagcctgtagagtacaacaccttccatgatgggctgagctctgttggcaatgcggcttggtctggctagtcgacgatggagaagccgcatgtgaagcactccatctgctcctgcgactttctcgtgtgatatacggtgtggcgatcttattgtgatgggaagctcgcttttgagcttccctacggtatttgctctggcatcttttatcagccggcagattggtactacgtatcctccagcctacttttttcagctggatgatgatcgtgatgaaataagactgtaggttagtcgagtgatgatgattgtcggcatttgtcccatttttaatggacgcgtatgcttgcttgtaacctgttgtggacttgcatttgcatgtttgcgatcgatatgaaaatatgagaaatttgttggttctcaccttct

SEQ ID NO: 11033 - DNA, 709 bp, Triticum aestivum
  Clone ID: PAT_TA_11033
agttttttttttttttttttttttttttttttttttggttcaaccttcatgtgtttactgtagtcgccggctggccactgcctgcattcaatgacatggaacgggccagacagggcaacctcagcacagaatcgagaaccggccgttttcaggacatgaagcaaccaaggaaaggtgattggtagtatttcactcgccgtagaaagcttgggggtcctgcctatggctgctgctggctccccccatctgcaccatgctctggaggtcttgctcccagctgaaggtgccttctagctctgccccgtggccgtggccggccgcgacggcgacgggtgaaccggcgtaggagaagccgggcactgccatctggttcatctctttggacgggatctgctgctcgtcgagctccaactgaggattcatggtcgacaacttcatggacagaaactcgacctgacgctgcagcgactggacgtagttgatgatctcgtcgagcatgagtgccttgccggtgatcttgttgcagcttggcaccagggactgcagcagcttcatcctctcaccgatcttctccctcctcaccctctcggcgaggctgtgactatcggttgcctgccccctcctcgccctcacatggatgtagtccttggccggctccgccttctcctcctccaccgcgcctgggttttcgtcgttgctgccgtcggcg

SEQ ID NO: 11034 - DNA, 810 bp, Triticum aestivum
  unsure (1)..(810): unsure at all n locations
  Clone ID: PAT_TA_11034
ttttttttttttcccctcggcgccgttcgctcttcttctgatcgcccttgctggtggtgcgtgcttacactcagcctctcttttcactggatacttcgttttttaaattctgtaaaaatgcacttcttttgaatacagttaccgatggagacacggttactaatattgtaggagacctccgctgcctattattcaaaaaataacttagtgacaaacatcttacaacttacaagattggcttagtatgagtagccgctcagctacctccatcatcgttggcctttgatccacgtcaaggctaaggcattccacagccatacttgctaaactttcaaggatctccaaatcttttgttattgcaatttccttgtcgaaaaactcagttgctttcttctatttcatgtgggcttcaaggaaattctttaccaacttattattatcagaatggattgccctctccctgctaataagttccaggatcacaactccaaaactgtagacatcacttttttcagtgagtaagccttcttgtagatacaccggatccatataattcctgtcgccaatgattgatgcagtgtgttccttgtcacatgcaatcagcctagatatgccgaaatctgaaatcttgggtatgaagttatcatccaaaagtatattagctggttgccctcccccgtgtgccgttctaggatttgtgttgctgtgcatataagctagaccatcggctgaatgtgcagcaatacttagacgggcatccaagttgagagccaccttgttattgctgttgtgaagaatgtcatggaggnt

SEQ ID NO: 11035 - DNA, 1234 bp, Triticum aestivum
  Clone ID: PAT_TA_11035
ttttttttttttttttttttttttttttttttaacaacgacaccacattctcatatatgggagggaggggcctcccagcatgccagccaagtgaagtattatgccattacaaacaagatgttttatgcttctgctgcagcgctctccaatgtacatgcacctgaaaaacccgggctcaagactatgggtacagaaagaaagaaagaaaacagcagagagcagaggaagttttgaaacaaaaaacaaaaggacaccactacaataccactagtccactaccacaacgacatcagcatcaatctagaatctacactgccgatcacccgaaacaagcgcggggcaccggcatgtcttgggatggagctatactgcccgcgaggatcagtggcgcagctccaatttgagtccgccacaagatgaagaattcagtaagcaactgcaactactcctgggcatttttatcccctagcatgccgcgtcccggaagaattctgcgggcactgaagttgggcattgctttttcccgacaaatttgtacttatgttggctgtacttttctctgattgcaggaagattactcccaggaccaacgctgaaaaggcggtgcagcgccttcacacaatcgcagagctccgatggcttgtactgtgtgtagtgggcaagggtggagttccaggggtgttttgctggctgcagtatgaacttcgacaagaaaattgcggaggccgcaacaagtgaaggagggtaagcaagtagactgtactcaagcagtgatagctcagcaacataattggctaggaactcaagatgcaaaggtggatcctcatcacagacttgtgcagcccggacaaatctccttaaaaagcactttgctgtaggcgcggtcatctcaaacttcaggtaattgaggacggaagcttccatatccagaacctcatccttgaagtatgtattgtcagtgatgtagcagaattcttctacctggggtgcacaaatctcctcatatttagcagctataagcatgcaagcgacaccaagtaattgcagcctttgccgattgatctcgttgccggaaaggtaacggtcaatatagttgactgtcaggtataaggtatcaggaacaagacgatattcttcagcaacttccacaagccagtcaatcaggatagccctcatgcttgggttcacatccttctgaattgtttccagaaaatcagttgatggtcttttcctc

SEQ ID NO: 11036 - DNA, 970 bp, Triticum aestivum
  Clone ID: PAT_TA_11036
tttgggttgcttgtggacaagtcgaatagttatttcctctgtatagtttaaggtttatcccgtatctccagaggttagggtatgacattaaggatgcatattcagtatatcatactaagtgtcttccttattttaatactgtacaagtataatcactggctctctgcacaacacggggctggattgaggattgggacttctacgcattttttgcaagctaaaacatggttgtaacttttcacaccattcattgttccactgctttgggggttccagctgctacttaaaatcatattgctttggaactgctaggaatggcttgaaggtcagcacaagcccaattacttcgactaaattcaaaatcaggaatatcatttgatcccctggaaagaaagcagcatgttggcgcttttgggcccatgagaacagaactcctgctcctgctggagcaatagccttgaagagggacattgctgtcgtagatatgccatttgcagcacctctttgattttgtgacacagcactgttttgcagaatacaagtgcccgttaagatagtcgtggcaaaagcaccctttataacggcagcgaaaataaatggctagtccgagtttggtccctgataggtgtgtcatgaaggggtacctagctagttgtggtctggtctgtgcacctgcatttcgggctgaaatgatagacccaagatatttgtggacgtgtctataaacaaatatttgatacaaaagaagaccagcacctgaaactgcaagaacttggccaacatctttagatgaaaagtttagtccgccatacttcttttcacttacagcccacaaggaaaatatctcactgtatgctgtatcatgaagggtgaaaacacaatatgcaattatagaagacatcaacggccagttcttgtatagactcttctctggatgtggaacttctctatggggagcagctcttgaatc

SEQ ID NO: 11037 - DNA, 420 bp, Triticum aestivum
  unsure (1)..(420): unsure at all n locations
  Clone ID: PAT_TA_11037
tttcgagnnangnaacgcggacgcgtgggctaaactgttatgggttgaacttcgaggagctcaatccatacatctacattgatgttatttacctatgagattagagaaaagtggaatgctccttttttaactaggtgcatacattcacttcatttttagattttacatgccccctcctggttctaagaacatatagacatgtaattttgtttcctattttgccggtcagtttttgttagctaataagatgttttttttgcagagattcacttaatttggtataaaaacaatatagccactgccatgtcgatgcactctgaagctgaattgttttttcgtggtttcatattttatttggaagaatgtgttgtgctaacaactttttaaaacaagaagaatatggtatataatcgctgagat

SEQ ID NO: 11038 - DNA, 978 bp, Triticum aestivum
  Clone ID: PAT_TA_11038
aagcgcccacggcccctggattcagttcccatcatttttttttcctagttcttcggttctttaatgtataacgaggctattatgctcatacagagactcatatttagtttcagaatccaatccttataggcccgtgtgtcatgattcatcctcctaactctagaaggcaaatattgctgactttattattgtactgcaaatggcatgctaaacaggcggggattgagcttacggcgttaccaagacataatcggcgtcgtgggatcctcccatctcatcaaaagaaacctcgtggcggctgacagcaatagacctcctcgttctcgtgcccattcccattccctgctggcgcgtttggtgaaggaccggcagggcccttcccttggtgcccctcaggttatctccgtcgggcaagtgtagctgcccaggcgcggccggacaactcggcgagacgcctttgcttgccaagacagagatgtccttgttggttatcctcgccgaaggaatatatgtaaccgagcgatgggagagggcttccagcggcgttgtcacggcggatgggtgaatgcttgcagccgctgaaggagatcacactgggggggtggttcccactgccctccggggtctccgtgccagtccacatggctgatgcgtaaaggtcagcatacaggtaccttccatacaggcaggggtcggtgcatcctcggtagacataaccgacccatgatcgacgcagatccaatgtttttattgacatcagaatggctgtatcccataataggaggaatgacatttacggacttgagtgatgtgtttcctcccaggtgcccacggtggattgtacaccaatggaccctcatatatacgccatccatagtttccggccttggagatcaaatcgtcctctccgtatcgctcctgaccagtatctgcacagtagaagtacgaaggcctctcaagatcaaagctgcatctcca

SEQ ID NO: 11039 - DNA, 533 bp, Triticum aestivum
  Clone ID: PAT_TA_11039
aggaaaactcattttattccagcaccgatcatcacccaacattttattccagcatcatggaagcattcatgcaccctctcaggtctcagctaggctaagctattatagtctctcatctctcatggacggaggtagcctacctatagctgagccatgctcggtcgctaggggcaagcctagcagtgggggacggcgaggccgcaggaggtgagggtctctagcgcgtgggggctcctgatgtaggcgccgagggaggggtccttggcgtactggcagaagcacgcctgctgggcgcgcaggttggcgcagcaagcgccgctcggcttggcgccggtggtgatcgccggcatgcacaccgtcagctgccccacctcgcacgccgcgagcgccccgcagggcgccgccaccagcagcgccagcatcatggccaccaggaggacctccttcctcatcgccatggccgtcgtcgtactcgtacgtgcgtacgttggactgctcctcgctcactctcgctctcgcagtggcaagtgttg

SEQ ID NO: 11040 - DNA, 569 bp, Triticum aestivum
  Clone ID: PAT_TA_11040
aggaaaactcattttattcaagcaccgatcatcacccaacattttattgcagcatcatggatcggacagaaacatgcgtgcgtgcatggacgcagcatgccctctctcaggtctcagctaggctaagctattatagtctctctcatctctcatggacgacggaggtagcctacctatagctgagccatacgcgctaggcgagctggcgcctagcctagcagtgcgggacggcgaggccgcacgagacgagggtctcgcgggcgtgggggctggtgatgtagcgagcgagggaggggtccttggcgtactggcagaagcacgcctgctgcgcgcgcaggttgccgcagcacgcgccgctcggcttggcgccggtggtgatcgccggcatgcacaccgtcagctgccccacctcgcacgcggcacgcgccccgcccggcgccgccacaaccagcgccagcatcatggccaccagcaggacctccttcctcatcggcatggccgtcgtcgtacgtacgtttggtctactccttgctcactctcgctctcgcagtggcaagtgctgcaatggt

SEQ ID NO: 11041 - DNA, 637 bp, Triticum aestivum
  Clone ID: PAT_TA_11041
ggttaaaaagtttaaagcaagtgaagatggagcgagcaaacagaggagattgtaggaaattaaagtcattttattcagcacatcgatcacccaacattttattgcagcatcaggaacagcatgcgtgcatggacgcatcacgcactctctcaggtctcagctaggctaagctattgaagtctctcgtcatctctcatggacgacggaggtggcctacctatagctgagccatacgcgctaggcgagctggcgcctagcttagcagtgcgggacggcgaggccgcaggagacgagggtctcgcgggcgtgggggctcctgatgtaggcgccgagggaggggtccttggcgtactggcagaagcacgcctgctgcgcgcggaggctgccgcagcacgcctcacttggcttggcgccggtggtgatcgccggcatgcacaccgtcagctgccccacctcgcacgccgcatgcgccccgcccggcgccgccaccaccagcgccagcatcatggccgccaggaggacctccttcctcatcgccatggccgtcgtccttggtctactcctcactctcgcagtgtcaggtgttgagtgtgatggagtggtgcaatggtggtgtggaacgcgtgggcggccggcc

SEQ ID NO: 11042 - DNA, 1462 bp, Triticum aestivum
  Clone ID: PAT_TA_11042
cccacgcgtccgcccacgcgtccggacacgtccgccccaatatggcggcgccagagtacaagcacgagacagaaaccccagcaccctccggcgagcagccgccagagccagtagccgccgccgccgccgccgccggccgggagctgcagccatgggagcagcacgctgcggtgatcaatctcccgcgctacgactaccgcgcgtcgggctccctgctcctgcgctcgcactccggcttcctcatcacctgccccatcaaacgagagaaaagtgcaacgaaggaagccatttcaattcttggagagtatattagcgacgcaagcagccacagttctgaaaacttggaaccatgtgttacggaagtggcatcaaagaaaaggaaaatattttctgaggcatccgaaattgaacattcagaagatacaaatgggaagggtgatgcaccagaatctactggcagcattgaagtagaaacaaattcacttcactccgatacaagtggaaattctgacaggacttcaaatctctcattgattaagctatcaatgagtggtttgcttttcttctctttccctactggaggcgttcatgttgttcagatgcttaccgaagtctttcgttcactgaaatctgggaagcttaaatctccacagtggtgtcatcgcatattccctattcaggaaacttgtgttctatcagaaacagaactgcatgccactgtgtcaaagttgttcctggacttcatcaggaataaggaagatcaagatgagcctatcaagttcgcagttgggtacagtaggagaggcattgatgaaacggtgaagacgcagaagaatgacaataacagctcaattcaacaaggtttaatggacaggcaacaatgtttcaaggttgttgctgctgctgtcaagtcagttgctaaggacgcaattgtggatctcaagtctcctgaggtggcagtactagtggaggtgctccccatttctggggtgccagttggatcttcggtggccggggtgtctgttctcccagctgaactcgtctcggctaagcctcgtctttgtgtcaaggctttggtgtctgatacaaaaacaaaaaagaagtgatgcgccagttcggctgcaaccagtcagagcacctgtaacggcaacatatggaggaaacgatcttgttgggcatgctcgtcagccatgccgcagcttgagcattccacaaacaaagaaacggtatcgcagctgtcttgcctggctctgagtatgccaatttgtaagctgcagtgctcgtcccgttctttgaggttagcttcttatcgtttttctagcgtgctccagcgtcaaagcttaactgacctgttgctggatgtgattgtgttatactgtttctctagactttatgtagtattattattatgggcaattcagtgaactactaaagtatacgtgcctatcggggaaaaaaaaaa

SEQ ID NO: 11043 - DNA, 860 bp, Triticum aestivum
  unsure (1)..(860): unsure at all n locations
  Clone ID: PAT_TA_11043
ttgatgtnatatnataatacaagatttataggatctccatattgttctacgaacaacttccataagaggaatggttgaaaaccaaaatgccacaatgtaataaaatgaaagaataaatccaccattggggaaaattaaatttagaaccaacattacgagaggtaaccaaagtaaacatcactggacacacgaaaaagtcgtgagcttattcgccaatctcatgcggttaaaaacttgttgtgtcgtgaaacgggtcaatagggttagtgggaggtgacgtcgccccaattccttctgatctcaccattgagactggtcttgacgtcgatagcgcccatccttaccattgcttccttgaacttctcctcccacacaccgttgtccttggcattggcacgcaccgctgcacttgtatcatctgccgtcatgagcgcggcatccgaactgaagagcacctcgtggctaagcacattcttgtagtacttgttgtcgaccttgttaggggtctcgatgtcctgcaccacggtgttgtcagtccctgtgtctgacttgcattgctcccggagagagctcattagtgtggggtccatgtcggaggtgcttgggttgaggcggtcggagaaggatgagttgaaggacgagcaatgggagattccgacggtgtgtgcaccagagagtgtgaccatctcgtcggcagtcagccccttggaggcgaagttggccttgagctggtccacggtgccgaagggtggtggcaggttggggagtgtctcattcatgaaggaaacaagtccatcataacggccagctgtcatgttgaagtagaccttcttgttgcttaggaagtaggtggcatcgcg

SEQ ID NO: 11044 - DNA, 1840 bp, Triticum aestivum
  Clone ID: PAT_TA_11044
gaattcggcacgagccaccacagaccagacggaccaggcatgccgcccccgccgcctcccaccaccgcgctgccacgcccctccctcctcctcgcggtctcctccgccgcgctcaagatctcggccgcggcggcgacgagcccggcgcgcggcgtgcggtggaagggggtcggggtcgacgggaggagggggaggagccgggccgtcgggaggtgctgggcggcggcggtggaggaggaagccggcgcgcaggaggacggcgtgctgctcccccaggagggagagcgaggcggccgggaggtacgactggcgggaggagtggtacccgctgtacctgtccaaggaggtgcccgacgacgcggcgctcccgctcaccgtcttcgaccgccagctcgtgctctaccgcgacgccgacggcgtgctccgctgccacgaggaccgatgcccgcacaggttagccaagctgtcggaagggcagctcgtcgacggcaagctggagtgcctctaccatggctggcagttcgacggcgagggcaagtgcgtcaagatcccacagctgcctgagggcgccaagatcccgcggaacgcgtgcgcgcgcaactacgaggtgcgggactcgcagggggtggtgggggttggtgggatgtcgccggcgaccccgccggacgccaagaagctgccgtggttcgagccgtacgcgcgggcggggttcacggacctgtccacggtgcacgagctcccctacgaccactccatcctgctggagaacctcatggacccggcgcacgtgcccatctcgcacgaccgcaccgactggacggccaagcgggaggacgcgcagccgctggccttcgaggtcgccgagcgcaccgcccggggcttcgccggccactggtggcgcgagcgcgcgccgcacctccgcaacctgctccgcttcgaggcgccctgcgtgctcaccaacacgctcgagttcgtggacaaggacggcagggagcagtgcttctcggcgcagttcctgtgccggccggccgggcaggggaagtcgatgctgctcgtccggttcgggtccacggcgaggtcgccgctgctgagggtgctgccgaaatggtacttccaccagaacgcgtgcaaggtgttcgagcaggacatggggttcctgtcgtcgcagaacgaggtgctgctccgggagaaggtgcccaccaaggagctctacctcaacctccgctcgtcggacacctgggtcgccgagtaccggcggtggatggacagggccggccacggcatgccctactacttcggccacagcaccatctcgccgccgcccgtgccggccgtcgtggagcaggcgccggcgggggccgccgcgggcatctccgcgtcgttcccggccaagggcggcttcggcacgcagcacgcgcccaacccgaccagcaggtacttccggcacgtcgtgcactgcaaggggtgcagggacagtgtcaacaggtacaccgccctgaagaaggccttcgtcgtgctcgctgcggtggctgccgccgcggccgtcttggcggcgacgaggcagtggaaggccgtcttgctgggcgccgccgccgtgctcgccgcggcgtcgtatgcgtgcggttccgtggtttctttgatcacaaccaacttcattaggacacacagaagattgtaaataagcagaggccgggataagatcatactgtcagcgcattttaatttagtcagctagaaacacttctccgtttttacccttgtttatatatctatactagcatcattttgccatcagaaattgcatggcaagacgcgttcataaacctaaactggattttta

SEQ ID NO: 11045 - DNA, 772 bp, Triticum aestivum
  Clone ID: PAT_TA_11045
ttttttttttttgaccaggaacaaggtgacggtattttcgcaagaaaaagtttataaacataatcaactagcagtgttcccgcacttggagcctccaatctccagatgctagtggtacattgtgaaaaccccgcaatcttgccatctttcagcagatacatgaaaagatgggggagagggaagaccagaccgaatgagataacaacatacgtacaactctgcgtgggtgtgtctgtgcatgcatctatcaataagaaggccgtcgagcaataaggttcttccttcatctaaatagagcagaatacatacagcctcgcaactgcatgcaaagaacaaaacgaaccaccgggcgagacgaaacctttacagacggtaaccatcacagcggaccaaacggctctgggagcggctcgaaccggtgatcgaacacggggctctggtccgacttgtcgtcgacgctgtgcagccagtccgtgttcttcccgcccgcccttagtagcatctcctcgtaccttgagctgccgtacatatccagttcgctcagcgtctctttagttcccatgctttctctgtctggggagtcagttgagctcccaccatagtgtgaaagagctccaatggaatcaccggagaagtgcccattgatgctgccactgtcggtgtatgcatcgtgctcgccatttgaggtgtgatggccgggatcggacattcgagctgaacggcccttgggagcagaagaccggatgctatgaggaaatagagatgcacctcg

SEQ ID NO: 11046 - DNA, 1072 bp, Triticum aestivum
  Clone ID: PAT_TA_11046
cgcggccactctctccggcgagcccgaccccgactccgacgcctccgaatccgaggcctcctccgccggcaggccggccgcggaggggtcctcgccgcgcgatcccgaggacgaggagcccgaggagcccatcaccccgagccgcggcgtcaaggacgacatctccgagctcaccgagaccctcacccgccgcctgtggggcgtggcgtccttcctcgccccaccgccgcccccgccggagccggagtcctcgtccccgcgcgccgcgcccgcggaggcggacgacggagaggggggcgatgtggacgtggacggggacgggatcgcggggatccggagcgatctggcggagatcgggggcagggtgaggagcggcatctccatgctgcagagcaacctggccgtggcggagatctccaagatcgcgtcctcgctcctgccgttcggggaggaggagcccgacgaaggggagcccgtcgccggcgggaccgaggaggtgctggtcttcgtgaagcacatctcgacgcggcctgagacgtggctcgatttccccctcttcatcaacgagcgttatgcagacgattttgaactgtcgaatgctcagtatgtgcatgcactatccatggaacaccttgtgccaagcttatcagatttaaaggttcagatttgctcaactgatatgagtgaagcatgtttctggaagatatattttgtgcttctgcactcaaaactgaacaaacaagatgccgaacttctttcaacaccacagatcctagaagcaagggaggagctgctgcaaagtttacaggctaagaataagcgaggatctgagactaccggagaatcatcagagaatgcaaatgaatcctctggcccagctgaagagaaggtgatagaaccttcaatcatccaagataaagaagtctccatatcggaggtccgttcctttgaagaacccacctccgacatcacgccagaaatcgaggctgagaagttcccagtctcaaccaccgaagtggaaatcatcgacaagtcagtgatcgaagaagagctgttgtcagtgaaagataaa

SEQ ID NO: 11047 - DNA, 1960 bp, Triticum aestivum
  Clone ID: PAT_TA_11047
atttttttttttttttccttcttaacaaaagataatccattcatcgataatggatcaaagagtagtgtagccccagcatctctaccggatctctacatggacgctgctccggcgctctccggccacgtcccggcgacggggctcgtgacattgtgctggccgtcgctcaacgtgaccgacccgaacgcgtacttcccgtccacgatcaccgggttgccggacacgccgagggtgatctccccacgccacgctccgctgcccctcgtcgcactcccgcccggacggcgtcaccttggcgtcaacgccggcggcgctctccaccttggcagcgatctgcgacgtaccgcctcatctccccgctttcaccctcccctcccctccggttcccccaaattttacacactgaaccctttgcccccaccggcagcggtgccggcgcgtggtccccggcttgcgccgggacgggcgccagtcggtcgccgtcggggttgccgctatcccggtcgtcgcggtgcgcgtaccgtcccgccccaagaggcggccgaagtcgccgctgttcatcggcgccggatacgcggccgggatcgaccgcgcggatcccttctacgtgcccgccgccgcgaaccgaaccgtcgtcggagtcttgtcggcggtcggccaggacctgggctcaccgcgccggagttgtccctggagtacgcggtcgtcatgagcgccgatctgaccgccgcggggctccactccgggtgcgccctgccggagcagcgccgcgaggccgctcacgtgcgggcacgacatggacgtgccggagatgatgttgaaggggacgcgccgcgggtcgacggcgagaccggtcgggccggcctcgccggtccatgccgcgagtatgttcacgccgggcccgatgatgtcgggcttgaggatctccggcgcgctggagttggggccgcggctcgagaacgacgcgacgagcggcgagggcggcagctccccgtgtgtcccgccgaggacgatggtggccgccggcgtggactcggaggttatgtagtacttcatgatgttgccgtcttttttccccacgacgattgccgacaggaggtgggcatcggcgacgaggacctgcccattggcttcggtgttggcgagcaccatgccggcacccccagcgtcccgcacgccgaagcccttctcgacgcgggcgctgagaccgcgctcgcagagaacgatcttaccacgaaccttatcccggcaaagaaggcccgggaagcaaagtaatgctcatttgaaggtccggtcccggcacgatcatcccagcctcctttggggcagccccgcgagcacacgctcgctggcgtccccccaggggctgcagaaggcagcggcggatggaacgtacgccgggaaggcgggctcgagggtgcccgcgcccacggtggtgatccaaggcgccacgttggagagtgtggcgctcccgggcccggcgttcccggccgagcaggacaccaggacgttctgctccatcgcggcgaaggcgccgatggcgacgctgtcgcgcgcgtagtcggcggagccaccgccgagcgagagcgagagcacgccgcagccgtcggcgacggcggcgtccataccggcgaggatgtccgagctgaagcagccgccgagccagcacaccttgtacacggccacgcgcgccttgggcgccatgccgcgcgccgtgccagacgcaaacccgaacaggtcggcgtcggcgacagctgcgccggccgcggtggacgacgtgtgcgtcccgtgcccgtcgtcgtcgcgcggggagcgcgactccctgctcgtgtccatgggccccatcgccgcctcgtagccccggttaaagaaccgcgcgccgatgagcttccggttgcaggccgaggagttgaagtcagttccagccatgcacgtgcccttccacgaccccacgcgtccg

SEQ ID NO: 11048 - DNA, 872 bp, Triticum aestivum
  Clone ID: PAT_TA_11048
agagcttgcctccttttatttaaaccaactataaagagtacatagcatttaacttcttcacatcccgagtattaacctacgatgtatacaactaataaataaaaatatttttgtctgcgagacacatatatcaagttactcaaagttcagaccagtgaagtaactatagcggggcttacaggagagatcccatttgcagaagctctgatgatgatttcatccattcctttcaaaagttcaaagagcatgcgtatcagcatgaattagcacatatatgaccacaatctagtcaaaagtacttgtagctatagatcttgaacccagaggtactgaacctgacatggggtaccagatacgcaatctctttgaagaccaaatgacagattactctagataggttttggaatctaaacaccactgatactgcaattttggagtataaacaccaccgatactgcaattttggagtataaacaccactgatataaggtccttgctctccaactttttggtaccaggttaatagaaatctaaaaacaaatgcaccattacagcatttatttaatgcaattatccaccaatgtagtgttgcaactttcttgttatgaagctgattttcaagccagaaggtgtaacccacaacattattgggatgtagcttttctgaaggtatcaaccaagcctctcatatattgtagttttctcataattttctgtcttcaatggtacaacccgcatcctctgatggccagtgtacatagatatgtacgcatccatcaaccacatggggaaaaatattgaagtgaagccatctgtgttgaaccctggagttctgaatctaaatcttaaatgcccatcacattggcactcaa

SEQ ID NO: 11049 - DNA, 628 bp, Triticum aestivum
  Clone ID: PAT_TA_11049
atgtttacttgcttagacttcctaaggtacatagcaacagctgaacttatggaatataatctgctcatcttttcttgtcaataccacctaggtttcagatacaagggcttatatagtgcccacaaacatacaacgtgttgctgcgttttcctgctttctttcttggtcggaactaaccatggccattaccgtcgcccatgcgtgctcccggctgcgcaccccgggccgccacctggccccaccgtcttcgccttggtgactatcagcctagaacttggtcacacccaacataaacaatcggcagcctcaccatacccaccgccgttcctgccatgacttcgtcatcagcgatcccatcggacgtgcggccgtcattaacacgagtgctctgcacaacgaacatgtcgttgcactgcatattcagcggtgccgcatcctgtgcgcgcaaggtcacatagatgtagcgcttggaacatggtgccatgattcctttggttggttgtacggagtacttggcttggttggttatgacacgaaacgctacggagccatccgtctggtttggttagctgcatacacgtcgatatgtccttccttggctcgaataggaagcgcagctctattgccg

SEQ ID NO: 11050 - DNA, 1012 bp, Triticum aestivum
  Clone ID: PAT_TA_11050
tttttttttacctttggccttcaccttctccttcttcattggcttaacgtcttcatcagacttttcatcctcaaagaaatcatcatcttcatcagcaccatcttcgttgcgatcgtcgtcgtcatcatcatcatccttcgacgacctcttcctagctttccgcttttccttcattttttcttgatgcatctcccagacagtcttcttctcgctgctcttcctctcaaggatacgtttgctaaggtcctcaagttccgtgttgaatgttatctccatgtcctggtcatcagtttgttcctcatccgatttatctccttctagtaaaagagccaaccgttccttatttgttaacttcctttttgctactccatttggtcgaggctcgtcaccagaatcatctacatcatcatctgactcactatcactcgctaaaaatacaccaaggtcatctaactgttcatcgttgaacttccgcctcagtttcttcttacgctctggctcatcatcatcccatgtgagcttaactttgctatgttgcaaagcacgagtctcaaaatcaggctccttgtaattcggaggtgcctctgtagccacatcgcgagcaggatgtttgaactccatagagtccgaaataaactgcaaatcgaacacatttgctgttttcaagaactcggtaccatcaagagtggtgtataggtgatttgcagttgtactggaatcacacaccacaactgcatagtagtacctcagtctgtttagctcataagtacgcagcttgttgttctcagaatcagagtcatgctcatcttcttcgtcgccgtcttcatcactgtcattgtcatcgtcttcatcaccgtcattgtcattatcattgtcatcttcagagtcatgctcacgatcttcgtcgtcatcctcttcgtcactgtcactgtcattgcccggacccgtggcatcttccccaccatcaccatcactatcaccatgaataccaagaagagaagacgggccttga

SEQ ID NO: 11051 - DNA, 844 bp, Triticum aestivum
  Clone ID: PAT_TA_11051
cttccgctgacgcgtggggagctggtcgcgtctgaaactgatgcctatgcaattgctgatttcattaatcgaagcaaagccaaggtttacaccatcaaccttagcatggcgtatggtcaggctgccatgcttctttccctggggatggagggtaaaagaggagtgctaccaaattcgataactaactgcacctgcccaaggttcacaaatccggtggagctgccattgatatgtggattaaggcaaaagagttggagacaaacacggactactatctggaactcgtgtcccagggagtcggtaaacctaaggaagagctcgcagagttcctgagaggcccgaggtacttacgcgcgcaggaggccattgactacggcctcgccgacacgatcctgcactcgctggacggctcattcaagcccaaggacctgacggcgcagctggccaaggcacaggaaatgcggcagtctgggaagcgcgctccggctggagctgggcgatggtcgactccgaccgcacccagatagactagaacgcgacgatatgctcaggcgactgtcctgcctgttggttgtagacttagaagatatctgcctgttgtctgggatagatgatccacgccgatgaaaatgttgtgcacgcactgtacatcaacttctctatctttgtcaccatcttgtcatggatattgtattgtctcgaagattccactagtgggaaccccaaaattttgccaactctggtttgtagaagaagtgataatagacttgaggtttcttgtgtcaacctgcatatttttatttacagaaatactatagtatacaatttagtttttttcgccggt

SEQ ID NO: 11052 - DNA, 1279 bp, Triticum aestivum
  Clone ID: PAT_TA_11052
cgtccgcttgacaggggttatcgacgcttactagcgcggccggtgggcgctgtgctcttcaaccactcaggggcggacttgtccgtggagccggtggccacgtctcgtacatgattgtccaggtgatttcgacgccggtggtcgccgaggtggatgacctagacaccaccgtctgtgggaaaggaggattcgggtccaccggcgtttaagctccgagccggcagcagccacgccgtcgtccgcgctcgcgctgcgctgccccgccgccgcctcgccgtccagggcccccttccccaactcctcctcccactcccagtcggctgcgaggcccgcgaggaggccggcggggggctgcaggtgccactactaccacggcgacgggcccccaagaagctacgaccacatccccaagcagttccgcgaggagaacctcaaggatggcctgatggataattacaagaatgttcctcagttcctttatggcttaagcccatctcagatggaaatgtttacaactgacgacaacccttataatcggcagtcaaagaaagttacagaggaaagcgttgctgctttgaggagttatgatgaattcggtatgtactccttatcaggcacgcatgagggccctgcaagttacagcatgggtatgggcatgcccagcatgagcatgggtagagcagggaaaggatatagaagaatgagaagctcagccccggatctgccatcattgctgttggactcccgaattatatttcttggaatgccaattgttccagctgtaactgagcttattgctgctcagtttctgtggctagactatgatgaccgcacgaagccaatttacttgtatataaactccacagggtcgacggaagaagaaacggagaaaaacaagacattggtagatgttcttgtttgctcagacatctcataggaaggacgaagaatagttagcgagtctctgaagccgaagttcaacctctttgtcaagcaggtgtccgccagcattgggatggcagagccacacattgatgtatggatattttctggttgcttgccccgttctcaaactaataaaaaggaagtacatgctaatcttttgttttgctcatatgatattgctcatcttttgttttctgtctgatgcctcctgtatctagagcagaaatattcttaatttagtgtttcttgaacatggccagggcaatggataaaatctactctggatagttgacagagggagtacatgctaagttgacttttttcctgcggattt

SEQ ID NO: 11053 - DNA, 1703 bp, Triticum aestivum
  Clone ID: PAT_TA_11053
cccacgccgtccgcccacgcgtccgcccacgcgtccggctctgggccatgaccaccctcggcttcgaggactatgtcgacccgctcaagcactacctccacaagttccgcgagatcgagggcgagagggccgccgccacgtcaacgtcaacgtcaaccacgcccgacatgccaagaaacaacaacaacaatgccaccggttacgccgacgccccgggaggcatgatgatgatggggcagcccatgtacggctcgccgccgccgccacaacagcagcagcagcaccaacatcagattgcaatgggagggagagcgggctttccctatctcggaggcggcggcgggtcgtcggccccgcacccgcccccacgcgaccccgccccccccctcccctgccccccccccgcaccgccccccgctccccgcccccaacccccccgccttgcccgcgcgtcccgccccgcgggagggcccccgcccgctccagcggccgcggggccgccggcgggcccagggcaccacgccgccgggccgcctggagccgccgcccccgcaccccaggagcggccggggcggcaccgggagccgtgcccgagggacctcagggggccgggcccgcatggccggcccgcctcaaccccatcgccaacggcaactccggagactgacgacaggcccggcaacgtgcgcaccacgaaagggacaagccaatcagctggctcgcgccgctctgaagcagggagtccctaggattcccgagatcctcactcaacagcccgagctatatgcaaaatgacagtgaactagccccccaagcagaagtggcatcaaaagcgcaagagggaagtgttgaggaaggtcgagcctccgacctgacaggcgagactatcgtacacggataaggtataggtcagcgtggaggttacacgcacgggaagagtaatatagaacaccccttaatgtaatggggaggcgagaaagtcacaatcgcgcaatagacgacgatgggagtttccacttgttaggtaacccatcccttattaagaccgagccgacctatgcgtcttgatgctgagagcatctgaaagggtgcttctgatcgctgcatcggggatgtgtcgtgcatctaactgaaaacattgaatgaaaatgcttcagtgcttgtttagttcggtataatcggaataatccgaccggtggtagaaatgcagttttttggttgcatattgattttaatatgacccttgattaacttgctttttagtattgatttttgttggtgcgtggtgtcatgtgccggtttggggcatcttggctgtcatgccagtccgtgactgtcgtattattccgtgtagtgaaaattgttaggaggagtaatagcttctcttaactgcacgtttgtacttgaaagaagagattggttcccaccttctcttgtctttaggttgtcgctgttgcttgtagctgagctcccaccatccgggactaggtgctgttaccgttcggcgcatcttttcttttcttttcttttctttttgagctgaccaaagtgagggaatttcaacatattgttcctctctttggatgaagccctcctgtagccttatatcccattcagcaacaggtgaggaatactttgttctaccccacgttgctggaagccttttttttcaacttcttccccttctttccctcgcaaaatca

SEQ ID NO: 11054 - DNA, 1561 bp, Triticum aestivum
  unsure (1)..(1561): unsure at all n locations
  Clone ID: PAT_TA_11054
gccccgcccccaaacgaatcgcacccgcctgcgccgccttctcttctccagcgtcggatcttcccccactcgccgccctcaccgcacctccattcccctccaccaccttccctccctccacgcgctcctctatataagggggagggccggatgtcggacgaggcggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagcgggagaagcgcaagaccatcaacggcgacgacctgctctgggcgatggccacgctgggcttcgaggagtacatcgagcccctcaaggtttatctgcagaagtacagagagacggagggtgatagtaagctagctgggaagtctggtgatgtctctgttaaaaaggatgcactgggtcctcatggaggagcaagtggcacaagtgcgcaagggatgggccaacaagtagcatacaatccaggaatggtttatatgcaacctcagtaccataatggggacatctcaaactgaagatatggaccatctccgagactgctgctactctgctaggcgggttttcgtcatgcggagagcactaagcagttaaagaaacctcttagtacccccattagtctcgtgttgttgggtctgccagaactgatgctcaaaggctgcttcccagatgtaaattgctttttccctccccctagactcagttggtggtttagnatggttgttgttgtccccccccccccccccatgattagcctcgtcgtggctgtcattcggttcccatataatctgggtatttgggggagacataactcctcccaggtgtagtttgtcctgaactagctgtatcagactcttgagaagatgtgcttttagtccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggggggcaaccaaccgccctaaaaaaaaaaaccaaactaacgcacgcatgcaaggaaaaaaatattttttatatagaccaaaataaaataaattggccggccgttaaaaaaaaacggaactagaaaaaaaaaacccgggaaccaaacaaaataaattggcagaaaaaaaaccttttttaagcaaggtgaaaaaaaaaaaaaaaggcccgaaccgaccttcctaaaaaaaagtcacccagaatgaaaaaggaaaggcaccctccatggaccaataaataaagcggggtgggtggggttactcacacgaaaaccgacaaatttactagccacctaccaaccgcccgttccttttgtttccttcccttccttgccaggaacgtcggctttctttcccaag

SEQ ID NO: 11055 - DNA, 746 bp, Triticum aestivum
  unsure (1)..(746): unsure at all n locations
  Clone ID: PAT_TA_11055
aaattagattgcgatggataacaggnaatttggctttctagtgtgaaaacagaaatgtcagcacaacaattctcacactgagtacatggggtaaagtactggtttcctcatgtaatcccttcgttgactacagctatgcgcccacttgttccaatattcaggacattacaacttttttggccaacgataacgctcggaaatatttgtcccaaggcaacatggaagtcaccgcacttcaatgatttatggaagaataagggggttccaatgttcatgctgctttcctattagtaatggactattggctggcccagtaagtgttactggtacagattactagctgcatcacgttcttggctgatactgatctcaccatcggtgttgtatttcttatcttgactaactgctggcaaccagttccttatctgaagggcatgagttaactggtaagttttcagatgtttccatctccaattgtttgctgccatcatcagcagctttcttctcagccttcttgaaccgtcgatctttctttctatcactatttgatggcttattgtacaaatccttgtacttttcaagcaaatccttcttctcttctaatagaccaagcatttcatatgcaacttcaactttccgtatatattctttactaggacacttgcgaccacatgcttcaagggcaccgaaaagcttgataagcctatctagcatattgtttctgtagtaaattgccaacataagac

SEQ ID NO: 11056 - DNA, 595 bp, Triticum aestivum
  unsure (1)..(595): unsure at all n locations
  Clone ID: PAT_TA_11056
tttatgaatcaactatgancangatatttaacgngcagcaccgggccattatttgccagctcacttgttccttatcagggcgaaccaggtaaggagttccttatcctgctactatttacacccagaaagaaaggaaggctgaagaagatgttatcaaccatgagcttaattcccagcatgctctggccactattgcaaggttgcacaccagcccatcttggcgaagatcttgtccatgtgcagcaggtgcttccgcacgcggtacacgtgcagcgtgtacatgagggcagcgcaggtcaccagcaggaaggacaggacgatcagctcgctgaaatccttggggtcggagacgatgatgcccatgatgtaggtgagcaggtcgaacatggactgcagcgagttctggacccctccgacgatgcaccggtccgagtccgggacactgtcctgcatcagctgcatcaccgcaaggtcgaacatccagaggccgaggcgggacaccgcgacgccggccatgagcacccacgccgacgccacgccgtcgctcacccagatggagccgacgcaaagcagcaggcagcaccactgcatccag

SEQ ID NO: 11057 - DNA, 564 bp, Triticum aestivum
  Clone ID: PAT_TA_11057
tctggttccgggttctccttgccttttttgttttttcttttttggcgaaaaggaaggacaatttattcgagggatctttagttaaaccacagcaacacattgacccgaaagaagacaaatacgtggttaagccactgacaaatgataactggaagtaaaggaaagaaaatacggggactctcacaagtcacaaagctaataaacaaggaacgatagtcggcgtgcgttgtgttcctcttcccctttgccacgcctcactgacagtactgacagatcctgagagcctcagcttcacagtagacaatagtgaaagtgggaccaatgttcccgatgcaccacttatacgctgtctcatagcagatgcctgccgccaccggcgtggccattagcagctgtgcggcgaagagagccagcacgaaaactgcagccatcttaagcatggagctgggagccattgcaagagcaaacttgaagtgttttctgggcgccctcgcgccagcggcacgcgctgttgccatcaagggcagatcatagctggaactggcacaagtgcaaagatgaacg

SEQ ID NO: 11058 - DNA, 1749 bp, Triticum aestivum
  Clone ID: PAT_TA_11058
gagcgagtaggacctgtcccatctctctcttctctgctcggctcaggtcgccggcgatggggctggcgccgcccctccgcaccaccgtcctgctcctcctcttcctcctcgccgcctcttctcaggcggaggcggcacaagcggcggaggacgccgtgccggtcctctcggcaaagaaaaggatcgacctcaccggccccattgtcaaggtctttctcaccctcaaggcccagaacaccgccccgggcgccgacgcctcacacgtcctcatcgccttcacgcccgcccaggccgagcacctcgccatcgtcaagaccacccgggccgagggcaggcgcaagaagaaagcctacatcccgctcccagtaacacccgccgaccccgcgaccgccgctcccaacggcgcccgcctctactccatctcccttcccatcccactaaaacccgccgagaccatcaccaatggaggtcttctatgtgctcgcccactccctcgcgcccttccctgccgagatcacccagtccgagtcccagctcgtctactaccgcgacagcgccgtcatcctctcgccgtaccatgtccaggagcagggcacctacgtcaagacgcccagcagcaggcgtcgagtccttcaccagggccgaccccaccagccgctcgggccctgatgtcaaatacggcgcgtacagcaaccagctcccatacgcctactcgcccatcattctgcattatgagaacaaccatgcatttgctgtcgtcgaggagttcgtgcgcaaggtggagatctcccactgggggaacgtccaggtcaccgagcactacaagttgaagcatggcggtgccaagcacaaaggagtcttttcaaggctcgagtatcaggctaggcaatctatcagcggagcgtcatcatttaagaatcttcttgcaaggttgcctccacgagttcattcagtctactatcgtgatgagattggtaacatctcctcatcccatctgcgcagtgattcatacaagtcagaactagaaattgaaccaagatatccgctttttggtgggtggcactgcactttcaccatcggctatggtatgccactgcaagatttcctgtttgaatcggctgatggccgacgctttgccaatcttacatttggatgccctctactgaatactgtggttgataatcttaccatcaaggttgtgcttcccgagggatcgaaaagcccgcaggctgttgttcctttcgagaccgagcaacatcttgagactagctattcatacctggatgttgtggggaggacgacagtggtgataaagaagaaaaacgtagtaggggagcacaatgttccattccaggtgtactaggagttcaggccgatgttcatgctggcggagccgctgatgctggtaacccgcagtgctgcttttgttcgcagcgtgcattgtgtatcttcacacggatctgtccatcgcgaaatcgcaggcctcctattgaaggaggagtagctgcaaactagtcgttgtgatgaagtaattgatggtggtgaaacattagctttggggagttttgtagaagaagcaagcatgacgataattgattgctgtaggaactttgactcttttttttttattttcctgtggaagaaaaagaaaaatcacaattggattggatgttgagcaacaacttggttagtctgatcaagataagtttaccttgattcaactttccgtcaatcccttgagatcttttc

SEQ ID NO: 11059 - DNA, 976 bp, Triticum aestivum
  Clone ID: PAT_TA_11059
gccggcacgagggatttaatgaagctggtgttgaagtagttgtgaaggctgcacaaaggaaagagagagagatggcaaccgtggaacctggatttaaaaaacaattatctaaggaggaaaagtttgaaaagaagaagcagagacttgcagctatcggagaggatcttttggcaattgctgctgatcaaccatttcggtttcctgccacctttacatttgtggtcagagcattctcagtactggatggtattgggaaaggtttagatcctagatttgatattacagagattgctaagccttatgccatggagttgctcagatttaatgaagctggtgttgaagtacttgttaaggatgcaaggaagcgatgggacaggcaatctcgtgcattctacaatgtgttccgtcaacctgacagagttgaaaaacttgcacagatcattgagcgtttggagcaaggtgatctcaagcttcgtgtcagagcattagaatcagaaagatcgtttcaaagagttgctgctgtacagaaaacaattggatatggagtggctgccgggagtttggtaaacctcgctaccattctgcacctcaattcgatccggatgccagcaaccatcggatactgtctttgtgcgttctttgggctacaaatcctgcttggcgttctcaaggtgaagaagctggaccaacaagagagattgataaccggcactgcctgagttcaccaatcgaccagtgagagctgatccaaaagatttcagtgtaatacgttgcggttatcatccgctttttcttttccttttgcctgtgtgcagttttacctcagtggtggtgtagcatagccatcggcgtacctgcccgggcgcccgctccatgcggtgtaatagatgaagagatgtacatactgtacaattgcagggtaaatataaccagtttcgcacccctgctccgtttcaaaaaaaaaaaaaaaaaaaaa

SEQ ID NO: 11060 - DNA, 1105 bp, Triticum aestivum
  unsure (1)..(1105): unsure at all n locations
  Clone ID: PAT_TA_11060
cccccattctcccacccatccaccaaccccgttccttcctcgccggcacgaagccagggccgccggagatgtcgccggcggcggacagcgcgtcgggatcgaagcggcaggcggagctgctcaagcaggagggcaacacctgcttcaagaaggaccgcatcagcgccgccatcgacgcctacaccggggctatagctctctgccaaaatgttgcagtatactggaccaaccgagcactgtgctataagaagcggaatgagtgggctaaggttgaggaagattgtagaatggctatccattatgacagccactccgttaaggcgcattacatgcttgggcttgcacttctcgacaggcaggaattggctggaggaataaaagcactagaaaagtctttggagcttggaaggggtgcacatccctgcaagctatatggttgaagagatatggcaagagctttctaaagcaaaatacattgaatgggaaggcctatcaaaaatgcgatcctctcaattgcataaactgaatgcaacatgtaaagaagctctaaagagctataatagccttgataatccaactggagacatgtctgaagagcatctaaatgagctagacgaagttttcaagaaagctgcaaaggccgatactccaacagaagttcctgaccatctctgctgcaagattacacttgatatcttcagggatccagtgatcactccaagcggaattacttatgagagggctgtgattcttgaccatttaaacagggttgggaaatttgaccctgtgacccgtgaaccactggaaccattccaactaatatcaaacctcgccgtcaaggaggctgtagatgtatttttgaaggaacatggttgggcttacaagatcaggtgattgatttgtacaattgaattggtagggtacaccttgattggaagtaagattggcagtacatagttnctgttgttnctgttgacatcaaggaagttgtacatactttcgagtgttgttaaattggattggatcatacatagaacttgtcatgggtacatgtgtaaggaaatagacatgtgggtttagcaagtgcaaaaaaaaaaaaaaaaaa

SEQ ID NO: 11061 - DNA, 569 bp, Triticum aestivum
  unsure (1)..(569): unsure at all n locations
  Clone ID: PAT_TA_11061
ccaggatttgtcctcctccacccagccgccaaaccttctcgaagcttccccaccccgcccccgccccgatccgatcggaccgcccgcccgccatggccgacgaggcgaaggccaaaggtaatgcggccttctcggcaggccgcttcgaggaggcggcggggcacttctccgacgccatcgcgctcgcccccgccaaccacgttctctactccaaccgctcggcggcgctcgcctcgatccaccgctactccgacgcgctcgccgacgccgagaagaccgtcgagctcaagcccgactgggccaagggctactcgcgcctcggcgccgcccacctcggcctcggcgacgccgccagcgccgccgccgcctacgagaagggcctcgccctcgatcccagcaacgagggcctcaaggccggcctcgctgacgccaagaaggctgccggcgccccgccgcgccgcgcgccgtctggcggcgccgacgccatcggccagatgttccagggccccgagctctggaccaagatcgcctncgaccccgctacgcgcgcctatctcgaccagcccgac

SEQ ID NO: 11062 - DNA, 2245 bp, Triticum aestivum
  unsure (1)..(2245): unsure at all n locations
  Clone ID: PAT_TA_11062
ccggggactctgtcctggccgctctgactgagcaccgggctccgcctccgctccccgcccccgccccgatccgatcggaccaccaggccgtgaaggcacaagaggattatgaccaaaagtaagctggatgcgcagagggagaaagggaggaggaggtgcaagcagcagaagtatccaagaagcaataaagcactacaaatgtggctatctgcaggaacccggaagggtgctaggcggtacagtaatagggctgcatgctacacgaagctgggaacaccgcctggaggtcttaaggacgcgcgagaagtgactcgagctagagccaagctcccaccaaaaccgtataccagaaaaggtgcagttcagtttgccattcagggtttacgaaagggcaacggaaagttaccaggaagggttgaggcttggccggaattaccaccgaactgcctggagctgcctggtggtataaggaggtgtgcagagcggatcaccaaggctaacaggggcgggataagtcagggggaattgcaggagaagcagagcagagctcggaagtccacaacaacccagaccatcctatcctgcgccaggtggcgacggatgtcgatggattcccaagggaaccctaggaccgcccaagatcacctgagggacgcctggagtagcacagaagatccaaaagctcataaaagtccgaatagtccaaatcagacgatccatcgaagccagaacgaagccaggggcagttgtagcgcgattgtgctccgttgtgtaaccagcgtacactgcttctcgggccagcgtgaatgtactacgattcgatgccatgggagttgtctgttggagtcgcgcgtacggcgtaggaggccgtgattgcagcctacaagaataaggtcttatagacggcgaacctgcattatacaaagtccttggaacttgatgacgaggacatctcctacctcactaaccgagcagcggtgtacatcgaaatgggcaagtacgatgagtgcattgaggactgtgataaggctgtggagaggggaagagaacttcgtgctgatttcaagatggttgcaagggcactaacaagaaaaggaactgctctggccaaacttgctaagaactccaaggactatgatattgccattgagactttccagaaggctctaactgagcatcggaatccagacactcttaaaaggctaaatgaggctgagaaggcaaagaaagacttggagcaacaagagtattatgacccgaagttagctgatgaggagagggagaaaggtaatgagatgttcaagcagcagaagtatccagaagcaataaagcattacaatgaggctatcaggaggaacccgaaggatgctagggtgtacagtaatagggctgcatgctacaccaagttgggagccatgcctgaaggtcttaaagacgcagagaagtgtattgagctagacccaaccttcaccaaagggtatacaagaaaaggtgcagttcagtttttcatgaaggaatatgaaaaggcaatggaaacttaccaggctgggttgaagcatgacccgaataaccaggaactgcttgatggtataaggaggtgtgttgagcagatcaacaaggctaacaggggtgacataagtcaggaagatttgcaggagaaacagagtaaagctatgcaggacccggaaatccagaacatccttaccgatcctatcatgcgacaggtgttgatggatttccaggagaaccctagggctgctcaggatcatctgaaggaccctggagtagcacagaagatccaaaagctcataaacgctggaatagtccaaacgagatgatcaagcaaagctagaaagaagccaggggcgtttgtattgaaattgtgctcggttgtgtcaccactgtacactgcttctctgcccagtgtgaacgaacttctattgtatgccatggggcttttcagttggattcgtgagtacagccagccacatcgtttttcctgtttacggctattatgttacagttttatgcgggcaatatcccatgttattacttgtagccgtttccgccttcactgtggacaaagagaacaatagagtgttattgtattttatttcttgctctaggaaaatgctgtcaatggagaaaattcataaccaaaaaaaaaaaaatcaccaagggacggcccaagtcgaggaactagggantncccagngggganantccctaatanntatnccgccat

SEQ ID NO: 11063 - DNA, 739 bp, Triticum aestivum
  unsure (1)..(739): unsure at all n locations
  Clone ID: PAT_TA_11063
tatatttattaattaatttttattcaaagcttacaatccccatcatctttcaccaaaccgatagcaaagcaaccccatacatagaagcttacaagcgaagcaagcgaccgagctaatggacatggcaccgcctgcatccgccgtctccttctccccccgcccatcgacgggaacgactttccggccccgcgccgcttccgcctctggctccgtgggcgccgggcgggtccgcgcggcggtagcccccgagggaggcaagtggtgggcgccactgctcggctggtctgggcgggcggactacatcgaggccgcggcaccggcgccggcgatggcgatggcgatggcggcggaggaggaggagaaggcggggaggtcgttcgtgggcggcctgacggaggagaaggcgcggcagctgcgggcgcggatggtggagacggagagcttccacgatgccatgtaccactccgccatcgcctcccgcctcgcgcgctccacctagctaggccgccggacagaccgccagccaacccgccgacactagcagacaagttgatgtgcctgtgtgtcctttctgctataattgttgttgtcatgtgttaaagtttagaggagagaggtcggaaatgagatctagttttagggttgatccattccctccgtctccggccaccgcgacgctcgccggcctgcttgttttaccggcgcagatgtttcaatctgattnccccgcatttgtagt

SEQ ID NO: 11064 - DNA, 709 bp, Triticum aestivum
  unsure (1)..(709): unsure at all n locations
  Clone ID: PAT_TA_11064
cgtcccaccgtctcgtcgcatttcacaagtctctcgccgaagcaaagcaaagttacacagcagaagcgtagcgtaccgaccgagctaaccgatggccatggcaccgaccgcgtccgccgtctccttctccgcccgtccctcgacggtccggccacgcgccgcctccgcctcggcctcggccggagcagggcgggttcccgcggggacaccccagggaggcaagtggtgggcgccgctggtcggctggtccgggaaggccgactacatcgagcccgcggcgccggcggtggccgaggaggagaagcccgggaggtccttcgtgggcggcctgacggaggagaaggcgcggcagctgcgggcccggatgtcggagacggagagcttccacgacgccatgtaccactccgccatcgcctcccgcctcgcccgctcctcctaggagatccggccaccaacaaaccaactcgccgacgcgaagccgctgtacatagcgtttcctctctggatctccccgtggctgttgtggggagtccttgatgttcttctagccatggagggaggagtggtcagaggagatgaaggaggggatctagttntaggggtttgttcctttccgtcgtcttcggccaccgcgatgcttcccggtcttgttttgcttttgtcctgtatttagagtacaagcttggaatcagatgtttcgatttggttt

SEQ ID NO: 11065 - DNA, 924 bp, Triticum aestivum
  Clone ID: PAT_TA_11065
aagcttttctacacccacccgtctcgtcacatttcacaagtctcgtcaatcgtcgtctctcgccgaagcgaagcaggttacccacccagccgaagaagctttcgaccgaagcgtaccaacaccgagctaaccgatggccatggcaccgaccgcgtccgccgtctccttctccgcccgcccctcgacggtccggccacgcgccgcctccgcctcggcgggagccgggcgggttcccgcgggggcgccccagggaggcaagtggtgggcgccgctggtcggctggtcggggaaggccgactacatcgaggccgcggcgccggtggtggccgaggaggagaagcccgggaggtccttcgttggcggcctgacggaggagaaggcgcggcagctgcgtgcccggatgtcggagacggagagcttccacgacgccatgtaccactccgccatcgcctcccgcctcgcccgctccacctaggaggaccagccaccaaccaaccaactcaccgacgcgaagccgctgtacatagtgtttcctctctggatctccccgtggtcgttgccgggagtccttgatgttctagtcatggagggaggggtggtcagaggagaggacggaggggatctagttttagggtttgtcccttcacgtcgtctccggccaccgcgatgctccccggccttgttttgcttttgtaataggacaagctcagacccagatgtttcggttcagttccgactttgttgccacattggaattggagatcttcagtgcgcttgtacatagccatgttctcgccgtgctgtaatcatggaggagacgctagatgtgaatacgggaggggtctggttttaggattgtagtccctccccgatcttctcttttactcttttgtaattacacactatgtgcaaatgtttccatgt

SEQ ID NO: 11066 - DNA, 891 bp, Triticum aestivum
  Clone ID: PAT_TA_11066
gcagcctcctcctacacccaccgtctcgcatttcaccgcttcacttacaagtctcaccgtctcatagagccaccccagcagagcacccagcaacccagccaaagcttccgagcgaagcgaagcgtaccgaccgagctcacccatggccatggcctcgaccgcgtcggccgccgccttctccgcgcgcccctccacggtccggccacgcgccgcctccgccgggggcggggcgggttcccgcggggaccaccccagggaggcgaagtggtgggcgccgctggtcggccggtccgggaaggccgactacatcgaggccgcgccgccggtggtggccgaggaggagaagcccgggaggtcgtacgtgggcggccggaggggaggagaaggcggggcagctgggggcccggatgtcggagacggagagcttccacgacgccatgtaccactcccgccatcgcctcccgcctcgccccgctcctcctaggagaggatccggccgccacacccaaccatctcggccgaggcggaacgccgctgtacatagctgtttcctctctggatctccccgtggttggttgtggggaggtccttgatgttctagtcatggacgggaggtggtggttcagaggagaggaaggaggggaccttgttttagggttttccccttcccgtcgtctctggccaccgcgatgctccccggtctagttttgcttttgtactgtaattagagtacaagctcagaatcagatgtttcagaatcagcgtgtaaaacagaatcaaaacacggattatgctaaatagagaaaacttggtacgctcgccggtgacctggtctcccgaaaaaggttcagttccgactttgttgccacattggattggagatcttcagtt

SEQ ID NO: 11067 - DNA, 656 bp, Triticum aestivum
  unsure (1)..(656): unsure at all n locations
  Clone ID: PAT_TA_11067
cctcccctcccgtccggcagtaggttctgtgcactcctcagcccgaagtctgccatggctcggctggccctcctctccgtcttcttctttttgctcatcatcaccggccttgtggctgccgctccgtccagtgggaaggtcggcaagaaggtgaccatgaccgtccagttcccgcctgccgactcgccaccgggggagatgatcacgatctcaacgcactacgtccgcgaggacggggtgcacgacagccacgtccatgtcgactgcgacgaccacgagccccagctcggttccgccgcaaaatatcttgtcaggagcctggagaagatacgagatgaggaggcgtctccatccgaggcctacaacatgcccagtcagtggatggacgtcctctttgaattggtctcagggaaaattaggcgcgatttactttattatcgtagcattgtctctgcaaggagctccttcgctcgtgcgaacaatcaatcggtctactgacattgggtgaagaaatcttctgtctgttgagtgcccattgcgcgatcggatcagttatcctatggatcattattggttctggtgtggtgggggcccgcgctctgcgcggggcgcgtgtgcacctcccttcagttatctctgtattattngattctgag

SEQ ID NO: 11068 - DNA, 1750 bp, Triticum aestivum
  unsure (1)..(1750): unsure at all n locations
  Clone ID: PAT_TA_11068
ggcgcgcccccagacgcgcgaggccatgccgtggggccccgccgaggccgggcgcccgggccgcggcgggcgctcagggggtcctcaaaaagcttggacgggacatccccggcagcgacaagcacaggacggttattgcctatggacggtgggctctacgagcactacacaatcttcagcgaaaccctggagaacaccctgcgcgagatgctaggggcggttgtatcctcctccgccgtcgtcgggctcgcgttcgccgggtccgggttcggggccgctcgcctcgctgcggcgcgttgtgaagcaatgaatgtgatgagctctcaatcccggcacacttaatgactgggacctcgcaagaactatttgattttattgccgctgctttggcaaaatttgttgcctcagagggtgaagactttcatcttcttgagggaaggcaaagagaacttggttttactttctcttttccagtaaagcagtcttcaattgcatccggaactcttatcaagtggactaagggtttttctattgatgaaacggtaggcgcagatgtggtggctgaattaagcagtgctctagaccgtcaggggcttgatatgaaagtgacagcattggtaaatgatactataggaacattggctgggggcagatatgatgacaatgatgtcgttgctgctgtaattctgggtacaggtaccaatgcagcatacgtggaacgtgcaaatgcaattcctaaatggcatggcctccttcccaagtcaggagatatggtaataaatatggaatgggggaacttcagatcgtcccatcttcctttgactgaatttgatcaagcattagatacagaaagcctgaatcctggtgaacagatttatgaaaagctgatctctggtatgtatttgggggaaattgtaagaagagtcttgttaaagatgactgaagaagcttctctttttggtgatgatataccaccaaaactaaagatcccatttattcttaggacgccacatatgtcgatgatgcaccatgacacgtcagctgatctcagaacagttggagccaaactgaaagatgtcctagggatccagggcacctcacttaaaacgagacggctagttgtggccgtatgcgacatcgttgcaaagcgtggggcgcgccttgctgctgcagggatacacggggtcctcaaaaagcttggacgggacatccccggcagcgacaagcacaggacggttattgccatggacggcgggctctacgagcactacacaatcttcagcgaaaccctggagaacaccctgcgcgagatgctaggggaggaagtatcctcctccgttgtcatcaagctcgcgaacgacgggtcaggtatcggggccgctctcctcgctgcagctcattctcagtacctcgaggccgaggtctgaggagcctagcctggatatagatataggttgttcctcaggagcagtgatgcctgagtcgcgccagggtcctgtctgtgtgtgtagctggagcatccatggagagctgtgtctcttagtaagtggtagctctgtaactgtataaatgcaggaagacgattnctgtcctccagccaaaaattcggctctccagaaatttcaaaccatccagacgcattttgtgacctcaagtggattgttgcaacatctcaactgaatgggcgttatggcaatatgaagtggtcccattacaaatattaagttattagctccctcattttttttgt

SEQ ID NO: 11069 - DNA, 1522 bp, Triticum aestivum
  Clone ID: PAT_TA_11069
attcggcacgaggccccctcccacttctcactgtccactccaagcagctagtggccgtctcctcttccccacttccccatggccacctcccacttcctcgccgccgccgccgccacatcttcctcctccgccgccttccgcccccctctccgcttcctctccctgccgcctccttctctaaccctcagccggcggcggccgttcccggtggtctgcgcggccgacgccgacgctaaagaaacaacgaagccgaaggtcccggagaaggcgccggcggcggggtccagcttcaaccagctgctcggaatcaagggcgccaagcaagaagacaacatatggaagatccgtcttcaacttactaagccggtgacatggcctccgcttgtctggggtgtgctttgtggagcagctgcctctggaaatttccactggacagttgaagatgttgcaaaatctattgtttgcatgttaatgtctggtccatgtcttacaggatacacgcagacaattaatgactggtatgaccgagacatcgacgctattaatgagccttatcgtcctattccttcaggagctatatcagaaaatgaggtaattactcagatcggcgtgggttgggtgcctggtcttgggttgggtgctttgttagacgtatgggcagggcatgattttcctatcattttctaccttgctctgggtggatccttgctttcttacatatattcagcgccacctctcaagctcaagcagtatggtctgggaggaaactttgctcttggtgcgagttacattggcttgccctggtgggctggccaggcgttatttggaactcttactcctgatattgttgtcctaactactttgtacagcatagctgggctagggatcgctatcgtaaatgattttaagagtatcgagggggatagaactctgggacttcagtcactccctgttgcctttggtatggaaactgcaaaatggatatgtgttggagcaatcgacatcactcaattatctgttgcagcctacctcctgagcaccggtaagctgtattatgccctggcactagttggactgacaattccccaggtgatcttgcagttccagtacttcctgaaggaccccgtgaagtacgacgtcaaataccaggcgagcgcgcaaccgttcttcgtcttcggcctgctggtcactgccctggcgaccagccactgacggacggacctctgctttggattagggggcattttgtacaacacagatagtggaataaatctgcagcaacaacatcaagaacgcccccctgaatgctgaagatggaaacattaggcggtggctctttccttctgctgccttgcctctagtgcgcgtagaccgtaggtgcacagtgccaggttgtttgtttgtgatgttatcagttggctgtacaacgtagttttgggtgggccggtacgcgtcgtttcggttatgatacggtacgttctcccggttaatgatcagattgtttctcctattaaaaaaaaaa

SEQ ID NO: 11070 - DNA, 1179 bp, Triticum aestivum
  unsure (1)..(1179): unsure at all n locations
  Clone ID: PAT_TA_11070
cacaaatctcgcgcgcaccaccgatctccagcgaccacctcaacgccggcgatgccgtcctcctacgccgcggcggccgccgccgcatcctcttcgcggaaaccagctcctttcactactgctaccgccaccacccgtaaaccagcacccttacctgcccccgcgcccccgccgtcgaaccctagccacgtctccgattctgatccctcgtcctactcctcctccggggaagagaccgatctcagcgcctgcgacccggcgactgcgtccgtcctctccacctacctctccgtcgccgggnaatggcgctgacctctcgaaagtcggcatcttcctcaactccgccgcgcgccgccgatccccgccgtgcctgatctgcttggaccccatccgcccctcggatcccgtctggtcatgctccgcctcatgctttgcccttctccacctcccctgcatccagtcatgggcacaccagtcagcctccgccgctccttcccccacctggggctgccccaagtgccgcgtcgcctaccccaaatcccagacccccacctcctaccactgcttctgctccaagaccgaagaccctcccgcggacccctggatcctcccccactcctgcggcgacgtctgcggccgccgcctcaattcaaatcccgactccggctgcgagcacacctgcctcctgctttgccaccctggaccatgtcctccatgcccggctgttgttcctaacgcccggtgcttctgcggggcgcaccgtcgtccgcggcgctgtgcacatcagcgctattcttgtaagggtaaatgcaataaacgccttagctgtgaactccaccgttgtcctgtggattgccatgatgggccatgcccaccgtgtgctgtgcgggggaatcacaaatgtgagtgtggagagacaatggtggagaggctgtgctctgaaagagttttccagtgtaagagggagtgtagtgggatgctagagtgtgggaagcatatgtgtgagaggggatgccatggtggaaaatgcggggaatgcccgcttcgtgggcagcggacttgcccttgtggcaagaaggattattcaaggctggagtgttatgtggaggccgcgacatgtggatcaacttgtgagaaggtgcttgggtgcggactgcacaagttccccgagcggtgcca

SEQ ID NO: 11071 - DNA, 404 bp, Triticum aestivum
  Clone ID: PAT_TA_11071
ttcggcacgagggtcaagacggacctccggttccagagctccgccgtgtcggcgctgcaggaggccgccgaggcgtacctggtggggctgttcgaggacaccaacctctgcgccatccacgccaagcgcgtcaccatcatgcccaaggacatccagctcgctcgccgcatccgtggggagcgcgcctaggcctctctgcctctgcgtcacgcctgccgccgcggttccttcctggttgatcccgccgacggatttgttctgccctgttagtctagtctcgtcgtgcttcgagttgtcattagaatttgttctgttctattagtctcacgctgttgattacccgctcgaaaattgcaacggaggtgatgcaattcatcttaaaaaaaaaacataaacgggcgtcc

SEQ ID NO: 11072 - DNA, 979 bp, Triticum aestivum
  unsure (1)..(979): unsure at all n locations
  Clone ID: PAT_TA_11072
tgggtaacgccaggttttcccantccacgactttgtaaacgncggcccagtgaattgtaatncgactccactatagggcgaatgggccntntagaggcatgctcgagcgccngccagtgtgatgnatatctncagaattcggcttagcgtgttcgcgnccgaggtactgaaagaatatattactactagaattagaattctagtaattaaattacgtccgcttttttggaggttgatagtttatttattgaggaagagtcaatccttcttttctcacttcaagattgatcatctcgagccatccgttgagggtggaaatttaagaataaataagttttaagcaaacttgtttagtcgtctttttcaaactatgtttcattcatatgatagaattttaatatgggtttaaataaattggatcttggcggaggcttcccggataaatacttactttcttttatccatattgctccatagatagcaagttttaattagtataaaaaaactaaaccaatgactattcatgattccatccatattggatcaattctctataccactttgcaatgaaaagaggaatgtttgttatggtaaaacttcgtttaaaacgatgtggtagaaagcaacgtgcgacttgaaggacatgatcgattgtggattttgctatccatcattttccatagtaatgaaaatgctcttggctcgacatagcctgttctattcgttccgaaccaaatttgcgctgggtttaagtaacatagtacccgcccgggcgcccggcgacgccgttttcctgctcacgggcggccgctacgggtggtgcccgcggctcggttccgccctcggcgtcatcttcaggaatatanaaataatcgaaaggtcaaataagaagaatcaataaaatatacagatcatccctctataattcnatngagagtaagcttatcganggaatangaaaagtatttgcaccttttan

SEQ ID NO: 11073 - DNA, 937 bp, Triticum aestivum
  unsure (1)..(937): unsure at all n locations
  Clone ID: PAT_TA_11073
ttggaaatcttcttctagacatatatngaagagatcctccactagactaacacttacaaagtaagcagtaaagacgaataaaaatggagtgcatttcacatatacttatcaatgtatgcgacagtaacacacaaacctgccctcacacaccaagctaaatggaaaagcatagaaaacagtagcatccttattgacacacaccagcagagcaaatggatgtgtcaccctctacgtcagacgtagcactcgtagagcttgatgtccatctgcagacggaagtagacggctccctcggaggcgtcaaggcggagcgtggcgatgccgcgcgccatgaagaagtcgccggtgccgccgacgacggagaggtcccgcgtcttgtcgtccatgaggtccgcgccgacgcgccccatggggcccgggcccgccgtgctggggttgaccagggggaggccttaccccgtggtggacgactcctgcttgtcgtagaagtagaacccctgggcgcgcgccgccgggctcctccccccccaccggtagcgttttcccctccgtcaacgggtcgtcgaacaccaccagcatgccgaagtaggtgccgttcttccagtgggtcgtgctcagcgccgtgggcttggtggccgccgcggacgtcgcgttccggcgtgttgttgacgccgttgtagaggatgtcgtggtagtagagcgtcatctcgttgcacggctcgtcggagctgctggagacgaccctcctccggccgcgggcggcggccgcccccgccccctccagggccaccgcgaccaccacggccaccccctccctgatgccgcccgggcggccttgctcggctgtccctcgctcgctgtgctgagcttagccgccgctggctcgactgccggtgcgggtgtgcagcccggcaccttgtgttcttgggacgatcgg

SEQ ID NO: 11074 - DNA, 556 bp, Triticum aestivum
  Clone ID: PAT_TA_11074
agatttgctcttcttccttcacgtccgcagaaccggtgggcgtacctacttccactgtttcttgaagaagctgtatacgaatgctcaggaatgcccccgctcctatgataagctgcggttcgacccaagccatcctgattgcacgctggttgttagccatgatgactatagcttaacttcaaagctgccaagggagaggacttccgtggtgacaatactaaggaatccagttgatcgtgtgtttagcacgtatgagttctccgtggaagttgcagccagatttcttgtgcatccaaacttaacatctgccaagacaatgaccagccgtgtgttaacaaaatcacgtgctgtaagtacactggacatatggccttggaaatacttggttccatggatgagagaagatcttttctccaggagagatgctagaggtaatgacagcgtgccaagtagcaagaagattaatgcatacgatgtggaagacatggttatgccattgcaccagtacatcaatgacccctgttgcccatgaaatcattcataatggagctacctt

SEQ ID NO: 11075 - DNA, 821 bp, Triticum aestivum
  Clone ID: PAT_TA_11075
atgccctgtggctagcttaatgataaaaacagtaaggtgtacactagctacgtacatataactgaaatataaaactctaatcatcttgttcttggcggtgcaacctaatggcccatctttcatttctcttctaggcagaactagaaagatgaacatggcaagcaaacctacgctctgtccaagctatatagccgcagcaatatccacctagttaaccattccctatgttctcaccattccccatctgtattgacagccaacttctaatggtattcctcccgtccgctgtatagccacaatatcctatggtctcacaccgaaaccttgcaattccacacacaaaaaaggaacccaaagggttcttctaaacttgcgaagctatgcaacaactcagattatctttggctagatctgcggcttcgtttcacacatgactgggttccattgcttgctgctccatctgcttctccaactcttctgtagaacagcacgtaagctgcacctgacttcacttcttcctcattgatggcagaaacatggctatcatcaaaattgtaccacctgttctcatccaagagctttatgtaagcagtataatgcccactcgccatgctgccataatgattgctaacagcatacagctcataagtttgacgctgaggtatcttgttagcaatatagtttgtcaaatccaagtcatgtattgggaaattaacaaaagtttccagcttatgcttagttgacctactaaatgagaatctcttcaaatgaataactaacacttctggtagtctccataaatcaagctttttactagcttg

SEQ ID NO: 11076 - DNA, 597 bp, Triticum aestivum
  unsure (1)..(597): unsure at all n locations
  Clone ID: PAT_TA_11076
gnggacccaaacccggcttacccgagcgagcgagctgtgacgatagagcccgggaggcagcaccgctcgggagcaatggagagggcgacgccggtgcggagcccgcacacctcgacggccgacctgctcacctggtcggccacgggcgccgacgcctccgccgcctcgccggccgccccgtcccgccccagcctcaagccggctggggggatcacgccggccatgttcggcgcgccggtgagcgagcacgaggccgaggatctgagcaacagtgaaaggagattgatgtccggttcaaagatgaaggaaatgactgggagtgggatatttgctgaaaagaacgagaatagtgattcggagtcttcaaatcctgcaaacagaacttctgtgaggatgtatcagcaaactgtaactggagtaagtcagatctcatttagcgctgatggaagtgtttctccaaagaagccatcctcaattcctgaagtggctaagcagcgagagcttagtggcacattcgagactgatgctgaagctaaaattaataagcagctttctgaagccaagaacaaggagctcagcggaagcaatatctttggt

SEQ ID NO: 11077 - DNA, 1374 bp, Triticum aestivum
  Clone ID: PAT_TA_11077
tgtcgcctgcgcccacgcgccaaccccggcttacccgagcgaccgagacgagaagaagaggcgatagagcacgggaggcagcaccgctcgggagcaatggagagggcgacgccggtgcggagcccgcacacctcgacgggagcgctcacgtgtggtcggcgacgggcgccgacgcctccgcccgcctcgccggccgccccgtcccgccccagcctcaagccggctggggggatcacgccggccatgttcggcgcgccggtgagcgagcacgaggccgaggatctgagcaacagtgaaaggagattgatgtccggttcaaagatgaaggaaatgactgggagtgggatatttgctgaaaagaacgagaatagtgattcagagtcttcaaatcctgcaaacacaaactgtaactggagtaagtcagctctcatttagcgctgatggaagtgtttctccaaagaatccatcctcaattcctgaagtggctaagcagcgagagcttagtggcacattcgagactgatgctgaagctaaaattaataagcagctttctgaagccaagaacaaggagctcagcggaagcaatatctttggtccacctcctgagacccctgcaaggccactggctgctcgtaatatggagctacaaggaaatgtagattttgcacttccacaacgaagaagcgtgcacacatcagtgaaagtatccaatcctgctggaggtccaagcaacatcacgttcagtgaggatcctgtagcgaagacagcaaagaaaatccacaaccagaagttccaagagctgacaggcaataacatctttaacgaggatgctccccctggctcagctgacaagtctctgagctcagcaaagcttaaggagatgagcggcaatgacatcttctctgatggaaaggcgtcttcgcgagactacctcggcggtgtccggaagccccctggtggcgagagcagcattgcactcatctaattatggtagactgctctagtcgggactggctagtacatcctcctcatttcaggtgctctccttggcgttcccgggtctagacgatgctttgagatctgaattatgttggatatcttagccctaatatagtgtagagtcagcaggatctgactcggctcatatcatgtacgcttctgcgtgatctcatccttgttttgtggtacttatgtattaatctctctgtactgagaacctgcgcaataagctttttatggactcattcggtatcattgacaaggcaatttgcaactcttttatcagctatgccaggaaatgttcagcggaattcttgtggtcaatttgccactcttttatcagctatgctaggaaaggttcagcggaattcttgt

SEQ ID NO: 11078 - DNA, 669 bp, Triticum aestivum
  unsure (1)..(669): unsure at all n locations
  Clone ID: PAT_TA_11078
aaacatatgatggcggcattcgacgcaacgtccctcaaacatccagggnaaacaaaatgggtgtagcgagtgcgcgcatgtacatgcgcaccgatcgtatagcgtattacagtacatgatttatttatcatcagtactggggcatgctgcactcgggcggtacggggcccttgccgttgacgcagtagtcgtagatggtgtagccgagctgcacggccctgagctggcgcatctgctccttggtgagctgggacggctccggcggggtgtccttgttgcatctggcggcgcactcggcgtcggtgctcaggcactcgcagacgtcgaggcccatgttgtcgtactcggcgacgaagggcgccttggcccagtccgtcttgacgcggccgccctgcgtggcccagtcgtccgccgaccagatgctggagaagccgtacatcggccgcttcgtcgggaacggcacgcccttgctcgcgtagttgcggaacacgcggatcgggatgctgtccacaaaccacacgatcatggaggggttccagaagatggtgtagttgtggaagtcggcggtggggtcgaaccaggggtagaactgcacctccttggcgcccacgccgtcggcgaacacgttggtgtggatggtgtagggctggcccgtctcgttgcccagga

SEQ ID NO: 11079 - DNA, 992 bp, Triticum aestivum
  Clone ID: PAT_TA_11079
ttttttttttagagtgaaatccttttattatctcttcaaacaaatttattgaagacatgggtattgcattgcggatgacagactagcgaactgcaccaaaacactctcgagtttttgacagcacacaaagatcaccgaacacaacaaaagaattgcaaaataagatgcatcagggggctaccgaactgcacgctgctagcttgtcaaatcacacgtacgacgccaatgagctgcacggcgtcgccgtccatactgcatctagtccaacacacaacacaacacacacaacttgactcaaaagaaaaagaactgcacttgcgcactaactgagtcgccctagatctagcccgagcgagtactacgcgctttgcagcccgcagtggccctcgccgctggcccgctgcgcgtgcgggaaggaggccgaagtctccggaacaggtcacgctaggggtgcctcgggtgctcgctcgaatcacacgtacgccgccaatgagctgcacggcgtcgccgtccatactgcatctagtccaacacacacaacttgactcaaaagaaaaagaaccgcacttgcgcactaactgagccgccctggatctagcccgagcgagtactacgcgctttgcagcccgcagtggtgcacggccatggaggtggaggtgacgaggggaggggaacttgcggcagagtgccatgccgctcacgctcggaagtcgacctcatggcggcaagggacgacctacagcccaccgaatctcgcgcggggggaggggggagtgccggcgtgctgcgtgcacccaggtagtggactgcacgggcgcccttggatcgaccggggcagagccatagctgccggcgcttcctttgcgccgctcgttgtccttcctctccgaggttgggctccctgtcatggccagcaaccagtggagggggaggaggatggagacagatccgggggcagacgaactgcacgcctcgtcggggcctcgtgccga

SEQ ID NO: 11080 - DNA, 478 bp, Triticum aestivum
  unsure (1)..(478): unsure at all n locations
  Clone ID: PAT_TA_11080
catcggcaagagactacactcctccccagtacctcacncttcttttgactgatcttggtgttctgacaccatccgttgtgagcgatgagctcatccnnctgtacctatgatcactgctaagatacatgttctccagatcgtccgcggacgcgtggggttgaattgaggttttccctgtctctcactatatgttatcttttcccccgctgctgaaatgtctagaagaattctctaaaaccttaggtgagaggatgatccatttttacccgaccgttgttctggagtcaagcaataaaaaaaaaaaaaagtgacatcaaaaaaaattgcaaaaaaaaaaaaaaaaaaaaaaaaaaaaaataaaaaaaaaaaaaaaaaaaaataataaaaaaaaaaaaaattataaaatttaaagaacctattttttcaaatataatataatacttgggggcgccctttttaaaaattccaaattttgttc

SEQ ID NO: 11081 - DNA, 1234 bp, Triticum aestivum
  unsure (1)..(1234): unsure at all n locations
  Clone ID: PAT_TA_11081
tgtnatgngtanctnatccctntttgaaantcccccntgggttcttttgaaantgnagcgccggcgnggtggcggccggtntagaactagtggatcccccgggctgcntttnattcggcacgagcccacccctcccgccggggggngntnttcnnacgcctctccgggctgcccccgcacgccctccgcctccagatcgacgaggactactcggccaacaccccgcccagccgccgcttccacgtccccgacgtcctcctccccgacgtcgactcccgcgcgctccacctctccaagcccaagaccgtcggcggcgcctccaccgtcgcgctctccgccgacctcgacgtcgtcgtcaagcacgatcccttcgagctcgtccgccgccgagctggctcgggcgaacccgtgctctccttcaacttccacggcctcttcgacttcgagccgctgcaggagttaaagcccgagggcgagacctgggaggagcagttcaggagccacaccgacacgcgcccccgcggcccgcagtcgatcaccttcgacgtctccttctatggtgccgacttcgtgtatggcctccccgagcacggctccacatcgctcgccctccgccccacacgcggcccgggggttgaggagtccgagccttaccgcctctttaacctcgatgtgttcgagtatctgcacgaatcgccctttgggctgtatgggtcgatccccttcatgattgcacatggtgcaaagtgcatcttcaggattcttctggctttaatccgcggaagatgcacanttgatgtgcttggcaccaanggtnggantggccccggnatnaaacggganaatgggaagaaattanaaccctntngatggcntgaaggcttggtgntggttgaatgccgttccttttttgntgggttcccnacccnaaagggntgtnnttcaagccagtacattcagcggttacaaggnacncccttcantgccacaacnaatttncaagtgggattttaancantgcccggnggaactacagggaaccaagaaggantttgttggaatngaatcctgggtttgatgacnatgaaattccntataaacgngctnttggntttcncntttaaaaaatttttgggaanccnaaantttaaatngggaccntcccaaatttntaaaccccanganaaatcaccgganaaccnntntaggggnngggananngnttncttttttt

SEQ ID NO: 11082 - DNA, 591 bp, Triticum aestivum
  Clone ID: PAT_TA_11082
tttttttttgtcgttgtggccgtgtgcctatccaccaattcagccttgggcgtacagagcaacccttactcttatatcagtcacaaacttaggtcagcagcgcacttagcagaccgttgcacgcctcactggattgactaccatactgatacaaccaccatatctctatactgatatatacgtatatatgtagatacgtatatatgttgttaattagtttaaccatatatatgactctgtgcaggagcagagcagcagtcatgtccatcagtgaggtataggcttgaagcgaggcctggagaacgctggagtcgggtcgtagcggccgtagtcgttcgtcttcaccatgaggttccttggatggctgcctggagctgtcgttccctccttgtgcacagcgttgtgatgttccttctgaatcttttcttcggccagacccctgcctcctgcggcgcaaaccgaaacgacgatgagcagtagaagaacaagggaagctctaccaaccctactggagcccattttccccttcttcctctcgatcagctccctctaactctagtcccgagctccctgccctcggccgcgcgacgc

SEQ ID NO: 11083 - DNA, 642 bp, Triticum aestivum
  unsure (1)..(642): unsure at all n locations
  Clone ID: PAT_TA_11083
catgtaattatatagaagaaacgaggtgtgatagctttgccatctctccacacatgtgccaaatatcacagtccttcggtccctctcttaacaggccactacctagctccgtgcaccgcaagccgttgcttttttagtctaaaaatcagatgcttacgccgatgtcaactaggtgtgttacagtgcgcatgtaacacgcaagtatgtcaacgccagatttttcaaaaggtagattggacccagtaactcccatgctttttcactggagtgcatcttctcatcttctagccgcacagagtaaaatccgcacgtaacaatatcccatcacctgattctgttcttgaaaaggaatttcacatcgcttgtatccggttgcctccttgcggtgatttgtatcacagcaccatcagcaagcatgcgctgaacaactcttgtaatgtttttcgcgtcatcgatgccgagatggtggcttccaacaattgggatttgaagctccctcatcattggcatcattccangttgctcctccattgtagaaggtgagggagaatatccttcaaattggtccactccataaagtaagatggcaattttatttttgaaaccttgcactgctcagggaccttcgtcttcaaatcccaa

SEQ ID NO: 11084 - DNA, 689 bp, Triticum aestivum
  Clone ID: PAT_TA_11084
cgaggaacctggtgctacggcacctccgcttggccgcgtcccccgcgtcgtcggtggccctcaggccggcagcggcgctgcagggggccctgtcggggcggcggtggatgtcgtcagaggacgccaaggggtcgttcctggacaaggacgaggtcaccgagcgcaccatcaaggtcgtcaagaacttccagaagatcgacgacccatccaaggtgaaagcagatgcccacttcaaggatgatcttggcctggacagtttggatgcagtagaggttgttatgtccttggaagaggaatttggctttgagatacctgacaatgaagctgacaaaattgactccattaaagctgcagtggacttcatcgcctcgcaccccaaagccaaatgagcaaagggcttggtcctccacttgttcaagtctttaccccatgaagctcgtgttcagatgagaaacaattcctctgcatgctgtatgtttctggggttgtgcgccatgttcaatttcgagcaccgccttttccgaataatatttttgatatgagaaggataacgtattcctgtatggagttttcttaaagatctctgtcctgagtctccggtttgttttgaagactgagttgcgattttgattgtgtatgaccaactgaagtatcaatttactcatatatgcgctgaatgtttgtaatac

SEQ ID NO: 11085 - DNA, 930 bp, Triticum aestivum
  Clone ID: PAT_TA_11085
ctaaaaccctgccgcgctcctcctcccccactccaccccagcccagaagactctcgcctctgcccccctcccggagctaagcacccatcccacccaaatggcggcggcggcgaggaaccgccccgccgccgcaacgcatcacgcttcctccccccccctctgcccccctccccggagctaagcacccatcccacccaaatggcggcggcggcggcgaggaacctggtgctgcggcacctccgcttggccgcgtcccccgcgtcgtcggtggccctcaggccggcagcggcgctgcagggggccctgtcgcggcggcggtggatgtcgtcggaggacgccaaggggtcgttcctggacaaggacgaggtcaccgagcgcaccatcaaggtcgtcaagaacttccagaagatcgacgacccatccaaggtgaaagcagatgcccactttaaggatgatcttggcctagacagtttggatgcagtagaggttgtgatgtccttggaagaggaatttggctttgagatacctgacaatgaagctgacaaaattgactccattaaagctgcagtggacttcatcgcctcgcaccccaaagccaaataagcaaaggacttggtcctctacttctagtttttaccgccatgaagctcgtgtcagatgagaaacagttcctctggggttgtgtgccatgttcaatttcaagcaccgccttatccgaataatatgtttgatatgagaaggataacgtattcctgtatggagttctcgctagctattaaaagatctatgtccggagcctccggttgttttgaagactgagttgtgattttgattgtgtatgaccaactgaagtatcaatttactcatatgtgcgctgaatgcttgtaatacaggtcgtatcatcgtttgcttgtttgaagagttgcaaaa

SEQ ID NO: 11086 - DNA, 698 bp, Triticum aestivum
  unsure (1)..(698): unsure at all n locations
  Clone ID: PAT_TA_11086
ntggtgcaatttggaggnaangngggcctttgttttancngtggaaaggggttttntcaagggttanttggaacncaggttttccngtctcccgttgtaacgacggccgtggcgcggtatagactcacttagggcgattggtaccggcccccctttcttcctcttaagtatcttctaaagtggaaaatcaggtacatcaagtattatatactactcccactgtaagggtaataattaaacgctcttatatttatttccaaagggagtattcatatcagtacatttcacacttcccctaataataatgacaattattgtgtaaaaacttttgaattcccttgagtgaaaacaaagaatactcgcagaagagaggcggaggtaatcattgtctaaatcctcacctaacagctggaccagtagacagtatagacacactgcccaaatgctcttgctcaaatgcagtgctgctctggctcagatcagtagacatgccagtgtcgtaccgaccatagtcgttcatgctgccaccgctcccaggcgtgtaaaaccctgcattcccattgtcgtgtgcagcctcaagctcaaggcactcatgtagcactgctaccacatcagtcatcgtgggccgctctccgggcttttgtgccgtacacttcaatgcggtgtccgcaattttccacacgctattgacatcgtgg

SEQ ID NO: 11087 - DNA, 1693 bp, Triticum aestivum
  unsure (1)..(1693): unsure at all n locations
  Clone ID: PAT_TA_11087
ataactccttccccgtgccgcaacctcccgcaaatctccgccggccctccccttccgacccgcacaggccgcagcagaggcgccatgtcgtcctcccctacccccgcgccagacgccggcgccggcccgaggccccgcgatggcccgtcgacgaccgtcggagaccgatccagctcgactcatgtccacggaggacatcgtccgggccacccgcctcctcgacaacgaggtccgcgtcctcaaggacgagctgccgcggaacaacctggagtcaaggaaaagataaaacagaaacaaggagaatcaagagaaaataaagctcaaccagcagctggcctggcaacatcgtcgagatgttggaaatgttagatggatttaacactgaagagaggctgaagatgatggtaatatacatctggactcacagaggaaaggaagatgtgttgttctctagacgtccacaagaaagactatatttcttcctgtgatcggactaggtgaccctgaggacttcgtgatttggctggagtcagcagggacaacttcttgatattagatatgataccttcggtctttgaagtatgactctcgactataggcaatggagggagatgaaaggggaagctggaattataatgccatggggggactttagagaggtgatccatgaacttgtcgaagctgtagtgatgccaatgacacacaaggagcaatttcagaagttgggaatccgtcccccgaaaggagttcttttatatggaccacgtcgggacgggagaagacgttgatggctcgtgcatgtgctgcacaaaccaatgcaacctttctgaaacttgctggtccgcatttagtccagatgttcatcggtgacggggcaaatcttgtccgagatgcctttgagctggcaaaggagaaggccccctgcatcatttttattgatgaaattgatgcaattggaacaaagcgttttgacagtgaagtgagtggtgacagagaagtgcaacgaactatgttggagttgctgaatcagctagatggatttagcagtgatgagaggataaaggtgatagctgcaaccaatcgtgcagatattcttgatcctgctttactccgttctggtcgcctggacaggaagatcgagttccctcatccgacggaagaagcaagagctcggattttgcaaattcactcaaggaagatgaacgtacatcctgatgtcaactttgaggagctggctcgttcaactgatgatttcaacggtgcacagctgaaggctgtttgtgtggaagctggcatgcttgctctacgcagggacgctacagaggtgatccatgaagatttcaacgaaggcattatccaagtgcaagcaaagaagaagtccagcttgaattattacgcttagtttcccttgagtaatcagaacgcttggtccagtgatgacccctgtttgtaacactcggctaccatttttatttggaatatagtttaaattctcgaatcctcgtgattgtgtgaagcactcttgctttgtgcctgtacccaaagagattatttctagccaattgctctgtgccgaaaatgtttacggcttgttacaggatgcattagctatattccaaataaaaatggtaggttggtgccagattgatgtcccgagggactcaccacttacttttccttctccaanaaaccc

SEQ ID NO: 11088 - DNA, 876 bp, Triticum aestivum
  Clone ID: PAT_TA_11088
aggaagtacacaagaatactggggtagacaagatgctgcgcaggccattgctctagttctatggaaaggtcttggtcttgaggaaggaaatgctgttggaacttggctggggagtggtgagaaggttctactaggtatcggtggtggtcactacgcccctcgtcatacggatattgtcatcaaagatggtgtctgggtgggtcatctcctgtctggttactctttgccaatggacgctccgcctcaagtaaatggaaagagttctggtgaggttggtggtatgtggaagcattccatcaaagtttcgtatgaagccacaaaggcaggatttcctggtggtgaagttatagcacatcttgatcagaagagcttcaaggggtggcaaaagaacgctatcacgagctatttgcaggagcaaaatatcaggatagggaaacccaatgatttcctctgcacaaaaacttgactgcgcccacaaggcaagtcgtcgaagtgacttcaccctccctagggcttggcacatgcaaattgagtaaatatagagcactgtattttgataatccgatttcaagatgtagagtactccctccccgttcgtcttagaaggcctctcttgtgccaaaagagaaaaaaacaggaatatactactccctccgtccggaaatacttgtcctaaaaatggatgtatctagacttattttaattatagatacatccatttgatccatttcgaggacaagtattttcggacggagggagtaagagagagacatatcttaagggcacgtttgtctgccagactacgcgtgcttggggttccaagagttggcaggcaaatggggctatcattatccgtattctttttcaaaaaaaaaa

SEQ ID NO: 11089 - DNA, 883 bp, Triticum aestivum
  unsure (1)..(883): unsure at all n locations
  Clone ID: PAT_TA_11089
aggnaactaccatctcaatttaataacgtccggaagttaactaccgtctcaatttattttttaataaactcccacagctttgaggcggcgagaagcagaccggaggaggaggggaatcggagaagatggttgttctcgtggtagcgacggcgtccgacccggcgtccatcggccccgccgccgcgttcctggctatgcctggctggtcccccggcccgcccatcccggaggggatggagagctttacaaatgggaatgttaggttattgaagcatgaacgcagcattgttgcagaggatgatcttgaccgtcggtggcaggaagccactggagaggctgtttccgaggtcatattcctcagcaaacacactgcagtctccaaccgccctgcactcactgtccatccaatcggtgtgccacatctgagggaggatgagaccccccctcaaggtgggaggcctggatgggcagcggtgccaaaccctcgaattggcccatggttccggttgatgcaaaaggttgctgcagaccaaggtcttgttccagagtttgagattacacttgaagctactcaccatggaccacttaccagtacacccacgatgtttgttgagataggaagtacacaagaatactggggtagacaagatgctgcgcaggcccttgctctagttctatggaaaggtcttggtcttgaggaaggaaatcctgttggaacttgctggggagtggtgaaaggttctcttggtttcggtgggggcactacccccctctctaccgatttggcttcaaaaggtgttgggggggcatctctgtctgttctctttgcatggacctcccccaataatgaaaaaattttgtaggtgtggatgtggaactccta

SEQ ID NO: 11090 - DNA, 1635 bp, Triticum aestivum
  unsure (1)..(1635): unsure at all n locations
  Clone ID: PAT_TA_11090
ggtcgacgtcgccgccgcggccgaggaggacgaccgcaggggcgtcgtgctcgacggctcgccgccgcccatcgtcctcgtccacggcatattcggcttcggcaaggggaggctcggcgggatgtcctacttcgccggcgccgagaagaaggacgaccgcgtgctcgtgccggatttggggtcgctcaccagcatccatgacagggcgcgggagctgttctactacctcaaggggggacaggtggactacggcgtggagcacagccaggtttatggccacacgcgcttcgggaggatctatgacaccgggcattatccggtgtgggacgagcagaacccggtgcactttgtggggcactcggccggcgcgcaggttgtgagggtgctgcatcagatgctcgctgagaaggctttccctgggcatgatacttctgaagactgggttctgagccttacttccttgtcaggcgcccttaatggaaccacacggacttactacgacggcatgctggctgaagatgggagatccatgaaatcaatttgtcttcttcagctctgcaggcttggagtcattgtctatgattggctggacattccttggctgaagaattactataatttcggttttgatcactttgaaatgtcttggaggaaagttggtttttctggtttagttgatctcctgctagggaatactgggccgttttcctcaggagactggattctccctgacctcacaattcaaggatctctaaaaattaactctaccctcaagacctttcccaatacattctacttcagttacgctacaaagagaactcgaaagctatttggaattacagtaccatcaagcgtccttggagttcatccaatgctctttctcagagttctccagatgtgtatgtggcggcaccctcaaaacgcacctctaccttacaaaggatacagggatgaagattgggaagataatgatggggctttgaacacaatctccatgacgcaccctcgcattcccatagagcatcctaaccgttttgtagtggatgattctgactgcaatcctttgcaacctgggatatggtatcacaagatcattgagggtgatcacattcttttcattgtaaatcgggaaagagctggagtgcagtttgatttgctgtatgacggcattttcgagcgctgcagaaagcatgcatttaggaagagcccccctaccatgccaaacgaagcaagtcattagaagattaaactaagcattctaggtagtagtgaggatgaaacaaggtggccatggagcttttttcgcttctcttcatctccggcctccatgcacttggatgtaacttcaacattgtaatctgtaaattaatttgtccatttgagcaaatggcacgcttgataccgccggttcttggaaggaggggttttgcaacttgcttttcgctggcccttacagcacaatgcaaggaaggaagcttgtattgagcaggagtncaaatnaataccacatttncnaataccttanggggcngtatanattaagattcacccaaaaaaaaggggggcccgtaccattcnccnanatgancccataccncccaatggctcctttaaactcctgacnggaaaccggcg

SEQ ID NO: 11091 - DNA, 783 bp, Triticum aestivum
  Clone ID: PAT_TA_11091
tttttttttttctttttttgaaatgtctaaaaaaaaacttatatttagaaacggaggaagtacatgagaacattccaactgtattaattacaaggcaaataattacatcatactagcaatcaacaagactccaaaaagaaactacacatcgcacctctaagctagtttcttgatttttgtagatgtttgaaggagaccagccgcctacttattttgtttctaccaccactgacaagtgatagagatttcgccgcagaaaataagattaaaaataccaaagggaaaacaaatataggagtaataattaaatttgaacatgcatgcataaaacagccggcggctttcactcttttagcccatcaacaatgccaatactgctcccgccgtcgcagccgcggtcgcccatcgcccgtataccgctggcgcggcatcacccttatcagtggtggcatcatcggaatcttcgtcgtcagacgagtcgtcgtcgtcgccagcctccttcttgcccttctttgacggggcgggcgttggcgcctgggcgaccttgaacagctcctttggcttcaagaacttggagacggcgtagacggcgagcggctcgctgtcgccgacggtggcggtgacggtggaggtgacgaccttggtgacgagggtgaccttctcgtcgtcgttctgcacgtcgtagctgtagtccttcttgacctcgctggtggtggcgagcgtggagaccatgccgttgttggacttgagcagctgcagcgagaagtagtccggcacgccgtg

SEQ ID NO: 11092 - DNA, 897 bp, Triticum aestivum
  unsure (1)..(897): unsure at all n locations
  Clone ID: PAT_TA_11092
cgtccgcccacgcgtccgccgacgcgtgcgcttctactaggcagcagcagcagcagggttcttccatcatgggttctcggctggttcttttcggtgctctcgctctgctcctggccggcagcttcggtgcggcccaggcggcgccggccgtagtggttggctccgtcaagtgcctggattgctcccccgacgacgtcagtgctgaagatgccctcaaagggctccaggtagccatcaagtgcaggtccggcgccggcgagacctacgagacgcagacggtcgggcagctcgacgacaagggcgccttcagcgtccccctccaggcaggcctcctgcgcgaagacggcgagctggaccgcgactgcttcgcccagctccacagcgcgcccgacacgccgtgcgacgggccggcgccgcccaggatcgccccagccaagtccaccacccaaagtgtcgccgacgccccacacacctacctcgcggtccgagaggacacgtttttctcccctctcgtgtgcgcgtgaaaggaggaagaggagcttcatggtgagcccgccgccgccgcctccgccgaggccggagccctcatacgggcccccgacgccgacacccactcccacgccgacgccctcctacggtcctccttccacgcccaagccgcccgcgcccgaggatgacccgaagccgttcttccacaagcaccccaagatgaagaagatgatgcacaagaagaagccgtgcccgccgctcggcgaggaggacaagcccaagaactgacctgccctgctgcgacacatgcagcggcggctcgctcacttgcccatcgactggcattacagcaaggaggggggcgtcaggcgctacgacatttggtgatcgatatgtntgnnnctgtnt

SEQ ID NO: 11093 - DNA, 890 bp, Triticum aestivum
  unsure (1)..(890): unsure at all n locations
  Clone ID: PAT_TA_11093
gtggcggccgcttcgaggcccggccggtgcccgggaggagcgtccgcggacgcgtggggttccggcatatcgccgccgctctccttttcctcgtcacggccgcttcgaccgccggtgcttccacttattacgcctcggatcccaacctcggatccgcccgcgtcatcttccagttaaatcatggtgacattgaattcggcttctttcctcgtgttgcacctaagacagttgaacacatttttaaacttgtgcagcttgtatgctataatacaaatcacttcttccgggttgacaagggttttgttgcgcaagttgccgatgtcatgggaggtagaaaagcccctatgaataaagagcaggaacaacaggcagagaaatcaattgttggtgaatttagtactgtcaagcatgtcagaggaatactctcaatgggaaggtattctgacccagacagtgcctcctcttccttttctatcctccttggtgatgctccccaccttgatggccagtatgctgtatttgggagggtgactaagggtgacgatacattaagaaaactagagcgcctgccaacccataaagaaggcatttttgtaatgccaattgagcgcattgagattctgtcgacatactattatgatattgatgtagagagctgtgaggcagagaagtctattcttaagaggagactttctgaatcagcatcagaagttgagagatggagacgaaaatgcttcgcatgatccagcgattgagtgtctttattttcctttnngtctcaccgagaagacatgcgtttcaaaaggacatccatattacctcttccaggatttagngtgcatgtgcattccaaggagaagggtcagacttgtacctgccccgggcggccn

SEQ ID NO: 11094 - DNA, 439 bp, Triticum aestivum
  Clone ID: PAT_TA_11094
cgtccgaaagaaagttcgtagcgggggtattgaaccaggcattcgggctgaagtttggcccttcctactaggagtctatgatttaaatagctctgaagaggaacggaataccatcagggctaaaaaaaggaaagagtatgaaaaactgaggcggcagtgccagcacattctgaatgggtacagaggaagtgggctgaagtcaataaatgaagtgaataatgaggagtgttctgctcaaggaagtggtgctgaaggatcagaatcaccttgttttgaagatgtcaatgtcgagaaggcgtctaggtcactcgaggaaccgaagcctgaacacagcgaggccgagcaactggaaatcactatgtgtgatgatgttatagaatctatggaagaagacacaagcgagttaattgatgcatatccatgcatagtagagttagaa

SEQ ID NO: 11095 - DNA, 984 bp, Triticum aestivum
  Clone ID: PAT_TA_11095
ctcgcgggtcgacaaacttatcaagttacgaggggaactgaacccactgcaggaagcatctggtggaaagaagatatctattaacgaccttgttataaaggctgcagccttggctcttcgaaaggtccctgagtgcaacagttcttggatgaatgattttattcgccaataccacaatgtgaacataaatgtagctgtacaaactgagcatggattgtttgttccagtagttagggatgcagacaagaagggacttggtacaatcggtgaggaggtgaagcagttggctcaaagagcaagggataacagcttaaaaccacaagattacgagggtggcacgttcacagtatcaaacttgggaggtccttttggaattaaacagttctgtgctattataaatcctcctcagtcagcaatcttggccattggttctgctgagaagagggtgataccaggcagcgcggatggtcagtacgagtttggttcctacatgtcagtaacaatgagctgcgatcacagggttattgatggtgcaattggggcggaattcctgaaagcgttcaagggctacatcgagaacccgaccacaatgttgctgtaaagttaggaggatgaagcctattcttgtccgagtcttggaataatgcacagaagcggtgctgtcccgttttacataacctgggcgtggtctcatgggacccacaatcaagagcacagagccagcaagcgaacacacaggatgacgtgttttttttttggattgaaacgtcttctgttcgttttaccttctgtttctttcttcccatgaatgaacgacctgattgatgtaggttggacttgcatggcctgttgagctcgttttttgccagagaaactcttgattataggatttgcaattttcctatacacacgcaaacttaaccaggaggctcagtaaatggttcggaataataataatccatcttgttagagacaaaaaaaaaa

SEQ ID NO: 11096 - DNA, 1139 bp, Triticum aestivum
  Clone ID: PAT_TA_11096
gtcagtcctcccatcttgaacttgcattccgagtgcgctgctacgaaagctaacccctatccgcatcttcacctctaagcaatgcatcccaaattactacttgacagtcgaaccacgcgtagtcgtcttttgcatattcccatgtgcactaatccccctgcagagcagagtcgacaaggtataacaattagctaaccccaagtgcatcatcatatccatgaaatagttaggaaatgcatctgaaatgataaattaaaaagcagcagatagaaaactcagcacattattagaggggaagcatcagaatggggcaggggatgaactcagccagtaaattcccatcgacttgctttgagtggattgcctccatactaaggacgaccaggtctaactccaaatcatctgcgacttctgcgatgatagctgttggcttctttccttctccaaggcgctccatcaacccaaactctgtaaatccaccttcagaaagatgccatctaatgcttgacatttgagtatcatgctctgggaatgactcctttggcttatcatcaataacaactactgtaatgtttgctccatacttcttggctagagaagtggttgttgctgcagcctgtcttgtgccttctgaaaggtaagggttgcggtcagtgatcggaagtagaacatgcttaacttgggagagagcatcaatcgctaaagcacttgcagattcattcacttcagccctgactccgtgccgggctccccggcgccgcagcgagacgccgcccttcctgttgaccggcgggaaggcgagctccggggcgtggctcgcgcggacgccggaggccggcgcgggcaggagcgagctggcgaaggccatggggggtcggttggatcggagcggcagcggcagggtggcttctggaggggcgtggaaagggggagagacggagaatacggagacgaggatttgcattttttccgactatacacgcaaacttcaaccagggaggctcagttaatggttcgggaataataacccatcttgttagaaacaacactttctgttttcttatcgctgctgggtgatgcaagcaatgaactgtgtagagttgaagataaaaaaaaaaaaaaaaaaaactcgagactag

SEQ ID NO: 11097 - DNA, 590 bp, Triticum aestivum
  Clone ID: PAT_TA_11097
cgtccgcggacgcgtgggcgaaagcacgtccggaaacaatggtgtcacatctgaagatgctactggtcttgatcgtggtgacgttggcggtgcatagacattgcgaagcccagcatgcctttgatcccgcagacccatggtacaaccccaggcgtgacatatatctagatgttggtacagcaagcgtgcgggactatcaaacggccctctaccatttaaatttctatctactagatgggtgccgcaattttgttgatggacatggtgttctcgcacgacaggaaggggaggacatgccaccccccttctggatatttttccatttgacaggacgcgaccaggacaccgtgatattcgcaattagatcagataatttatatttggcagggttcacgaacaacttggacgtgtggcacgtgtttagtaacagggcccgcttcaacttaattcggcctgctcaagtattgaggtttagggatgacttcggtagtcttgttggcgggacacagaattttagctgatcttcaccttagcaaatagtcagtcttgctaagccatttcatttctggctcatttctattatcctaggg

SEQ ID NO: 11098 - DNA, 158 bp, Triticum aestivum
  Clone ID: PAT_TA_11098
cgtccgcggacgcgtgggcgaatcacagcagcaaaaaccaagacagggacgaccatactcacctccaaagttagctgtggtctccggcatggagaaaaccgtagcactagctctgctgctactcttcactctcctgaccacggcgcatcggttcgcgg

SEQ ID NO: 11099 - DNA, 575 bp, Triticum aestivum
  unsure (1)..(575): unsure at all n locations
  Clone ID: PAT_TA_11099
gttggaccccacacaccaccaacacatcaccctccaagcgtccgcaagcgcgactcctgcgtgcttgcttgctagagtcaagcaccacctacccaggcaggctagccagtgagaggagatagagagcgatgaggcagtcgaggttcaagaggatctgcgtcttctgcggcagtagccagggcaagaagaggagctaccatgacgccgccattgagctcggcaacgagctggtggcgaggggcgtggacctggtgtacggcggggggagcatcgggctcatgggcatggtgtcccaggcggtgcacgacggcggcaggcacgtcataggtgtcattcccaagaccctcatgaccccagagataagcggtgagacggtgggggaggtgagggcagtggcggacatgcatcagaggaaggagagatggcaaggcactctgacccttcatagcctgctggaggatatggtacctgaggactctcaagtatacatggccactcggatcatcanagccgttggntctnactggacgtananaccgctgtactcagcaaaggcgtgnggaggtnacaanccg

SEQ ID NO: 11100 - DNA, 480 bp, Triticum aestivum
  unsure (1)..(480): unsure at all n locations
  Clone ID: PAT_TA_11100
ttttttttttttacaaagaagaaaatcactcgcattattttccttgcactcggatggcttagctcagtaccagctacaccgcggggattacagatgacgaaacctaaggtctcaatacaaacatttaactgcaacatttgtatgaaaaccggccacttaattaacgctcactaactcttatcttaaataaaacgtacgcacggatcgtgcatggcgtagaagtacggcaaagcgagaaggacgacacggagctccgggctctagttgtcggcgacgacggtgcggatgaccatgtcggcgtcctccgccgccgcggcgccgcactggagcatggacgactggcagaggacgatcttgagctccccaaagcgcgcggcagatctgcggcacggggctccacgtcggtcggggtcgtcctgntgagcggggcaacggttcttgtagtancccncggggcccgcggnacgcgggtgtcttctt

SEQ ID NO: 11101 - DNA, 1676 bp, Triticum aestivum
  Clone ID: PAT_TA_11101
agccgacccagcctcaggtctctcctccgcccacgcgtccaccaacacgtccacccaaatccaacaaaacccaaccaaatcgcctcttccccgaacacaaactcccaatctcccacctccgcctccggcgacatccctctcccgtagcgaggcagccgtcccccctgcggccgatggggagcggcacggagccggccaaggggctgctgccctacctgcagcgcgccgacgagctgcagaagcacgagcccctcgtcgcctactactgtcggttgtacgcgatggagaaggggctggtgatcccgcagaaggagcgcaccaagatgaccaactccatcctcgtctccctcatcaaccagctcgagaaggataagaaatctttgaccttggggcctgatgaccatcttcatttggaggggtttgcatcaagtgtctttgctaaagcagacaaacaggatcgtgctggacgagctgacataaacactgcaaaaactttctatgccgccagcatcttttttgagattctcagtcagtttggcgagcttcaacctgatcttgagcagaagcagaaatatgccatctggaaagctgctgaaattagaaaagctctcaaagaaggacgaaagcctgaagctggccctcctggtggggacaaagatgaagcacctgccagcaccactacaattgatcatgatatggggcaaagcccgtcgtcgcgcttgcagccgaagacgtgtcaattgccgtggagcaccagaggcgcgcgctgtatcccctgacgaacccttctgcagagactcactagctgcctggtcccgggacaacacatcctgtgtacatacactatactgtaattacgaccaacatggagatggacgtctggcctggttgcattcatacgcgatcgctggggcgcctccacaaatctaggagatgatacgaattctttagcaaactgtttcctgcgccacatggagtcatttgttttcagagttttgtgataaggctatatttggccattgcttggaatgcatatcctcgaatggtgatgggtgttgatacagtttgcttcactcaaggcctgcgactttcggcgttgagcacctgccgcgcgcgctccttctcctgacgttccgattcttttggtaaccggcagaatggaaatgaagcatcacctcatcctatagacaaggattttagcaggagggatagcttttctgctgtccagccaggaaatatatcttctcgacaaggtgcagagaagttcaatgatcatgtctctgcccagacacatttttcaccaccacctccaccgtctgagttttcatctccacagtcccagttttcacccccaccacattcatcttattcctctccctcataccaaggaacagattaccctcctcctgatgtccacaacccacaccccaattattcatctccctcgtacacaagcacagactaccctaccaatgaggtccataaaccaccatccaattattcaccacccccatacacaagagcagaccatccttcggacgatggctacaatcctcagagcaatgataagccggacatttcagcttatcctcagacataccaccagccaccctacacaattgaaccccagcacacctctcaaaactactacgctacagaaaccccactgctccata

SEQ ID NO: 11102 - DNA, 675 bp, Triticum aestivum
  unsure (1)..(675): unsure at all n locations
  Clone ID: PAT_TA_11102
cggcgcgcccgcccccctgtttttttcttctacctctctccccctcggcgagttgatttaccggcccgtacagtggtagcgctataactacttttattttaccacgctgatttaccgctgcgagctgccgcgtacgtacagcgccactcctatttgtcttggctttctgccctacgtccttggcatgcagctcgctgcactcttcgtgcttctgcaccacgcttgcgttacaccatcctgggccttcgtcctatctccttggcgggcatgtagtcggagtcctgccggttgcgcccggccgttctccccttcttcacgctacgccggaccctccgggcgcgtcgtccgcggggtcctccgttgtgcgtcgcggcggtcccccctgctccgcaacgcgccgggcgacccgcgctcgtcgcccgggccgtcctccgccggtgctgtcttgcgctgggcctgggccggaacgccggcctgggcgcgctcttggcccgccggccttcgttctccagcaccttgatgcacttggacatgggcagaacgccccccgtgctcctccccgggctgcccgccgccctggccgcccgcccgccgcggctcctcccgctcccgctcggagccgtgttccccttcatggtcagcacgccgggcttgcagctggcgcgcgtcagctnc

SEQ ID NO: 11103 - DNA, 585 bp, Triticum aestivum
  unsure (1)..(585): unsure at all n locations
  Clone ID: PAT_TA_11103
atacgactcactatagggcgaattgggtaccgggccccccctcgagttttttttttttttttttcgaaagcgaggtcgcagcatatagataggtggttcccaacatatcacagtttgatgatttaagggtccaggcctgacctcgaccagagaaccaagacggtgctaaaagcatggaaaaaacaaacaaaggttccaaccaaagttacagataaaccaaaccgcgccagggctacaccaaaacaggctgctcggctcggttcaaacacaattgagccggccacagcgacgagttccttatcattccgcgaaattcaattccagccggtccagcaaactgtttccgaaagctgaaaccggagcaancgacgaaagcaggggggggctttagtccctcctccgcctccaaccttcaaggtcctgccgcgcttcggagnccaaagggcaagcaatccctttcccgtttatncgtccccaatactttggcctcggtcaatcaatcaancctcttcctttccgtccctccggttcaattcaaggggttccccctccnggggcttcgtttctcgtnccangcggggcccn

SEQ ID NO: 11104 - DNA, 729 bp, Triticum aestivum
  unsure (1)..(729): unsure at all n locations
  Clone ID: PAT_TA_11104
cgtccggtcccgttgcatctcgtccctttccgcccgctccgcgccgcgccgcgcaccgagcccgggagaggaggggaccagatcaacaaagccaccgccactgcgttactcccgctccactccgctccgctccccctccccgccgccgccgccaccgccgttgcagcgccaggaggcggaggagatgaagcccaagagcctcccgttcatcgccttcgagcacaagcgggatgcctatggcttcgctgtgcgcccccaacacttgcagcgctacaaggagtacgcaggcatctacaaggaggaggaggaggagagatccgatagatggaagaacttccttgagaggcggtctgagtcgtctggacatgatgcgaaggttgcactgtccgcggacaaagtcgaatctgcagttgaggagaattctgagaatggaagttctgaattgttgcatgagaggagtgcacaagggacacgtaaggttgaatnatgggagccaattcngtcatccctgggcaaacatnnancacgtgatgggtctgcnnttnnaaaaaaaantttttattttgctggcaaggcttnnantcaaaangaaatccaccntttttgnnacnattnaaananagcaaanggnntnnnnnnnnnnntnaannacnannntntnntnnncnnnnnntannnttnnccctttnnncnannannnncnnnnnnntnnnnnnnnnannnctnann

SEQ ID NO: 11105 - DNA, 1174 bp, Triticum aestivum
  Clone ID: PAT_TA_11105
cagcggagcgcccccaaccagaaagagaaagaggcaggcagcacagccgagccaaccaactaaccaacggacggaagagaccgccgcgaagcctcgccaatccggcccccttccctccttttcctctcccgcctacttgggatccgctcgcgcgatcccgccgccgagactcgagctccggccggcgcatggacccccgccgtcgcgcggatcgcgccgagtagcgggaggtagaggtggcagagacgccggcgccaaggggcgaggcgggcatggacaccaacgccggctccttcgtcgccgtccggcggctcgccggctccgaccgcgcggccggcgccgtcgcgttccatcactcgtcctcaggtggaggtcgtgaccggctcgacggcatggatagggagggggctctcctgcgtctgtgtgcagagtagggacagcgacgcccgcctttccttcgatttgactcccgttcaggaagagtgcctactgaggttacagaaccggatagaaattcagtatgatagttcaaacatagagcatcaggaagaactgaaggccctttggtgcgcctcctttcctggaactgagcttaggggcctaatatcggaacaatggaaagagatgggctggcaagggaaagatccatccacggattttagaggtggaggcttcatctccttggagaatttattgttcttcgccaggaactatccgaaatcttttcaggaacttcttcgtaagcagaatggtgaccgtgcaatttgggagtatccatttgcggtagctggtgtaaatataacattcatgctcattcagatgcttgatctacaagcagtcaaaccaaggtcattgttgggagctgttttcctaaagctactttcagaaaatgatcgagcctttgatatcctgtactgcataaccttcaagctgatggatcagcaatggcttgacatgcatgctacttacatggacttcaatacagtcatgaaatccacacgacggcagctagaaagggagctggtgattgaagatattcagcgggttgaggatatgccatcgtacaagcttctagcccgctagctagtaactgaaaccttaacatggcttacatgtcgccgcgaggcttgaatcgctgaacgatgcagccagtgtccttatacagcgagagaat

SEQ ID NO: 11106 - DNA, 913 bp, Triticum aestivum
  unsure (1)..(913): unsure at all n locations
  Clone ID: PAT_TA_11106
ganannnccttgctcgaanttaaccctactaaagggaacaaaagctggagctccaccgcggtggcggccgctctagaactagtggatcccccgggctgcaggaattcggcacgagccctaacctgcgcggccgtagatcccatccaatcatcgcgccgccgccgccgccgcccgccccgcccgaccccagcctcccccgccaccccccgggccgcgatcgccgtcctcccgccgccggaggaggagggggaggctcgcccgcgacgggggccatggaggccgacggcgccgcgtccgcggaggccaagccgctcacgcccgaggaggaggcgctccgccgcaacaccgactgcgtctacttcctcgcctcgcccctcacctgcaagaaggggaaccaatgtgattttcgtcacagtgagggtgcccggatgaaccctagagactgttactactggttaaatggcaattgcttgaatccaaaatgttcatttcgccatccgccaattgatggtatgtttggtgcttcaactcctggaatacctgcagtgtcttcacactatgctgcttataactcgggcaagcagatggtcccgtgctattactttcagaaagggaactgcatcaaaggtgataaatgccctttttcccatggaccgcagcccgctggcaataatccaccagaacaggtggcgaaggtttcttcctttcctttggagcaccctcagacccaaaagaatgaatttttgggtgtcaaggagtttgcgcagaccaatcatctaattcagcaaggtggcccaataattggcgacaggtccaagtcagttaatagggctgcagcgaatttcgccaggacagctgcagctgctataccagctgacctagcttccagtgcagtgaaatctttgcccaagtc

SEQ ID NO: 11107 - DNA, 1574 bp, Triticum aestivum
  unsure (1)..(1574): unsure at all n locations
  Clone ID: PAT_TA_11107
gacccacgcgtccgccgacgcgtgggcaagagcaggggcgaccgcgcccatcaccaccaccacccgcctgacggagcccttccctcccatcggcggcggagatggtggggtggctcaaggcgctggtgtacggcgcagggggcatggcggtggtgggcctggcggcgctggtggcgctgcaggagcgcctcgtctacgtgcccgtgctccctggcctcccccgcgcttaccccatcaatccctcgcgcttccgcctcatctacgaggacgtctggctccgcgccgccgacggcgtgcgcctccactcctggttcctccgccactctgccacctgccgaggtccgaccattctgttctttcaggaaaatgccggcaatattgcacatcgtttggaatgcgttcggcaattgatgcaactaattgatgccgctgctattatgcaatgtgtttaagctttcggtatagagcgtatggtgaccttctcagattatccttcccaaaggttgcaccacaagcacttcatcatctactcctgatcatctagattgacacatccaggatagttatcttcgggagatctttctttggtgatgttggtgcagttcttgcaaaaaacaatcctgacaaggtgtctgctctaatattggaaaatacttttacatctatattggatatggctggtatcatgctgcccttcttaagatggttcataggcggtagttctgacaaaggcccaaaacttcttaactgcgttgttcgctctccatggagtacacttgatgttatggcataggtcaaacatcccattctctttctttctggattgcaagatgaactggttcccccttcacacatgaggatgctgtatgacaaagctgttgaacataacaggaattgtaggtttgttgattttctcaatggtatgcatatggatacctggatttctggaggggaccgctactggcaggactatcgaagggttcctcgaccggtattccccagaagtacagagttctgatgccagctgcacaagtgaaattgctgatgatgataacgctgcataataattggaacatctagagcatcctgctgttttccaccagtttttgctgcctgtgatgctcctccggtctttgttggattgaagcacatttcaaacaattaattcaggtggttgttctgctccattccacctgaagaagccaaagctgtgaatatattttgaggttgttctccatcctgtgatgctgctgcatgtgtgtatggaatgacacatatatatttcggagcctggctcggccttcaacccccgagtttctgtaccttgttctaggcgtcttccatctagttgctgctttttggtggctactacgtaccgaatgttagaaaatctggccttggtgtatgacggttaaagtatagggtaatcttgttgactcaaccatttggttctattattatgactgttgctaccaaaaatgggtttttttttttggaacctggcngggcaaaaaacctgcagctttccctaaaanctgtgcaattggggcaaanggaaataacctttgnttcct

SEQ ID NO: 11108 - DNA, 385 bp, Triticum aestivum
  Clone ID: PAT_TA_11108
tcgtccgcggacgcgtgggcggacgcgtggggtttgcggaacgatgatgcatagagaacatagagaaggcattcccctttatccttacattacaagtaatgtggtcagtattcaatatgaccttgagtccttgaaggctaattgttttgattgtccatcttggctttcgaccactcgttattggccattgcagtttcttcgtcatctccacgcacattgctagaatacaagattttgagtttttgtacgtttctgcatcacattgctagaacagaatattaatgagtcattgatgtcccattttaagaacaagggtataagcatctattgaaacaagtagttcagttcagtctcgaccgtaagcagtctggaagtggtacatttg

SEQ ID NO: 11109 - DNA, 1097 bp, Triticum aestivum
  unsure (1)..(1097): unsure at all n locations
  Clone ID: PAT_TA_11109
cgtctgaccgcccgggcgtctgtgctggcgtttctgccgtatccttgagagctccacctccagcttccccatccggcctccctccccctcgccgccggcggccatggtggccggcgctgggtgggatggaggtctggatcctaggtctagtagtgtgtgagtgtctttctctggcaaataaagtggagctgcgttttggatcttgtctaggtggttgttcaactctcccctggggccacgctggtggcgaaaaggcggaggcaaggatgatccctggcagcggatccttcggcggcttccctcagccggatccatggcgaagcttaggcccgtccggtttcgtccccacttctccccccttttcttgctgtaataaattccaatatggtgcgccagatgctcttcttcctcgatctgttcttaccaccatggttgtgggaagagagatagagcagcaggagatgtacatgcctaccacttgcaggaggcctcgttgctaccttcctccacttgatgccgccaaggtggtggatgaagaggggtggggaagcactgagctgaagattgatggtcgggttcgagctcatcagcagaggattctatggtggagctacggcgcctgcagtcggctgccggtgttcatcgaccctctgcttcttctggtcgaagggcggccaacccctttcctcctggcttgcatgccttatgggaggcagttccagttttcgttcagaggctatgggatgcacgtgctgcacccatggcgatctcgtcgccccaagtggttcgtccccggcgacggcgaggttcaatctgagcaaaggctgccaaggacccgattgcgttttaatctttcagctaggggttctccatgcaaaagtctgggactttgttgtaatctttctttttctttcggtcctgatgtaaagtgtgctttgaagcttatctaatgtaagtctggcccttcggggcacttccctgttcaaaaaaaaaaatagataagaaatttaccgaatgtagggtcggccccgcggggcacttccctgttcaaaaaaaaagaatgcctgcgtaccaactaacgcttganantccccttt

SEQ ID NO: 11110 - DNA, 797 bp, Triticum aestivum
  unsure (1)..(797): unsure at all n locations
  Clone ID: PAT_TA_11110
aaccaacactcttgtattatagaacttcgtaaatccaagccatcgaaaccacgcttcgttgcgctttcttggtgtctcgggcgctgtacattgctttataattgaaagcactatctgcatgaagccccttggctatgcactgtaataacccaaacctttgggcaaatgttacttctcgccacaagaggtgcaacacgcaagctatacaaaaatactcttcactcaatccagtttcggggggaaaaggaagaagattccgggacattaatggagaaaatttggcggttccgtaaatatgtgcatatataatctaccaatggctcatcccgtgccttttcatcttcatcttggagctaaatatggtgggttacctgcctgtggtgtagtgggattgccgtcctgggaggagtatcactgtttcnaaaagcacccacccaaagcttttaccttgcttttccttagactccacaagcttgcttgcagtttcttctattacattgttgaatagcccctgcgcatctttcttgtcttgtgtatcttgatgcctcagtttcactgaaggagattccaagtcaggctcagtaggaacaccattatttctggtattcctcttaaaaatccttctcactagctgaccttcaccatttgcaacttcattggcagctcttcttctaaatatgagtcttctcgggccattactgtctggggtgagttctacaattttaccccttttaaacttcaatttgtaaggtgtggtactagcatcatctgggtgaagtgatgagatcctttgcagc

SEQ ID NO: 11111 - DNA, 771 bp, Triticum aestivum
  Clone ID: PAT_TA_11111
agaaagagtatgtacatatgggagcatccaaatcaaacgaattatcatgcccacatgggaagagacacggatttcttatctagatattcgagacttctaacgtcagcggcccacgggcataagataattacatgagccaaccgggcccacaataacaccgctgcaaaacttggtcaaggcatcagaacatggcggtgacccgcagaatagtcctaagctacaggtgctccaaaaaacctgtgcaaaaagagctttgcacgattgttgacgccaaaggcctgcgatcagctccctatatgttgaagagatatccgagatcttccacggtgagccgagttgcgatgcctcctgttttctcgtcgccaaatgctgatgccaccatctccctcttttttgcctgcagagctaagatgcgatcttccactgtgtcattgactgtgaaccgagtgacagtcacaggacgggtctggccgattctgtgtgctctgtcaaccgcctggtcctcagcgtaagggttccaccagggatcgagcatgatcacatggctagcagctatcatgtttagaccaagattaccagccttcagtgacatgagcatcactcttaccgctgggtcagccttaaactcttgcactgcttcttctctatcgtcgagggacattgacccatcaagccttctgaagtttatgaaattgctattcagtgaaagctccaggacgttcagcatgccagtccactgggagaagactattgccttaggagcatcacctg

SEQ ID NO: 11112 - DNA, 680 bp, Triticum aestivum
  Clone ID: PAT_TA_11112
aagacttcttctttcaaaatttatctgatccagaccatataacagccatagccaattaactttccaattttcatgagttttaaaaagcgaacttgtatttttcatcctcggttagttccttgggttgttttcgtcgccatcaactttctcttgtaatgtttgacttgcaattcctacaaatagcggggaagtcacccctgtagtgacaaaacagcccacaagtcagctaaacatacttcttcccgggccgtctggctaccagttcttcctctcacgcccccttattttcagaaaataaagttgaagaatctgctgctcaatagagtggccttttgttagacttcgacaggtgcgtgcatacatacatgtgacgccggagcaccaaattagaagatggtcgtcaacctcaggtcctcctgcacccttggtactcgaatagaggatccattctttttcaggaagctggagtaccagcgagcagagagcctggcttgccgcggcctcctttcgtcatcaaaatccacgcggtacaggccgtacttggactcgtatcctgccaggagctcgaatagatccatgagtgcccaggcgaaataacccctcacattaaccccattccttattgcatctagtgtgcttcccatgtagctgctcaggtaatcaaccctgtaagcatcatc

SEQ ID NO: 11113 - DNA, 967 bp, Triticum aestivum
  unsure (1)..(967): unsure at all n locations
  Clone ID: PAT_TA_11113
ctgctgtaccaactgctaccatgaaacccgagattggtactgaagttacggaccatgttgttttggaagggtctatagcaaaggaagttggtccggcggtagagagcggtcatgacccagtagctgccagtgcagcccctcatccaccagctcctgctacgtctagaggcagaaagacccaagcagttgaaacccctcgcagacgaggccgaaaaccaaaatctcttttctcatctagtgctggtgatattaatataaaccctgtggttgcaattggtagtggacctgcttctgtgggttctccatatcctcaaggggatatgcctgcaagtctcatgtcaagatttcagaaggatttggttacaggtaggcctgttacgtcattgccagagggagttaagggcatctccgcccctgaaagtacgacgcctgttgccgaagataaacacactggaactgcaataagctcggacaatgccaacttactaatgccaaagatcattcacaatgaaaatgttggatttgttcaagcgagctctgagcaagttttttctgcatcagtacctactttaactgctgtctcaggtggaatattgaaagcatcacatattctcttggcagataagcctgccgagaagcaaagtgcttcacgccgtcgcagaaagaaagcgcctggtggttgaggatctggggagtaagcactaggcaaagagcagctatgaagaaatctgatggtattcctggtaccaatgacaatgttgggtgcggacatgagcacagctgagaagctccttgcagtgaatgtgaaacaattacagttcacttcaagatactcccaaggaattaccaaatataaactctcctcctatgnacagtctggggtatgactctcaaccaagaacactnatagcagtccccattagtgaagctgcacttccttagtggttccgggtaatgcccatgttgc

SEQ ID NO: 11114 - DNA, 960 bp, Triticum aestivum
  unsure (1)..(960): unsure at all n locations
  Clone ID: PAT_TA_11114
cagcatcatcagtcaggagagctggaaaaggaattcagttggacaactccgtgtgttggattggaacgaaccagtctacaaagcctacacataacatagcccccatttctcaaacggggggaacgcccatcagaatgaaaatctaggaaacaaaaatcgctaatcagttcgatccggttaaacctaagattcagctcacagaagcaaatgcggcatgtccacccgatgagttagctttgagttgcccttggtcagtaggaagcctcctcagcaacttgtacaggccgaaaacattcttgtgctcccattggtatggtatgaagaacgaccggtatagtgccggcgaaagctgtctgtctagaaatggtagcgatgccaatgtctcccatgttgacaggtcgtttccacgagaggggtaaggccccctcagatccaagnctcccatccagtaagtttgcttgctcccaatgtccttcaaatattgcttgtcggaggcccttgttcttggtattgaaataagatggagcagcagtggtgcctcccagggtttcgttgaagggaaatgggagaaggcctctgaaaccgtcatctatccagcgaacttcgctgatataggagggtacgaagaatgatgaaggatagcggtgccactcacttccaacacacagaatagatccaggcccggtatcttcatgatattctagatgctgatagatctgcagaggagcaccgtatccattcaacatagagaatgttcggctgtgtgaggtgcacaaaataaagcctaggatcaaaggccgcagacccttcgctatcttctcaaaaattgactgctcatttgcatatttgtcgtggaaaaagtaaggaaagctgtcaataacagaagctgctgctacacatatcaatggataaattggatagagaaacctttcttctttatgcgcctgcaaagacatgaaa

SEQ ID NO: 11115 - DNA, 1249 bp, Triticum aestivum
  unsure (1)..(1249): unsure at all n locations
  Clone ID: PAT_TA_11115
cgtccgcccacgcgttcggggtctgcagcaccagcgcatggctctagcatgtccgctgctcggaccgtccgcggacacgtgggcgcggcgccgccgggcatgggtgaaccgtcggcgaagaagaagcgcgggcggccaaggaagtacgggcccgacgcggccatgtctctggcgctggtgaccgtgccgacggccgcaggctcgccagctgtgacacagggtgcttctgggcggcccttctcacccacgctgccgggaaacttcgtgccgtcggcgtcgccggatggagggaagaaacgcggccggcccaagggatctaccaacaagccccgcgtggatggtgctgggccggcaggagttggattcacacctcatgttcttacagttcaagctggagaggatgtatcgtcaaagattatgtcattttctcagaatgggactcgtgcagtttgtgttctctcagcaaatggttccatatcaaatgtaacacttcgtcaaactggtacatcaggtggaactgtaacatatgagggccgatttgagatactgccactctctgggtcgatctttgtaacggacaacggacagaagcgtacccgaacaggggggctgctggtttcgctggctggtgcagccggtggtctcttgggctcagcttgaacgcaggactcctcatagcagcttctccaatccagatagtagtgggaagcttcaatgcttgtgggaaaaaagagccaaagccgcaggctccttctgagcccgtaccactgaaggtcgttccgagcactgggatggcggccaacagccccccttcaagaggcacattgagcgaatcgtctggtggcaccgcaagcccgagacatcaaggctacgcctccaacaacaataaccagccgccgatcttgtccagcatgccctggaaatgaactcagcatccttgaccgaattcggacatcgatagactgtcggtgaactgcctccctggcaggaagtagaaatgtcacttctgtctaactagctcccatttagtcgtataaatcagaagtttaattagggagcattgtagctggtataagtggtaactgcagctgctgtgtaggtcgtctcagcttgaatttctgtgccacttagttgtttattgttgtcttgagatgatgtatttaggtatgatcttgtgaccctatgaggcgctatggaataatcatgttcttatgttccaatccctaantgagtctatagcgcctactgg

SEQ ID NO: 11116 - DNA, 974 bp, Triticum aestivum
  Clone ID: PAT_TA_11116
ttttttttttttttttttttttgagcttcaaaacatacatatccactcattattttcacatagccacgcaaccatccggtacacagcagaatcaacgacacaagtacccaaccgaactacactagggcaaagactatacaaaatgaccatccattcttactagtctttctcttttgcgttcctcataaacaacaaaatggacttcaaatgaacattaatgttctcttctctttttcttactgagtgcactgcaaatgatttctagaagaaaaaaagagtgagctgcaaaacaactcactcagcgacgagggactgcagtatggtcaccggcaaaacgcacgacatgcatgattagctggcgaaccccaagtgcacactagaggagctacatgttttgagaagtgaacctcttggctactaaccgcttagtatttttatactgagccgcttcgcaatctcacacaaaactgcatactgaactccatgatgaagtgtgtatgacttttctttgtctttttcgtcaaccgccgaaccacaaggcacaaaccatcgtcgttttgccaaccggcgccaccgcactgcacctgacgcgccaccgtgctgcacctgacgcgccaccgtgctgcacagagaaaaggagacggggttaggaggatgtggcgctggaactgaagtgctaaaaacaggggggtcaggaggatgtggtggtttgcaggggcaaaacgggtggccgccggcgttgggggtggatcccgtggccccccatcagcgttcgaaggggtggaccgaactacaaacgcctgtttggtcgagctgcacgctgctgtgggcagaactgcacccccatgtgcacctcgccgccgctgttggagggaggaaggacgctgcggtcgtaggatgcagtccaggtggtcgacgcgcgtggtcgccatggtgctcacggaaggggagctgatggccgcccgcacccacac

SEQ ID NO: 11117 - DNA, 1883 bp, Triticum aestivum
  unsure (1)..(1883): unsure at all n locations
  Clone ID: PAT_TA_11117
ttttaaacattaattgagtttcnggactttnaatnggcanaatctaaaatatgaattgcatgcggttgtccccggtgcaccaaagtgcgttgaaaaatcacatgtgtgtccttggttgaatttctaggtcccatggaagaaatgagaatgaaattcaaacatctgggcgtcatgactcggccgagaacatcgagaaactttgattataaattcatgtaaatccaaaactcgcctggaaatcatgaaacttggcatggtgtcatgtcatggcactaacatgttgtggtaaaaaattgtgccgattggaagctcatggttctaagagggaacgtgccacctttgagtgtgaaacgatatacgctgcccccccttgagtttcttaacaaaggcaacatagaactacattagtgccctgttaaattttggaattattccgggttcgtttgtcgttttttatacattaattgagtttctgggtctttatttaatgtgcataagtcaaanatttgaactacaagcacatgctctcgtgcaccaaagttggttgaaaaatcacatgtgtgtcctcgggtgaatttctaggtcccatgcaagaaatgggaatgaaattcaaacatctaggcgtcgtgtctcggccggaaagattgagaaacttggttttttaattcctgtaattccaaaacacgcctgaaaatcatgaaatttggcatggtgtcatgacatggcaccaacatgttgcggtaatttctttggccgaattgggacacgctttggtgtaagcttcttgcaaaccggagcttccctcaagaaggctcgtggttccgagagggaacgtgtcacctccgtgtgtgaaacgacatacgtacactgccttctcccgccttaatttttttacactgacacgattagaccaaatagaagtaccgtgctaaattttgggattattccgggttcgtttggccttttttatacactaattgagtttctcgggcatttaatgtgcataaatcaaatttgaactacaagaacgtgctccaatgcaccaaacccgggtgggaaaccacctctgggtccttgggtgaatttctacgtcccatgcaagaaatgggaatgaaattcaaacacctcggcgtcgtggctcgactggaaatattgagaaacttggttttttaattcctgtaaatccaaaacacgcctgaaaatcatgaaacttggcatggtctcatgacatggcaccaacatgttgtggtgaattttttggctgaattgggacaggctttggtgtaagcttcttgcaaaccggagcttccctcaagaaggctactggttccgagaggggacgtgtcacctccatgtgcgaaacgacatacgtacactgccttctcccgccttaagtttttttgcacaggcagattagaccaaatagaagtatcgtgctaaattttggaattattccgcgttcgtttcgccttttttatacattaattgagtttctgggcatttaatgtgcataattcaaatttgaactacaagcacatgctccaatgcacaccatatggttgaaaaatcacatgtgtgtccttaggtgaatttctaggtcccatgcatgaaatgagaatgaaattcaaacatctgggcgttatggctcgaccgaaaatattgagttggtttcttaattcatctaaatccaaagcacgcttgaaaatcatgaaacttggcatggtgtcatgacatggcaccaacatgttgtggtaaattttatggccgaattgggacaagctttggtataagctttttgcaaatcggagcttctctcaagaaggcccgtggatccgagagggaacgtgtcacctccgtgtgcgaaatgacatacactgccttct

SEQ ID NO: 11118 - DNA, 884 bp, Triticum aestivum
  Clone ID: PAT_TA_11118
ctctgccgcggcgtagcttctactgctgccattcgagctgggaacgcgcgcgaaggtgctgtagtgtgtcgaggtgtttcgtgtaggcctcagggtttccgtcgccgacgtgcggcggagggcagtgggaatctagggcggcgtcggggtcgagcgagcgattacttgccaatggccgagatctgctgccaggaagccaagtcgccgccggctaccgccgccacggtggccacggtctcggcatcggcggccgccgcggccgttgcctcttcggtgatggacaggcggcgccgcaggctggagctgaagcgcttccgcctcgcgagcgacctcgagcagtcggccgcggagtacgccggcgcccgcaagcggcccagggtaccgcgcacggtgtctggcccgtgccccgacgctgcctcggcgtccgagaacatggatcgttgcccaaggttcgggttctcctcggtgtgcggccgtcgtcgcgagatggaggacgccgtctccatcaggccgggtttcttgcccggctccggcaagtcccacttcttcggcgtcttcgatggccacggcttgctcacacgtggcgacgacttgccaggagctgatgccttgaggcggtggcggaggagcacgagaaggcgggctccggtaaggggcctgtgtggaaggaggtgatggagaggagcttcgcgcggctggacgaacgggccgcgaactgggcgaccacccgcagcagcgaggagcccgcctgccgttgcgagcagaagatgccctcgcggtgcgaccacgttggatccaccgccgtcgtggccgtcgtcagcccgatccagatcgtcgtggccaacgcctgcgactcccgtgccgtcctttcccgcgctggcgtc

SEQ ID NO: 11119 - DNA, 769 bp, Triticum aestivum
  Clone ID: PAT_TA_11119
ctgtgttctggttgcccggcacgtcatgctctgttcactctgtctgttgctggatgcctggatgatatggtgttttcactctgtttgttaatgtgttaaaccaaagacagcacctccctacaaacaagacaggggggaggggaattgatttcaggtcaaaaccattcatgtgcactggaggcgcccaaaacaagacaagttacaagaatggcacagcactaatatcgacatgctaccaccaacgtggaactgctgagagagaatgctcaaacaaaaatatctaattattcctcgccttaacgctttttctgtcgccccttgatcacagcatgaccctgtttcttccaaatgagaaaacaacttggctccttgactcgaaagtatccccacatgtttcacaatcattgcgtgccttcgaaacctccttttgcttctttccctttgatgtgatctttaggtcagcagaaacagttgttttcttctctgcgcctttctggttcttttggtggtttttaggattgtcagtcttttcgttctgttggtctccaacgcttgctgatgtgccatcatcattagaagagggtggaccttccgccttaccatcagcatccttttcaccattatcatgcacagactcccctctcggaccttcattcttcataccatgtccactatcagcataactaccctcatcttgtcccttcttcgatgcccgccgccggcgtcctctcttcgtgccgctcctgcctcctcttgtgctacctcatag

SEQ ID NO: 11120 - DNA, 510 bp, Triticum aestivum
  Clone ID: PAT_TA_11120
cgtccgcccacgcgtccgggcgggtagggttagcgcgatcgccgcctcatccccgcacgcaacctctcctttcggctctcctccgcgctccgcctcctcctctggcggcatccaacccatcgtcttctcctacttccctctcttattcttctgtgcctcgacgaggtgggcaagccggtgcacacacaaagggtggttgcggctgtggctccgatgcgggcgccgtggaggtggagtcggagctgcagcagaaggaggtggacggccgcgacaacagctttagcttcgatgagttccatcacctccattgctatctcagtcccgcggctatagctaattcattccccggtgttatgatgtggcggagagtgggatgatttgctcggagccattcatatcagagagacgaaatgtatttgtactatagatccactaaagattgtattgaaatagcaggctacatatctatctaatatgcatctgtggtacaaggtgaatcttgttacctga

SEQ ID NO: 11121 - DNA, 816 bp, Triticum aestivum
  Clone ID: PAT_TA_11121
agggtgccctcgattagtgatctcgtaatatgtgcctaggtaaacacaaacactattaaaaagcactaagcgcaaaacaacgacaacaacatggtaagcaactgtgcagcgcggagcccaacggggataaacaaaaacacggtgtatataatcggcctgatagttacaacaccatccatcatcattcctttgcactgatcctcgggagctccacgaggtgaaatcatggcactggcagtgcaaaaaggagcaccaagctacccggtcttccgcccccatcattgagctcattgagtcgccctgcgttgccatgtgaggtcgctatctagcttcttgatccgcgcaccccgtgcttcttggcctccaccttgagcgacttgaggtacttgacggcctcgtcgagggcggcgggcgtgtccatccggtcgccgccggggatgatccccttgagcgtcttcatcatcttcttcatccggtttttcttcctctcgccacctccgccgccactcgggctgacgctcaccacgtacccgggggagcacgtggagtccggcgagccctcgccgcggctccctgaggtgcgacccgtgctcagcacgtcgtcctcctcctcgccgtccccagagctcatcagcgcgtcgatctcgccgctgtcctccttctgcccggtcgagcattcgccgccgccgtggccgccgcccgtgccgtgatcgtagccgccgtggtgcccgtgcggctcagcccccccccgggaaccgaagttgttgggcagcgacgggttgtacatgaccctgctccggtcgtaggtctgatcaa

SEQ ID NO: 11122 - DNA, 854 bp, Triticum aestivum
  unsure (1)..(854): unsure at all n locations
  Clone ID: PAT_TA_11122
tagtgcaantacggtgcatcancacctattnctgtatgtgttagttgccttctcctttgtctttttagtctccccgcgtcgtccacttgtctgttgtggtgttttgggcaaacagtaggtgatttacctacggtaaatatatgtctaccgttcaaggcatatgtgataagttgacggatcaatacttcaatccgctggtgaacggcacgccggtctgcggcagccagttgcccccgagcaccatgctgtcgacggtaaagttgccggcatcggcgccgtcgcctagcacgtggtagcccggccagctgacccgacggccggtgtcggcacccggaccagagttgttgtactcggcgtagtagagcgtgtcgagcgcgaagtccccggaccacggcatccaccccgcggcgtcgacgagcccgccgatgtacgactccatgaccaccgtgcgcgagtagttcttccacggccggccgaggaaggtgcgcgtgtcaaaggcggcgttggccgcgagctccggggacgggaggagggtgcagccctggatggaggtgccggtgttctgctccgggttggtgcggccctgcgccgtgacggtgttgctctggccctgcatggggaggcgggagtagaaggtgcagtcctggaacacgacggcggcgttgccgaacacgtagtccacggtgccgtgcacctcgcagccgcggtagaactggcggagggagtgtgtgtagagcgtgtcttggtacgcctgaagctgcagctgtagaaggtcgacaggtcggcgctcgaccggagcgccaccgcctggtgcttcgccgggccagccgtgttccggatcgtatgttacctgt

SEQ ID NO: 11123 - DNA, 594 bp, Triticum aestivum
  Clone ID: PAT_TA_11123
cccacgcgtccgcccacgcgtccgcccacgcgtgtgcccacgcgtctcaccagatttgatcgacagcgccttggtactactactactagtagtattagtaaactcctcttatccagtgagccacgactacaaggcagtggcaccctgctcttggagttcccaatcgatcgcgtcgcgtctcgtctgcgcttggcgtgggtttaataaataaacggcgacggaggcgaccagccagcgcagcagcagcaactgaagccgccggggttcccacttcccagttgagattcgccattcgcatgtgtacacttaatctgttcttctctggagattttggacttgcatgagttgatcaacaactccattcccctggttcctgatggaggcatcatcttgcttgctctatcaagtccgtggttttggttcgttcaggatatggctatgtcttcttttacttctcgtccttcagaattgcagcccggtgctctccgactctccatatttggtcggcatggggagctatgacataacagggcccgcagcagatgttaacatgatgggatatgcaaatactgagcagattgcatcaggaattca

SEQ ID NO: 11124 - DNA, 725 bp, Triticum aestivum
  Clone ID: PAT_TA_11124
atctaccggcccgtcctttccgagccgtggcttggacgccacaccctgtccgtcgccgtcttcgccactccgcccctgtctccactgcctcctcctcatactcattcccgcctgtctccctcaccgctcgtcagatttgatcgacagcgccttggtactactactagtaaactcctcttatccagtgagccacgaccacgaggcaccctgctcttggagttcccaatcgatcgcgtcgcgtctcgtctgcgcttggcgtgggtttatttaataaacggcgacgggggcgaccagccagcgcagcagcggcagcaactgaggttcccacttcccagttgagattcgccattcgcatgtgtacagttaatctcttcttctctggagattttggactcgcatgagttgatcaacaactccattccctggttcctgatggaggcatcatctttcttgcgctatcaagtccgtggttttggttcgttcaggatatggcagtgtcttcttttacttcttgtccttcagaattgcagcctggtgctctccgactctccatatttggtcggcatggggagctatgacataacagggcccgcagcagatgttaacatgatgggatatgcaaatactgagcaggttgcatcgggcattcactacatgctaaactgatgggcgtttactgttgctgggcctaatggaaggcgtgtgcctttgtgaatctggatgct

SEQ ID NO: 11125 - DNA, 837 bp, Triticum aestivum
  Clone ID: PAT_TA_11125
tcgagcggccccccgggcgggtgcgggccgccccccgggctggtttttttttttttttttgtgttttttttttttcgacaatcagagtcacttgccctttcacctgtgtctttatgcatacatccacacacggccatattaagtttatgtttaatccaaattcatgttttgcattgggagacggctctctcgtctatcacattcctttctgtattcacatacttgaatgcaagcttgactccgggactgaatgcatcatcgtgctattgctcgggtccaagaggagatcaaacgaggtgagggagtacggatccagtacaagactcatctcctccctcgcattgcttatcggactttccaccggcaccaccttgtctggttgctggaaggaattctcatcccgtagagaaccagatgtaagtaccgtctttatggatccaaatgtctgaatctcattctccagcccagttatggagatactaagatctacagccttgttgccgaaattgagaacctttatttttaggtaggtattgccatctttagaattctgccacgtgatagccgatgcgaccagttggttatagttcgatacttgaatggtagatggatgaagtgccgcgccgcttgactccttgaagaagtgtaacatccagtagtttggacatccatagtgctgccatgagttgaagactatggcatctggactccacctgcgatcattgtcatttacgaagagtggagcacaacttgccatttcaacagcgtcgctgcgtccttctagtccgttaagcacgccagttcaaaatgactgctgtcatcgccatgatgccaaac

SEQ ID NO: 11126 - DNA, 717 bp, Triticum aestivum
  unsure (1)..(717): unsure at all n locations
  Clone ID: PAT_TA_11126
cattttgattttcttttgaggaatgcatgcacatttcagtgtacctacacaacacaacacaacacaaaagctatatttcccaagactatttctgcacaaggtctatctaacattgcgtgcatcatcatctgttcttggagctccattccatgatggccgaccggagcgagtggttggggatgaggctcttgctcggcagccggaggttggtcatgggcgacttgtccttcatgctcacccatgtctcgatcgccttccggtcgtaggtgtacccatcggcggcgacgcatgggtcctccatgatttcctgaagaatggggcagaggaagtggcctggggctgctgacgatgatgctgtccggagaagggccttcgtctccctggcggctctggcagcgatgtccttgatccgctccagcgccgggaggatgtgctcgcgcagcccgggccggtccctgcgtcgcatctctgcgcaccgcagcgcaagtgcggccagctccctagcctcctctggcggccactgcccggcggttgcgtccagcatctccgcgaaggagtcaccgccgtcttcctccagtgcggtctccacggcgtgggcgagcccgagcggcgacgtccgccccgtgagcagctgcagcaccaccacgccgagcgcgtacacgtccgacttggccgacacggcgcccgtccgctggtactncgggtcaatgtagcaga

SEQ ID NO: 11127 - DNA, 972 bp, Triticum aestivum
  unsure (1)..(972): unsure at all n locations
  Clone ID: PAT_TA_11127
tgtccatgcccccatatcacaccaccacctgtcctcccccttcctctctctctctctctctctctctctctccctctctgcaaacctacaagcagggcaaggaggaggaggaagaagaagaagaagcaaacatgtcttccccaagcaagcgcagggagatggatctcatgaagctgatgatgagtgactacaaggtggacatgatcaacgacgggatgcacgagttcttcgtccacttccacggacccaaagacagtatttaccagggtggtgtgtggaaagtcagggttgaactcaccgaagcttacccttacaaatccccttccattggcttcaccaacaagatctatcaccccaatgtcgatgagatgtctggttctgtctgcttggatgtgatcaatcaaacatggagcccgatgttcgaccttgtgaatatctttgagtgttcctgccccagcttctcctctacccgaacccctcggaccccttgaacggcgaggcggcttcgctcatgatgcgcgacaagaatgccntatgaaaataaagtcaaagaatattgtgagagatatgccaagcctgaagacatatccccggaggaggaggaggaggaggaggaggagagcgacgaggagctgagcgacgccgagggctacgactccggcgacgaggccatcatgggtcacgcagacccttgactggtggatggatggatggttagctcagtcagtaactcagtaatgcaggatgatcatttcatgtatctctgtcagtctgtctgtacatagctgcggcgctcaccgaatgccgccatggcagatgctgaagaaagtcatcagccatctcaactcagtttcagttcccctagctctcgtgtcgcgtcgttgttgttgttgtcgtcatcgtcgtcatccctgtgaataacttgccatttgtttgtgttggttccatttgcagttcatgtttccattctaa

SEQ ID NO: 11128 - DNA, 1360 bp, Triticum aestivum
  Clone ID: PAT_TA_11128
gaggattgttgattcatgtttaatagctagcttgcttctattgattggtcaggcctctctctctcgcgctctctctctctgtgcaaagagagaaagagccacctacaaacagacaggcaggggaagcagagcaaggaggaagaagaagtgagatgtcttccccaagcaagcgcagggagatggatctgatgaagttgatgatgagcgattacaaggtggatatgatcaacgacgggatgcaggagttcttcgtccacttccacggacccaaagacagtatttaccagggtggtgtgtggaaggtgagggttgaactcacagaagcttacccctacaaatccccttccattggcttcaccaacaagatctatcaccccaatgtcgatgagatgtccggttctgtctgcttggatgtgatcaaccagacctggagcccaatgttcgaccttgtgaatatctttgaggtgttcctgccccagcttctcctgtacccgaacccctcggaccccttgaacggcgaggcggcatcgctgatgatgcgcgacaagaatgcctatgaaaataaagtcaaagaatattgtgagagatatgccaagcctgaagacatatccccggaggaggaggaggagggagagaggagcaacgtggagctgagcgacgccgagggctacgactccggcgacgaggccatgacggtcatgggccacgcagaccaggtggatggatggatgcatggatggttagctcagtcagaaactcagtaatggaaggatgatcatgatgtatctgtctgtcactgtacatagctgcggcgctcactgatgaatgccgccatggcagatgctgaagaaagtcatcagccatctcaagtcagctccactagttcttgttgtcatcgtcgtcgtcgtcgtcgtcgtcgctgtgaataacttgccatttgtttgtgttggttccatttgcagttcatgtttccattgtaggagatgtctgttcttctgttttgttgattttcatttccagttcatgttttaaactaaagtatgtttccctttcctactcatctcaggggaatttaaatctgctctgcatgtccagtcgtccctctctccatctgtctcatcgtgcttaatttctttgattgatccatcgattgattgattgattaggtgcgtgatgatatctgtttctttctttctttctttgcttgattgattgatttcccctcatctatgttcccaaatgaaatctgcctgtttgttaacctacaactacaatggaggatgaactcagctgtcccccttatttcggaacaaacaaacaaacaaacaaaaagaagtagcttctcttttctgtatcttca

SEQ ID NO: 11129 - DNA, 664 bp, Triticum aestivum
  Clone ID: PAT_TA_11129
agacaagaccagaatagaatatttggcagcgctgcttcgcatgcttaataagatccgagtaatttttgccaatccatactcaccctacatctctgcctccgtcctagtcgtaggcaccaatcatccatcaggctactagtatttacaacgccggatcattccacggccaaaacaatacgagtgttgcagttcagtcacacctcagtgaccgactactaacaaatgactagtagtccagagcagcagttgcttcaatctcagtgttataggctctgatcatccaagcagatcacttcaggcgccctccctctggacatcatcgacgacgactctggagaggactcgatcaccgtcagcttctcgtccagatcgtgtatctgcttcttcagcttctccccacggtcaggcagcctagaaaccagcgtcgtgttcgaaagggtttgcgacagccggttgattttcgccttgatttcctcagggctctctgaacttgtattgcttccagagtatgctcttggagtgaagtcctttggcttgaaagcatgggcagcgccgttggcgacatagtccatcgaggatgccttgttgtactgcctggccatcatcggcatggctgggtgcttgctctccagcgcttcaggctccaacgaaggcaagactgctg

SEQ ID NO: 11130 - DNA, 612 bp, Triticum aestivum
  Clone ID: PAT_TA_11130
tttgttttttgtcccatagctaggtagtggaagctctgctcttctattacagtgtgacaaagattactagcatctgcggcctcctaattatgcgccccgtttgcccgacggcttagactcctaccctcctaggcctccttctccaccgccccgcctggctgactgctgtaccaccaacccctccacctctcttgcgccgccacaccccccggtccagctccgtgcaacgtcccccgtctcctcgccctgttgtccacgccccccgccccagcctctaggcggcacagcctccgtctttgggcctcctgcgcccgcccagtcgccgagtgccgggtccagcatctggcctcttgaagcctgcccgcttgaggccctctcgtcagcggcttctgtcaatatttcatcgcctggggggcttccaaatccatcgggaggagccccctctggtggagcaccttccctaacaataatccatcctgccgaggggggcttagagaaaccatccaagatgaccttcctacccggggactgagaccgccaccaataattcatgaggatgcaaacggcgctcgcgaccgtctcgccgggtacccccactgttgtatgaatggg

SEQ ID NO: 11131 - DNA, 793 bp, Triticum aestivum
  Clone ID: PAT_TA_11131
accaagaagcacaaactgtacagccagatcaattcagtcacagcagagatgcaaattctgctgcaacagggggcacaatacaagatcctgaatattacaaggatctagaagcatgctgggatttggaaatctcactcagaactgcaccaacgaccgcagcttgctcgagacattcagacttgttcaaagcgtctaaaagactgacgcatgtcgtcacattgactctacatgcccttagacgagtttcttcaaatatgtgatacgcctccattgctctgtttgcattgctcataccctctatgagagcattgaaacatgcagagtcaggcactccgccattggttttgaaccccacaaataggttgtaagcatctgttatgttccctccctttgcaagcccggagatcatggttgtgtaagtgacaacgtttgggatcaaaccttgtttctgcatttcttgccagaacacaaaagccttgttgtacttctgtacccggcaaaggccatttataagaatgctgtatgtataggtatttggtggacatttcatttccttcattgactggaaacaaataagggcctcgttgatttcttcagctttcactaaagcatccatgagactattccatgtataagcatttggagtcagacccttcttcagcatctcttctaaaattaaataagcttcatctatcctgccagccttcccaaagccatctatgagagaactatacagaataatattcaattctattcctttcgatttcgcttcttcagaaagcatgtaagcctc

SEQ ID NO: 11132 - DNA, 731 bp, Triticum aestivum
  Clone ID: PAT_TA_11132
ggccggtccgccggattttaaacgtttcccataaacttataccataccctatattctccgtccggtcctctcatccgccgtgcgtgaccgccgccgcgaatcgtccccaacgccgatctggctggaccctcgccgtattagccgtccccgacctcgccgtggccagtcatggccggatcctccccgcctaaccgtacccgagctcgccgtggctcgatctcgcccgacgaagtgaggcgacggtatgaaccgaccggcagagggaggaagggaggtacctgcggtggtggcggcggcgcccggcgaccatctggttctgattcggccgcgtccggctcctattcaatgtcaggtagatctgattcgatcgcgtccgacacggaatccgggtcagacagagggagcagcagatcgaaaaaaaccaggatgtctaagcggctccagggagaggagatacaggcaaactgcgcccgcaaaaggtcacgaccttctgatcagaagcacctctatctggtgctggatgactggaaagatgggttcagcattcacaagattgacgccgacgacgatgacgcggaccttggccagccaccggtcctccggttggtgttgccggcgcctggctttccaatgcgctttgcggtcgtgggcagcaacatcgtcatcgtcacctacccacgctgtggtcaggctcccacacttttctatgatacgaaaagaacaggactcgc

SEQ ID NO: 11133 - DNA, 419 bp, Triticum aestivum
  Clone ID: PAT_TA_11133
ttcggcacgagcgtccggcctgcctgcccgtgcgcacggccacgctccccccagagccagaggcagaggcagaggcgagagaaccaacccgaggccaggcggcgatggtgtcggactcggagctggtggagcggctgcgggaggtgctgcgggagtcggacctcaccaccaccaccaccggcgccctgcgccgccgcctcgaggaggacttcggcgtcgacctctccgacaagaagaccttcgtccgggagcaggtcgacctcctgctctccgagttcgccgacaaggccgagccggaggatgcgcccgtggaggaggaggatccggtggaggtgacgccggaggccggggaagggggtgaggagaagggcgagggggacgaggagggggccgagcagcaggagggggaggtggaggag

SEQ ID NO: 11134 - DNA, 700 bp, Triticum aestivum
  unsure (1)..(700): unsure at all n locations
  Clone ID: PAT_TA_11134
agaagtttgatcgggtgtttgctaacaaagtgaaacatccataagctaatatggatggcattgtcgacaagctacgttgtcgttgtacctcatagagtagaatacaaactgcagcagattcagggcactgagcgccgctatcgtccagaagaagtagtccaagtgtccgtcgtcgaggtcctccgggatccacatcgtggcggacgcgacaacgcccagcgctgccgagttgaggtagctccctgccgcgatggcgagctgcgcgaatgcggtgctcttgctccgcaccccccccggagcccgctcgtagttgcgctcgaccgtgccgacccccgttaaccccccactggcgcccttcccggcccttcccggtgcctgccacccgatgctccccgcccccccgcccgcgagacggttccctcttcgagaagagccaggtaagccatggccagagtggacaacgcgagacccggacgcccaaggcgcttgcggttgcgtgaggcctcggtccntcgccggtggcgcgccgagccaggggcactagcacgacgtcatatatggggatcaatacaagtgtggtgaccacattgaagctggcgagggaggccggtggcacggtgaatgaccccacgcggttgtccattgccataccctgctcaatcaccgtcgacgacatctgtgccgtgatcatgaagaagac

SEQ ID NO: 11135 - DNA, 1856 bp, Triticum aestivum
  Clone ID: PAT_TA_11135
ggcgccggagcttgctcaggcagcggaggggctcaacagcatggcagttgtccatctcctgcagcacaggatcacccagctccctgatagggaacgtgcagtgatcgtctcttattcctgagaaggcgttcaacgttctacgtataaatggtggggaagttcagatgatttcgtaagtggcgtcgaaggtaaacatgtgatctgtggtgacccaaagggatcggaaatcgacgatgtgagcccgccggaggagcttcatctagatcgcatccttgagattagtctagatagctcccttcttccagattttttggacaattcggagaaactgaatgagcgtggtccgccgatgataggtctgagtcgttttactctacttcacctaactgatgttgctgtcttaatgtatgcgggagattcgtccttggattgtaattcattggtggtgaacgaccgcgagtataaccatcttggttgctgtcctatcaccctcggctgttttgggtaaacggtttcttggcggaagtacatgaggcggcccttgcaaagaaggtgattgtgggaggcgttcaactcgctgaacttcaccaatggaggtttgtcgtggactccctttggtatcttctaccaaatacttactaaacagagggtgagagggtcattcgacctacaatcattgaggacacctgggggttaagagaaatgcaggttgggaaggatgtagacggtgtgttgacgtgtgatccaaatattcatgcaaacgcggtagcagtaccctgcttgacctttgatgaggcggctgaacttgcttattttggtgcacaggttttgcatccccaatccatgcgaccagccagggaaggtggtatcccagttcgagtgaagaactcatataaccgtcatgcacctggcactgtgatcactaaaacaagagatatgcgcaagagcatattaaccagcattgtcctgaaatcaaatattaccatgctggatatagtgagcacaaggatgctcggacagtatggctttctagcaaaggtcttctctatatttgaagatttgggtatctctgttgattctgtggctactagtgaagtcagcatatcattgacactggatccatcaaaactttggagtcgtgaattgatccagcaggagcttgatcatgtagttgaagaacttgaaaagattgcagttgttcatctcctacagcacagatcaatcatttccctgatagggaacgtgcagagatcgtctctgattcttgagaaggcgttcaacgttctacgcagaaatggtgttaatgttcagatgatttcgcaaggggcgtccaaggtgaacatctccttggtggtgaatgacagcgaggcgaagcagtgcgtgcaagccctccactcggcattctttgagaacggtttcttgtcagaagtagaggaagcggaccttgcacagaacatggctccagtcctagtaagctcgaatggtgccatcaatggaaactagtcgacgtcgcttttttctatttccagcaatggatgcgccgttcttaggttaagagggtgattcgaccttggattatttaggccacctgagctgattcattggtgttgcacgagcggtattagagctatcattttttatagctatcattggtgttgtaagagtgagcggtgttatagttggcatgattcttggagtgctagcatatggtagcccaatcactgtatgtgattgtgtgaggcgtgctacttgctgaacttaaccattggaggtctgtagtgcactccttgggtgtcttctaccatatagtatgtgtattgtacccttttatttatattagcgaataattcttgttg

SEQ ID NO: 11136 - DNA, 652 bp, Triticum aestivum
  Clone ID: PAT_TA_11136
ttttttttttttgagtacgaatgacatttgtattgcatatacagagcaacacgattacagttacagttacatttttcttatttctactttgctatagggcaccctatatcgagtacccgagctctgcatgcatggtctccaaacatcgcgtgctcgagtacaagtacaacactctcacacaccatatctataggtacacacacgtaaaactgctaagcgtatacaccacatctgcttagcccaaacgaggccgtggtatatatacgcagtaaaacaccgatgccaaacccgtggtagcacggcaaaatatcatacgaggcggcatccttgattgcttgctatgccgcatgcacttacttaccagtaaggattctgaagtaggatcggtgtacgtacgtagctgtagataaccaaccagtctgcggcttcgcgcctcctcgtcggccccgcccgcgcgcccgcgtggcgcggccgccgccgcagcggtaggtgacctcgcaggtcttgccgacccggagggtgtacttgtgctgcggcttgacgaggaacatgggcaggtggagcagcgactcgcacacgcacccgggctccacctccttcagccaccggcagcagtcccggtacgcgcggtgctcgtcctcctccctcgtgc

SEQ ID NO: 11137 - DNA, 1495 bp, Triticum aestivum
  unsure (1)..(1495): unsure at all n locations
  Clone ID: PAT_TA_11137
ccacgcgaccccatcgccaaaccaaagcgcctcctccgagcgtccgacgcttccaaatctctccttccctcacactccaccgacgcccgcggtgaccatggcggcggagcagagcgcggagcacttcagggggcaggcgcggctgccgggcttcgcggcgccgcggcggtacgatctgcgcctcacgccggacctcgctgcctgcaccttcgcgggctcggtgtccgtctccgtcgacgttgccgcgcccacgcgcttcctcgtgctcaacgccgccgacctggacgtggcccccggggacgtgcacttcgcgcccaagggctccggccaggtgttacttcctgtggaggttaccagtgcactggaggatgagatcttgattattcgcttcaatgaagtgcttcctcttggggagggaactttggtaattgcattccaaggaactttgaatgataagatgaagggtttttacagaagtgtgtatgagctcaatggggagaagaagaacatggctgtaacccagtttgaacctgctgatgcaaggcgctgcttcccatgctgggatgaaccgtctttcaaggctgtattcaaaattactcttgaagttccgtctgagaccgttgctttgtcaaatatgccagttgttgaagagaaggtcaatggtcctaccaaaactgtctactttcaagaatcaccgataatgtcaacatatctagtggccgttattgtcggcatgttcgattatgtagaagctttcaccgcggatggtactagtgttcgtgtttacacacaggttggtaagagtgcccaggggaagtttgcactagaggttgctgtgaagacactgatcctcttcaaggagtactttgctgtgccatatcctctcccaaaaatggacatgattgccattcctgattttgcttctggagcaatggagaactatggcttagttacataccgtgaaacagctttgctatttgatgagcgacactctgcagctgctaataaacaaagggttgcagttgttgttgcacatgaattagctcaccagtggtttggaaatcttgtgactatggaatggtggacacacctatggcttaacgaaggttttgcaacatgggtatcctacttagctgcagatcgtttctttccagaatggaatgtttggattcagtttctagaggaatctacaacaggtttcaggttggatgcccttgcagggtcacatccaattgaggntgatgtaaatcaagttgatgaaaganatgagacatttggtgctantaagctatagggaaaaggngctgnctggntntcccgnaatggttgncaaagcctacccttggggggctggggatctttccanaaaaccactggggtngcaataatantccaaaaaggggtcccaataattcaaaatngccaaagaccaaaggggactttgggggggcctgccccccccaaaaaagggggtccnggggggagccaaagttaa

SEQ ID NO: 11138 - DNA, 526 bp, Triticum aestivum
  Clone ID: PAT_TA_11138
ctgcgtgctatgaaagaatggttcttccccaacccactaaagacggggctggacaagggcattatatatacagggccgtaaccgatctgtagtaggtatgtacaaaagaatttgtggccatttgccagcttatcatgaaggtacgaaggcgtggttcacacaaccggttacaacagcgcacgagcaagcatcaactattttttgtcagttttttttcctttttcgagcctacactgggtcactgcttcgaggtattatccttacgggaaggccagccggcatgctgtcatacgcatcagctgctactccaggtcgttcatcggtgaaatgaagacccagcccatcctcgatgtaggagtcgtccatatacctcgtcttggacaaggcttggggatttctccagctcctggtgctgctgcttctgttgtcgccctgctccagatctccctcgcttccctctgatatatcatcactgtgatggctggaatgacttttgtctgccatattatgatatccaaaatgctgg

SEQ ID NO: 11139 - DNA, 827 bp, Triticum aestivum
  Clone ID: PAT_TA_11139
cgtccgtccacgcgttcaggcacaggttcggaaaagccgaaaaataaaacctctccttcccctccccctgttcgtcgttcttctcggttcgatccactcgagcagccccaaatcccggcccgattcctccccaaatccaatcgactccctgccgaaatccgccctcccactgatcgccgcaagctcccggacccggagcaagcaatttcgcgccgcaagaactgctcgccgtccgtggacaaaagccctcgaccgactctcccaacctcttttctgttcgtcctgaccatcgccttacgcgcctcgccgccatcgccgtcgcagttcttcctcgtctcgtctcgacatccgcgttcctgctatctgcaccccgtccgcagcctttgggtttcgagatccgcccttgatggcgggggaggaggccgcggagggaagcgggaacaggaggcggatggatctaaacctgtacctgggcctccctccattgccgcggcctccaggtcggctgggcgtagctatggatcgcccgccgccgcccaactcggccattccggttccggaatctccaagaacagatgagcctgcagtattaccggcaccagaggagatgccgccactgcccgttgtatactcgccgtccaatgcgctctccacgccggagctatcgctgatagatccgatgctctttgattggcttgatggcctcagtacggacagtgaagaggctcttgatgctggtgaaccggctgtggtgcgcgacacgccctcacatgatgccaatgtatcaccaccgccgccagcgccattgtctcttcctgggctggaag

SEQ ID NO: 11140 - DNA, 440 bp, Triticum aestivum
  Clone ID: PAT_TA_11140
cgtccgcggacgcgtgggcggcgattcgattcttgctgctgccccacgccccctgcagtcgaatccaatccctcccccaggccatcaactagacggaaagaatcgaatccctctttacccaatcgccaagggagggaggcaaagccaccatgaagatgcgtatgctgctgctgcgccaacaagcttctttcttcttcccccctcctcttcttccctggaggacggacggatgctgcggcaagaagaaaagaatctcactccatcgcccggccttatctccaatcctttcttagtctgctctctgcttgctggtggatctttcctagattgtgacttgcaaattatctctatgcttcggcagcctggtcgtgttggagggccaacactgactggtgttgaggctgagggcttacgaagctgcgttcaccgtcttggatttc

SEQ ID NO: 11141 - DNA, 589 bp, Triticum aestivum
  Clone ID: PAT_TA_11141
cgtaatgcccccccccccccttgtctttgataagtatgagaacgaatgtagcaatcgcttctcttcttctttgtttttctttgtacagcgacgaacaatcaatcataggaacaggggaggagagaaagaactggaagaaagaaacgatccccatccatccccatcccgatcgagccgaaccatccgagaaaaggccaccatcttttcgccacgctttgaaagtttgaagtttgaccaccatcatccatcgaacgatacctttcctttccctgtggtgtgatccgggggacgggggcggaggtgcgggctgccccgccggcccccgggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaagcatatgactactggc

SEQ ID NO: 11142 - DNA, 871 bp, Triticum aestivum
  Clone ID: PAT_TA_11142
tttttttttttttttttttttaggggaatggttacaacaaaccataataatttagaaaaaagcacttcatggggcatcaacaaaaaaaggaatatgaaaatggtgcttttccttcttcacatatagttgccaacaatgaattccgtagcttctccttcttggacatttacacaagcacctagcaggcaatgaacaccaaaacacacaaaagtagccatggcaaacgtctcggcggagcagcggatgcacttggtgctatgcggggaggagagaggtgtgcatgaactttttactgcatctgaccttttgaatattgcatatatgaacttctctggcgagacaagattgtttttttacaacatgtcatgaatatgtctctatgtcgcacctgctcctgcacttgaaaacaaaacacagcttctgtgcaattgaaagcagaacaacaatctgagcaatgatggataattaacaacaaacaacatctgagcaattgaaagcagaacacagcatctgtgcggcacctgctcctgcacttctctttccctcctcggctgcatctaactggttcgattcggtcgcagggatgtttgtgatggtagagccagtagagtgagtagaggaggtagcagaggcgggtggggagtgaaccagaggagcaccgcaggcggtcgactgcgagatggtggggttggtggctggaggggtgcccgatcgtccggccacgaagggcgtgcgggataggacggaggcgagggcgcagggacggacagtggcacgatgccaggggacctgagcaccggcagtagaggggacaaggcccagcggcagagatcgaacgacggacggtgaagccaccggtacgatgcagagg

SEQ ID NO: 11143 - DNA, 424 bp, Triticum aestivum
  Clone ID: PAT_TA_11143
ataaaactagtacacaaactttccgagtagaaggttctcagtgattagctgatgatagcagctcttattccacttacgcagaaaatcttggaccatcagatacaggaaccagaaagatcggaagcttagttacaaacgaaatttgaaacttctgctggcaagtttacacaaggattccttgtctggtatattcttctaagcttaactaatgaccaggtacaacttctggtacttctaacttctaagctcacgtaggtactaactcggtcgaggatggcgagaggcgcataacatagatgcctacggcaataagcagcagtataaactggctgaaacataagagtgacgcggtgcttgttctagactgcagctgcaagatctctgcactcgcagagagctctttgcattgcgcctccagcttctc

SEQ ID NO: 11144 - DNA, 473 bp, Triticum aestivum
  Clone ID: PAT_TA_11144
cccactcgtccgactccctcaggtgattatatcgcgtccgcggccgcgtgggtttggcttatcaacaacagcagatgatgccaagaattatttgcgtgtcattattcttcttcaatatgtcccccgcatcatcagatttgtaccattgctcggtggtcgtcagtctgccactggattcatatttgagtcagcatgggctaattttgtgattaatcttctaatgtttgttttggcgggtcatgtcgtcggttcatgttggtacctttttggattacagagggttaaccaatgcctacaaaatgcttgtgctgcgtcaaacatttcgtcgtgtaaggttttccgagactgtggactcaactttgatattggagggcagaatgagcaaattagtcagcaatggtttaatgagccagcctcaacagcttgttttgacactgggaatgatactaatttccagtatgggatttatcagc

SEQ ID NO: 11145 - DNA, 1277 bp, Triticum aestivum
  unsure (1)..(1277): unsure at all n locations
  Clone ID: PAT_TA_11145
tagccgcccagcgggtactgcccgaagttgagcgcggcgtgctgcgccgacgcgagccagacgagcgtggtcaggatgttggcgaggtcacgcggcgtggacagcggcggcccaccacggcgcngtcccggaggtcggcgtggccgacgtggatcgactcgtggtaccactcctggagctcgtcgtcggactggaccgtgccggcgtccgggtagtagagctgcacgtaggactccacccagttgccaatggcagaccacagcagaagcccgtcgtttgcatgagggtaatcctcgatgagaagcctgatgccgtgggcctgggggccgccccccccggccactcccctgcggaggaggtcggccgggaggccctcgaggtcgaagcgccagtggttgccgtagtaggcggagctgatctcggccggagacagggccgggtgtgaagcaggactcgatgaccccttcggcgttgatcaggctctgccgcgcaagcgcattgatctccagcgtgtacctcatgtgagggtgtaggaccttgaagatggggtgcatcgcgctcacacgccggtgcgcagccaggatgaatggctccattatagcatgcgtcctcaaccagtgattaacaagctgatgaacaccggcgtcattggagctgacatgcgccttgccaagcatccagatccagttggatgtagcatcacaggcaggggtaaggaccttgcttggctgaggctcccctgactgtgctggaggaagagaaagctcaatcgcgaccggtttcaatgtgccaccttgagtcaggaagaagattgcccgggttgcgtatgctttccgcccctcgatcgcgttgatccggtccaagaatggcatgtacacatcatggtggtctacaatgaagagcttctccatgtctattgcctcttgtactgtcagtccgttgagctgaccagaaatgtgccgttctgtaattgatgattcaggtggaccgtacattgcaggatccagcttgctcactggtgggaaaaccttgagcctctcaatgctaactgggtttattcctgcaatagtttgccgcgcaaactcatcatcacggagccatgcaaacttgtccttggaaaggatgctaggtgtgtcatagcgaagcatcccttcgctcgactcctgaatcttttggacaaatggtatcttctgaaacaggtgctcctggaggcctagcttgagcctgagaccctccttgtagaggttgccaaccggacgcgtgggcggacgcgtggg

SEQ ID NO: 11146 - DNA, 606 bp, Triticum aestivum
  Clone ID: PAT_TA_11146
attcccctccctctcccttctcttaaaccaatcagacgctagaatccttggcaattcgccgctcctccgatccgttcgtcgccgccgggatcgaccatgtcgtacgcctacctcttcaagtacatcatcatcggcgacacaggcgtgggcaagtcatgcctgctgctgcagttcaccgacaagaggtttcagcccgtgcacgacctcaccatcggcgtcgagttcggcgcccgcatgatcaccatcgacaacaagcccatcaagctccagatttgggacacggctggccaagaatcattcagatctataacaagatcatactacagaggtgctgctggtgctcttttggtttatgatatcaccaggagggaaacttttaaccatcttgcgagctggctagaagatgcaagacagcatgcaaatgccaatatgacagtgatgttaatcggaaacaaatgtgatctgtctcatagacgggctgtcagctacgaggagggtgaacagttcgccaaggagcatggtctagtctttatggaggcatctgcaaaaacagcacaaaatgttgaggaggcattcattaagacggctggaacaatatacaagaac

SEQ ID NO: 11147 - DNA, 1253 bp, Triticum aestivum
  unsure (1)..(1253): unsure at all n locations
  Clone ID: PAT_TA_11147
gctcctcctccctctcccttctcttaaaccaatcagacgctagaatccttggcaattcgccgctcctccgatccgtccgtcgccgccgcgattcaccgtcgccgggatcgaccatgtcgtacgcctacctcttcaagtacatcatcatcggcgacacaggcgtgggcaagtcatgcctgctgctgcagttcaccgacaagaggtctcagcccgtgcacgacctcaccatcggcgtcgagttcggcgcccgcatgatcaccatcgacaacaagcccatcaagctccagatttgggacacggctggccaagaatcattcagatctataacaagatcatactacagaggtgctgctggtgctcttttggtttatgatatcaccaggagggaaacttttaaccatcttgcgagctggctagaagatgcaagacagcatgcaaatgccaatatgacagtgatgttaatcggaaacaaatgtgatctgtctcatagacgggctgtcagctacgaggagggtgaacagttcgccaaggagcatggtctagtctttatggaggcatctgcaaaaacagcacaaaatgttgaggaggcattcattaagacggctggaacaatatacaagaaaatccaagatggtgtttttgatgtatctaatgagtcctacggaatcaaagttggctatgctgtccccaatgcatctggaggtggtgctggctcgtcctctcaagcaggtggctgctgcagttaagcaagtttacgaccaagtcctatcatgtgagactgaaaacagctgcccaggttgttgtccttccttccgccattgacggtgtaatcagtgagcaaatgttcatcaatggtgcttgtctacactgcgcaatctttctgtaaagcaaacatctatagtttctgtccatttgtgtctgtaactaaatggtgtggatattcatttgttcgatgtaataatgctttgtagactacagacatggctgtgcagcaattgccctgttccatgtcataatatatgcccaaataagtccagttcatttcccttatactgtatacaatcactgtaatccatctagatgcttccgagtcagtgtcatgtgaggattcatgaattaatatccatttgcatgtgtgaattaaaataaaaatgtaatgattcaatgtgtatgttttaaaaaccaccgaacactgtgggccctccaagtttaaaantaattggacacattttttggttaanaaaaaaaaaaaa

SEQ ID NO: 11148 - DNA, 699 bp, Triticum aestivum
  unsure (1)..(699): unsure at all n locations
  Clone ID: PAT_TA_11148
cgtccgagcaaatctcacggtctatcttgtcaagcgctacaacattgggcggctcgcggcagcaaacatcaccaacattttctacggtacgctcaactttgcgccgttactaggcgccttcatctccgacgcctacttgggaaggttcagaaccctggcctacggatccttctttagcctcctggggatgctgggattgactttgtctgcatcagttccagctctcaaaccaccaggctgcagtcagacagcccaattaggtgggcactgcgacagtccatcaacactccagctgagcgtgctatacatatctctagcgtttctaaccatcggcggtggagcaatccgaccatgcagcttgccctttggagtagaccaattcgatatgactgatgaaaaaagccgaaagggcctgaatagctattataactggtattatggcacaactactgctgccctggtgttctccatgactattctcatctacatccagaatagcatcagctggccaataggatttggcattcccacattcttcatgcttatgtcaatcatcattttattcatgggcactagactttatgtccatgtgccaccagaaggaagcatcttcactggaattgcccaagttttagtggcattcatttaaaaggagaagactcaagcttccgcatcctgacanatataaatcaacaagag

SEQ ID NO: 11149 - DNA, 403 bp, Triticum aestivum
  Clone ID: PAT_TA_11149
ttttttttttttttttttttttttttttttttgaccaattccatgagcctgtgcttgaaagcccttttcgctcaactggggacctcgcgccgtcactcgtcgacagactcgccttcgtcctgccccactaggcgcgtaccagaccccgttacaaatggcttctgccagaaccagacccctcgcactggcagtcaaagcgtgccacagtcgtagtccggcgtcatgaggagccccttggcgagcacccctgacagcagcctgtcccgcgcaaatctcaccacggcgtgctcgctctgctgcacacgccccaccatgtaggacgccgctatcacctgcgcgcttcctccaccgccggatcccggcgtaccggcgcagagccgcctcgatcgtctcagtgccgtcg

SEQ ID NO: 11150 - DNA, 733 bp, Triticum aestivum
  Clone ID: PAT_TA_11150
tgcagcagggcgatggcacgaaggcgcaggtgacgtgggatgaccagcagaacatcaaccggttcggccgcctcaacaaccgcctccacgagctcgccgacgagatcaggctcgccaaggaagcaaacgaaaacctcgaggatgctgggaatgaactcatcttgtctgatgaagacgtggtgcgattccaaatcggggaagtgtttgcccacatgccagtggacgatgtggaagctaggctagagcagatgaaagaggacgcagctaagaagttggagaagctcgaggaagagaaggaatccatccttgcccagatggccgaactgaagaagatcctctatgggaaatttggagatgccatcaacctggaggaagattgatgtcaagaactggagctgcctttttaagtgtcgagtcatatgacacctgttcttgttcaggtgtttcattcgcctcgttgcattgtttcttgtgatgctggctagtgtaaaatgggagttttaagttctagaggattgttccccgttatgcattggcatggttgatctcggttggactcaaataggttgaggctcattgtccagcagaagccatgggtagtttatgcaaatggtcaattcggataccaatgaggggacctttacaatgttttaagctagtgagaatggtttgaacctgcatgattgtatgagattaagtcattaggctttacatgaaattttcttcagagccc

SEQ ID NO: 11151 - DNA, 848 bp, Triticum aestivum
  Clone ID: PAT_TA_11151
gccctaccgcacgcccccccggccgccggcccgaggccgaaacccagcagcgaccgccggcgcatctcaccccgggccgaggccggcgaactccgaagggaatcggagatgcagcagggcgatggcacggaggcgcaggtgacgtgggatgaccagcagaacatcaaccggttcggccgcctcaacaaccgcctccacgagctcgccgacgagatcaggctcgccaaggaagcaaatgaaaacctcgaggatgctgggaatgaactcatcttgtctgatgaagatgtggtgcgattccaaatcggggaagtgtttgcccacatgccagtggacgatgtggaagctaggctagagcagatgaaagaggacgcagctaagaagctggagaagctggaggaagagaaggaatccatccttgcccagatggccgaactgaagaagatcctgaaagcgaaatttggagatgccatcaacctggaggaagattgatgtcgaggaccggaactgcctttttaagtgtcgagtcgcatgacacctgttcttgttcaggtgttttgttcgcctcattatattgtttcgtgtgatgctggctaatgtaaaatgtgagttttaagttctagaggattgttccccgttatgcatttgcatggttgatcttgggttcaggctgattgtccagcagaagccaccgggagtttccgcaaatggtcactccagataccaatgaggggacctttgcaatgttttaagctagtgagaatggtttgaacctgcatgattgtatgagatgaagtcattaggctttacatggaattttcttcagaaaaatgcagtgttacaatcgcgtc

SEQ ID NO: 11152 - DNA, 560 bp, Triticum aestivum
  Clone ID: PAT_TA_11152
cgtccgcggacgcgtgggcggacgcgtgggcgcgcctgctcgtcctcatccaagacaccgccgtcctccgatcccatggtgatcgggccaaagaagtcaaggagttggacgcaattgccatgcccccaccggctgctctgcgtgccggagcactgagcatcggcccggttcgtggcagtcgccgccgtctgcctcctcgtcgtggtcggcacgtactacgtgctgtggtcgccggccgacgccgacggccagacggagcagcggttcttcggcatgtggcgtcgtcgatcagcggcaagtagaatcctccggcttcaactacttacttactcaattcggggccttttatatatgtcaattgattgattatttgagcctgtaactaattcagacgcagcaaagcccgaaaccctaacttgttggggattgttaaacttaaacccaggtgcgcgcctacggcggcgatgatctggaggcggcgctgcgcggcgcggcggacgcgaacaggacgctgatcctgagcgtgctgaacaaggcgtacgccgaggaggatggcctgc

SEQ ID NO: 11153 - DNA, 1251 bp, Triticum aestivum
  Clone ID: PAT_TA_11153
gcggtgtcggccgcctctccacccggcagcgcggccggcgcccggcaccaccgcgaccccggaggatactcttttcgtctcgtctcgtccccttttcgagatctcgccagttgggattttgaagctcagcttcttgacacgcatctgatctggtagctatttgtatgtgttcacaagacattcgacatgaagcttttagaatacaccccgttcgactgtgtaaatgtgttcctcgatcaactaaaccttggtgattgtacaattagggggagccttgaagccttctcatgcaagcacgcaggaaatgatcgtcggctttcaataagcctggaacatgagattcttgattaccttggcaagtcttctgatagtgatcctccttcacctgtggagcatttgtcttgtagatcgagccggaaaacgttgatatatctagttctcactcttggccatatgtatccagattatgatttcagtgctgttcgggcacacctattcttcaaagaagaagacatggaaagtttcaagcagatggtagacaactacttatcggaggcttctaggctctgggcagcaagaaatgaaggcagttctcttctggacagtatgactaaagctattgatgaggttatcaaaatcagggagtgtgacatctacagctacaacccagactctgacggagatccatttctagagaaaggggccatatggtcggtgaactttttcttctacaaccggaagctaaagcgagtagtgagctttcgctgctgctgtactagcaaatttgcaggagatgacttccttgctggtgcactctcggatggcgaggaggaagatgcgttgatcgacatggacatatgactgactcggttcggctaggaacatgaccaaccaaccagtgtgacctgcttgtgtaatatacagctcgtatggcgacagttcccggtaggaaactacgtatggcggcagttccctgtaggaacttttagtgtgactttgtttgtctgtttggagagcatacacttttggcctctattgtttatcgtccatgtttgtagatacaagatttaacttcagtctgccaaacttgaactggcatagtttgtccctttggtttgcactctggagacatgtttccaggaatatggcttcagtttgcagtcttatgtatgtaaattggattcttgaatttgaaccattctctgtacttatctagttgctatgtggtgtatccgtgtatgcaatgccctg

SEQ ID NO: 11154 - DNA, 2962 bp, Triticum aestivum
  unsure (1)..(2962): unsure at all n locations
  Clone ID: PAT_TA_11154
gcaggnaattcggcacgagggaacagnatgaagaaacctggtgcaaatagaagtagcgtagcaggaggtgaaccaccagttccatcaaccactgctggacaggcaatatggaccatatgcattcactgtagaacaagatatcagtactacagtggcgtactaaatcatcgcatccgctgtcagaactgcagtaaatattttgttgcttctaagctgaatggacaggatgtgccttctgtattcacatcaaattcaatcagaggtgttggacaacagagtggttttcccagtcaaccagactgttctacaaagttctctccttctaggttgaatggtgatgctaagccctcggtgaatggagcacaaactgctgaacatatgaagagtgccagagcggctggtgaggagaaggttaaccatgcaggggcagctgggaaaagcggggttgaattttcaacagggaacatgtctaaatcttctgcaccaagtgcaaatgacaaggcaggtggaagaatggcatctgaccctgctggtccagatgttgcttatagtaaaaacccatgcagtagggtagtagatacaccagcagagccaggtgctactggcagccctagtccccggagatcagctaggagaaaggcaaaccatgatgccagtaccccggttccccctagcaaaaagaggcgaacactaaaagattggttttcaaatgctgacactagttgtaagaaaatgtttgatgacaatgttgctcgtgctgatggaaaaactggtgaagctcatgtccctagcaaagcacacaatgaagagagaggaagcactgccaaagaagggaaccaggaaagtgttaagaaagaatttacatgtgatgcatctgctgcgaaggatccttgcgattctgcacaattaacctaccctgacccagaattttttgactttgataaaggcagggatgtgaatttgtttgcagttgatcagatttgggcagtttatgatgaccgcgatggcatgccacgatattatgctcgaataaagcatgtagatgctaccaaatccactattcggtacacttggctggagcataaggcagttaatgatgaagaagacagatggacggataaagaactgcctgttgcttgtgggaagtttcatcccggaaaaacggaggtatcacaaggtgccctcatgttttctcatactgttgttccatgggtgatgggcaaaagagggtgtgcctacgaaatatatcccaggaagggtgaggtatgggctctttataagggttggagtatgcagtggtgttcagatgcagataaccataaaacatacgagtacgacgttgtggaggttctgtcagacttcacaatggaagctggagctgctgtttttcccttggtcaagattaaggggtttgtcagtctatttggaaaagcaattgacagatcatcttctgttataccatctagtgaactgcttcgattctcgcacaatatcccattttataggacaaaaggaaatgaaaaggttggtgtggcaggtgggtttcttgaactagataccgtatcacttcctagtaacctggacgcatcgtttccatcagttgctatcaacaagacaattagcagtggtttcattgatgccagtgatattagtacaccaggtcctggaaatgaaccaagtgcttcaaaaggaaactcagccaagtggaggaaaacggatagatgattcccttgaacaaaccccaagacagaaacagaaaggcggcactgcgagtgtgcctggttcttcttctcagctattccgctcctctccaagtactattgcaacatatccagattcagagttttataactttgaagaagggcgatcatataacaagtttgaacgtggccagatatgggctctttacagcgatcttgacaaatttcccaagtattacggctgggtgaccaaagttgatatggaaccgttcagattgcatttaacttggctcgaagcgtgtcctcaactggagcaagagaagatgtggttgaagcgtgatatacctgtgagctgtgggacatttaagctccgcaactggaggatcaagtatgattcaaatgacgcattttctcatttagtagaaactagccaagttaatgggcaacgcttcgaaattcacccgcgagtaggtgaaatttgggccatttacaacaataactgggcacctgactgggttccttccagtgatgatgcgtgtgaatatgctgtcggtgagattactgagcgcactgaagctagcacaaagttctcgtttctgactccagtagacggttacacagctctgttcaggtttgacaatgaaagaggtattctggagattcctgcaaatgagaacttgaggttttctcaccatataccttcttaccgtctgacagaagaaaaaagtggcacgctccgtggcttctatgagctagatccagcttctgttcctgatgctttcctggtccgaggcggcacctgctgaccgactgacttggaagctaacattaaattacttccaatcaagtcaagtagtcatctggtcgctactgtgatctggttattaatcacactttgaaagtgttatctgcaggggagagcaaatgatcagttaggctctctgtatttctagatgttttaccgtacttcctagtgcttgggcgtattttggccatttctgttgtggaccttatgtaagctaggtgtggaccttctgaaagctaggtgtggaccttatgaaagactgggaaaaaagggaacttgatggttgttagtttggatcaggattctgcttaccgttgtgttgtgtgctatctgcgtgcatgcattattctggtttgtgttcaggtttttggcattgctgaactatttggagatgcatttatgccctttcctaggtaaggagcagtttaataaatagataaattgcttaaaaaaaaaa

SEQ ID NO: 11155 - DNA, 1752 bp, Triticum aestivum
  unsure (1)..(1752): unsure at all n locations
  Clone ID: PAT_TA_11155
cgtccctccacatgcccctctatgctgtggcgcattaaagcagccgattgagctataggaaggacatacttttgtcatcagccagcactattatggttgccttttccatgagctgctgacgtttcaaattggcgaccggcatccacaacaggagagagaacatgaagaagtgctctctaaggagatgctagcttttttaaatcgagcgatgcccacataagaaggtggggagccttccgtacctgtatccaaggaatccggtgtcatacatatggatctggaccgcagcttcttaccaagtaccttctgcagtaaacgcctccatttttccagttttttttcgatagaacatcaccgatgcttcaacccatgtcggtttgcaatttcagcatctactcctaaatagctctctcgtctcagcatatggttgtccgaaatagatattcgggaaagcctccatcgcgctgttaaagaaacttgttctttgctgcctgcaagagcaaggcaccttgcttttgcccgtgcggaccaatcgggcattacgtcattgttgctggcttggtgcacgcagaggccatcacctattccgctttagggaacattctggcttcaacgaatgaagcaagttttcgatcctgacgcactatgacaaagcgtctcaaccgtgggatccagctttccggccccacaatctaccctactcgctttcggaacaccgtcgacgatatagcggatctattttctggctgtgcgaagtacggagcttgggtggtgatagacacctcctcctctggtctggagttccaagccgccggctgtagccaatggaatttggaaaaatgtctttctaatgtgaagtcttcaaagccctcattctctgttgtcctgctcggggagttctcctttgagctttccaagtgctgagcttgacttccggtttctgattatgagcgactcgtccgttggttgacacattttacacgtttcccaagcttgagtcggccacccagcacgttgaagtacactctcaggaaactgctgggtcttaagaaccagaaggatcagcatttctctgaccttatcgttgagcagaaggagacgctgaagaatcgtgccaaccagttgatcaagacacttgagagctgtggctgggacgccgcgggctgccatggaggcatctcgatgctggcaaatgccaaccgcctacattggcaaatcgctcaaggtggatggcttcgagggcaatctcgacagccacaacatcagggaagccctccgcaagtccgcccgacggtgcatgagttgcagcgcgtgcactagggttcaagacttcagccggtccagctttgctctggatagcggcgagttcgaccgggcgatggagtgcatcacccggttcaaggagctggtcctcggtggcagtgctaaggtgaatggtagcaactagggttgttgggtgggtcaagtgggtgaagaaactgtaaaacctgaaggggaacaaactcttatctttctttgcccgtatgaacaactttgtttcgaatcaaaaagggaataaaagcgtggcatcacgggttttaaccactcttatctgtctttacctgtttgaaatactttgtttcaaatcgaaatggaataaaagcacgtaatctctgatgcttccgcaactacaaagtgggctgactcgcgtgcggacttctccagcggccgggggcccatttattgttccccccggtggcggcaccaacacnt

SEQ ID NO: 11156 - DNA, 495 bp, Triticum aestivum
  Clone ID: PAT_TA_11156
ttcgccggtcgacgggatccttagacacgacaaattcgtcgtcgtcgaggcttgcctcgtcttcggagggaggcatgcaattatcgtcctcaacctctctgtctgccgctctctcatgagggctggcttctccatcctcctgtgctgaatcctgctggagggggttgtcttcggcactgtccggggtgttattatctcccgtgccagaatcgccgtttttgctttggcaggatttagagcggcgccactgatgccgacgcttaggctgcttcttggaggggtcatcctccgttgttccatcgccattcccttcttttggggtgtccaccatgtatatgtcgtatgacgaggtggccttccagtgccctatatgcgctggttcttggtcgtctcctgcatcggcgtccataccgtcgatgtattcagagtggaagtcaagcatgtcggttaaatcatcgacagtggctacgaagtgggtggtgggtggcctttgaa

SEQ ID NO: 11157 - DNA, 364 bp, Triticum aestivum
  Clone ID: PAT_TA_11157
atgcccatacacaaccaaaaagagttagcaaggctataactcaaattggccaatttggcaagacatgatccatttcgcaccaccacatatcatttcagacaccgagtgaggataaactcacactgaagagatcattggatcattgtctgtagtaaacttaagcacattttgaactacataggtgcacaggatagtcattggcagtatgataattagcggcacgggagatgatcaactcctggactggatcgatcaggggaaaaggccccaacactgacgcataataaaattgcaatatagtacatacctaacagccaagatgggcttcaataaggtcggccctccttgggatagccctttttcg

SEQ ID NO: 11158 - DNA, 930 bp, Triticum aestivum
  unsure (1)..(930): unsure at all n locations
  Clone ID: PAT_TA_11158
ataggccattccggagggntaaccattgcccttgcaatncaaggntgcacttnnnctgggccacagnacaaccntggggcctanccngattngggcntcttgaatgcnctttggaggccnganccaagncgacggcgtgcttgcacggtggcccgttttttgcaaagtcagggtnatcttccaccgttgccccccggcggctccccggcattccccccactccgaaatccctaagcatggtcatacagccggcatcattggccctggccacacaggtcacagtatcacaacatacagtgaccattggaagccaagaaatgacaccttaggatcagcaagcaggggaggcaaacgacagattgatccctcacatctatccatacaatctataaacatctctggaaagcgggaggatcacaacgaagatagtcacgatgtacaaaaagatgccgaatctgtccaaagtcggctaaaaaattcactgctccaacgcaagctgcttgtgcttgtccagatcattgaggtaactcgtacgagtgtagtcctctgaatcacaggagtcgaacattgggggctttgtgggtttaggctttcccatcagttcgagtgattccctatcccccttcatgaaacggaccaccgatttcatgctaggccgcaagtttgcgctgtggtggatgcacatggatgccactgccagggtgagtgccatctcttctgggtcatatccaacatcaagagaaggatccaccagccccttcatgttgttcgactcgagcagcggtttcgcccatatcaccaggctttgtctcgaagagtccacggctttccgccctgtcgctagttcaagaagcaataccccgtatgcaaacacatccgtcttctcatttatgatcccatgcatgaagtacctcggccgcgaccacgcta

SEQ ID NO: 11159 - DNA, 650 bp, Triticum aestivum
  unsure (1)..(650): unsure at all n locations
  Clone ID: PAT_TA_11159
gggttttttttttttttttttttttttttttagttgctaatttggcaattatatgatttatcggtatcaacactcgatagcaactaagcctaacacttcagnaaataagnattgtacaatttctagcttccaggctccctcctcagcaaatatagattatatgcttcacaagatgtcagataccactcacaaaaaccaaaacaccataataaaactatgattgctggaagtatacgcatgtttatgccctaaccctctttttgagctcagcagtaatcaacgggaattttagaaccaacaatgcataaccatcggtgaacatggcctccttaaaatttgcttccaccgcgaagaagtcaatgcagttgttcctcaattcctgacagttataggtttcagcacaagctaacatagttgcaancggtatctactgaaactttattccataacttctgggcacaaataaccttcagccgatcaagtgcatatagatcagccgcagcgagtagattctggagcatctcantggaatagtcgttacactcatcttctccgggtaattcatncatgtatatgaatccaagcctaaattngaatgntgcangcgtgatatnnngcannctgatggatgacattgngnnctnanacat

SEQ ID NO: 11160 - DNA, 729 bp, Triticum aestivum
  unsure (1)..(729): unsure at all n locations
  Clone ID: PAT_TA_11160
cgtccgggggcagaaacccccttccatctccagccccatccgccatggcgcttcacactgtctcaggcatcaagctcccacccttctccctcccgcctccccacctccacctgggcgcgaaccccggcggcggcggcataagcagcggcctctacgcgagcagcgcattcccgcgacgccgatgcggcgcgctcgccgccgtcgtgcgctgcgcgaggcgcacgggcaagcggcggtacccgtcggagaagaagcggctggatcggcgccacaaggagcagctccgccagaccgcccccgaggagggcggcgtggcccgggaggctggcttctggcggctctccaagctcgccgtccccgccagcgacgaccccggcaaggacttcctcggcgtctccccgccgctcctccaggccattgccaaggccctcaagttcccggtcgcttctatgctccctgaagaggctttctctgttatccgcaagtcatttgatgcacgcaagattttgaaagaacctcaatttgtttatactgttgatgtggatgctaagaagcttctggacatggagccaaggacatgggattttattgctagattggaaccaggttggaattgtagaatatatgtncgatgagagggtagaatgatctgatnagtatgnttaatgttataaaaagtttcgatgatgaattggtacanggatatgtatatggtngatagtntaagat

SEQ ID NO: 11161 - DNA, 1087 bp, Triticum aestivum
  Clone ID: PAT_TA_11161
gcacgaggggcgggcgctcggtggccagcggccgcagcttccctttcgggcaggcttgggacggagctcactgcgcgctgacggagctcactgcacgctgccccctccccaggcagcacccgaggccggcggcggcggcgacggcggcggcgatctgtccactccacccatggacacggacgagttcttcaacccaggctgcgccgggacggccggcgacggctgcgactgcggggactgcgaggagcggaggcacgaccacggccgcaccaagcacttcgtcctcttcgcctccgacaacaaagattttctgtgcataccgtgggaggtcacaagacagctgagaaatatgatcgcccactctgagcctatcaaacttgaaactcctgatggccatgtgtacagtgttgaattcgtcaagttcggcctgataactcttacgactgggtggcggcactttgtggatgctaatcatatacgacaaggtgaccccatcacgttcgtctactgtgggcgctccacgttcatatgccacttaaagggcacttcatccggtcacaagtgttctctgccctcttctcaacagcctcccaacatctttagtgccaaacctcctcgtgatcatcacgtgctgaatgaacaagtggtgcctgatcctgcacatgttcccctgtcaaccgaccttggctataccatgttgaagaaagtgctagagctagctgatagcagcatgaggtctgaaattcctctgcatgtggcagctatgatcaaaagaaatgccaacgaggactgctatgtttacataccgttgaagcttttggacaatttcaaagagggggtaactgaagctgccattcagcttgaagcccatggcaacgacatggtatacagtgttggcacaagcaagcacagtgatgatcaagtaatcctccaatctgggttgagtcattttgtagcttctctccgcatacaagacaacgacctcctcgtcttcagaaacaagtggaaagaccgccttgaagttcttgtccttgatccgagcggctgtgagaaaacttgttttgccatgggaaactcttcaaatgct

SEQ ID NO: 11162 - DNA, 637 bp, Triticum aestivum
  unsure (1)..(637): unsure at all n locations
  Clone ID: PAT_TA_11162
aagaggttgagtatgtatgatgaacatgatgaatnaaatnatggtcctaggctgtgctaagctaccaccatagacttttcaacccctgccataaccaacaaacccagggtccgtgtcccatccctccactacttctgtaattacacctcagtgacaaacccccctccatacccagcaagacagctcaacccatcctaaatgggcaaaacaagtaaattatctctagttatgatcgatctgcaccaaagtaggaacccaatctaacaatcatcagttacaaaaagggcatgaatgtataggtagcacagcctgcacatgtcaaatatcttgagaagaaactccatgctcgctcgccaaatcatgcgacgctggagccgatccgatgcaccgagttcacgctacaatggtattccacctccatccactccacgccccggcgtaattttcaaaatgacaaataccaatagaatttcagtcccatcaaagccccagtaacatacagtcaatactgaataccatctgccaatcctattctgtcggaccgcgcatgaatagctgtaccatgtctttgcagtgacaggaagctgccttccatccatgtttggccctccgttaccagtcagcaaagcggaaccgg

SEQ ID NO: 11163 - DNA, 675 bp, Triticum aestivum
  Clone ID: PAT_TA_11163
tttttttttttttttttttatgagattattgcttctttttactcgaacacttctggagttctgacctgtaatcttaaaatggcgttcttctcgactgcttctcgaggcttgccgtccggcttggggttctgcgcccacacttgagttctatacacttcatctcgccatatgaacagtgcttttcgcatatgagcctttgctctcacctgtataaactagtattaacttgtctccatatggaatcagggaaggattctgtcaatcttattatgagacagccaagccatataattttccgccatctttctttgctaccacagtcatgtgactgccaaacagcccaactgtgctggataacttgctgaatcaaacagcttgagatcgccatcccagctttcagctaaggcgatgtcatgattctcaactccaggatcagggatgatgaattcatcaaagtcggataacgttttcaactgcgcgctcagtgacgctattgttttctggcagtctgctagtttccccgcagcacgagctaactctttctcctttgtgatgtgcaggtctgtacttgccataggtttcacttccattggttttggctgatgacctggagctctgctgcacaattcctgtttcaagtcatggcattgtgcggcgaactccgacgattctgcc

SEQ ID NO: 11164 - DNA, 1411 bp, Triticum aestivum
  unsure (1)..(1411): unsure at all n locations
  Clone ID: PAT_TA_11164
cccaggcccacaacctggccccccgcctctcaccggtcccggcccgccgccgccggcgcccaaaccctcgccgccgcagcaccacttcctcggcggccggaacggcagtgcatcccgctgtccgcacgacgccagcgaaggccatggcggacccaccttccccccgcctagacgaagacgacaccttcggccgcgacttcaacgcctcgccctctcgcaacgccgcccccgcccgttccggcgagaagaggcagttcggcgatctggatgacgacgaagacgatgtcttcgcttccaagaagggaaagacaaaggtggaggaaagtgcaccaggtgctgccacgggaatgattctgtctcttcgggaaagtttgcagacctgcaaagagaatcttgaatcaaaccaggtggaactggaagctgctaaatcagaaatccagaagtggcattcagcatttcagaacattcctgctgtacctgcaggaaccaatccagagcctgtttcggtggttacttatctcaataacctgaagtcgtcggaggagtcactgaaggagcagctggagaaagcgaagaaaagagaagctgcttttattgtaacatttgcaaaacgagaacaagagattgcggaattgaagtctgcagttagggacttgaaaacacaattgaggccaccatcaatgcagacaagacgattattgcttgatccagcaattcacgaggaatttacacgcttaaagaatctggctgaagagaaagagaaaaagataaaagaactgcaggaaaatgttgctgctgtcaattttactccatccagcaaacatgggaagatgctaatggccaagtgtagaacattgcaagaggaaaatgaagagattggggcaatggcttctgaaggaaaaatccatgaacttggaatgaaaattgcagttctgaagacccagaacaatgagctcaggaatcagttcgatgggctgtacaaacacatggatggcctaacaaatgatgttgagaggtcaaatgaaatggtttccattctgcaagaggagttggaagctaaagatgtggagctggcaaggttgaaggagatgctttgccagaaagaggcaactgaagacgacacggtcgttgaagaaagagaggaagctgcaaatgatatgaacgcttcttctgatccgcagccgataaaagtggagtcctaagggtgccaactgttttctgctgctcggtttatgcctctgatgtaatgtaacgcgttgatggctgcaacagtttttccacattgctacttggttacctgagaatttcatctgtatgcttgatggaacgctcgtgtatcacaggttctaagatatcccgaaagcccgnnncgatcgcccttgcttgtacacctgcccgggcggtcgctaaa

SEQ ID NO: 11165 - DNA, 728 bp, Triticum aestivum
  Clone ID: PAT_TA_11165
taattataatctctttaattaatcaagtgcacggaaaatgtcggtacatgtaatgcaaaaatagtcatagttatttttgctaaaaataaccgtatctgaaatcaaacagcaacgataactcgaaaatggcacatacataaaccattagcatattctcatgagtctccagcgtggagaatcaagataagatatgcgtcaattcttgtgatattttgatccaccgcttagctagttcacaaaccggcactgttttctgatctccccgttggccctggtcttcacttcgatactgcccatcctcaccatggccgccttgaacttttgctcccactgcccagggatccaggcgttgaggagcacttgtgccccagtctccgacgaacggagtgcggcgtccgacttgaacaatacttttttatcgagcacgttcttgtaatactggttgtctaggtcccccggggtcctgaagtcctgcaccaccacggggtcaccagtgcggttgcattttacctgcacagacgcggcgagcgtggcatccatggccgaggggtcagaggggttgggagggaggcggtccgagaaggacgagcagtgggagaccccgacgctatgtgcgccggagagggtgaccatctcgtcggcggtgagccctttggaggcgaacatgtccttgagcgtctggagggtggcgaagggcggaggcaggttggggagggtctcgctggcga

SEQ ID NO: 11166 - DNA, 640 bp, Triticum aestivum
  Clone ID: PAT_TA_11166
aaacactactagtgtgcgccacggccgccgccctccccccgcgtgtgggcggtggccaaaagacaggagataaggcgagactgtgagagggacagggcgggagacctcgacgacccctctcatcgtctgtttccggccgtccagcgccggcaggcagcgaagctagggcagatcgaatcaacagacgcgcgccggccgccggacaagatgacgggtcgcccggtgttcgtgctcttcggctcctccatcgtgcagtacagcttcagcacacggcggctcggggcggccaccctcaccgacgtctacgcccgcacccactggttctgcgttcgccagcctggctttgttgtcagtggacactcaagggccgaggcacctttcaacgtcattcaccaaaagttttccccaaggagtcagcagtgcagcggagcttggtgacagtctatgtgggaggcaatgattcgattgcccccaacccagccgggcctggacctcacctgccacttgtggggtacatggacaacatgaggaagataggagagcacctcaagagcctgtccgacagactcgtgtgatctttctgagctgcccgccgctcaacgaggagctgctcaagaaatcaacgagcactgcactgagc

SEQ ID NO: 11167 - DNA, 523 bp, Triticum aestivum
  Clone ID: PAT_TA_11167
ttggttgtggctggtggcacctccacgctcctcctcacttctctctccggcctggcttgcggcgacaaggcttgggaaaaaaaagaagcaagtcacagcacctacaagatgccctaggggatggatggatggatggatggtaaacaactccaccactcctctaaggtccggagggtggttccagagagcgaagtgcgcagtgcctgctcgcgccgtcgcctgccgcggcggtggccgctcgccgcccccgccgccgctgcgcagggcgcctcccgaccccgccgccggcgcgcgcggagccgccggaggaagcagcaggctgcggctgctgctgccccacccagcctccgccgcgccgcgcccgcccgcccccaccttagccccgcgcccgttgttgtacgacgcggcggcggcggctgctgctgctgctgctgatcctgggttgtactggtacggcttcggggcggcggccctgtactgctcgccactacccccgtaggccgcatcggtggcggacgcgtgg

SEQ ID NO: 11168 - DNA, 895 bp, Triticum aestivum
  Clone ID: PAT_TA_11168
gtgagttgctgacaccatcgccgccgccaccatatcgccacacagcgccggcaaggcggcaaccaccgctcccccccgccgccgccgttatcccttggggcccggacacgcacgagtgccctaatccccaaatccatccgcaccgccgagcccggcccgtacatgctcgccaagttccggcccctcatggcggcggcaccgacgacgaaggccgccccggccgtggcgttctccacggcggcggagcgggatggctacgcgcagtacaaccacaccgacgcctgccagcacctccggtggacagccagggagagctacgagtacatgtacgcgcggccgtggagcagggtggtcgacttctacgccgagctcgtgcgcaccggcgccggggcggcggggctcgccgagctgtttgggaaagacgagaaagatcatcttcgtgatacgaatggtgaggagcctttagcatcatctgaaaaacaaatgtctgttaaatcctccaaagcccgaggaggcaggtgggaaagagcaaactttaagattgttctttcgtatcatggggggtcgtttgatggttggcagaagcagcctgacctcaacactgttcaagggttagtggaaaaacatcttggacaatttgtcgatgagcgaaaagctaagcaacttcaagaaagatctttgccgatagaaggctgtgccactgttgctgggcgcactgacaaaggggtgactgctcttcagcaagtctgctcattttgttagttacacttgagaacacatactgttgtgttgcctctgtctattttaatcatgtctataaacttgttatgatgcataacaacttgtcttgagcctgaaatctcatgtgtagttgttagaactatggcgtgcttga

SEQ ID NO: 11169 - DNA, 944 bp, Triticum aestivum
  unsure (1)..(944): unsure at all n locations
  Clone ID: PAT_TA_11169
tcgtgcggccgcccgggcaggtacagctccattcaaacgaaaactttatgtccggcactcacttggtgttggctgcgcctgctttagcgttgtcggggccgaggtacagctccattcaaacgaaaactttatgaatggaattcactttgtgttggcatggcctgcttccttggtcaagggctcaagtgccttgtcttcctgtctggatttcttcgccttgtgtcaggaagagttgcaaactagaataactgatgaaaggatggggcagcagatcactttgtgctcctgtgacctgctgaagccatgagtgttgctacagcggcgataaacatgagcagcatgaacacgagcagagtatacgttttcttcgacgactttcggtacccccccgggcgcccgctaccccaaaatgtgctcacaagtggcaatgcctgaacagcatcagcagctgcataaccagcagcctgaccacccatgaattggaagccattgccgaaaccgcaaaggaagccggcaagaagagcccattgcctgccttcccagtcattcagataggccttgaaggatgacttgggcacgcccgccattggacggtagaggaacaagatgttcaacccgataccgacggacaaaacacgaaatggagaagtagaagaaggcggtgtagaccaccaaatgcgggacaccgtctttcggggtgtgccactggtcattggtggccaggttgatcgccggggagaagagagagaagcagangccagaaaagaaaaatatcccaagccctataaaggtgcttgatccaaataccttaattgaacggcgntcttcgagctcaattaggtattctgcagttccagcttcggctttggtgtcacactctgcagaagctccattntccatgtccttcggagcatctttgtctataacttgtttgcctctctccg

SEQ ID NO: 11170 - DNA, 522 bp, Triticum aestivum
  Clone ID: PAT_TA_11170
ccgcgcttgctgcgctggtgcagtctccttggttctattgccacgccgcggttcgcacggccccccggccggcttttccgctgctgctgctgccgcgctccggcctcgcgcagtgtcggagtgacatcagcggcacaggccgccaaggactttaggcggtcgcgtccgcccgcgacccggcgccggccagtgcggccggcgccggcggctcggcgggtcccctccggccgcgttcgctgccgccgccccgtcgttccggccgcggccgccgccgccgcggcgccgcccgcggcggtgcgcgccgtgccgggccgcccccgccgccgcccccccccgccccccccgcgcccccccccccttgcccgcccgccgccgcccgccccccccccgcccctgcctgccgcacacggcgggccgcagctgccgcccccgcggcgccgccgccgggggcgccgccgcgtccatggcgtcttccttggtgctagtgtgcttcagctggtagcagctagagatggatgtggg

SEQ ID NO: 11171 - DNA, 695 bp, Triticum aestivum
  unsure (1)..(695): unsure at all n locations
  Clone ID: PAT_TA_11171
gtcgtggccgggggccatcctcctcgttttgcattagtccggatatactggcccggggtctgcccgcctgttgtacattaaaaacccacatgattcgagaagagcgtggacgctgccgtggtacattaaaaacccacatgattcagagaagggagaaaaatgataaaattaaatagggcgggtcatagaggctcattatccaaccagcgtcgagccatggcaagacattccttaggtcggtgttctatggatacgtggccaccaccctttattgtcgcaaatgtaatatagttggcgtatgtgattgtaaatcctgcagcctggccatcaagatgccatgctctccaatcatcgactacggagaagttgaaggatctaacccacgcatgtgtgctcaaaaatggtatcacaagatcatggtctccgctaaacacaagcgcacgatagcccctgcttgtgaggttgaaatggtacctgcccgggcggccgctcgaattccaatgccccccggcgccgctgggggccgcggacgcgcgtcggccgcgtttcttgcatcttataaactctccagttgttccctaaatggatgcattatttcagtaatgattggaccatcttacacaaaggttaggggtggtgctcgatcgtctactcttaatacaactagaaactncaatatgttacataacatcatt

SEQ ID NO: 11172 - DNA, 1797 bp, Triticum aestivum
  Clone ID: PAT_TA_11172
ggcaaagcggacatagacgtggagaacgaagagcagaacggtggcggcggcggtggtagcggtggcggtggtggctcacagcatatggcgcagcacagcgctggcggcggtggcggtggtggctcacagcatatggtgcagcacaacgctggtggcggtgccgacgggggcatggacattggcatgggtgttgtggccgtgagcggtgatggtaaaggggatcaggggggcgaggctggccaggatgagcaggtgaagaaaaagcgcgggaggccaaggaagtataagcctgatgggtcggtgacgttggggctctcgccatctccatccacgcctcattcgtcgagcccaggaatgggcgcgatggttaccacacctggctcaggatttgggccggagccagggtcagggggcatctgattatgacgcactcacggagggacgtggcagcgggcgtaaagtccggctcacaacgatgcagcagaggtatttgcttcatctcagcaataggggctgtctccacggcaacccttcatcacggattcagactccggtgcggtgacatatgagggtcgatttgaaatcctgtgtctttctggatcatatttggtggtaggaagaacggcggtacccgcactctcaagtggaggcctttgcatagctttgtgtgggcccctgaccacacagttatcggtgggagtgatagtggattcctgactgcagctggtattgttcaggtggtagggggtagctgcatgtgtggtggcgggtctaggaaggccatgggcgacccggaccacggcgtggacggcggagagtagtacggcggtgccggcggcaggggagagtgctccacggtggctcggcagctgcacccccagagcagggtgaaacacccgatgaggggatggccaccaggccttatagaccggagagccgagcgggggcggcgccggggaagagactcccacgttggcgctgccggagcacccccacaacatgccgccccacccgatgagcggatggccgcccggcctgatgaaccagatggacctgagatcgtctcccatgtacggcagcttgtcaaagcaaaaccagaccaaagcggagcaagaaatggaggagcgcaacggtggcggcgccggcggcgaagagccccttgcaatggcgcatccggaggacgacatggaccccgagcataacatgaacatgccgccgccccgccccatgggcgggtggcagcccggcctgatgcggcagatggactcgaggtcctccagcatcgacatcaactcgatccgcgagtagctcatcgccagagtggtcgagaccacttctcgaccccagatcagatgagatgagatcgtccctttgagtgaccacacagcaagcatcatgtaccgggcctattgtagattgcggtgttgttggagactgctgctgctgctgctgttttaggaacgaaaccctgcatatcgattgatcatagtattggtcattgtactgcgatgttgtattagagaagggatgacgatggatcctagtacctacctatacaggaagagtaaggaggaaaaacctgggtattttagttgatggaataatgttggcattgtacaccaagtaactctacctagcttcatccacctagctagttttcttttttgagcttcttccacctagcttctccatccatgcttcttccacctagtcttttttagcttcatccacctagcttcttcaagtttggacatttatttttggttgtttactctatatatatactccatccgttcc

SEQ ID NO: 11173 - DNA, 1543 bp, Triticum aestivum
  Clone ID: PAT_TA_11173
tcggcacggaggacaaatgcatacttgtttgggatcttgtttactttttatgaagatctttataccacaacgcttgagaactgtccaaatttcggcgcgatgacaaaaggtaagacttggtgatagattctgccatctcttgttctcatttccctgaagagagggagcttgaacgctgggcaccagatggaggggattcagactgcattgaattgggaaaaatttgacagaaagggacataggagctgggaccagtttgagacaaatgcagctttgtttggggtaaagagtactttcaatgaagatctttataccacaaagcttgagcgagggactcatatgagagagcttgaaaagcatgcttcaaggatagcacgagaaatagagggtgaagatacagaagatcttcatcttgctgaggaaagaggtttatacttggatgaagatttggagcatgatgaagagatcaaatattctgcagttcggagggatactgataccacagttaaacccttcacaaatgtcccaagcaggcccgttagcattgataccaaggatttgccagtgtgttcatcaacaatggatgacaaatcatcttccccgttatctggtggtactcatttgtctgccactgctgaataccagtcaaacaagcttttgcctgctgacgccaacaggttggatggtaagagaaataaagatagtagtggtgacaaagacaacaggatcttgcaacccggcaataccagctgctgaagggggccggcccttatcaccaagttcttcgatgggatctcttagctcagacaaatcaagtttgaacccaaacgctaaggaattcaaattgaaccctaatgctaagagtttcactcccttgacttctccgaggccacatcaccctccagcgcctgatgcaacatactattatcctaataacatgggggctactggacctggtttgcctgttggcatggggtttccacaggcgtatggtggacagcctgttgtttacaatgctcagcctggatcttctccccagggttacatgcatccttctgggcaacagtatgggcagcaaatgatgatgggacagacccgccctgtctattattatgcacctgagatgcagcagcagcaatacagaggaaggaacttctaggtagattgattttgttacgctgcaatgtggaactctgcagtgaaatccccattggcgggggatgctaaccaggccgatgcgccgccatgcggcaaaagagctggcgatggcctctgacttcaaccatgtgtgttttgtcgccaggacgaagatcaccgttgttccttctgcgacagtgttcgagtctgaagcgggctaactcggatttattgtttttatttaccccatagacgcgatgttgtaaattaacccccccccgcaaccatttatttggtgtgcccctgggatcatgatattctggagtgtgtgggtgggctctcccctttttgtaatacttggtgtttgatgtccacatcttgctgatttatttaacccttgtttggg

SEQ ID NO: 11174 - DNA, 1141 bp, Triticum aestivum
  unsure (1)..(1141): unsure at all n locations
  Clone ID: PAT_TA_11174
agcggacccgtgtccgagaaccaatttacaaagccatggcgtcgacctaccactaccggccatatcctctcccattgactgctgcacccccagcgttcgcatcccgctgccgcttcccgatggcctccaccggccccctcggggtcacggtgtccacatcggagagtgttggtcagaatgacttgctgattgtcgggcctggtgtgcttggtcgaatcgtagctgagaaatggcgacaggagcatccagattgcaaaatttatggccagactgcaaccacagatcatcacagtgaactaactaaaattgggataattccctccctgaagggacccagagttgatcagaaagttccatacgttattttttgtgctcctccatatcgcacggatgattaccctggggatcttagagttgctgcatcaaactggagtggggaaggctctttcctgtttacatcaagtactgccgtgtatgactgcaatgacaatggattttgtggcgaggattctccttgtgtgccgattggtaggagtcctcggactgacgtccttctaaaagcagaaaatgtcgtcctcgaggcaggaggctgtgccctgaggctagcagggctttataaaaaggatcaaggtcctcatgttttctggttgtcaaaaggaactgtagatgcacgaccggatctcataatcagtatgatccattatgaagatgctgcttcgcttggaattgccatcatgaagaggagacttcgcgggcgtgtctttgtgggctgtgacaaccaacctctgtccaggcaagaaataatggaccgtgttaacaggagcgggaaatttgatggcaagtttgagggcttcacaggtacagatggtccattggggaagaggatggataattccaaaactcgggctgagatcggctgggagcccaaatatcctagtttcacagaattccttggtctcagcaattgacatcttataccgatttgatagcagatacaatctgcattatgaatttcttctacagttatcctaaagcatggtaccatactcgtagcgttttctttttgcgtggaaacacggcatatgtattaatcaacctggaagacgttggtcttgtatgtatttttcctttctggaatana

SEQ ID NO: 11175 - DNA, 1376 bp, Triticum aestivum
  unsure (1)..(1376): unsure at all n locations
  Clone ID: PAT_TA_11175
gaggaggcgcatctccacatcgatgacacgaccggggaggtcaaggatgagctggcccaggacgcggtcgagcccaatgagaccgaggagcctgccctcgccggtgaccaggcacattcgcccctcgatgagcgcgccgccggcgcggcgaacgccgacgacatgccggtcggtgctgccccgctgcagcacgccgccatgcacggggccaccgacgagcacctggctgtggccacgcttgctgacgaggacgaggccgcagccggaggccctgcggatcaggccgctgccgagcgtaacgcggccgccgaccaggaggcgaatgtgggcgaggtgctccgtgccctggaccaggcccaagccacggcgaatgatgacgtagaagctgccgcggaggagcatatcgagggcgcagtctctgctgatgaggaggaggacgatgtcgcgggcgatgagttgcagcacaccgactctgtggatgaggaggagaacgatgaagaccggaccaccttggctgcttggctgctgcttcacagagcagccaaggccgctgaaggcaaggaagacgctctgattgttgatgaggtcgagcgcccagccgaagacggacgcgtgggggaacatttggttcttgatgaggtgaagcatgccatggataatgagtctgttgcagaggatgagaatgaggtggcattctttggtgctctgtttcagagcgcggccaagtacaatgagaagaagaagaaatatctcggttgttgatgacgtgtgctcaaaaggaagacagtgaggggccatgcttttggggctgtggttgagagcgcgtcgcaagccaccgtaaccgacgatgatggtgcagttagggacggccttgcagatgtgtccgttgaagaggatagagtggtggcccccatggnaggnagaaagtagacgaggtgctcatcgtcgacaacctgtcgcaacccacggtgactgatgacgaatgggcagccagggnagtttgctttcaccggtgacctcacaccggtggctgacaccgccagagacgagtgcgcgaaggaagtggtcaccgtcgactacctgtcgcaggccacagtgacagatgacgagtgggcagtcaaggagagcgctctcgccggcgaccgctcgccggtgttcgacgctgccggagactgcagtggtcacgtcatttcgccgctgttcgcaggcttatttgaggatgccaccaagttcctgtccatggactccacggtgtctgaagctgctgctgagaagaacgttgctgaacctgtggcagtggaaaaggagaaggagggaggcaacgaatctgaagcactgggcagcctgagcctgaggaagcttagggtccagctcaa

SEQ ID NO: 11176 - DNA, 575 bp, Triticum aestivum
  unsure (1)..(575): unsure at all n locations
  Clone ID: PAT_TA_11176
aactctttataacctactactagcggatagtgtgcggctgcacaccgcgcttcgttggttggttnagagttgtttttcttggtgtggaaaacaatactccctctgtctcaaaatataagacattttttgacacttacattttgagacaaagggagtgtgtgttacaggttgtttacttgcaaaatttatacatggttcacactacaacaaccacacaacttctagaacctcaggtacagttcaatcttaacatatgaaggatatatcaggttacagttccatattcactacgcaagctttggaaacatgcatctgaatccgatcttcctgctagctcaagggatcatttatccttcagatttgttgacaagtattgtcacatgcatctgtgatttgtcctctttttagctatgcccattatccttcaaacagatctgacagcagctcttcaagatcttcaggggtgtacttcataagctttggagctttgtttttgtgattctcaaggtatgtactgtaagcctgaacaagcttctctgatactgatttacgcatattggacccggagcananga

SEQ ID NO: 11177 - DNA, 537 bp, Triticum aestivum
  unsure (1)..(537): unsure at all n locations
  Clone ID: PAT_TA_11177
nntgggttccaaatttaccnaatattggggnggngattggcaaaaaccggaaaggattgttaacatgttgacattgcaaggttaacggtggggtgtacntcccaaaaacgaaaacggaaaataacaccaacttgcaccctctttcgatgtcatcacccatcagaaccgcaataacattaaattctctcctttttttggtgcagaaaagaaaacaggaaagcatcacagtgcatgcattgcatgcaaccgggaccggccatggagaaaccaagaacgatcaatcactgatgatcagctttgctcatccgacggcggcggggaagaggtggtggtggtggtcgcgatggcggcgagtttctggaggttgagcttgaccacggtgtcggtgaacatgcgggtgtcctcctcggtgttgccctccggtacgtcgacgacgtaggactcgacaacgacgcagtagggcgggcctgaaggctggtccgtgaactcggtgacggaggtgacggagcgcccgccccggcccccgcccagtccaag

SEQ ID NO: 11178 - DNA, 724 bp, Triticum aestivum
  unsure (1)..(724): unsure at all n locations
  Clone ID: PAT_TA_11178
ctgctcggctccccaaaacctatcccgcaactgctctgctgcccaaaacctaaccatggcgcgagtccgcagcaacgggcggcgtgccggcggcagtggcggtggaggcggccgcggcggcaagggcaaaggaaagggaaaaggcccgggcaagtggaagatgccgttgtcggtggcgcggaagcagcaggcggtgctggcgaacgtggaccaggtcaccggcgagaggatccccaagagcttcgtcttctcgcgcggcaagctcccctccacgcttcgtcacctacagcaggacctccgcaagctcatgctcccctacaccgccctcaagctcaaggagaagaagaggaacaacctcaaggacttcgtcaacgttgccagcccattgggtgttacgcatttcttgatcctctcgaacccaaagagcttgccgcacttgcgcttcgccaagtcaccgcagggcccaacctacacttgtcagattttagaatacgctcttgcggctgacatcgcaaactcccaaaagcggccaaggtgtcctgcagagatattcaaaaactcgcctctggtcgtgctcagtggtttcaatcgcctggccgttcgtccctgctgttgattcacctcctgttaagctagcaccctgcccaagatttttattgccaanaatggggancattcgatccaacactaactttggcacnagttnaacctnaaacaggcacng

SEQ ID NO: 11179 - DNA, 468 bp, Triticum aestivum
  unsure (1)..(468): unsure at all n locations
  Clone ID: PAT_TA_11179
aatggggaggaanttttgccanacaaatcatcntattaaggtggtcgtctagattttttaaaggaaaaggtgantgtaaagaaaagaaaagaaangaaaagaaaagaaaagaagaggcgcacacctcgcgcaaaattggccgaactcgggcttcaggtgagataatatagttggtgagactgaccgaccatttcaacaataaagcagcaaaagaaaggattttaaacttcacatcgtcgtctttccggccccggcagcttccatgaggtcatctatcaagcggtgcagatcacggtcggaggatcctccttccgccactgcggcgtgaaccttggcggccaggcccatgactctgctcctcgccgcatcccccggccctccaggctgcatgaaggtcttnaatgcccgngccacatcatgggcggggatgacctcgttnttnttcatacctcgngctccgaacgccgg

SEQ ID NO: 11180 - DNA, 664 bp, Triticum aestivum
  Clone ID: PAT_TA_11180
tttttttttttttttttttttttttttttttaagaaatgaatagctgccaatactttgctatcttggtgttacattaatgtgctcctagcaagtccttgtgcttgacagcctgagaagctctagaattccgcatacaaattactcaccatgactgaggtataattcagaccaaaatttggggccagcatgtcaaggagatatgatatgctatgagatagcttggaaatgttaacatttgcttcttgcaccatgaaaccaactgatctgggatgccaattggttgtcaacttgtcatcgatgctgaccagaagggtttctttccctgctgtcggagaagagccagtgtggtgcttttgttgcatttgaactgggggcaatgcttaatttgagatcgagatcaccttccatagaaacactccaactttcaccttcaactgatttactgctttctggtcttctttcttggtttcttgaagtttcttcgtcgaagaggtttaagcatgacactggcttgcattcttgaagaaacgactgttcgggtacttgcctagtatcagagtactgtgcgtttccaagacaagcagattggctagtctctgacgtacaagagctattcttgaggtttggcctgtggccctgcaccatttctcgagtatcttctgt

SEQ ID NO: 11181 - DNA, 645 bp, Triticum aestivum
  Clone ID: PAT_TA_11181
ccacgcgtccgggagtttcgagtagccagcctgctagctgcttctggcgcaatgatggcgcagccgcagccgccgcggtcggcgcccccccggcccaggccgcccctgcgtccgcggacgcggtttcgagtagccagcctgctagctgcttctggcgcaatgatggcgcagccgcagctggagaagaaggcgcccccgcgggcgaagccgccgctgacggggaaggccgtggccgcgctctgcgtggccagcttcgccgtcggcctgctgctcagcggctgggtgccgctcctgtcggcgccgatcagcacaggtgaacaagacctctgctcccggctgcgacgacaaccgcgtaagcaaggagttagccggggagaggcatgaccccaagggcatcatgagcgaggtgtccaggacgcaccacgccatccagtcgctggacaaggcggtgtcttctctggagatggagctagccgtggagcgcgcccggagcggcgtcgccggcgccggcgcggcgggctcgtccaaggaccttcagaaggccttcgtcgtgatcggcatcaacacggccttcagcagcaagaagcgccgtgactccctccgcgagacctgggtgccctcaggggagaagcttaggaggctgga

SEQ ID NO: 11182 - DNA, 906 bp, Triticum aestivum
  unsure (1)..(906): unsure at all n locations
  Clone ID: PAT_TA_11182
cggcacccacctccaacgccgccgccgcagcgtccatggccgccgcttataaggctgctaactccggcagcgtcgacctcacccccgctgcgcgccgcaacaagaagcgcaaactcccggagaagcagctcccggaccgcgtcntcgcgctgttgccagagtccgcgctctacacgcggtctccgacgcgtggggggacgcgtgggcgcagcgctcgcgcgcaagaaggtggacattcaggaggccctcaagacaccaccgtccctccagcgcacgctccgcatttacgtcttcaacaccttcgccaaccaggcgccccgcaccatcccgccgcccaagaatggcgatccgcccacctggtcgctcaagatcattggccgtgtgcttgaagacggcgcggagctggacccagccagtgtcgtgccgaagcacaatccggtgtatccgaaattctcctcgttctttaagagggtgactattgctcttgactcgtcactctatccagagaacccactgattgtctgggagaatgcccggtctgctgcgccgcaggaagggtttgaggtgaagaggaaaggggataaggagtttcttgccaatatccgtctggagatgaattataaccccgagaagttcaagctgtcacagccactaatggaggtgcttggggttgaggtggacactcgcgcaagggtgatcgcagccctttggcagtacatcaaggcaaagaagctacagaatccaagtgacccttcctactttatgtgtgacccccaactgaaanaaggtatttgggggaaggataaaatgaggtttgctatgctggtcccaaaaagatatcanaagnaaccttctcctccaacggcccatcaaactttggganaataagatnanagctatcnaggg

SEQ ID NO: 11183 - DNA, 581 bp, Triticum aestivum
  Clone ID: PAT_TA_11183
cttccgcaggcatcactcaacaataaagtaaaaaatcttacgcattacactgacgaactgcggtggatcacaagtcaaaatcggaaatcaagttgatgagggagtcagcatttattgtttctcagtctcttttgcagacaatgttgctctcaaggacccacagagaggaaagccagttagctgctaaaatagagtatgagtgcaaaatgagaggtgcccaaagaatggcgttccatcctgtagttggtggtggagtaaatggcagtgttgtacattactcaagaaatgataagaagatcaaatcgggtgatcttgtcctcatggatgttggatgtgagtaccatggctaccttagtgacctgacacggacatggccgccctgtggtagattttcagctgctcaggaagaactgtacagtttaatactggagacaaataaggaatgcataaagctttgtaaaccaggcacgagcattagagagatacaccatcattcggtcaagatgttgataagcggattccaagaacttggaattatagggaagggcaaatctatccaatacaattatttgaatccaacc

SEQ ID NO: 11184 - DNA, 595 bp, Triticum aestivum
  unsure (1)..(595): unsure at all n locations
  Clone ID: PAT_TA_11184
ngggaatgggtcggcccccctttttttaaatcntatgatgatggttgtacttgttgcattgtactactgtttatatatatcctcgtatataccaaggaaaagcaaatcatttttttcaggtccgacaagcaaccggaacggagagtggtgcaatgtacggctctgccaaatttgacgtccttagtaatccttgaagagcgagcacacacgagcctccttgtacacttccctggcctgcagaagtagccttgctccggagcacagtgcgagttgttggagcagacgcaaagtccttcaatggcacaacgctttttgatgatgttgggacttccattgataccgagaaccttgtcagtccactcgttggagaagagcccctctgggtcgtacctatctttcaccctaagaaactcatggacttttgggtacttcgtgatggcaccatcgaaggcgaaattgcggctcttaccccagtgcgggatgccngccgtacttacgcagcgccagctgctcgagctcgtccaccacatcggcatgcgcacgcggcatgccttcggtgtggctccggtaatagatgatgtcgacaccgatcgag

SEQ ID NO: 11185 - DNA, 1308 bp, Triticum aestivum
  Clone ID: PAT_TA_11185
catccttcaatagctccttctcccataaaaccgacttacccaaattacaaattcagtcaatttacatatagcaattgcagtatttgtgacactagtttgatcaatacaatttcacaccaccgtttgatcatcgcattagctaccgtgctatccttgaactgaaactagcggcacatccgcagtgctcgttaggatacaaaatgcccacctggctccgatccgcgcgcaaccttgggccctgctcagctgagtatgcctgcagacatgtaggactcgacgctgtccttgagcgtctcctccagcgtcctgaacttccaccccagcctctgcagcttctcggtgctgaacactttctcatctcccaccagctgaacgaacttgtttgcgcagttcaggctcggatgcaggctcctgacgacggaaaccatttcggacaccttcctggcgtgcgcactgcagatgtaccggccggccgcctccgggctctcgtacgccagcacaagggcgtcggcgacgtccctgacgtccaccatgttcctcaccctgtcgtccatggcgttcacgccgtcgcatttcaggtatctgatgaggaacaggctgctggtgttcaccgtgggctgcagcagaggcccgaacaccagcggcgggcacacggtcaccacgtccagcccggccttctctgcgtaagcccaggcctcgcgctcggccagcgtcttggagaggcagtaccagttctcggtggctctgcagtactcctcgttcgaccagcagtgttcgtccatggtggggccctcgggggggttggggttcatgaagaccgcgccgaccgacgacaccaccacgacgcggcggacgccggcctcccggcaggcccggagcacgttcagcgtgccggccaccgccggggcaagcagctccacctcggggttcgtgggttgggcggcggggcaggggctggcgacgtggaagacgccggcacagccggccacggtggacgccacgctcgcgtagtccagcacgtcggccttgaacaggcggagccgctcgccggcgccgtccagcgccctcaggtgtttattcttggggtcgctgggatcacggacggtgccatgcaccgcgtagtctcctccggcgagaaggcgctccacgagccacgaggcgatgaagcctcccgcgcccgtcacgcacacagccgccgccgccgccgtcgccttccccgcgccggccgggtccatatcgctcctctgtccgtactctgtactgcgacccgagagggactactcgatgtctggcttatcttcggtgcag

SEQ ID NO: 11186 - DNA, 1912 bp, Triticum aestivum
  Clone ID: PAT_TA_11186
gccggccgggctgggcctccccttcccggattcccaccctccacctccgccctccccttcctctccgcaacgctggggacgccggccttccccgagccaatcccccctcaccatagcgcggaccacggccgacgtcgacccccgtcgcccgccccccgaaaacccgagcgccccccccgccccgcccgcctccgccaaccctagccggcccccatcccatggccccggcctgcagcctgcgcgagccgcctccccgagaaccagctacgagatctcgtggagcaccccgacgatgggttgtcgggacgggctcgtcgacgactatgcaagccatcttcgaattgtggcaggtccccatcatctgtctcgccccggataaccctatgcggtagaggccttttttcaggtgcaatcaattagtcttccccacataaggttttcctaaaatgcccctccaatcaggttagcattcatcttcgtgtgaatgttgatcattcatactgtttatccggattgggcggggatgcgtttctattcttcatccgcttggatgtatgatcccaacggaatacgacgcttgcgacgtgatgcgttggacaccaagtccatagggttgagagcagagaataaaggcatcgtttagatgctttgagaagacaaaactgagtgaaacaccaaggtgaaataccgaagcaggctatatgactaaaagatgagaagaagagatgagttcaagaagaaagtcaggcgcgctgtacgtatatccccaggaaatgcgctgaataaaatgggtgtactggggaagtttgcattgcccatttcaggtgtggagggttttgctgtcgttctccaaatgtccttccgacactagcaatttcacttctcccctgtatattttccattagcctgtctcctgtggaggtcttggttttgactctgaaaacgcaacgcatattcctcaaggcgcacgggcacgcgtccacgaataaaggccgagggcggcgaagccaggcccaatcgccaaaaaccctagcgccgatccgatccgatcgagctctgcttcccctcccatggcggcccccccgagccaggcgagcctcctgctccagaagcagctccgagatctagcgaagaaccccgtggacgggttctcggcggggctggtggacgacggcaacgtgtttgagtggcaggtcaccatcatcggcccgcccgagacattatatgatggaggctacttcaatgcagtaatgacctttcctcaggattatcccaacagtcctccatcagtaaggtttacttctgagatgtggcatccaaacgtctatcctgatgggcgtgtgtgcatttctattcttcatccacctggtgatgatcccaatggttacgagcttgcaagtgaacggtggacaccagtgcacacagttgagagtatagttttgagcattatttcgatgctctctagtccaaacgatgagtctccagcaaatattgaagcggctaaggactggagagaaaagagggccgagttcaagaaaaaggtgaggagccttgttcgcaaatctcaggaaatgctctgaaaaaggaggatcatatgggggagtccacaagcgctgcaattctcttgctttcaccaaatggggcacctgatgccagcacttgcacttctcccctgtttattttccgttcagcgtcggtcgaatggtggtgttggtcttctctccgagacacttggggtgctgcctattatgaacttctgattgtattgtggcatggagttggtcaatgtcaagaagtattttcgtgtgatgccacttaatcgtagtcatcgccgtgaacatcatatcaaagaaattggctgtttgttgaatggatccttccccaaagaatctgcccgcgacatggttatttg

SEQ ID NO: 11187 - DNA, 792 bp, Triticum aestivum
  Clone ID: PAT_TA_11187
gacccacgcgtccgcacaaccctccccttccccccccccccccccagacaaccaaccctcctcgtcgcctctcactcgccggacgggagcttcctcaaccgtctcccggcgactcctcacttaatgcaatggtcaagaagaaatcttcatggagccaggttctgagtggcaggccaacaaacctctttgttcctgcaagaaatcttccagtgcaggatcttggagctgtaattttcggctgcacaaacaatactattgctgagtgccactcgcgccaactttttggcttgccaaaagcacatctttcatatgtccacaacatcaaggaagggctacctctattcctgttcaattatgatgatcgcagattgcatggcgtttatgaagctgcaagcaatggcaaattctgtcctgaatcaaatgcatgggcaaataatggctacgaaaagacaagctatcctgctcaggttgcaatgcggattagagtgtggtgtgttccactagaggagagtaaattcaggaatgctattataggcaattattaccagaagacgcccactgtctatggccagaagcctcacttcttcagatttgaattggatcatgcacaaacacgtgctttgatggctatgtttactccttcgccttcccccatcaagttctggacgcctcctgtttcacaaccaggagctcagcatgtgagtgaaccaacaccacctcctgtgtgggtacaaaaatttgagggtaacaatgagctcaaagcagaaaaggttttagtgtcatatgcagatg

SEQ ID NO: 11188 - DNA, 249 bp, Triticum aestivum
  Clone ID: PAT_TA_11188
gggtgcaaacagcgccgcccatgcactagctaaactagcgactaggcctgcaacctaatggtgcccatgctttaatgtaatgtgggagtatgactatggtggtgtttggttctctagtcctaggattttttctagtctcaactaaaaagttttcctagtcccttgctagaggttattaaatgatcatgttgcccctagtctactaccctataaaaggaagagagagcggagaaccaaacaaaaaaaaaa

SEQ ID NO: 11189 - DNA, 1426 bp, Triticum aestivum
  Clone ID: PAT_TA_11189
cggcccgtcccacccgcctatgattcacgagttcatggagcacgcatgaaaagcggagtaagaggcatgcacgaagtgccaccatggagctcttcctgctgccgcgcaggatgccgccgcgctaaggccaaggcttaggctcactccgacgccgtgcgctctccgccatggacgccacgccgtcgtggttcgctctcgccgacccgtcgtccgcgtgagggagtgcctgctcggttgctccgcctcgcctccggacatggagcgttgcctcccactaccgtaacgttgtctcccacgactttcagggcctcttctccacttccgctgacgcctgctcgccctggctcctcttagacggcctgcccgcggcggccgaccagaccgtgacggtctccggtggcgcctgcaggagcgtcgctcttccccgccgctcggccgaccagaccgtgacggtctccggtggcgcctgcaggagcgtcgctcttccccgccgctctggtggctcaaatccgtctgtgcccgcccgccgcttggagatggagcacgccgccgctgtcatcactctcttctacggcgtcatgcaatgcatggtcgccggcttcggcgccgcggtgacgggctcgaccgcacctccttccgtctccgcatgcacttcccttgccgcgcacgggggtgtcccaggttgcgaccattgccaggacaggctacagtccggcgccgcgctcgccgaggagctgagcgcaggaccgcgtcggcgcgtcggacgacctgagctctctggattccaagcagtgggagaaggcttttgtggactgcgtcgtcgtctaggcatgcgccagcaatcttgacctcgagcccggcctaccagccgaggccacgagctagcgacctctcaggctgaaggcccgccaatccttgtcacgtctccaccggctggacgttgcgttcgcccaggttgccgtcgccttgccatccagcgccatcggagtctttcccccgtgtcgtcgtcatgagactggagaggtgctacctcggctatactagagccaaagcggacgtgacgacgcactcctgttccttgcccacctcgatcgtcgtcaactgcgggatggcgagcacacgggcggttgcctcttcctcacctctatgttgtgtgccatgcgtgctgcttgcatgttgctgctgtgtcagtgcgtgccgtgaggtctgcgtggccgcgcactgctccaaccagtcgaccacacactggatgcccgccgcccactgtcgacctgcgagccacctgcgccgccgcgacgaactgcgtgagcacctccatggcatcgtgccaaatgagactgactagatgcagcatgctagaacatatagcatgttcctgtgatgtcatgccaaactgcagtttgtggaagggtggtttagcctgcag

SEQ ID NO: 11190 - DNA, 552 bp, Triticum aestivum
  Clone ID: PAT_TA_11190
cgtccgcccacgcgtccgctcccacccttctctccccgcacccttcacccacatatacacatggttttgaatcctccacacctcaaaactagcagcttcctcgccttctgctatcctccaccaaagccatgaagggtttcacgctggcccgagtactggtggcgctgctgctcgccgccggggagctgcattgcgcagcaacagcaccaccaccaccaccagcaaaggcatcggcgccaccgccgcaacacccagcaacaccaccaccgcatgcaccaccatcgccgccgcagcgacaccgaccatcacacagacgagccccgccagttccccgcaagcaggaccctccatcgtcaccaccgccgccgccgcctccatcgccgccgccgccgccgccgcaggaccctccatcgccaccaccaatacaggtcgtgccaccaattcaggaccccgacgtggcaccagcggctccacccaggggcggcaaccgcttcccggtctgcgccacgctcctcgtgttcggggactcgacggtggaccctggcacaacaa

SEQ ID NO: 11191 - DNA, 1301 bp, Triticum aestivum
  Clone ID: PAT_TA_11191
attcggcacgaggcacaaccggaggaggtcgtcttctccgattccggcaactactgccgccgccactgttcggatggttccgacgccgtccggcccttcctctcacaagtttatccaccactagcctccttgagcacccattgatccacccccacactcaattttgcccgggagccaccataggcgaaacacccaattcgtctccgccggagctcctcgggtgagctcgccgccggcgactccctccactccagcgacaaaggagggtacccacatgtccgcctcaaccttctgagctcgtaggaggcctcggttttccaaacggtgccgcctttcgccggcgccgaccgccggagctccgcctctgttcggccggagaaggaggcgcgcgcgtggactggtcaaacctgaccagtgggccgggcgggcccactgccagtgactcagcgcggtgccagctcattttaagtggagacgttttccccaaagtacgtctcctccaccggaaaacgtacaatagtaaagacgccttcgacgtcgcaaccctcccacgcagccaaacgactgggctcggcccagtagcgctaggcggctatactgcgcccagggcgcgtttctgctcagcccatcacagaaatggaggggagatataatttccaagttttggagtgcgcctaatctttctgcatgctcaagatcatgattcagagaggagtactacgaagccacctcgcaacctaggattcagagatagcaaccgcgcgagataggagttatccaggtcagctgttcccgtgggaatggagttccatcagcgttggagatccacgagtcgcttcccctctctgccactcgaaatcattgttgtactcaatggacctataaggtcttgtactcaaatccttgtaattgcttggaattctgtatcaaggaaatgtccaccagcaacagtaatcctggggctggtggtgacacaagggtcgtttgctgggaatttatgtcccggaaatccaggccccgacaaccctccttccaggccttcgctgaccacccgctactccggccgttgccgcgcacttgccccgggggcgcgctcctttttacctttgggataagaaccaagacagtatcattaatgcattctgctgactccgtgccttccacaatcctcaggactgccttagtgacgtcttccccacaattatcccaatggtgctgaaaaaagtgcgccgggaatccatccgggccgggtgccttactggggtacatctgaaaaagaggtgtttttacctcctcttgac

SEQ ID NO: 11192 - DNA, 1229 bp, Triticum aestivum
  Clone ID: PAT_TA_11192
gagtttctctgcgatggctgggtacgtcaggaacgggctgcggcagatggtgacgcgctctgcatcagccaattcgaggtcggagtacgcggacagcaagcatctgtcattgggcgagttcttgcgcgctagtgagagcaccggcctgagcctccggggcgcgcggctgcggctctcgccctaccgtgcgtggccgagcatgcacgacaacaggtttgcgctctacaagttgacgacgcaggtgcccatgccaggccgggaatatgccgggctgtggcgaggcacattcgggtggccaccggggcggccagacgacgagcgcaaaccagggaaggccctcttcttcctgctcctctcatacgaggaagacagcgaggggaagcttcttctgattgcaaccaaggtgttggagggcacgcactatgtcgtgcatccgaatgggtcgtccatgtttgtggtgcgggtgggcgaatcatcaacagaggcatttccatttccgaccgatgaggattcccgcagtgtgagcattgagagatgctttgctggagagggcattgctactgggtacgggttcaggtaccctggctcaaagcccgggtcactgtttgttctacgggatggccggctcgcctttgtttggagagacaacaagtctgtgctcaccttgcaaaggctcaacttggaggagctgctgaggaagggggagcgtgtgcccacattgccaccgataccgaacttcgcgtatctcacaaagtcttactccaatgtgtttgttgctatccatggaagtcccagctgctcatcttctcccaggtgaaaggcgcaaggtgagggtcaggaactgagacaatccacctgaggcagaggtaaagcgagcaatgcttctggatcaagctctgacgttcctccttggcaggttacataccgaagcctgcttgcaatgatatgatgccccgttgctgccaagggaagaagcgtagcagtagtgagaaatatattagcctcaaggaaatgccactttccctaagaatacaggaaatggcatcgatatacataactgttatgtccttatcttggttatttgcttgcttctgctttaaaagttgtccacatttaaaaggaatgagctgcctgtcattcagcaccaggcccatgctccaagtgctaaaatggcgccaattggaatgagattgattttttattagaagtatacatggttgagtgagaaa

SEQ ID NO: 11193 - DNA, 575 bp, Triticum aestivum
  Clone ID: PAT_TA_11193
gcaccctcgatactaacaacagcgtcaccagtccccagccaaaatgacgaagggtacctccagtttcggaaagcgccacaacaagacgcacacgctctgcaggcgttgcggtcaacgatcccttcacatccagaagcacacctgcgcctcatgcggctaccctgctgctaagacccgcaagttcaactggggcgggaaggccaagcgaaggaagaccaccgggtaccggccgcatgcgatacctcaagaccgtcaaccgcaagttcagcaacggattccaaactggcgctcccaagggctccaagggccccaccgtcaagtcctcgtaaacgtatcaagcataaggttgacgacgaggaggagtagaggcgcgatgaaggccattcggacgggtgcatgatcggaaagcgggttcttataggcaaatggtattgctcggcatggggcgttctgtcatccctctcccggttgctgtccatcccacatgacgaatgaggatggcatcaccgtttgagcgcatagctctggaggcataactacggaaaattcatcatgttctgtcacgaaaaaaaaaa

SEQ ID NO: 11194 - DNA, 602 bp, Triticum aestivum
  Clone ID: PAT_TA_11194
gccaagcgaggcactcggtgcatcgtcttcatcctcgccagcagcagccctgctttggcgttgcattcttccacctgaaccgtgcaaattatctaaattggtgtaggtgatacttactggagataatttgatctctaattatgtgcacatgatacttactaaaggtggtgtgattgctcgatggagccgataacagtcgcggggagtcaggagaggagattggggcgcttgcaactattggaggaaggcgatgtccaagtgtcgatcgctggaggaaggcgatgatgaaggtgggctccgacttgtagggcgtgctgaaactgacttgatgctagctcgtatggctagactcgtcgccatggcaccattgctagcctgattgccagagctcgtaaatcataacattaccttctcacggtatcgccttgccccgattgctcaaggtagtagccgccggcctgatacaacaaatcagtttaaagttaccctttgttcccttggggttgtggcagcaaattttcagattatctgtttgtttctcaaccccttagttgtgatgctctagctgtaagttaaacttgtttgtgtagaggcagccttca

SEQ ID NO: 11195 - DNA, 1449 bp, Triticum aestivum
  unsure (1)..(1449): unsure at all n locations
  Clone ID: PAT_TA_11195
cgtgcgcccacgcgtccgtcgatactcccggccccggacgacctgcttggctgcgcgcgtctcgataccacctacctcgtcgccgtcagagcctgttcccacgcgccgctcccctgtccccgcgccccccgccgccgccgccgcccccccccgggacgagatggaggtcgctgccgctgccgccgccgtcgccgtcccgaggcacaaggtgaagaagcagattaacctcttctactgcgccgagtgcgaggagctcgccctcaaggtcgccgccgcctccgacgccatccagctccagtccatcaactggaggaacttccccgacgggttcccgaacctcttcatcaacaacgcgcacgacatccgggggcagcacgtggccttcctcgcctccttcagctcgccggcgatcatcttcgagcagatctccgtcatcttcgcgctgcccaagctcttcatcgcctccttcacgctcgtgctgcccttcttccccacgggcaccttcgagcgcgtcgaggaggagggcgacgtcgccaccgcgttcacgctcgcgcgcatcctctccatgatccccaagtcgcgcgggggcccaagtcggtgcatcatctacgacatccacgcgctccaggagagggtctactttagggcgacatgtcgtgccctgcttcgagaccggcatacccctcctgctgcagcgcctcagccagctccccgacgccgacaatgtcaccattgccttcccagatgatggggcgtggaagcgcttccacaagtcgttggccaacttcccggtggtttgctgtgcgaaggtgcgtgaaggcgacaggagaatagtccgaattaaggaagggaaccctgaagggcgacaagtactgtgtgtgcatgaaatagtacaatctggtggtacgctgagagagtgccagaaagttctggctgctcatggtgctacaaaagtcagcgcctatgtaactcatgctgtgttccccaatcagtcatatgaacgcttcatgactgctaattctgccgggccaggtgaccagtttgcttacttctggatcacggattcgtgccctcagacagtgaaagccatcagccaacaacctccatttgaggtgttgagccttgctagctcgattgctgatgcccttcagatatgaacatggaccgtgaaatgggctgctcctgaatatagagcttacatttccagctccagcaaaacaaataatgtggagcgagttcgagttctctaattgtgtcgagtcttaagctttcataagcagcccatggtttgataataaaacaaggcattggatattcatccgtgcggttttctgtatccgcttttaaagctctagtcctgtctagtgttttaatttcctgacatgacatgtacgaagtctgaaaaacctgagcgtttgcattnattaaattttaggtcaggtttcggcc

SEQ ID NO: 11196 - DNA, 444 bp, Triticum aestivum
  unsure (1)..(444): unsure at all n locations
  Clone ID: PAT_TA_11196
tgcaggnaattcggcacgaggcggagctccgccgatcttccagcagcaatggccggagcaggagaagacgacggcgaagtagccgctcctcctccgccccctcccccgcgtactctagcgagcgcgccacttcgacgatgggctggcggagcggagcaccaccacggagtcggcgacgagccgtccttacggatggagagccttcctcgcctggggtagggtagctgccattccgccggtccctcttttctctttcttctccttgaatcgcagcagggcaaaaaaaaaagtagtactctttacttgagcatttcactgttaccctaaggatccaaccagtgcgtcaaaattagtccttggtgtgattcctgtggtgttctccacggatctgaacctctggggcaaaaaataaataaatggngttttatggggttaaaaaaaaaa

SEQ ID NO: 11197 - DNA, 450 bp, Triticum aestivum
  unsure (1)..(450): unsure at all n locations
  Clone ID: PAT_TA_11197
gctgacctcagcgactccgaaccactccccacggnacagacaatcaaaatggctcccgcaggaaagcaaaagaagaagtggtccaagggcaaggtgaaggacaaggccgtccacgccgtcatctttgacaaggccctccaggagcgtctcaacaaggacgttcagtcctaccgcctcatcaccgtcgccgtcctcgtcgatcgcctgaagatcaacggctctctcgcccgcaaggccctgaacgacctcgaggctcagggtaccatcaagaaggttgttggccacaacacctgcaacatctacactcgcaccgttgcggatgcttagatgatgaattttggactgagtggctctgcatgatatcacggcgtatggaggactgctagcggtttggagcaggtagttcgatatcaaacacttgctacaattttttaccgctgaaaaaaaaaa

SEQ ID NO: 11198 - DNA, 895 bp, Triticum aestivum
  unsure (1)..(895): unsure at all n locations
  Clone ID: PAT_TA_11198
gcacgagggttcctttcctcgtccgctcgccgccgccgccgacctcctccgctcctcccttcgccgccgcgcctccctctccgtccacctcctaggcaggtgctgctatctggtaccactctcgccgattggacccacttctagcggcccgcccagctcgacaagtaggcaatgagcacagccgtggatgcttcagtgcctgttgccgagcaggaggatggtgctgtgaatatcttgggtgggaagaaagtcgcaggttgtatttgttctaggtggtcctggaagtggaaaaggtacacaatgtagcaatattgtggagcatttcggatttacacatcttagcgctggagagcaattcggcataaatcaagtctggttctgagaatggaaccatgattgacaagcattttaaaggaagggacaaaattgttccaactgagagaaccgtaaagatcttacaagaagcaatgcctcattgtgggattgccaaagtccccattgatccgtctcccaggtatcaaggttaccgtctgtcctccggggatggtgtaaaaaatatctcctgagtttgtgctattcttcgactgttctgaggaacgcatgctagggcggcgtctgggtcgcaatcagggaagagctgacgataacgttgagactatcaggaaaagattcanagtttttgaagaatcaagtttgcctgtagttcagtactatgactctaanggcaaggttaagaanattaatgctgcaaaaccaatcccttgagggggtttgaanatgtngaaaacanttttaatcccnanggccaaaaggcgcataaatgccccaatgcaaaatatgtgatccattaaaacggggacccanaanttccnaagggaaagggggngccncgggn

SEQ ID NO: 11199 - DNA, 661 bp, Triticum aestivum
  Clone ID: PAT_TA_11199
gctcctctcttcatctctcttcacctctgctcgtcggccctccccttcctgctccccgacgcccccgtgtgatggaccacgggttggcgctggacggaggaggaagcacgccggggatttgcatctggtggacgggaacagctgcaaccggcctggccgggagctgcaaccggtggacagaggagctgcgatgggtgggtgaccacgaccacgggcaggcaacggggtggatggccgtgccccgacaagtgctacaaccatggcaactagatgttcgaaccagcgcctgtttgtgctactacaggcgttttgatttgatggaaccatcatcgtccaattttcagttttttgctaccgccgtaatatgtatctgctggaaccatcaacattttttttgctaccatcatttttttgattttgttggaatcatgcccaatttactctttttgctaccaccataatattttttttgctggaagttttgttggtacaccgccaaaattttgcatttttgctaccacaggccgtttgatttgctggaacgagctccattttttgctacaacgggcatctttgattttttttcttcaacaaagtccatttttccaatttttgataccagcgttttcaagtttgctggaagcagcgcattttctttgct

SEQ ID NO: 11200 - DNA, 1182 bp, Triticum aestivum
  Clone ID: PAT_TA_11200
gttattagacgcatgttcgacaacatgtttgcttgctttgggcacacccattcgaccaatgtgactcgagcctcatcctcgaggtcagagtggagctcggttttcacccgtggtctgaggagccgcagcacaagctggagatcccaagatagccacgccgatgcgatcgccaggtgatgactgcatcacgcattgggggaatattacgacattagatgttggagagccgcatatgtttgcttccgtttgatgttctctatatataagtcagctgagagatgaagagaatttgtagagcgcaaattgcatgctgttttgtacatagaggagcacgaactacgagatgttgcagtggaaatgtcctccagtttgcgtattcaagatggccttcctgttgcattttggagtatcattcagcaagacaagttttgttcctgatagatgcaagcatctggacagtgagcgcttaaattgctggcagcactcaattgtttcttctaattccatcttgctcaatgcgacggggcttcgtccattgtaacctcgacttgggcggtgctccggggcggagctcagggtcatcaaggcggcgccgttcgtcgcagaggggagttattagacgcatgttcaacaacatgtttgcttgctttgggcgcacccattcgaccaatgtgactcgagcctcatcctcgaggtcggagtggagctcggcgtttcacccgtggtctgaggagccgcagcacaagctgggagatccccaagatagccagcgccgatgcgatcgccaggtgatgattgcatcacgcatcggggaatattaccggcattagatgttggagagccacgcaaatgtttgcttccgtttgatgttttctactatatataagtcagttgagagataaagaggatttgtagagcgcaaattgcatgctgtttggtacatagagagccgcagatagcgactcggcaatcccaaatgcacacaacaataacacatcacctgcacattggcagacaacaacaacacactgtgttcgctagccaccatctggctccaggcctgaatattgtgtgcctgcgctcccactgcttcccgggaatagagaatacagataatgttgcagattatatatcaatgagaatttttaattcttgcaaaaaaaaaaaaaaaaaaaaaaaaaa

SEQ ID NO: 11201 - DNA, 341 bp, Triticum aestivum
  unsure (1)..(341): unsure at all n locations
  Clone ID: PAT_TA_11201
gcggattcgtggccgcgcccccgccggtggccggggcgtaccaccctcctcccgccgccggtggccactactactgatcagctaggcagctcgatcgctggctagatgggcacatgcgtcgcgtctgtgtgatgtgatctcgatagctaataagcctctactttgtactgtttgtgtaatgacttaccaacgcgtgctttttaattttgcacttggtgttgagacgagaactctgtatgtgtgcatagatggatgcgtgcgaccttgttggttgcttttcccctttgcgcggtgtcccgcgnaggtgtctgaatctaagagccgtatcttcaaaaaaaaaa

SEQ ID NO: 11202 - DNA, 481 bp, Triticum aestivum
  Clone ID: PAT_TA_11202
gattcactgcagcggcagggcgaggcaatattgctcacggtcggcggcgaggccgtatccttgcaccacggcggcaagcctctggagctcagatgggaggatctggcattccgcggatggtcgaccgcggggtgaagatggaggacgacggggagccatgggcaaagattacgtctgtcgtctattggcgcaaaaagtcaggaccatgagatgccagatgtggtgggtgcatgccgcggcacgaggtagatcacaccttgcttgcaagaaagaggtcctggagcagagtctaaaggagaaagaggtcctggagcagagtctttggtttagttgcaatcatgtttgcaatggctgggaggtcctgatgcatgaatgagcaatgttgaagctcttcttttggtgaactcagtgtgctgtagtagctactttgtatgtgtactgaatgaaaatggcaatacaatgaagcttctgaaaaaaaaaa

SEQ ID NO: 11203 - DNA, 696 bp, Triticum aestivum
  unsure (1)..(696): unsure at all n locations
  Clone ID: PAT_TA_11203
gcgcctgtgcatatataactcctcacttcccgaacctgcagaccctcccttcaacgcaccctttctatcttcaatcgaaactgccgatccagtccatccgctcgactccatcgacagcttaccccacttctataaccaccttaacaccacacaaactagctaccgcaatggcttccactactgccgagggcgtcaagctcatcagcattaccacctccgatggtgtcgagatgaaggtcgagcgccctgtcgctgagcgctccatcctcatcaagaacttgctcgaggatctcggtggtgaatccgaggagtctatccccatccccaacgtaaacgaggcagtcatgaagaaggttgtcgagtggtgtggccaccacaagaacgacttcacccccgaggaggaggagcagatccgccgcgagaacgagtgggctgaggaccgctaaaatatgcgccttctcttgcttgacctctctctgtacgtctgtatcgcataggttcacggaccgtggatatattgatgggtttagtctccggcgtagcggagttcatgggtatgattattttgcaagcgcatgatgctgcagctgtccctggtgcaggactagtgggcgccagcaggttacgaacatcacggggctgactgtacggtgcaatcgatacgtcattncaacccatgcaggagcccaacaaaaa

SEQ ID NO: 11204 - DNA, 874 bp, Triticum aestivum
  unsure (1)..(874): unsure at all n locations
  Clone ID: PAT_TA_11204
gctcccgagcgcctccgcgtcgctcctacctccagcgccggcgtcgccgggtgaagctcgatcccgagctgcgcgtccccctctgaaccgctcgttggtcatcggagcccaccgccatggcagcccaggaagctccagttcagccgccatctacggtggagccaagctcgtccccctcccccccccccctgccggtgctcccccccaccggatctgcgccgcccctcctcggatctgtccatccatgccgctacgagccccgtctgccatcgcgtccttcacatgcctcctgcaccgccgcggaggagcagcgcctcgtccagttcgtccgttatcaagactttggagtgatgtatgcatcagatataagagccgatgagtgcgctgtcgggatagctcagatgaccgtcaaagaggggcgccagctttcgatagttgctgaagcggacgagctcgattcttctaatggaagcactgagcagcacgtctcgacagttctagatgcagagcatgggtcgaaatcatggactccaaatcttattgacgtggaaagggaaaaccgcggctgggttcgacggcaccagttcagtacacgttggaagaaggatttggagagaccgaccccatgtgttcaacgaaatggggtgtggggttctgtgcggggtttcccggtatggcgtgcgcggtcgcaagtcggcagctgtgagtgtaggtgtcccggcccgcgccgcccctcgcaacggaagcgtgaaatgatgtcatggaatctcacaattagcctgttgcaattcaagatcagagaagtgatagtatgtatctttgtaanaataataaaaagaattcgctcagcgtattatgtgtcttttgtcactcg

SEQ ID NO: 11205 - DNA, 673 bp, Triticum aestivum
  unsure (1)..(673): unsure at all n locations
  Clone ID: PAT_TA_11205
tggagngtagccgatcttctgcttaggtttggccctggtggaggatgccgtcatgaaccggggaatcacgtcgggcacccagaagatggggctagccaacggtgacgtcgtcaggacccagagcatggacgcgcgcaacccgagcttgcggtcggaaacgaggagcagctatgaaatcaacagcagtgcggcggccacgtgctgcacgccgtggagtggcttggctggagtagccgcggcggctgcgagcccctgcatgcgagctgatcagctgcatgcaaattattccgatcaatgcatccgatacatgcaaaatcagcggtaaataagccctaaattaacaggtctagcctttccctcgaaatcagcggtaaatcagtccaccatgcatgcaaagttaaaaaaagggaggcagaaactagggaacgtgggagcgtggatgtgaatgaattgacaccattattgatgctaatagagaggttttctcgaaggtcaacacgtatcggtgtagaaaattgggcgcgtgaattggcttcaaccgattctatccagtgttttaaatagcggactatactaaatagcggcggatatctaaatcagctatagcagccaattttatacatgaggtcatttaacggcacctgattgaaaaggctatagcgaacagggtcaa

SEQ ID NO: 11206 - DNA, 480 bp, Triticum aestivum
  Clone ID: PAT_TA_11206
gcggtggcggcgttctacacggtggacccggagcgggaggtggagccggcgccggagctggtgagcgaggagaggcccaggcggtacgagaagaccggagagggaggtggagccggcgccgggcctggtgagcgaggagaggccgaggcggtacgagaagaccaagaggagcggcgactacgtcagggagctgctggagagcttggcgcgaggggagcgggccatcgacaaggtgaaggtcgtctgatcgagcagctttgatccacggttcgctgcatgcatgcgcgcgcggtgggcatggtggctagttgacgtgcactgtgcacactacttactttacttttttttaggggcacgctttacgtacggtaaaatatatgggtctggcaataagctactccagtagccggttcaaaaatacgagtagtaattaagctagtcgcctcgaaaataaatatccttttcgccgcaaaaaaaaaa

SEQ ID NO: 11207 - DNA, 660 bp, Triticum aestivum
  Clone ID: PAT_TA_11207
gatcgacgagcacgccggcgaagagagtccccagcgcgcacccctcgcccgttccggatggctgagcaattctacacagtggcatctgacagtgaaaccaccggggacgacaaagcaccacaatcattccctgatgttgctatcggcattgatattggcacctcaagatgcagtggggcaatttggaatggtcatcaagtggagctgatgaaaaacacccgtagccagaaagggatgaggtcatatgtcatgttcaaagatgacaccctttcagcgggtgttactggaggagcaaccaaggagcacgcacacgaggaaagagatatcttgtcaggaagtgcaatatttaacatgaagcgtttaatcgggagaatggacacagatgaagtggttcaagctagcaagactctccctttccttgtgcagacactgggcattggtgtgaggccatttattgccgctctggtcaacaatatgtggcgctccacaactcctgaggaagttcttgccatctttcttcttgaattgaaggccctggtggaaatgcatctcaagcatccagtgaggaatgctgttctaaccatcccagttgcattcagtcgcttccagcagaccaggatcgagagagcatgtgcaatggctggactgcatgtgctgagg

SEQ ID NO: 11208 - DNA, 656 bp, Triticum aestivum
  Clone ID: PAT_TA_11208
ggccgccctgggcatgctctaccgcctcgacgggatccagggaggggaccccatgatccgggaggggaagcacgccgtgagccgggagctcggcaggatactggagttcgttgacaaggtgctcctcaaagagcaggaggagatgggcatggatggcgcattcgacgattatcctgaaggttgtcatgggatgaatcgcccaactgtgaacaggaaggtaggtttccgcggtaatgaggacaacaccgaggctgatgagagctctgagagctcgagttctaccgaggctgctgagacgaaggctgcaaacagcaagaagagtgccaatggcaagcctgggcttgcagccccagtgcctgtacacatggagtcaaggagaactggaggggaaatgtgataactcggtcttgcatcttgtaatgttacctcttgtttagaatcatggggattgtcttgctcttacattaccatggttcttcttccgaaccgatgtttcttgaaattagattggagcctgctagatggtagagtttgtgccgcaactacgatgtttagactgttgtattgcctctctgttacatttgttactgcattgtactactggtagttttgaacattgagaatctagcctggatcattttgtcgcaaaaaaaaaa

SEQ ID NO: 11209 - DNA, 1573 bp, Triticum aestivum
  unsure (1)..(1573): unsure at all n locations
  Clone ID: PAT_TA_11209
cccattcgtccgccggaagcggcggcggggacagcacaggagaggaaagaagccaagaggcggcgccgccgatccacccagcccgagagcaccttggccgacggcatggcgctgctgatggagcccgggtcggagcccctgacggagggcgagaaggccgacctggacgccatcgccgccatcaaggagtcggcggcgcgcgagtacagggaggagggcaaccagttcgtcaagaagggccggaagcactaccccgacgccgtcgactgctacaccaaggccatcgcccagatgggcgccctctccccgccgaaccccgacgcctccgtcctcttcgccaaccgcgcgcacgtcaacctcctcctcggcaaccaccgccgcgccctcgacgacgccgagcaggccgtccgcctctccccctccaacctcaaggcgcactaccgggcggcgaaggccgcgcttgccctcgacctgctgccgcaggcggcgtccttctgccggcgggggctcgagcaggaccccgccaacgaggagctcaagaaattcctcgcgcaggtggaggcgcagcagcgcgagcgggatcttaaaagggccaaggttgcacaggccatatccgccgcaaaggatcttgctgctgctatagagaagagagggctgaggctggggaaggcagcatatcaggagctgaccggggtaaagaagccgaagctggatgagcagggcgtgctccactggccagttcttctgctctacccggaggtcatgtcgagcgactttattgaggattttccggagactgatatgttctcggatcaccttgatctcatgttctcagaaagttctccacctttgccatgggatgagaaccacgcttacacaagggacgctattgagttgtattgtcaggctggtgatggcacgccgttctccaaaagtgaaatgttaaaatatcttctggaaggcactgtcgactcagggtcactcacagaaagccttgatggggaagatggagaacatgatactgtgaagggcagcacagctatatcaccaagccagggtaagtggatcaaagtaagagaagggaaaactcttcaggaagcgctgcagcataaagactacatcatcccggcggtacctgtgttctttgtggtttcaaggaaatccgccttccattcgaagttcaaggctgggaattggtctttgccgtagagctgccgtgtagtagttcagttcaccatctctggaagaggccaagggtgctatgggtatatgatcaggaaagaggaagctggcaattgtcaattgccgtatggtcctagaaggttatactacttgagagaagatgagttgtgcttaattagcacttgtgtgtcttacaagttcttccaaccactgcttggttggttgatggctcaggattgcgtttctagagggagaagcaaccgaatatgcaacttttcatgtgtattttagcagtgggcatgactgaactttttgggatttggcatggtcatacttgcttctctgtatgcccagaacagtacnattggatgcgattatgttgttcaattca

SEQ ID NO: 11210 - DNA, 1252 bp, Triticum aestivum
  unsure (1)..(1252): unsure at all n locations
  Clone ID: PAT_TA_11210
aggaattcggcacgaggatctcttctttgttccngctacgtcaaatgtgttcgcatgaccggagctctcacagacaaggaaatcaatngacatatgtcaaggttctgagtcagatgtcatatttccgcagnatcgggtgggcgtgaccacatttttgtcttcccaagtggtgctggagctcacctgtttcgctcgtgggcaacttttctgaatcgatccatcatcctcactccagagggtgaccgtactgacaagcgaggtataagcgcatttaatacatggaaagacattattatcccggggaatgtggatgattctatggtgaaacctgatgctcgtgctgtccaaccaattccattgacgaaaaggaagtatttggcaaactttcttggtcgtgcccagggaaaagtaggccgtcttaaattggtggaactggcaaagcaatatcctgacaagctggagtctccagaactgaagttgtctgggcctgacaaattgggtagggttgattacttcaaacacctgaggaatgcaaagttttgcctagctcctcgtggggagtcttcgtggacacttcgcttttatgaatctttctttgtggaatgtgtgccagttcttttatcagatgaggttgagctccctttccagaatgtgattgactacaccgagatatcgataaagtggccatcgtccaagatcggtcctgaacttttccagtaccttgagtcgataccagaggaaaggatcgaggagatgatcgcccgtggacgtgaggtgagatgcatgtgggtgtacgccctggacacggagccctgctccgcgatgactgccatcatgtgggagctgcagaggaaggtgaggcggttccaccagtctgcagaaaccttctggcttcacaacaggtcgatcgtgaacagagatttggtggagttccggcagtggggaacacctgttccattaccatgactctccgtgtgtgtcgggttgattggccagattttgggttgttgtatggtggtagatgttcgaggtagggtgagcgacttttctttcgatctattcattttcgtcgtcacccttgaggggtggattccacttttttagagagttgtgtgtgcatactggctgagaagtgtgttctattgttgcattgacaaagttgtaacatttttgtccatttactttcgtgaggatcgcatggatcttgagaagaagctactagctgacacatgtgtgtatacaccaaaaaaaa

SEQ ID NO: 11211 - DNA, 1008 bp, Triticum aestivum
  Clone ID: PAT_TA_11211
cgacgcgtttcgcccacgcgtccgcgcgaacagcatcgactcggcggcggcgggcggcggcgaagcaggcggaggaagcgccggagagcacgcaatgccgcctaaatcggacagcgtcgaaggaatcgtcctcaacttcgtcaacgagcaaaataggccattgaattctcagaatgtggctgatgcactacagaagtttagtcttaagaagactgcagtgcaaaaaggactggatgcattggctgacagtggtcaaatatccttcaaggagtatggcaagcagaaaatctaccttgctcggcaagaccagttcgacattccaaatggggaggaacttgaggagatgaagaaagcaaatagcaaactacaggaagaactcgcagaacaaaagaaaattactagtgaggtcgaatctgagataaagggtctacagtcaaacttgacactggaagagattaggtcaaaggaggccagattacaaagtgaggtccaggaaatggaagaaaaattaaagaaattgcagagtggtgtgatccttggtgaaacctgaagacaagaagataattgaggagaccttctctgagaaagctaaccagtggagaaagcgaaagaggatgttcaaggagctatgggataacatcactgagaatagccccaaagaccagaaggaatttaaggaagaacttggtcttgagtatgatgaagatgtcgatgtgaacttccacccgtacagtgaaatgctggcgagtctcaacaaaaggagaaaagtttctcgctgaggatgtagaggggcatgggagtatctcagatcagatgtatgttatcagccaaacagctccatgattttgctagtttcttagtcagggtgttgtagtttgtccaaacagatggtctgctccgagaactctagctggtagcgtcagtagtagtttatttgaggtttgcaacatgttttgaaccagttgtgtaatataactttttccccatcttaaattatatcgaggagcc

SEQ ID NO: 11212 - DNA, 622 bp, Triticum aestivum
  Clone ID: PAT_TA_11212
ctgtcttcggaatacattctttgaaatcagtactctttcctggatatcaacgtttcgcctggacctttgaattccctcgtcaatacccattcagttttaagagctaggattttttgaactttcatcatgatgaagcttaccgttgccttcttggccgctctcgctgccgccgatgccgctgaggctcgcagccaccgccaggcccgtcgccaatacggtgccaccgactcctacggtggaggaaacagctacggctccaacagctacggtggtggcaacagctacggctccaacaacggcggatacggcgcccagccccctgctggatccagctctgccgtgcccgttgtcagctctgctactcccatcgtcagctctgccgtcccggtcgttagctctgctactcccgtagagacccccgaggcctccacctccgcaacccccgttgtctcctcggtcccatacgtccagacctcttccccagctttcgagacttccagcacccctgctgatgccacctacactccttccacctctgctggtggctacggagccgtcccccctgccggtggtgccagctccagctctcccgtccctgaggctgctaccagctctgctgcca

SEQ ID NO: 11213 - DNA, 1043 bp, Triticum aestivum
  unsure (1)..(1043): unsure at all n locations
  Clone ID: PAT_TA_11213
ggactgtcgatttaagcgtgacgagcccggcaagcacattgtggagcgcatcgagtacgatcccaaccgctctgctcacttggcgttggtggagaatgtggccaacaagaggaaaagctacattattgctgcggaaggcatgcgcgctggtgacactattgagtctttccgcgctggcattcccaaatcgctacttgcgagcatgggtggtgtggtggatcctggtatgctggcagcgaagaccgcgttccgtggaaactgcttgcccatgaagatggtgcctatgggaacacaggtgtacaacgtcggcagcacaaccaacaagggcgctgtgttctgccgaagtgcaggcactcacgccacagtcatcgcgaagaacgatgtcgacggcgtcattagagatgttactgtgcgcctgcagagtggtgaagtgcgcagagtcagcgcggaagcttgcgccactatcggtgtagccagcaaccccgcattggcagttcaggcagctcggaaaggctggtcgcagcagacatttgaacatcaggccaaccgtccgtggtcttgccatgaacgctgcagaccacgctcacggtggtggtagaggtaagagcaagggtaacgtcaaccctgtctctatctggggtacacccgccaaaggtggttacaagactcgccaaaagcgcaaccccaacaagcacgttgtccaggagagagtgcgcaaccaaggcaagcgcaggagcaccaactaagcccattgtggtgttgtcgtgctccactggcactttgtacattatgcatgcatcagacgatgcacattaccgagatatacctagatgtacaactatattcatttccactgctcgccgcatgtcaatgccaacttcgggagcatctctgcaaactagaaaggatctgcaagttctaagctgatgcacacaagccatgcatgtccggtgtgcggtgtgcgcagatcgtgtcgaaagcacgcactggctggcacgcacgaacccccgatcgcgaccncaggataacgcgattgcaatgaa

SEQ ID NO: 11214 - DNA, 566 bp, Triticum aestivum
  Clone ID: PAT_TA_11214
ggtcgatccacgccgtccaccgccgccccgacaccgcccggggctaccgccggtcgatctcgacgccgtaccaccgccgccccataccgccatgcctctacagcgccgcccgacgcagccatgcctctaaacgccgccgtgcctctatagcgccgctccacgccgtcctgccccttcagcgcagcccaacgtcgtcctgcatctccactgccggcccaacgccttcctgctctctctccgggtggccgcctctctccacggccacatccagcacagttgccgcctcctccctggcccgacctcccccatgtccaccacgaaagcacacgcagcggtggcggcgatttggatcggggcagcgtgcggctgggcaagggcatcgatgcggctgagggaaaggattactccggcggcggggaacggggagctcccggcggtgggaaacgagtagatgttccagtggacaaggcacctcatgctttattattctctggttctccgatttgctgtgtactgctgccagctagtctgattgtgagaagctttatggcagcgatatgaactaa

SEQ ID NO: 11215 - DNA, 1405 bp, Triticum aestivum
  unsure (1)..(1405): unsure at all n locations
  Clone ID: PAT_TA_11215
ggaattcggacgaggcggagttgtaccntcgccttcgcncgcttgagtgggacataaacaccctcaccgcactctcacggtgcctcctgctccagtgtcgcggcatcgacgctctatgtacggccctgcgtgtccgccgggccgacggggttctgtgcgcaccttggggccggtgcacgtgaccggcggggttctgtgcgcaacttgcggtgcaggtgacggtatacgcccgggatgctgacctggtcgaaggcgacaagactggcggggcggtggggaggccgccgctgcctacaaagcttcgtcagccccatctcgtggagttcaggacatgaacgacgacgtggatccatggaggtgggcaaggttatcgggttttctccgagcgccggcctggacaatggcgggctgaatggcggcggcggccggcagcgggcgtgatcgcaagacaacgcaggtccacgacggagccacagtatacagatcctttgtccaacctagcgtcgctgctcccctgcaatggacgtgtcgactgtcaagctgtgtcgcttgcggcgtccatgtgatcgtggccgcgagcagcccaggatcactgctcacggtgaggacgcttagcatcttgtgggaggaagatcgtctggccgtccgaagggtcggcaaggacggcgacgccgcagcagaggccgtgcctgagccttgaggtgaccgagagtgcgatgccacggaggtccgcggacaagagcgacacgccgcccccagctggaccatagtgctcgcactcctactccacgcgcgccttcttcccacgatgcgtccaaacggattaagatcggccgccgagacccgagagctgggaagcggcgcctcgaggttcggcgcatcctctnctnctatgtgcttctncccagtcgtcaccgggcgagctgtattccttcatcttctcacgacgtgcacctccttctctttcttgatcttgctcaacatactacccgcgcacttcttcgatcgtgtacgacggccacagtggcgcccaggtcatcgaataccgccaggacaggctacacaccccgctcgccgaggagctgtgtgccatagaggaccgcgtcagcgcctccgatgatgagctctctcgactccaagaagcagtgggagaagacgttattggacttattggactgtttctgccgtgtcgacgctgaggccgaggcgcccgtgttcttgacctcgagctcgcccaacccgctggcgcctgggacccatccaacccggctctagctcacgcccgccgtgtcgacctcttgcatgccaggacgctggctctccgtcaaagatgacgcgaggagaccttgaggttgcagagatcgtcgtatacgaacccagtcgtatacatacgaaccctcatgtc

SEQ ID NO: 11216 - DNA, 580 bp, Triticum aestivum
  Clone ID: PAT_TA_11216
ccctgcctgctgctgagttcagcgcatttgcagagatttgggtgcattgtccgagtcggtttaatcgagtgcaccaaggagggcgtcaagtttgcatgctctggcgacattggttcgggttccgtcatcctcaagcaagaccctagcctcgaaaaggagtctgaggctgtcctgattgagatgaacgagcccgtctctcttaccttctcgctcaagtacctgaccaacttctgcaaggccagtggcctgtctgactcagtcaaactttgcctttccagtgaggtgcctctgctggtcgagtacgctctccaggatcagagctacctgaggttctacctcgcacccaagattggcgacgaagagtaaacgcatcatgatttcattgacacacgagcggcatgttttcaggatagatgtgggggatttgcggcgcaatggctttgatatgcatcgagcgtctgttaggttcatgattctggtgtgcgacattggcgagtaggcggtcccgcgtggtgttccgcgccctaggcacaaaaggaaagtcactgccccaccaacgcttcacgtcataccgcgtgga

SEQ ID NO: 11217 - DNA, 418 bp, Triticum aestivum
  unsure (1)..(418): unsure at all n locations
  Clone ID: PAT_TA_11217
ggaattcggacgaggccgaggngaacctgtcgccggagctgccgcagggatgaagaggccgagctcgaacttgccctgtgccgagaccagcgtgtcgttgccccgcagcggacgcggcgccgagagtgtcgccgctgcacccactgcaggtgcaggggcgaagcacaaggcaagggccatgaaagtggctgtgatcangtggcatggtgatggtggctgtgatcacctgccataaattatgagtgggggtgcagtcgaattttgaggcaggtgaacgacggagacgggtggcaagaaaaaccatcttctcgccagcgtcacatgcgtgatgaccccggcgtattttactgcttgttaaattctactgctcgtgcattcgcctatgaaaaaaggtaagggctttgaattaaaaaaaaaa

SEQ ID NO: 11218 - DNA, 509 bp, Triticum aestivum
  Clone ID: PAT_TA_11218
gaggaattcggacgaggccgcccggcgttctgcgccgtcggcatgctggcgaacaacgatttccaggcaatcccaggagaagcccggcagtccgaactcggccaggcgggctactacctgctgctggtcggcacagccgccgtgtaccagtgcttctgcctcggcataatcggcgccatctactatggctcggcgctgctcgccggagtcatcatcaccgtgctcctcccggtgaccgaggtcctggccgtcgtcttcttccatgaacccttcagcggcaccaagggcgtcgccctcgggctgtcgctctggggcctcgcctcctatttctacggcgaggtgcggaacaaggccccggaggcagagcaccggacaagtcctgtgtgtggatcgtgactgcgaaaattagtgggaacagcacgtgcttcttttgagaaagaagggagaatgtatgaaccgaaggccatggatggcagtggcatggcacacataatattcgcttgaaaact

SEQ ID NO: 11219 - DNA, 1160 bp, Triticum aestivum
  unsure (1)..(1160): unsure at all n locations
  Clone ID: PAT_TA_11219
cgggctgaggaattcggacgaggctccttctccttgacccctcntcctctaaagtactcgattacatcgtcaccactttcacaaacatacgtttaccatgtcgcaacgagcagcacttctcatcggcaaactgtcacatgcccagaaagaatggcagcaatgttcagaggtagcctcgaagctgcacgagtaccccgatggcaaccgcgaagacttcctctcaaagtgcaaaagtggtgaatttgacggtatatacgccctttaccgaagcaacgactcgaatccgattaccggagacttcaacgcggaattgcttgacgctctgcctaagagtttgaagtatgtctgccacaacggcgcgggatacaacaacatcgacgtcgcagcctgtacaaagagaggaatatcggtatcaagcacaccgatagcggttaacgacgcgactgcagatgttgccatctggctcatgctgggcgcgctccgaaacatcaagcagtcctacatggcagtaaacaatggcaagtggcgcggcaacttctccctcggtcacgaccccaagaacaagacactcggtatcctaggcatgggtggtatcggctcagcggtcgcacatcgcgcaaaagcattcggcatgaagatacaataccacaaccgtcaccagctaccggctagcgaagagaatggtgcaaagtacgtgactttcgatgagctgctcaagacatccgatgtcctcagcctgaacttggcgctcaacccttcgaccacacacatcattggcaaggaacaattcaacacgatgaaggatggtgtaatcattgtgaacactgcacgaggtgcattgattgacgaggcagctttggtcgacgcgctgaagagcggcaaggtctggacatgtggactggatgtgtttgaggaggagccgaagattcatccagggctactggaatgcgagaacgcggtactgctgcctcatgttggaacggctacatacgaaacacagcgcgacatggagatactggttttggacaacttgaagtcggctatcaagagcgacaagctgttgacgcaagtacctgaacagaagggcaaagcgaacctatagttgatgattgacggatcctacttcacgattagagacacttgtattnccaacccaagta

SEQ ID NO: 11220 - DNA, 544 bp, Triticum aestivum
  unsure (1)..(544): unsure at all n locations
  Clone ID: PAT_TA_11220
aggaattcggncgagggatnngaagaagagcacggttcccctctttcctgagagaggatcgacgatgcatccaagaagcgcggccacggtgcggctctgccttgtatgccttgctctcctgctgctgacccgagatgtctgctccaggaatctcgtaggggcggtggtgcagaaggagaggcacaagcagagccatggcggccacggcggagccaccccggaaccgcccgttgaggaaggcagcgacgcaggtgccaagaggggacagctgcagcgtgatctgacgagatgggaggagatccacacggactacatctacacccaagacgtcaaacacccgtgacactatgagtcgctcgtgtttagtagtagtactagctccctggggtcgtttggacaagacggattagtctgggatttgtccttcagttttgggcctttgagccaaatcacaaactaatccctccgctgttagaagcatgtagtcagtggcgcactgtataattacttcagtctagctttggcacaccctttaaaaaaaaaa

SEQ ID NO: 11221 - DNA, 483 bp, Triticum aestivum
  Clone ID: PAT_TA_11221
gaggggacaccaatgtgatatttctgtcaatgtatactggccgttccttcatgatccaactcgagtcgatgcaactcagaagtatttctggaacacatcacgaccacttttatccctacacaaatttctttactgcaggcagagggattggtgatggaaatgatggggttaaaattttgtacaatacatgagacgatcttcctgaaggatctgctgatgtgctgtgtcgactgaaaaggatccctctgcgcttttgaagtgccaacatgaagaatttcctatgtttcgtgaccctgatactattgatgtggtaaagggtgaatatggccatcttgcaactgtcaaccatggcgtgtgctttaaaagtctagtttcggttgaatccaccataataacggtttatccttgtcaaatttgaggaccagccaaaatctgagttcactttgcttaacgcggtaaacctgaacatttccaaaaaaaaaa

SEQ ID NO: 11222 - DNA, 626 bp, Triticum aestivum
  Clone ID: PAT_TA_11222
ttcggcacgagggcagcttcagcaagagcagcaccagaggcagcttcagcaggagcaacaccaaaggcagctgcagcagcgccaagcccagctgctgcaacagcaacagcagcaacaacagcagctgattcttgaacaaatgttgcagcagcagttgcagagttcaaacttcggacaagctaacatggtcgatcaagtgttactccgggaacagttattgaatgacctgcatcatcaaccccatcattttcaaaggcagcatgatgcagctattgaacaactcattcaagcaaaatttgggcatggccatcatagggagcaacacaatgatatgttagatgttctctcacgttcaaaccagaggcaggcgcttcctttggagcagcaaattcttttagggctgcaccatgatcagctccaaacacaacaattggcccatgctataagacaacatgcgggcagggaggaagaacggcatttaagtgggggctggccaatggatgatcctagcccatttatccgcacaggaactagtccaaatcaaagccatgcctccagacttggtcaatttgatcttctgcagtcccttcagaggtcgtcatctgtggagcatcatgaccatctcg

SEQ ID NO: 11223 - DNA, 1004 bp, Triticum aestivum
  Clone ID: PAT_TA_11223
gcggcccccgccgccgcgtcgccgccgcggcggcccctcccccgtccccgccgcccctcgcgggccgccccgccggggctgcgctggcggcgccgcggcccctgcggctgccgctgctccacccccccccacggtgcggcccgccggcgcagccctgctgccgcctcggcccctacggctgcgccatgcccccccgcctcccggtttccgcagctcctcgttgtcccgcccccggtacagtccgctgttgcaggccgtcctgctatgccctccctttccctggtcgccgggtggtcaagagtgtcacaatctctggatgcagttggaatgttgagctactctcaagtaggcagctgacatgcacattttggattttaatctactattgtctgcacaaggttcacaaacatccttcatcccaaacagaggccaatccagactctgagtggtgggcagaaacagagagttgccattgctggtgctttagctgaagcatccaaagtactactgctggatgagctgaccacattcttggacgaatatgatcagatgggcgtggtcaaggcggtgaggaactctgtgactgctagtggggaggttgcggcactgtgggtgactcatcggctggaagaactcagatacgcagatggcgctatttacatggaagatggccggacgattattcaaggcgacgtctccagtatatccaggtttataaagaggaagcaagcacgctacttcggtcattttgagctctgatcctcgggagtcccaagctgcaggcagaattatctgctcttgtgtagtacgagtacatcactacatcatggtactagaaaacagtttcttctctagggcggtttgtatgtttgcaactgggaagttagggattctgtcgctctcgcctctatcgctgccgaaacattggtttggcgaatttagtagctgtcgattttcggttcatacattgtccttgttcacgcttttaatgttaagagtgtgcc

SEQ ID NO: 11224 - DNA, 520 bp, Triticum aestivum
  Clone ID: PAT_TA_11224
cggcacgagggattgatttcaatccttggggtggctatacattgccgcttatgtttacatgggaggagcttgaggatgagaagagaggagaggacaagctggagtttagagtggtaatggagcaaggtgcagtgaggccaggattaatgacagcagtgccgtatgatatgatggattggggagaagggagcggctgggatgtttttctgaagaaggctgacaatgaactgaatagacagatggcctcattagctatggattcgtaattgacatctggaacaaagcagcgcttgaggactccagtagttgaacaacttcaaccgtcgcctgtttgtaatgtttcacctgtcaaacgctagaagtaacagccttctttagattgtgatgcaaacctcacggcaatcggccgtttccccccatgacttttgcaatgctagattgctagtatgggagtaccgcatgctgcttcatctcagttttatgatatttacagaaaaatatttgtagtggaaaaaaaaaa

SEQ ID NO: 11225 - DNA, 187 bp, Triticum aestivum
  Clone ID: PAT_TA_11225
gaggaagggagtgatgtgccctattactgaactacaatatgtacacaggaaagggttctgttactgaaagatgctgctgcctgctgctgttacttgttcactagatacctgtgttgtaactcaaactccgccagtgcgcacaaggggatacggttggtaccgtgccctgtgttaaacaaaaaaaaaa

SEQ ID NO: 11226 - DNA, 943 bp, Triticum aestivum
  Clone ID: PAT_TA_11226
gaggaatgcggcacgaggaacattatatctcgatcagatgagacggtgaaaagattatgaaaacattgcgaaaatatagaccgttataagaaccgttgttggcgtcgaaaattcagtatggccagaacaaagggaagctgtacaatgaggaatgcgaccgttttctgttgtgcatggtgcacaaacttggctatggaaactgggaagaactgaagtcggccttccgcatgtctcccttgttccgttttgattggtttgtgaagtccagaacgtcgcatgagttggctagaaggtgcgacactctcattcgtctagtggagaaggagaaccaagagtgtgatgagcgtgatagacaggccaggaaagataagaagaacatgacaccaacaaagcgtccttcgtcaagtagtccagcaatggactctcccatgcagaccccctccaagagggggcggagggacggcagtgcacccttgggaaagagaaggcggcgatgatctagtgttccctgaggaacaaactcatttggcggttgacaaccgaagggaagccccagatgtacctgtttatctcatccagtgtgtttgcgcctagttatagtagctcaaaacgtattagaggtcactctcaagtctgaaccagtcgaaatccgaagtctgaactcctatcttaaatagattccatgtgacatggtgaacttatgtgtcggttaatatactgttcctgtgttcgcggatcaattaggttgttatcgaaccgattaatgcttttgattgagcatgagaaagttacattccgaaaacagaatatgcttttttgcttgtgtagccttgtctccgtctgcgtggacgtcggtgtccgccggggtgctccccccgtgtgcccggatcaattaggttgttatcgaaccgattgatgcttttgattgagcatgagaaagtta

SEQ ID NO: 11227 - DNA, 822 bp, Triticum aestivum
  unsure (1)..(822): unsure at all n locations
  Clone ID: PAT_TA_11227
gaggaattcggcacgagggttacctcgctgagttcgcctccggcgacaagcgcaagactgccgccactgctgcccacgaggcctacaagagcgctaccgacgttgcccagaccgagcttacccccactcatcccattcgccttggtcttgcccttaacttctcagtcttctactacgagatcctgaactctcccgaccgcgcatgccacctcgccaagcaggccttcgacgacgccattgccgagctcgactcgctgtcagaggagtcttaccgcgacagcactctcatcatgcagctcctccgcgacaaccttaccctctggacttcctccgatggcaacgagccagagcccgccgccgcctccgacgcccccaaggccgaggagtccaagactgccgagtctgtcgaggagcccaaggccgaggcctcgtaaagagaccgctcgagtatcacgaaatccacttgaccatttcacgtcttttttcgcacagacgccctctggcttggagcgcgacgtctggtctggagcactactgagcgtcgaaatgaattgattccccaaaatgcgttgcagcttgacgaataaactagccgatttgacatttctctacccttttccctatactctccacagaaactcttcttttcatttcggctcactcagtactcgcgaaacaaacttcgtgctccttgccatgatgatcgccgctccctttgactgcgctgaaataccccttttggttttttttactgtattccctttnacgtcattccttatacctccccgtcagttagggaaagcgctcatcatgcgccaaatc

SEQ ID NO: 11228 - DNA, 1138 bp, Triticum aestivum
  unsure (1)..(1138): unsure at all n locations
  Clone ID: PAT_TA_11228
gctcgctttncattcgctcgcttgcgtttgccttcgttaccagtcttgataatcgtcggtcgttcagtactacaccgtgcaatacctataatcaccgttcgatatccgtaatctactacagccaacgccacccacaatacaccacacagtaccctacttcaaaatgtctttgaagttcctatccctcgcccttgcggctgtcgcaactgcgtctccttttgactctatgtcaaaggccactagcgacgacccttacgaggcatgccaaccgcaaggagcgaccggcacaaccccaccagcagttggcacggagctcagctctctctacaccgatatcctctcctctatccagggtatcactttcgacaagcgatctgttcatggccgtgcggacggcttcggttgccgccaaagcttggactgtgtcaatgttcagaacatcaacatccccatgtgctatgacaagttcaccacaaacttccaattcccagacggctctttcggaaacgttgctgctggaacatacagctccggaggtactgaagtcaacctcgtcagcggagactacaccaaggatggccagagtgccaacatttactccaacaacgaggctgagaagccaaacacgtcgaccctttcaattcctgcccaatacaccggtactggtgttggaggagcgatcccagtcacagaactcggatccatcatcgtctataccaccactattccagccgtaacatactctgcacccaccactgttgcggaaaccgttgaggtagccactgtcagcggagtgaaggtctctaccaccgttcccgctaccaccatcacccaggccacaacgatcgccgcaaagaccaacgtcgtcactcaaacaaacactgcctcagctgcacctcaaagcaccggagcagctggacagatgtctgttgacacaacaaagtccttcggaatgtcggttgtcggtgccttgctatatgcgctcttgtaagcagctgatttattggaagctatgctcgtcgcagtgtactagatggacggattgatcttaggagttatattcaaggcattcctgaatggatgatacccgctggagctttagcatacgcatgtttatacgtactgggcaatccagtac

SEQ ID NO: 11229 - DNA, 450 bp, Triticum aestivum
  Clone ID: PAT_TA_11229
gcagccccgcaccctcggatcgccatgtctggagcccaagggcgcacagcccaagggagctggcaccgcgcccgccgaccgcgtacaggtcggcggcagctcccgacggcgcggaggagtgccagcagcagcagtcgcgcaaggacagagctacgctcgagcaaggacgagcatgggttaccggtgaagatgctcgaggggcggggccgccacgccgctgggcggcccggcccgcggcgccgcgccggcccgcggcacgcccggccgggccggcgcggcccccgccccggccgagccgctctgctaggcgtgtcgtggcgtgccgtgcgctgcgctgctcttgtagcgtagcctgtgctgtgctcgtcgcgtggtgtggtacttccaaggaggggaataagatacccagaccagaataaaaagaaaaaggattgaattccaaaaaaaaaa

SEQ ID NO: 11230 - DNA, 697 bp, Triticum aestivum
  unsure (1)..(697): unsure at all n locations
  Clone ID: PAT_TA_11230
agcgccctgctccggctccggcaccaaagcgcaaggcccccgccgccgcgatccctgccaccgacgcggctggcaagaagaaaccccgcgtcgacgagcgcaagacgaccaaccgacgcgcctccccaacaaccgtcgacgcccccaagagcggcgacaagttctccaagtttagggaggcgtgggagttcgagaccgcgtacaccaagctcgtggtcaccatgagacgcaccaagaaagcactagaagagctcaagccaaagccagagaagaaatcgccggaagaggtcaagccgtcgtcgccgtgccaccgcatgcggccgcgcacgttcgaggagctctaccccgggcgtgagtgccgggaggttctccgggagatgtacggcgacaggttgggaccgatgcgggaggcgctcgaggacggcgcgcgcaccgagctggctctgaggacgatcaagcgcaggctggagaagctggagcaggcggccgtgaagatgacgagggagcggcgggatcccgcccgcgttgtgcgcccgatgtgcgagcttgttgtagatcgggtggcggttcttcggggtcgcgcggaagcggaaagtgcagcggcgctcaatcgtgatggcccgtgcgagagcccggccggcatgtccgagaccaagattgccggtgagcagtgggcanattagcttccgaaaatcga

SEQ ID NO: 11231 - DNA, 621 bp, Triticum aestivum
  Clone ID: PAT_TA_11231
gctcttcctcccccacctcgcgccgccacccttgcctcctcccgtcccgtcggacgtcttccttccctcccgcaggccgtcctccacctcttgcatctcatccgcatcgaaccctagaaaccgatgaggaggccgagccgccatccgccgccggccgtcgacacctcctgttcgaccacatagagggagcaccagactatcgtccttgcgttcgtgctcctccaggaagaagacgacccaaggagacgaatgagttgggctcggatgttgctggccgccggttgtctgcaacaggaatgctcccctgccacgactttctcacaggtccttcctttcgtatcttcaagttgccgagttgaagtatcacccgggtttctgtgacgatcttctgaggtggaaatgctctgtttctacaaactgcaggcgcaatctcgtattgtattgttagtggtgattcaggctaatttttctctttatgccctgatatttctttttaagttagacattacaatcttagaagccttccatgacaaagatagccctttgtaaattttgcttctacaagtatacttttgatggccatgccccctgattgtcagtatatatttggcttaaaaaaaa

SEQ ID NO: 11232 - DNA, 1006 bp, Triticum aestivum
  Clone ID: PAT_TA_11232
ccgccaggcggtcgcattgtcacattccacaaggcaacaaatcacgacccacgagatcgcaccatccacgagcgcttgcgcacactccgcccaccctcactccgcggaacagcgcggcctcgtgcgccctcgcgctcgcgactcgatgcttcttggcgcttggctgcattgccgtggcggcaatgtcgctcgccgtggcgccggcggacggcgcgatcctcccttggttcgggagcggaggcggccgtcgtggatcccgcgatgacgcggtggcatcgccgctccaggacgtagcccttctcgccgacccgttccggatcctggagcacgtcccgttcggcttcgaccgcgacgacgtggccatggtgtccatggcgcgcgtggactggcgcgagacctccgactcccacgagatcgtcgtcgacgtgccagggcatgaggaaggaggacctaaaggtggagatcgaggagaaccgggtgctgcggatcagcggcgagcggcggcgggaggtggaagaacggaagggcgaccactggcaccgggaggagcgctcctacggcaagttctggcgccagatgcgcctccccgacaacgcggacctcgattccatcgccgcgagccttgacgccggcgtcctcaccgtgcgcttccggaagctggcgcccgaacagatcaagggcccgcgcgtggttggcatcgccgggggcgacgatagctccgctgccaagaagaccatcggcgacgccggtgccgctggaggcgaagagcgccagaccaagaaagtcgagctctgaatcctgaactctgcactgcgcagagtaccaatgttcttaccactttctagtacgcgcttgtcagttccgcttctcagtacagcgtgtggaaaaatgtgatgtactactatttttgaatgtaaaagcgacactgagtggtcgattcactctcgcatgtaagagaagttcaccgaggaaataagaaaccacagatcaaaaaaaaaaaaaaaaa

SEQ ID NO: 11233 - DNA, 629 bp, Triticum aestivum
  Clone ID: PAT_TA_11233
cggaagatctacacagattcaggtcgaggttcagacttcggagatggtgttcaacgtcgtcgcggctgcggtgatcgtcggcctgggcgctgtgggcgcctatttcggccggcccgcggcgggcgccgccggcggctggccggcggcgcccggcgccgccggcttcctcatcgcgcccgccgcggccgccgccctccccccccgcgccgccctgcccccccaccccccgggcgccgccccgcccccccccgccgctgccgccgcggcggccgcggcccccctggctgccttgccaagttaggcgcactacgctggggccctgcctggggcggtgcgcggggtagggactgtgctgtggggcgtgggcacggaccgttggtacctgggcacgtatgtattgcccaagctaagctagtgtcaatgaagttcaggagtagggactgtaccttttgcacctgggcacgtatgtattgcccaagctaagctagtgtcaaccgggctctgcgtcttcgtccggccctgggccgtccgtgtctgctcgaccatgttactagcgtgtcaacagtctgaagctactctctgtaatgtaaagtagtaaccgctatgtgtaagtgtgcatgcatgtatct

SEQ ID NO: 11234 - DNA, 1452 bp, Triticum aestivum
  unsure (1)..(1452): unsure at all n locations
  Clone ID: PAT_TA_11234
ccgccacgcggcggctgtgccccccccccagcccgcgctttacaagtctattcaacaactgagatctattggtggctgcggcgcctaaattttgttccggggatcttgattttggtagggtaggttatgacatagtaagcttctatgcacagggcaatgatgaggcagtcattattcatgatgccctcgatttcggacattgtcgcctgtcccttgcggtgccgaaggaaggtgtttttgatagcatcaatactctagacgatttgttacatatgcctcagtgaactgatgaaaggccaatgccggtcgggacagcctttggatatgtaggtatagagcgtttgaaagaaaatcggttcaagcatgcttcgttgtgagctggtgatggtcgctctcgagccatatcttgatataggtatggttgacgctattgtggatcttgtgagtagtggaacgactttgcgtgagaataatttgaaggaaattgaaggtggagtaattttggaaagccaggcagcttgggttgcccctttgatgtccctccactcgatagggttgggggtccgggatgttgggtgtatgttgtttgtgtgtgccggatcttgcaccttttgttggtgcggccctgaataattggggctacctgatatgaggacaataatgaatcccattggggttctcagccaaacatcattatgtggattacagggcccaactataagtccagtgtattgcacacaggatggcaatgttgcggtggactactatgctattaatgtggtagttccccaaaaatcactctacaagtctattcaacagctgagatctattggcggcagcggagtcttggtgtccgaaactgacctacatatttgacgaaggagactcctaggtggcgccaaacttctgtccgggagctggggaatgttgagacttgctgcaaggtccggccaccccctccctcctaagaatgggccgtctcaagtngagcattttgaactttatgctccgctggttagtgtgttacatccatacacagaagcgaccccgagtttgaaaaaaaatacccgttatgccaaagtgaactcccccatgttggattgccctgaggaaatttcgatatctagcgcccggatatttgtgctcagctaacgtattcccttggacaggcagtggttggtttatcccttttatgtacccgccagccgataganttgggggtccgggatgttgggtgnatgntgnttgtgtgtgccggatnttgcaccttttgttggcgcnggccctgaataattggggctacctgatatgatgataataatgaatcccattgtggtttggtctcggttgcgtggcgagtctattcagattcccatctgaaatgctcgtgtctcgctgttctcaccccattcaaaaaaaaaaaaaaaaaaaaaaaactcgttcggcagaggc

SEQ ID NO: 11235 - DNA, 461 bp, Triticum aestivum
  Clone ID: PAT_TA_11235
ggcgaactggagtcgagggccgccttccctacgcgcctcccgagccgttcctcagatcgagcgccgcggcgactctcccaggccgcaccatcatcgaaaccgcagccgctccgccgaagtcaatggagacctgctcctacagcggccctaaagctttgaagctctagtttggtcttcttctggtttgacaactttgtgtgtgaagggtgctttttcagacaaccttcagtatcgagctgttgatacctcacggtctgataagctcaatagtgtctcttctggtagtggtgtagcttgaggaagcaatgccttagggacatggggcaagaagaagtacgcaaaattctgtaggctgctcggatttgaggatgatgtgtgacctccatgtgtgaaccttctattctgtactgtgcccaaagctatgtgctgagatttatttgtgagacctaagctatgtgtga

SEQ ID NO: 11236 - DNA, 761 bp, Triticum aestivum
  Clone ID: PAT_TA_11236
cacattcgaaatggctcgcttccggaataccaggtcatcggccgccacctccccagcgaggccaaccccacccccaagatctaccgcatgcgcatttttgcgcccaacgatgtcgttgccaagtcgcggttctggtacttcctcggcaagctccgcaagatcaagaaggcgaacggcgagatcatctccctgaaccagatcaccgagaagcgcccccagaaggtcaagaacttcggtatctggatccgctacgactcgcgctccggcacccacaacatgtacaaggagtaccgtgagatgtcccgtgtcgccgccgtcgatgccctctaccaggatatggccgcccgtcaccgctcccgcttcagggacgtccagatcctcaaggttgttgagatcgagaagaccgacgacatccgccgcccatacatcaagcagctccttgtcaagggcctcaagttccctctgccccaccgcatcaacaagaaggctggcaagaaggtcttcgcttccaagcgtccttccactttcttctaagcgtgtttctctttccggagtgcggtctggctgggcagggacaatacgggtttcccgcggttatgcatgcttcgcaaaagaagcacactaggaacgaatgaaaatccctgatacctccatccgatcttgagagtcgtgtgatgccagccagggtggtgttgtgggattgcaactttggcgtcaaggacaggacgaaagaatcacatgtattcagggacaataagtta

SEQ ID NO: 11237 - DNA, 990 bp, Triticum aestivum
  Clone ID: PAT_TA_11237
aggaattcggcacgaggcttacagcaggcttggctccggtggtctgggtatccatggtgcccagatctgcaggctcactgttaggagatgagggacttgggcgaaagcttttgacgacgtcggcgcctgcgggtgtcgtgaccttcttgggaggcgtcgtcgtagagttccttcctctccttccatgtgcttgggctctcccgggtgagaacctaaactccagttttcgggagtgggcgacggcggcgttttacattgtaaccttcttggaggcgtcgctttggagggccagcctttggttgttgtgcgggctcttccgttttcatgggtggtgtatgtcggggcggcggctccgggatctttagttgagagccgaggcggcggccttgggcagcggtgcggcgatggccccaggaggtagggctgtttgtcgacatggcttgggtgaggaccttgagctgcgtgggtggcaaggttgtcggctcggtcgacgcgtcccagcgggggcggttggacggcatgtcggggcggcggccccggatgtggtgcgacgttcgtggtctgcgtgcagttgtcctgagcagtgcgggctgcggactgttgtatcgtgtggcgttgctgctcgagggtgagcggtggcttgtcagggcggcggctccggatgtggtgcgacgttcgtggtctgcgtgcggttgtcctgagcagtgtgggctgcgggctgctgtatcgtgcggcgttgctgctcgagggtgagcggtggcatgtcggggcggcggccccggaaggcggtgtcggttgagtgtgcagggtgcaacggagcagtggatgtcgaggcggcggcctcggaagatttgcagcttcgagggcatggacctcgtgtcatgtgggcgacgtggttgtcatcgatgttgttcgtggtgggctttgccctgtgtgttagtctttggggtgggctggcccttgttgtttcgattttcacccggtttcccg

SEQ ID NO: 11238 - DNA, 847 bp, Triticum aestivum
  Clone ID: PAT_TA_11238
acgcgccggccaagtcgccgacgacggcggtcgagacggagccgcccgcggggcccgcccggggccgagcgcacgaccggtggaggcctgtggaagccgaccccgtcaacctggggcccaaggggctcgcctcggccatggagagatgaaggcgccgcttgtggcgtgcaccgcggagggtgaggggaccacaggagcgcaagggaagcccgtcaagctggggccgaaggagttcgccacggccgtcgacatgttcgactacttcttcgcgctgctccactcgtggtcgagccgaaccttgagttcaataagtacgagcagatggtgttggaggacctggtgaatgaaaggccacgctgagcccaccaagaagattggatcaggcgtggaggcctttgagatccgcaaccacccggtgtggcagagccgctgtttcttcatccgcagggtcgatgggtccgctgatgatttcagcttccgcaagtgcgtcgacaacatactccctctccccgaggacctgaaggctggcaacaagaattcaaacggcaagaagggtcaccaccacaagaacggcggtggtagaggaggacgaggcggcggcggcggccgtggtggaggtggcttccgtggcggtcgaggccgcggcaggcggggcaactaggaaccaataatattccccacaattttggttgcccagtgccaatccttgcagttgaggcatttatcatgagctatgcgtgtttgtttgcctgtcctagagacctgttatccacctatatgtactactgtgcgactgatatatgatgatccttggatgctttgccatcatgttgtttcaaaaaaaaaa

SEQ ID NO: 11239 - DNA, 1177 bp, Triticum aestivum
  unsure (1)..(1177): unsure at all n locations
  Clone ID: PAT_TA_11239
aggaattcggcacgaggagagaaaatgcgtttacgccttgccggaactctaagagactaaagcttctagatcaaaggggtgctgaagctcataaggttgacgcaactcgaaatttgctcaggaagctgtcaacaaagataagaatagctgttcgtgtcattgccaaggtttcaagaaaaattaacaaagtaagggatgaggaactagtgccacaagttaataccttgatccaagggtttgcaaaaatgtggcaagacaagctacactcctaccagattcagttacaagtgatatcagaagcgaaaaacctggcttcggtaacatcaggtggaaccaacggccgtgatctggcaatggagctggagctagaactgattaaatggatcatcaacttttcctcctgggtgagcgcgcacaggaacttcgtgaagtcactgaatggatggctagcactctgcctcaactacgagcctcaggaggcacccacctactcgcctaggcgaataggcgctccagtgattttcgtcatctgcaacaaatggtctcaagccatggataggatctccgagaaggatgtggtcaacgcaatgcaagcccttgtctcaagcgtgcgccatctgtgggagcagcaaaaccttgatcaaagcgaaaggagcgtcgcagttcgagaaagggagaagtggatcaagatgttggagcggaaggcgcttgagatcaacaaggaagccgacgagttaaacaggaagctggccttggtgccgggccagcagcagagttttcagcggtgtccaacgatacgaacgtacgaggcgcatcatattgaagcgagcagcgtgcacgtgaatttgaggctggttgttcaagctctggaggactttgcctccaattccctggaagctttccaggagataccgagactagatgaagagccaacaaggccgtcaagagggagttcgagggtaccacggtgactaagagaagtttgagcaccaagtccagcttgtaagatgttgcctagaacttgcaatctgtggatttggatgagcagtccgtagtttcatggtgatgctggtggcctggtggcgttttggtggggggatcgcggtgccgatatcctcgtgtaattagcttttgtttcactgaagcgtttgtgggctacgncttgtgtaagataagg

SEQ ID NO: 11240 - DNA, 359 bp, Triticum aestivum
  Clone ID: PAT_TA_11240
ctcgcgggtcgacaccctgcactacctctagtaggtgcacctgagagtcaatagcgcagcagatgaaataaccaacttcattgtagaagatttgaaggccatcaagaagccaaagataatcgtggatcatgtcatcaccagttgaaatgtggtattctcttggagcgctttctcatcatcctacatttccactctgtttgttgagattattgattttatcgatgccgttcgtactccaacaaatacggttcctgtacgccactattatttatttggttttgaacttgacaccttatttcattctgggcttgtaagttgatgttgcaagagttgatgttgcaagagttgattttaactcg

SEQ ID NO: 11241 - DNA, 404 bp, Triticum aestivum
  Clone ID: PAT_TA_11241
ataacagatcacaaccctggaaagccaaggaggtgcacctcagagtcaatagcgcagcagatgaaataaccaacttcatagtagaagatttgaaggccatcaagaagccgaagataatcgtggatcatgtcatcaccagctgaaatgtggcattctattggagcacttttcttactcatcatccatctttcccctctgtttgtcgagattaccgattttatttgcgccattcgtacttcaataaaaacaggatgctgccgcattcctgtacaccgcaagactcctattgtttttgcttttgaaattcgcgctgtatttcgttatgggcttgtaagttggtatcggaggagttgattttaacttgaaactgcaaatgttggtcaaagatgtttttattaccgatc

SEQ ID NO: 11242 - DNA, 729 bp, Triticum aestivum
  Clone ID: PAT_TA_11242
atggaccgtatggcctgacactaggtggacgtgtatctgaagagctacacttcgacaccgtcacctccggtgcatccgacgacttccgcaaggtcactcagatggccacagccatggtcagcaaatggggtatgagcaagaagatcggatacatctacttcgaagatggcgagggccagcaactcaccaagcccttctccgaagacacagccaagaacatcgatatggaggtcaagcgcatcgttgatgaggcctacaagcaatgcaaggatctcctcactgagaagaaacacgaagtcggtctcgtagccgaggagctactcaagaaggagatgcttggccgtgaggacatgattaggttgcttggaccccgaccttacgaagacagccaagatttccacaagtacttctctggcgagtatggcaaggcaccgggatacgtcgagcctgcgggcgacggtgtcaaggggcctctagtacctcccagcccagcaaccttcaaggatctggattccaggaggtgaggtgctgaagatgtaatttatatcaatttctcttttgtgtgcattatggcatgttacgacatggatgtggggttttggcgatgatcaaggggtttcattccactctagacgagcatgcgcaaggtgtcttgttaaaatagacgcgcgttttggctttgtaacagtatagttcatcaggtcaaagagaaagaccaagaacgcaatt

SEQ ID NO: 11243 - DNA, 703 bp, Triticum aestivum
  Clone ID: PAT_TA_11243
gaggaattcggcacgaggggtggcaccaaggccgctcctggaagagtttctgtgctcaacgatggttccattgtggtcgaggttggaggtgttgaggttgggcagggactgtggaccaaagtacagcagatgacggttttcgcgttgggacagttatggcctgatggatctgaatgccttcttgatagagtgcgtcttcttcaggctgacacgctgaacttgatccaaggtggactcactgctggcagcacttcgtctgaatctagctgtgcagcaacccttgaggcctgtaacatgctggttgacagattaaagccagtcatgaagaagctcaggcagcaatccgctggcgctgtttcatgggatgctttgattgctcaggccattacggataatgttaatttgtcctcaagtgcatactgggtacctgctcaagaatcgagcacctatctgaactatggagctgctataagtgaggtagagattgatgttcttacaggagctattactttactacggagtgaccttgtgtatgactgtggaaagagcttgaaccctgcagtggacttgggccagattgaagggtccttcatacaaggaattggtttcttcataaacgaagaacatgaaacaaatgccgatggactggttgtgagtgacagcacatgggtctacaagatcccgagcgtggacaccatcccga

SEQ ID NO: 11244 - DNA, 567 bp, Triticum aestivum
  Clone ID: PAT_TA_11244
gccgtccgcccacgcgtccgcccacgcgtccgcggacgcctgcgccgggcgacatgaccggcggcgtgaacggcaacggcggaggcggaggcggcggcggcggggcgtgcgcggtgtgcaagcaccagcggcgcaagtgcgagcccaactgcgagctggccgcctacttcccggccaacaggatgaacgacttccgcgcgctgcacctcgtcttcggggtggccaacctcaccaagctcatcaaggccaacgccaccgaggcggcgcgccggcgcgccgccgagacgctgacgtgggaggcgcggtggcgcgagcgcgacccctccgaggggtgctaccgcgaggtctcctgcctccgccgcgagaacgccgtgctgcgcgccgagaacgccgcgctcaggcgccgggccaaccagtgcgcgtgctgtgccaccacgttgcagcagcagcagcagcagatattgctcgtctcggcttacaacaacggcgcccggctcccccggcggtgtgctgcacggagccagcaccggtggtcgtgcccggcggtttttacagttggaatgccgg

SEQ ID NO: 11245 - DNA, 736 bp, Triticum aestivum
  Clone ID: PAT_TA_11245
aagtcctcgacaagatgtacgcgcccgccaaggactcgtcggtccccgtcctcgaggacccagccgtcctcgaagaattcgacggcatcctcttcggtatccccacccgctacggcaacttccccgcacaattcaagaccttctgggacaagacaggcaagcaatggcaacaaggcgccttctggggaaagtacgccggtgtcttcgtttcgacgggcaccctgggcggtggccaggagacgactgccattaccagcatgagcacgcttgtgcaccacggtttcatctacgttcccctgggctacaagactgcgtttagcatgttggccaacttggacgaggtccacggtggaagcccatggggtgctggtaccttctctgccggcgatggatcgaggcagcccagtgagcttgagttgaacattgcgcaggctcagggtaaggctttctacgaggctgttgccaaggcgcatcagtgactagatgatggaaagactgctggccgtgttgctgagaacaagacggtggagaatgggaatggagcaacgacaaatggtagcactgctgctgctactgccgctcctacttctactcctgctcctgctgcgtcttcttcgcaaccccagcagaagacggaagaggacaaggataaagagggcggtccgtgtggattgcctgcaaagtgcgatatcatgtagactttggcctttcctctctacttcttctttcctacttg

SEQ ID NO: 11246 - DNA, 642 bp, Triticum aestivum
  Clone ID: PAT_TA_11246
gggatcgtctaaccttggtgcgcccgtcgctgctcgtgccggtcggccccgtcccccccgccctccgggcagcccggcggccgtcgccgcctgcgcgcgcccccccggcactcccccccctgccgccgttgccgccgccgcgcgggcggccgccgggggccgcgcccggcgggccgccggccctcgcggcggccgccctccgtccgcggcccgccccccgtgtccgtcgtcgccgccgggcgcccgcccgcttgccccccgccatgatgttgaggtggcccctgagccgcgcccccgggatggcccgcttggggagcgccctgtgcttggcgccgttggtgccgcccgccggctgcgtgctcctgctccggggctcgggcttgcgtcgcccgccctgcacggtggtgcggatggggcgcaggcggccgtggttgaacggcaacccgctgtagctggagcactgggacgagctggacgtggtggcgtgcggccccggagccgtgcgcggtacgtagctcctcgccagagacggcctgtagttgtagctgtactgtgctgattcttcttggttgccgatgttgccgccccgcgtcggcgtggccctacccgatcagcctccgccaccttcatgtttgtgaagcc

SEQ ID NO: 11247 - DNA, 821 bp, Triticum aestivum
  Clone ID: PAT_TA_11247
gggctgaggaattcggcacgaggtcgacccctccccttcctcctccgcccctgcggccgccccgccgccgccggagacggtggtcctgcggctgaagcggcgggcgaagaagaaggtgtcctggaaggaggggaccgtcgacaacgagtccctcggtcgcaagagctccaaaaagtgctgcatcttccacaaggaggtgcccttcgacgaggactgcagcgacgacgaggcggacggcggccgccggaatccgcatggggacgccggcgaggggaccagcggcggcaagggcggctgctcttcctcctcccacggccatgaccacggccacagacaccaccactgagctccggttcgataaggcaacttctgatgggcctccttgtctacgcttgatgtcgtcaagggaaacattgcttctgtgtgccaaaaacattaggtgaaaagctagttttaccatatcctcaaacttgcaagaggatgcaccttttatatcaaactgtactgttgtttacatgcaatctaatgttataagatgtatacatgcaacacctgttatcactgtcgtgattcggtgagttaaaattgtcaggatgttcttcgatattctttttggcacctcattatccttgtggccggaatagcgccgtgttgtctgtttataaagtgatggttgcttgtcttttcacatgctttattggcctgtctcagttgtaacatgccctgataatcaggatacatgtaacgttcgtgacttttctgttgaatgttcctgtcatccaaaatcaacgtatggtattcttagtaaaaaaaaaaaaaaa

SEQ ID NO: 11248 - DNA, 1219 bp, Triticum aestivum
  Clone ID: PAT_TA_11248
ctccctcgcccgcgccttcggggcgctgaaggtgcagctcgaggccgtggaccgcaagatcgacggcgaggttggggccgctcggggcgagctcgcggcgctgctggaggggatgcggctcgccatcgagggacagctcaacctgctggacgccaggaccgacgagctgaacgacgcgctgggcgggctcaggcggatggagttcctcaggaaggaccagtttgaagcattcctggatgagttcaaggagagcctaggctccaactctggcaccgaggtcgatctggatcaggtccgcgcgttggccagggagatcgtcatgagggaaatagagaagcatgccgccgatggggttggcagggtggactatgccgtggggtctgctgggggaagagttgtccgctactcggaggcatatgatgctgggaaacgtggtggtcttctttctgcattaccatttggtggtggagacaatggtgaccagtcacagaagatacttcagccgagctttggggagcccgggcagtgctttcccttgaaggggagtagtgggtttgtggagatccaactgaggaaggggataatccctgaggcaatcacactggagcatgtgtccaaggatgtggcgtatgacatgtccactgctccaaaggactgccggctatccggatggtaccaaggaacacataccgagacccctccaaaccatgctgcagagatgtacgccttgaccgagttcacgtacgacctagccaagaacaatatccagacattcgatataactgccccagatgtcggtgtcgtcaacatggttaggctggacttcacttcaaaccatggaagctccgcgctgacgtgcatttaccgcatccgggtgcatgggcatgagcctgtcacgccagttatcgctagtccactgccctgatgagatggagaatccttccacctcttttgtatctgttttgctttagggccatttctctgggcgtttgctagtttcagtctaggattatgtcatgcacactctgtaaaaagttaaatgattgtttgctgcacattttctagtgatctagtccagatgttcagtttttgccatgcacgaatggccagtaaaaaaaaaaaaaaaaaaaactcgagggggggcccggtacccaattcgccctatagtgagtcgtattacaattcactggccgtcgttttacaacgtcgtgactgggaa

SEQ ID NO: 11249 - DNA, 498 bp, Triticum aestivum
  Clone ID: PAT_TA_11249
gcggcgggctcggcggtggaggactcggaggtggcgccggtggactcggcggtggcatcggtcacggcggcggcggctgcatccatccgtgaccgtgacagacgagtagatcgccgtgcatgcagtacgtacgttgcatgcatgcgtagtgtcaacggtcaaggtccaaagaagggtcaacgctgcatgcatgccagattgtcagtaggaagtgtatccacgtgttgatgatgccatgttgaaataagcatgcatgcatgcatgcatgctactagcttaattacgtacgtgtacacgtaccctagctagctagctcgtccacagctcgatcatgttgctttcagtagtatctctccctctttgtttagggccccgcacgttacccttgtgttgtgtgtgctagctcctcggcgtccctgcatgtgtaatgaaaaataattcagccttgtcattttcaaaactgatatatgctattcttcgtgcaactgaaaaaaaaaa

SEQ ID NO: 11250 - DNA, 786 bp, Triticum aestivum
  Clone ID: PAT_TA_11250
cgtccgcggacgcgtgggttacacctgaggatgaaaataaagttttatgtcccactaattagatcaactgctcagggaaaaaaagagatgtgccttctttgcattagctccaccatggttctgccatatgtctaattacgatgcacccttttcagaccatttccaccgcacatgtgtgttcgtgctcattttttgttctctgcctttttgatcatgcctatgaatgcccatccgtccgatttgttcactgtcttttgatcacagttgtgtatacactcatgcctactgtattccctgcatttttcctctactatgcaaactgcttaccctttgactactaattaaatcaagcttgccactttgtacagtgtgattatttcatgtatttttggtatgtgttagctatgacttgactggctccagtctggtagagaacacaattaatttgcacttcctggaataaaattactatttgtgattttggtatgggctagctttgatttggatgatttcaagtcaggaacatgagtgggctaatgtattatgcatgaccatgggaagacggtattttctatggtagaattagtgtggtggtataaaattataagttcacttcatggtcggtaggttcaccgctgcattttgtttgtagatgccttgacttttaggctatcacaggtagtcgcgcgtcgccgcgggcgagtctctgatcgccttgctctgtttcactgtttcaatatttccaacttattacatgaatggatctaaaataacaaactttcaaca

SEQ ID NO: 11251 - DNA, 618 bp, Triticum aestivum
  Clone ID: PAT_TA_11251
ggccaattccacagcaaaaatgaccaaggtccagtcaatggtcgcgagctctcgccgcaaatcgcgaaaggcacacttcagtgcgccgagtagtgtgcgtcgggtcatcatgagcgcgcctttgagtaaggagctccgcgagaagcacggagtgcgcagcattcccatccgcaaggacgacgagatcaccgttgtccgcggctccaacaagggacgtgagggcaaggtctcctccgtctaccgcctcaagtactgcctccacgtcaacggcatcgtccgcgagaagagcaacggccagtccgttcccatccccatcgctccctccaaggtcgtcatcaccaagctcaagctcgacaaggaccgtgagcaaatcctggagcgcaagagcgccggccgcgaggagaagaagaagcagagggaggcataagcgtatcaacgctttccttggttgacgacacacaccacgacgatgagggacatcgacacgagcatccccgtccgtagtggatgaaatgcatatcatgggttcacggtctgggcatgcgatacgcgcatggaaaagcagggcgttataccggcttctagctcgaacaaggacttgccgtcatgcggccccgc

SEQ ID NO: 11252 - DNA, 1056 bp, Triticum aestivum
  unsure (1)..(1056): unsure at all n locations
  Clone ID: PAT_TA_11252
gnannccttaantaaccctactaangggaacaaaagctggagctccaccgcggtggcggccgctctagaactagtggatcccccgggctgcaggaattcggcaccagcggccctngacgccgccgcccgccccgacctcctctgcgccgtgctccgccaggccgccgacctccgctccgcggagctcctcgccgcgctccgctgcttcctctgcccggcctccgaccgggcctacgcccccccgcgccccctcaagacccgctggaaggaggcggccttggccgtcgccaacatggccgtcgacgagccccccacgggcgcccaggtcgcgaggcgtgccgcgatcctgctcatgatgggccacgtcgggttcgcctccccggaggtgtgcctgcactacctcttcgcgtcgaggaacgtcgaggacccgctggtcctcgccgcggccgtgtccgagctggacggcggggaggtggccagcctgctgaggtacctcgccaagtgggtggggaagtactccaggttcccggaggcccagccttgccctgaggcggtggaaatccacaagctcgagcagtgcgacagcgtgccgtcgcttgtggcagtggccagggcgatgggcctggtgctggaccagcatttctcccacctcgtgctgaatgcggagctgcggcaggacctgttggccgcgggggtgatggcgaaagagctggctgccgaggctgaagcttccggtccgatcctcgacttgctgcgccgtatgccgcaggctgtgtgagagattaaactgtctgtttacttttggtactactagttctgatgatgctggtgtcctagaatttttggttgcagtgatgagttatgtgctccagcaaatcgttgccgtaattcttaattgtagtggttccttctgttgcgttttacatcatgtgtatcactatcagttgtgaaatacgaatgggtttttgcagtgccggtcatttccatactcccaatcctccaaaaaaaaaaaaaaaaaaactccaggcggggtcccgccccccccgcgccctcgct

SEQ ID NO: 11253 - DNA, 555 bp, Triticum aestivum
  Clone ID: PAT_TA_11253
gatggactgcagtgcctggatgcagccgtcttactgttacagcacggcggaggcgccggaggacttcgaggcgtacgtgacgcgactgcccaaggcggaggactttggactggaggggttccaggaggtgcccctggaggtgctggccgaagccggaggaggggtcagcatctgggacctcagcatagcccctgaaatggcagcagcagccgcttcttcagctgctgccagtgcctgcactgtcccccaacagccgctgcagcaacccagctgctgaggtgcagatcgacgtcgacatagaaagtaaggagtggccgtgatatatagtgcatatacagcatgcggcatgctggtcactggccgtggtgcatgcagctagatagctacgtagttagtactagtatttgctttttttccatcgtcgcagtagcatactagcattattattggtgggcaggtgaccgtgcaagtgtgtgtatgatataatcgtgcgtgggagcaggggtaatcaaatgatcagtctaatggcgtgtgctgctgcagcggtcctattgc

SEQ ID NO: 11254 - DNA, 1367 bp, Triticum aestivum
  Clone ID: PAT_TA_11254
gccggacaaacaactcctccctcaccacggacgcccccacccgcacgccccgtgccgcaccgaccgggtgcggaccactcttacagcagcgtgcaaatcaagggcttgctggtctaaccggcgttgacgcgagtgtagccgcgattccgcttgctcgagacctcgccattcgtgagggatttgagcacattatgttcctggttgctgtggctccggtgtcgaagttggagaggagattccaactcgtgatggatgaaggaactctggatgcaatagggctccaccctgatggacctgtaaggggaatcatcagctcccacgtcagtgagcagctctatttcccctgctggcatactgtctcatcacatcgtgccgcaggacgaaggatgagctagtgcaggaggtggagaacttcagccaggagaaacttcggcgccacactctcttaatgagccttcgccatcgatgcggtggtgcccaacgtcgtggagcatgtgctgggcctgcacaattaccatgacggctcgtacgccgacgacctagttaattaccatgaacgcagcctcgcggatgactggtttggcaccgaggccatggatgtccttgtaggctggacgaaaaacttatgctccagcaaggatttgcctggctgcagcgtacttgacataggaaccgggagcggacgactcttacagcagcttgcaaaacaagggttttctgatctaactggcattgactatagtgaagccgcaattgagcttgctcgaaacctcgcaattcgtgatggatttgagcacattaatttcctggttgatgatgttctggagtcaaagttggagaggagatttgaacttgtgatggatgaaggaactctggatgcaatagggctgcaccctgatggacctgtaaagagaatgatgtattggcagtcagtggctagcttggtttcccctggtggcatactggtcatcacatcctgcagcaggaccaaggatgagctagtgcaggaggtggagaacttcaaccagagaaagttgggcgctacgctctctgaaggagctctagccagcgatgccgtggtgttcaagtacctcgaccacgtccaagcttacccaaacgtcgatggtgtttgcatcgccaccgttgctttcctgcatacatgaaaaatatatgtatatgtatccctgcccccctctctgcccctaacttatcagacctgtgagtaacaatgtaccccaggacagctgctcttctatggatgataatttacctcgtcggatacgttattcgctagtgtggtgctttgttatggctgggtatactgcgttactgtactgtttgaactttgaaagcttgtcaagcaaatg

SEQ ID NO: 11255 - DNA, 677 bp, Triticum aestivum
  Clone ID: PAT_TA_11255
cctcgcccgtccttcgaacctccacagcagcccgcccttccgtttccgctacacatcttaccttggcgaatcgcaccccgcatccaacaaagtcgtcgtcgaattctcgcccgacgacctctcaaacacacactccttgacccccacccaagtctccaagctgatcaagctagccggacctcggtacaacccctcaacctccatcatcaaactctcgtgcgagaagttcgatacccaatcccagaacaagaggttcctaggcgacaccatctcgagtctcatcaaggagtgcaaagaagggaaagatagctttgaagacgtgccgtttgacttccgccaccacacacctaagaagagggccgagttccccaaggaatgggtgctgacgaaagaaaggaaacagtatctcgaggagaagaggcagaagaccgcctaccttgaggaccagcgtgcgggcaacggtttgctggtagacggaaagaaggtgcttgagacgagtttgccgtttatgagtgagagccagccagcccctgagacggtcatggttgggggtgcgaggggaaagccattgcggtagttgcattgatcaaatgttctgtatgaatatgaaacgttggttgtacaagtacaaagctggaaccagctatatctccgtatgcggttgtagaataccgaat

SEQ ID NO: 11256 - DNA, 909 bp, Triticum aestivum
  unsure (1)..(909): unsure at all n locations
  Clone ID: PAT_TA_11256
actctcaactacacgaaactctaatctaacgtctatcaacaacaacaaccactatcaatatgcgtaccgccttctttgtcagcgcattggccagcactgcatttgctggtgttgtcacccagatctccgacggtcagattcaggctcctactactgagactgctcccgctgttgttgcatcgtccgctgttgagtcggtctcgagcgtcatcgcatccagcgttgttgcctccgtctcttcagccgtcgagtccagcgttgaggtctctcctatcgctacatcctctgcactctccactcgcatgcccgttcccatcgtcaacgctaccgtgacctccggagcttctctcaccaccatccctgcagccgttgtcccttctgctggcctcagcactgtcgttgccggcggcaactcgactggaaacgccaccatctcctcgcacagcttgaaggcttcctccaccgtcacctcttccaccaagggtggtgcttcgggaacctctgctggatcctctgccagcgcatctgcttctggtaacgccgccagcagcttctaccagtccaacgcaggtatgttcggtgctgtcgtcctgggtgctatgggctacctcgcactttaagcgatgaaccattcatcacattgagctccttcctacctgtctgctgtcacgttggtgcagtgtatagaaggactcttcttgtacttgttgctgggtaattggggcgcggcgcacattcaaaggatcaacatttacggttaatggcttttcttccatgtggaaagctggcgtggggcaactcgtcttgtcgtctctttcttcatccatccttccaggattcttcttcattgggcctgcgagcctgctacattagagcgatgcacaaacaaaatnaacactnagcaagaac

SEQ ID NO: 11257 - DNA, 577 bp, Triticum aestivum
  unsure (1)..(577): unsure at all n locations
  Clone ID: PAT_TA_11257
gaggaattcggncgagggaacgctttgctagtagctctataggagacgtgtttagaacgattataaagcgtgatggatacgttgggctcatgaggggatggaagccgagaatgctgttccacgcaccagcagctgccatctgctggtccacatacgaagcctcgaagtcgttctttgaaagatttaatgagaaaaggagaaaatagttggagcatttcttggaagtgatagtgtttttctggaagccaagtgcttcctcgctgtggcgtgtcctcggctgatgaaagaggcagcgcctaagatacagttgtgtgcagcagaggatccatttggatgatgcgccgtgcatcgaaatttgtctaacgatgatctgtctgtacgttgtatttcttttctttttggctgagttatatgtatcatttttccagcccgtggtcgggaaagcaaataccagaataattttgccctagtttttcaggcatcattgagcatactgtatggccttctttgtgccagattattgataaagtgaaatgagattttggttctgttaccattcctgcttctaaaaaaaaaa

SEQ ID NO: 11258 - DNA, 626 bp, Triticum aestivum
  Clone ID: PAT_TA_11258
ggacaaataccgccaacatgcccggtgtctctgttcgtgatgtccaggcggacaagttcatcaacgcctacgctgctttcttgaagcgtcagggaaagctccccattcccggttggagcgacaccgtcaagaccggtcacctcaaggagcttcctcctcagagcattgactggtactacatccgtgccgccgctgtcgcccgccacatttacatgcgcaagactgtcggtatcggccgtctccgcaaggtccacggtggcaccaagaaccgtggctcgcgcccctctcaccacgttgacgcctcgggctccgtcgaccgcaaggtctgccagtccctcgccaagatcggtgtcctcgagaacgacgacgacaagggtggccgccgcatcacccagtccggccagcgtgatttggaccgtattgcccagaccaccgtcgaggctgaggaggaggaggatgaggacgacgagtaaatgttctctctgacttcgggttctcaattgctgcaaaggcgcctggcgcaggaggattgcgggtctgaatggacgggtcgagggaactcgaacttcataggtgtctcaagcgctgagcactggaaacaggctgctatcctgatcaatcaaaag

SEQ ID NO: 11259 - DNA, 833 bp, Triticum aestivum
  Clone ID: PAT_TA_11259
gaggaattcggcacgagggtcgccgcatcccgactcccgtcctctcaataaagatctcgacacccttttagacgactcgtcgattacatataccgccgcaaagatggtctccgaactttgccccgtctatgctcctttcttcggcgcgatgggctgcacgtcagctatcgtgttcgcgtgtttcggcgctgcctacggaaccgctaaggccggtgttggtgtctcggccatgggtgtcctccgccctgacctgattgtcaagaacattattcccgttgtcatggcgggtattattggtatctacggtctcgtcgtgtccgtgttgatctccaacggtttgacacaggagtcttcgctctttgccaacttcatccagcttggtgctggtctcgccgtcggcctgtcgggtatggctgctggtttcgctatcggcattgttggtgacgccggtgtacgaggaaccgctcagcagcctaggttgttcgtcggaatgattttgattctcattttcgccgaagtcttgggtctttacggactcattgtcgccctgctcatgaactccaaggccagtgacgccaagtgctagacgattacgcagcctccattgcagatatgacaatacctacctgcagcaatcatgtaacggcatcgatacgcaaagtcgttcagcaatctacacatatgacgcgcaacaccaacatgcgcggcatgtcttacgtctccatgtattattcgaacggaagggtaacgagggcttcgaagttgggaagcgtgggtggtaaataatggcatacgagttgagatgcacttgcgattccatttggacggcgtgt

SEQ ID NO: 11260 - DNA, 682 bp, Triticum aestivum
  unsure (1)..(682): unsure at all n locations
  Clone ID: PAT_TA_11260
gctcgaaccccttcgctcgatcacctcctcttccctcgttcgcctcctccctcgcgctgccggaggagaggcgaggaagagcgtcgccccgcgcccgtcctcctttgtcccaccggcgagcctctgctctgccttgcctcctgtttccccgtgctgcttgctcactcatcgtggccaccccaagctcctcaggaagccacaccgcgcgtctctggtctcgactccgacgagatccgggcatccccgcgctggagccgccaatcccgcaccggcgcgacgccatcccgctccgtcctgccacgagctccacctcccaggacatgctgttgcctgcacgcctccacctcggtgctctccgtcagtctcctccccgggcagagaagctcctgcctgagccgtcctcttcagccaagtccacggccgctgcttcaccagggacgccgggcgccaccagcaggagttctggccggcgccgctgccaagtcccgtcgccggagctcgccttcatcccgactccggcgggttcaggccctttgtcgtgacctgcatcccgcagctgaccgtgaccactgtaggcctctgtgccttcatcctgccgctgccggccactctggcccttgtacatcaggtttgacccgaggagactgacaccgccggtgttgaggcatatctctnctcgatg

SEQ ID NO: 11261 - DNA, 820 bp, Triticum aestivum
  Clone ID: PAT_TA_11261
gttctcccatttcaatcctccgcgcgcctaagataccacttgagaaattactaatggccaacggaaagaatgtcgtggccatgttatttctcaccaccattgtggcggtggcggccacaaggccagccgacacctatggcgctgcggaggagaacacattgaagatggctacccccagcaggaaaggggttgacgctacattagcagctacacgtgttgttgccgccgagaagtccatcaagaaggctgaaagcgccaccacatcagaagaggccgcggctgccaagcaagatggagcaaaatctgcttctgctgcattaaagtacaatgccatctctcagcaggcaactggtaaaggttcttctatctccccaggcaggaaagaagcagccggtactttagccgccacacaatatgctaccaccgagaagtccatcaagaaggccgaaaccgccacgacacctgaaaaggccgtggctgccaagcgagacgcagcaaagtctgctgacgatgcattaaagtatggtgccatctctcggaaagcagctggtacaagttcttctacctcccccaataggaaagaagccaccactgacttagcagctatgcacactgctgctggtaagatgatcaccaagaaggctgaaaccgctaccacacctgaagaggccgtggctgccaagcgagctgcagccaagtctactgctgctgcatcaaagtatggtgtcatttctcagcaagcagctggtacaagttcttctacctcccccaccaggaaagaagctgtcggtacctttggagatgcgcgcatagctgctgc

SEQ ID NO: 11262 - DNA, 2096 bp, Triticum aestivum
  Clone ID: PAT_TA_11262
gtctcgaccatttcaaatcctccgcgcgcctaagataccacttgagaaattactaatggccaacagaaagaatgtcatggccatgttatttctcaccaccattgtggcggtggcggccacaaggccagccgagacctatggcgctgcggaggagaacacattgaagatggctacccccagcaggaaaggggttgacgctaccttagcagctacacgtgttgttgccgccgagaagtccatcaagaaggctgaaagcgccaccacaccagaagaggccgcggctgccaagcaagatggagcaaaatctgcttctgctgcattaaagtacaatgccatctctcagcaggcaaatggtaaaggttcttctacctccctaggcaggaaagaagcagccggtactttagccgccgcacactatgtcaccgccgagaagtccatcaagaaggccgaaaccgccaagacacctgcaaaggccgtggctgccaagcgagacgcagcaaagtctgttgacgatgcattaaagtatggtgccatctctcggaaagcagctggtacaagttcttctacctcccccaataggaaagaaggcaccactgttgctgctaagatgttcaccaagaaagctgaaaccgctaccacacctgaagaggccgcggctgccaagcaagctgcagccaagtctaccgctgctgcatcaaagtatggtgtcatttctcagcaagtagctggtacaagttcttctacctcccctagcaggaaagaagctgccggtaccttggcagatgctcgcatagctgctgccgagaagtccatcaagaaggctgaaaccgccaccagacctgaagaggcagcatccgctaagaaggatgccgcgaaatctgaggctgatgcaatgaagtacggggccatctctcagcaggccgccggcaaaatccgccaagtgccggcagcgcaccctacggcccctccgtcggcttccacggcgagctccctaggggggagggcggcttcgtgccttggcaagcaccgttcgttcccctgtcgggcacagctcctggagggcatcccccacaaggaacgagagtaaagaaagtatccaaggcagcagctgtgtttgccgtcactgggctatggacacccgaggtacctccagagaatgccaatcgtgactgtattaacatgactgtggtataccttgatttgcacttgccaaggaaaatggagcctaagctttctctgagagagaccttctatttgatatatggtggcaatacaatcaaagaacttgcggagcttgtatgcggtcgtctgaatcttgaggtggggcatccaatgaagttcaccattgatgggactcttctgccggaagattgtgtactctcgtcagtttacaacaagtatatttgggacgggagcattctgacactctgctgctgtgttgataatgtgaagaaaatcttcaacgtggacctgtcagtgaaagttcctgtgataccaccagtgcatgtgattgaagatgaagtcccattacccactctgaggatctgctctgtccgggacgcaaggagggcgtctatgatgagcaaggttggaacctactcgctgaaggatggtgctccagctgtgctggtgcacggcacctatggggagggcgggtcactagttttctattaggttctgtcgctggcacaatagtcccatgtcacttttgccacaagtcatgacttggaatagcttctgttaagcccatctcgtagtccttttgtgaatgaggcacctgtttacatcctgtgatccttttgtgtcatgaggcactgtttacattttgtggtcattttgcgacagggcagtcattctgcacacgcgcaacatcatctgcatactaccatgcatgcaaaatagcagcattgagatatcacgttatgctaattctcatgcatgcacgctttgtttaaacgttcccattacgaatcatgtattaatttctttcttgttttatttttagtagtaagacacgcttgacttgctttaaaaaaatacaacaaacgatgtatacatgtattatctgaaaattaataatatgagttccaccgcaa

SEQ ID NO: 11263 - DNA, 425 bp, Triticum aestivum
  unsure (1)..(425): unsure at all n locations
  Clone ID: PAT_TA_11263
ggtttccttccccgccgcgaccccatatccctctgctctacggtgcccctcctcgctccacggtcgcggaatccggacgagatcggcaggatccgctctcgggcgagggttttctctctataagtcgctgcctcgacccatgggaactccgacgaacggtgtacatgccggcagctggcgggccggcggatcggctccagccgcgtccaccctcacctcctcgtccatgacctactctgcccggacgcccgaggtgaccgcgtgatgtgtgagtgcgtgttgctgtgtgcttagcctgtgtgcgtttgcctgccgctgcgtgcgtgtgtctatgtgcagcgtgtgtgctgatggaagttttgctgctgcttagtacttccctatacaatagnatagaagatgatttgtatgttctaaaaaaaaaa

SEQ ID NO: 11264 - DNA, 880 bp, Triticum aestivum
  Clone ID: PAT_TA_11264
cctacccacccctcccggcccgccgaccttgcccggccgcgccgcccgcccctgccgcccacgccaaggccgccttcaggccatagctccgctcaaccagctctgcccgctcagccaccgcggtcctcagcgccgccccgtcttacgggggcgtcgaatcctgcgggccagttgacctggccggccaccctggagcgtccgagaacgcaggggcaaagtcgcgcgcatgctgcaccaccgctccaccattcccgacttcctggcttttgacgacctccggggcttcccagaacgctggggagccgatgcggagggtcatcttgtagtggccggcgacgacgaagttgtgaagaacgcttgtggaaaatctttcgcgacattccccaaaggtttcttcttcacgacatccgggggactgcagagctacgagcatcctctgaacgaggtgaagccggtgccgagggtcgatagcaaaggggaggtatgcggcacaacttacgcggtcgatgaacaggccaagaaagataccgccggcattccccgtgttggcagcgctgcagattggtcttcccagtactgaatctgtagatactgtcgcaagcgtatggtatatctttagaaccctgttgcagttgcatccatggtaataattgggctcggggtggcctttgccttgtaaaacgttcacctatagggtgatccttgtgcttgtggtacaaggttacatagtacgtactactagtatttaagaaaggattagcatgagggattgtaaatttgtagtacttgtatccaaataaaagggcagaagccttgcagatgtgtcaatagatgttgtgttctctaatgataaaatatacttatcacattaaaaaaaaaa

SEQ ID NO: 11265 - DNA, 301 bp, Triticum aestivum
  Clone ID: PAT_TA_11265
attcggacgagcaaaagcggggagtacgagtgggttcacaagcccgacctggacacgagcaggagaaggtttttcctgtgatttggcgccgctctcgcttcacccacaaagttcgtttttccttccgttctgttccgtccctcggaaattacttgctgtagagtagcatgatgctccagtccttcaccagtgtaacaacgacatactcgaatcaaaaccccagattcgaagcgatttcgcgtgatttcgcgtacccgtcaatcaaatgagtccatcagttttgagtttgacaaaaaaaaaa

SEQ ID NO: 11266 - DNA, 1054 bp, Triticum aestivum
  unsure (1)..(1054): unsure at all n locations
  Clone ID: PAT_TA_11266
ccacacgatgaatcggtcactctcagtccgctcgaagaagggcagcggtagcggcagtggggaaaagtccgcgcccaagcaccgtttcacaatggcttccctaagaggtacgcagcagccggagctttcgaagaaactgttcaagatcatcaaatctgaaaaccatgcgattggcgcctacgaggctgcggcacgtgaacgggttggcattgctcagcagctctcggaatggggtgaggccacagaggacgagacgatctcggagatttcagataagctcggagtgctgctcgcagagattgccgagcaagaggatatctatgcacaagcgttggaggaataccgaggtgtcttgaagcagattcgcaacacagaaagctcagtgcagccgagccgagaccacaaaaccaaggtgtcggatgagatcgccaagttgaaatacaaagaacctcagagtactaagattgtccagctcgaacaggagctcgtacgcgcggaggcacagagcctggttgccgaagcgcaactcagcaacattactcgtcagaagttcaaggaggcatacgaccaccacttcgcagccactatcgaacgtgctgagaagcaaatcatcctagccaagcacgctcgtcgtctcttgaaccttgtcgacgacacccccatagtccccggcgatgtacaccctccgttcgcagaggtagaagcagcacgccaggtactcaccgacgcggaagacgatcttcgccattaccagttggagcgggagaaacaagtggagcccctgttccagaatctactacgtacgagagtacagtacgaaatgagagtcccgtaggcgtgcagtatgacaaggcgggttcagccccttaccccttggaggaagcggatagagtggaaaggcagcagcaggaggttcctagacaggaagtttccaacgtggcttgaaagtggagtacggtggtgcctgggcatctttctaggaatctttcttgcgtccatgtgtactaatgatttgatacgtctctnattatgtattctttccgtagcaagacat

SEQ ID NO: 11267 - DNA, 535 bp, Triticum aestivum
  Clone ID: PAT_TA_11267
gcacgagggagagagcgagagaactaggaatgggaaaaagagaaggcgctagcagcgcaatcacaacctgttgctaaaggcatttcagttggccaaatgggcaaaccaactgcttctgtgtcaggcctgaaacataagaatccccaggctgttgctctttctatgcaggaggaacgagaccgaaaactcgctgacgaaagagagaaaagagcagcggcagcggaaagaaggctcgcggcgctagcagttcaatcagggccctcgaccgcggcgggcagctccacgcagacaacaacagcggcaaacgacgctgcatgttcatgctgtttctcatccctggcaggcaaggtaccattccataggtacagctacaagtactgcagcactacatgtatgcatctccattcagaaatgctggaagatgactgagctttttgttgtcgtggagaaacataccgagattttgtggtaccttcaattttaatgaactagtccggagctggcccatctgccagtttttgcttttgtttaaaaa

SEQ ID NO: 11268 - DNA, 846 bp, Triticum aestivum
  unsure (1)..(846): unsure at all n locations
  Clone ID: PAT_TA_11268
gccgatatctcncctcgtacggcgactcggagcagaccgtgcccaagacctacgccgagcgtgtctgcaggcaattcgcccaagtaggtgccagaggcacaacgctcttcttctcctccggcgaccgcggtctcggcggcacagatacctgctacacaaacgacggccgcaacaagtaccaattcctgcccaacttccccgcctcgtgcccctacgtcacaactgtcggtgcgaccatgaactttgagcccgaggaatcggcttaccgcccgagtcgcaacacgtctgctggtttccgcgacctctactccagcggcagtggctttagcaactacttcccccgcccttggtaccaggacagcgtcgtgccacagtacgttgactcgctcggcgatacctacgagggtctgtacaacaagacgggccgcggataccctgatctggctgcccaaggtctgtactttgcctacttctggaacggcaccgaaggcaccatttctggtacttcggcgtcttgcccattgactgctggtatcttctccctggtcaacgatgcgctgttggccagtggcaagcccaccctaggtttcttgaacccttggctgtacaagaaggggtacaagggacttaccgatattaccaagggcttcagctatggatgcaacgttcaaggtttccccgtcacggaaggctgggatccgattactgggtttggaacaccggatttccctaaactggtcaagctggctggcgcacatgtgcactgattgatgagttgagattgtacggcggatcatgatggatggtgggcttattgttagggaataggttcatacaatgttataa

SEQ ID NO: 11269 - DNA, 590 bp, Triticum aestivum
  unsure (1)..(590): unsure at all n locations
  Clone ID: PAT_TA_11269
ggaattcggacgagggaagaagnccgaagcggttaacccccccagtcggaccgcttcatgtgcgttgacccctcatggcgcaagcctaagggtatcgacaaccgcgtccgcaggcggttcaagggccaggctgctatgcccaagatcggatacggctccaacaggaagacccgccacatgatgccctccggccacaaggctttcgttgtcaacaacgtcgccgatgttgaccttctcctcatgcacaacgccaccttcgccgcagagatcgcccacgctgtatcagcacgaaagcgcatcgaaatcatcgccagggcgaagcagatcggtgtcaaggttaccaacggcaaggcccgcgttaagaccgagtcgtagatgggtgcggatttttactttggggcggggcatacaaggcgtctctctgattagttacgatctcaatgggaaggctttccatcctcttcggctcacagtacccctcgactacggtatgggaagaggcatgcacttcaaaaagcattgcgacatgttactgcggaagaccaaagatatcaagggacacgagcagtaggaagcaataaaaaacgagc

SEQ ID NO: 11270 - DNA, 1551 bp, Triticum aestivum
  Clone ID: PAT_TA_11270
accggtccggaaatccgggtcgacccacgcgtccgcgcagcctggcagcgccacctcgtctccctccctcggcgggttcgagacgccgccgccgccgggccggcgcactccgtccggtgctggcgcagcccggcagcgccaaaactggaccggacggtttccgccaaccccgtccactcccatgtccaccgacgacgtcccgctgtcctccgaagccggggaggaggacacgcccgagaccgacggcggcggcgtcggcgccgatgccaccccggtcttcgtctggggcaccaatatcagcgtgcaggacgtgaacgctgccattctgcggtttctgcgccacttccgggacccccgcgacgccggccgcgtcgaccctgtcatggacgagggcaagtacatgcgcgccatcccccgcatcctcgagctccagggtggcgagtcgctcgatgtggacgcacacgacgtgttcgaccacgatcccggcctggtcgccgccgaggtacgctacccgctcgaagtgcttgccatcttcgacatcgtccttatggacctggtggcgcgtatggagccgctgtttgagaagcacattcagaccaggatctacaacctcaagtcatccatttgcttgaggaatctgaatccgtcagatattgagaagatggtgtcaatcaagggtatgataattcgatgcagctcagtcataccagagctcaaggaggctgtgttccgctgccttgtttgcggcttctactcagaacctgtcatggttgacagagggagagtaactgagccacacatatgtcagaaagaacaatgtaaagcctcaaattctatgactctagtgcataaccgatgcagatttgcggacaagcaaatcataaagttgcaggaaacaccagatgagataccagaaggtggcactcctcatacagtcagtgttttgatgcatgataagcttgttgatgctggaaagcctggagatagggttgagatcactgggatatatagggccatgagtatcaggatcgggccaagtcagaggacagtgaagtcaatattcaagacatacattgattgccttcacataaagaagacagacaagtccaggcttcatattgaggactctatggatactgataacaccaatgctagcaagtcttctgaagatggccatgtcacagataagatagataaattaaaagagctttcaaagttgcctgacatctatgatagattaactagatcactggctccaaacatatgggaactggatgatgttaagaggggcctgctttgccagctttttggtggcaatgctttgaggcttccttctggagctaacttcagaggtgacatcaatattttgcttgttggtgatcctggaacgagcaaatcccagcttctccagtacatgcataaactgtctcctcgtggtatttacacaagtggaagaggcagttcagcagttggccttactgcttatgttgctaaggaccctgaaactggtgaaactgttcttgaaagtggagcacttgttttgagtgacaa

SEQ ID NO: 11271 - DNA, 481 bp, Triticum aestivum
  unsure (1)..(481): unsure at all n locations
  Clone ID: PAT_TA_11271
ggggattccgccgcattttctactgcagctccgcaattttaggacctgctgtcttgtagcagccgctgcctgcgctccgatttcccccccgcctgcttcttcttcttccgcttctccccccgtgtgggccgcggggtggcccgggatcccgccccggtcgccgccttcgtcctccgtctgcccctcctgcggccgcgagttcgaggtcgggttgccgcagcggggctgccgcttcctccgcctctggtgggggttttgggggcttttcctcccgccatgtaagccgcgggcctcatgtgggcggtagggtgcattgcgcttccgcggattcccagccagctctaacggttcaagcaacctgtcatggaatgcaatgatgcactgctatgaatgagcaattgggancactactaaactacttggggcattgcctcaaaactgcttgccaaaaaatcngggtttgcgtcaggtcantaaaaac

SEQ ID NO: 11272 - DNA, 1025 bp, Triticum aestivum
  Clone ID: PAT_TA_11272
cgcacgcgtccgggtagatcctcaaatggatggtcttgcactatcggaagtaaatggcctcgtgccgcttactgatatcagtgttggatacttgctgacagaagcatccaaggctgctaatttggattgtgaagtgacctctattgccaaaaatcctcttttcgatgagaatctgtgcagctatgactcgtttgatgctgctgttgccctacatgcttctcgttatcaagcagcagagcagccagctcatacatccaattccaccatctggggtgcagaagaaacatgtgatgagttcagttttatgttggccacagctaggaagcaacaaggtttaaacacttcagctagcagccctcctgatagcgacaatgaagttcactcttcaaattcagaagggtttcaaggttttcttcaggacttggctggaggagatactcctggtaatccttgtgctgatgatgtcaaggcaatggaagaactttgtgccagatcaccacctcaaagtgacaatgattttggattgaaagatcagcctctagatgacgcattctggcccgaatcacttggaccactggacttggatataccgccaataagatccctagctgatgagttcatcttaggagacagtcaaaatagttggagtcggatgatggaaaatagcatggatgcatttcgaaacatgtcgttcttcgtgtccgataacaatgactcagttcttccacccatcatgtagagttgtggatgctggctatgtttggctaggaaggatactgccaatcaggcatcccgccgaggaggaggctttatattgtccaagcgggctgcttgttgctaatacaacatatgcggacttgctgtgcctttgcagtccagagggacgcatgttgttgtaaggttataacataaaatcgtgtactatgtaaatcgggttgttcctgtacaaaaggcacatacaagcgcttggttacaataaagcctcttcatccggatattgtgaaatgagcttgggtcaaaaaaaa

SEQ ID NO: 11273 - DNA, 1188 bp, Triticum aestivum
  unsure (1)..(1188): unsure at all n locations
  Clone ID: PAT_TA_11273
aggaattcggncgaggatttgttgatgcttgcccggtcgcgtttggtggcctcacacgcctcaagctggaacatttgacgctggctcaatcngatttcccagaaatatttggtatatgtaagaggctggagttcctccacttgttcaactgcgacgtggagatttcgtcttctctacaagtggaacatcctcaactcagccaacttgagattatcaactgcagatttgagaatggtgttgatctgaaatggctaccaaagcttgcactgctgacttttaaaggttggttctcacaggaggatccgttttgcgttggtcatgccccactgctccagagtgtgagcatcactaatattggtctttcttaccacaagatgctcaagttaagtgagatccttggcaaagcaaccataagtgatctccatctcaatttcagatgcgaaaagatttggattaaaccagaaggtccaagacaattgtggcaggtgtttcgtacactaaaggttgtgactttggataacatttctgaagaatgtgatctgacttggacgttattcattctccaaggcgcacccttcctgaaggagctgtgcatacaggtgtgggacaatgtatgcgatatgatgggagacgaggaagagaggaagaagcatgcatttagcgaggagaggaaggacaaaggcacagagtgggaaggactggcatctgatttcaagcaccacaatctggctgtgctaaggatttatgggtttcaagcagaatgcaagttctttgaatttattagaagtgtgatggaagctgcagttgatctcgaaggcatatacctgcataacagggtattgtgtaaaaggcgcaatatcatggttccaagcacttccaaatatccgaaaacatataaacagaagatgtcggtgaggaacaaaatctacaagggcaattgctggatggttgggatacacttcccgggctggagtgccgaggtgctgcagggatgaagcttgttgttggtacgcggccctgaagggatcaacttgctgggttgacaacctgaggtcactgcaataatcaagtttgttgttagtatgctccccttgtctgaaatctcttccccgttgtgctgtgttagctgattatcttgtactgtactagcatttgttatcacttagagcagtgactggtgtattttgt

SEQ ID NO: 11274 - DNA, 774 bp, Triticum aestivum
  Clone ID: PAT_TA_11274
tgccggacctccccaccgcgccgcctcccccggctgcccccatcccccggtctccgcccccccccgccggccctcgcgcgcggaccacgaccggggcaggcgggcgctgacggcgcgagtacgggcgggaggccgaggcagcgctcacgtggccgtggccgcgatccagaccccgacctccagccgcgccttctcggcccaagctcgcccccgacgcgcaggccacccccccccggccctcgtcggtcggccgggcgtccgtcggtccgggctgcttggcgggcgcccctgcgcgcggggcgcgtgattggccgggcgcgtgcgctcgccgcccgctggtgcttggggtccccgacgtcatcggcgcgtccacggcgccgcgggtggccccgtcgtggagggggcgccgcagtgcgtggggcccgccagcacacccccgcggccgcccccgccgtggtggtcccgtagtgcgtggggcggcagagtccatgggcgccaacgccgcggagtgcggtcagccgaacacctcatctccgccgtcggcggttatcgccgggcccccggggcctgccccccccgcccggctcccgcccccgctggtctggtcgccgtctgcactcgtctctggctcgctcgggccggcaccggtggacggggtcgtcggcccgccgcgcggggctctcccgcggcccctggttcctctggtgcgccgtcggcgccggcgcggccgcctgtgggccgtcggagcgttgtccgctcgatcaattcttctct

SEQ ID NO: 11275 - DNA, 701 bp, Triticum aestivum
  Clone ID: PAT_TA_11275
ccggcggcccgcgggtcccgaggccggaccggcgcaggcgcgagctcgccccccaggcggagaccagggcggagggaggcggagatgaagcgcacccaggcgctgcttgacgcacagcagctcttcgccggcgcgtgccgccgctcccggcggccgcgccgcgggtgggcccagctggtctcccccgccccggcgctgctcgacgcgcagcagctcttcgtcgaacgcctgcctcgcgcaagcagcacccgcacctcaaggaagcccacgctggtctcctccgccgttgttatgcgcaggtaagtttgagaatgacatgtccggtgcctcctcttcctctgttccgtggggtgggttgcgagctgggcggcgttgcttgtcggcggcggctccggctctgggcgggcttggtgagtggtcatgtttctactcttcttttgtttgggatggttgatttaaggagtgaagggcaaagaatgtaggtgtaggatatggctgtgggaggatttagaaagtgttcatttgtaatcagtgtgttgtcttttgagttgctgtttatggtggggaaaagaaaagactagcttccctgggaatatcttcatctggtcactgcttgcttctgctgctttgctattgttaagattgtctcacagtgagccaaggtgtgattgttatgatagttgtaaaaaaaaaaaaaaaaa

SEQ ID NO: 11276 - DNA, 464 bp, Triticum aestivum
  Clone ID: PAT_TA_11276
gctcgattgaatccatctgtgacacagaaatcacagctttctgaaggatctgaggtcatattcaccgacgatgtttgtctgcaagtttttattgaacacttgcaggagttggctgttcagggttagcgacgcatggacctgcccatggttccgctatctcagttgggcccatctcagatcctgaagatacggctttctgatagatggaatgtcatattcacgggtggtgtttacttgcaagttttattgaacacttgcagtaactggctgtacaggatgaaagagtccatgtggaattagttacgtgttatttttggccatatgttatcttgaaatattgccagagctgcctggaggaatgagatctccttgatttgtacatttgcttcagctccagtttgatgtaagccagttaccttttatttttttgtatagactgatgttattaatctttaaaaaaaaaa

SEQ ID NO: 11277 - DNA, 675 bp, Triticum aestivum
  Clone ID: PAT_TA_11277
gaaattcttccagctgataatcaaaccgcactcgcccacattccacgtacaaagaagagcagcagtgagacacgtacgtgtcgtgtatttgtggtgcatagcatacggcgaaagctgtctaggggcatatatacacggcgccggagatggggacggtgcaggtacaaggtgtggcggcgtcggggaggatgccgtccatggaggcggagccaaagacgctcaccctcgagcagctcaagaggcggcgctgtacgtggtgagcacgaggacgactgaggaagccatcaggatcttcacggaagggctcaagccagtgcggggcgtgcggaagatgggctcctccatgactgactcgtcggacgacgacgttgagctcggctcgtcggaggattcgacgccgcgcggtggcggcggcacgggttgtcgcccccacggacgctccatcaagagagacattgccactgcaccgttctagtttgcgtgtgttagtttgaacttctaccttttctacggtcatttttcccttggcctagtactttagctttagcagcggctggtttagcgcggcaaattttggggggcgtcctggcctagagagggctacaagagacgtgaagctggcccgcgcggctagaatgccgttgttgcgtgcgtgtgtgtacatagcagcagact

SEQ ID NO: 11278 - DNA, 896 bp, Triticum aestivum
  Clone ID: PAT_TA_11278
tgtgccgcgctcgagccggccgggtaacggggcgcccccgccgctcccacccccccagcctctaagtcccactttatccctctcgcccacctcctcctctcctctcccttctcgtcacaccgcgccagctaaggcttcgctgtgcgctcccctcccccacgcgcattcattccctcgccgccgcccgctccgcgccgcgccatggccggcgttaggagcctcgtgctgctcctcctggtgctcgccgtcgcgctgtccgcctccgcctcgtccatcgccggcggggaccacctgcagctcggcctcctctccggcggcgctggccgcggggagtgcaggggcaccgtggccgagtgcggcggggaggacgcggagggggagctcgggtccgcgtcggccgaggcgcaccgccgcgtgctgcaggggcgcggctacatcagctacggcgcgctgcgcaggggcaccgtcccctgcaaccgccgcggcgccagctactacaactgccgccccggcgcccaggccaacccctaccaccgcggctgctcccgcatcacccgctgccgcggctaagccacggatccgcgcccagggatcacgtcctctcggttcaaaaataagctgcttctcgtgctgttctttaagcggtaccactagtatactactactgctactatttattagttaaatttctttggttgttgccgctgctgtgttggcctattgggacatttgttgccgtccttgttgtaaagtataagagatatttgtgccttaatatgaagagatatttgttattctttgaaaatccactaagaccataaacttgagctgctttcttgtctgtatcaagagaatgctttgctattgttaaatgattggtgtcgggagaaaaaaaa

SEQ ID NO: 11279 - DNA, 688 bp, Triticum aestivum
  Clone ID: PAT_TA_11279
gctgcgccggctcgcgcatctacgttcaggagggcatctacgaccagttcctcgccgcgctgcagaagaaggtccaggcgctcaaggtcggagaccccttctcggccgacaccttccagggaccccagacctcgcagctccagcacgaccgcatcatggagcacatcaagtctggaaaggaggagggtgccaccgtctacgagggcggagagcgccacggcaaggacggcttcttcatccagcccactatcttcactgacgtcaagccccacatgaggatcgtcaaggaggagatctttggccctgtcgtcgtggtgagcaagttcaaggacgaggccgacatcgtcgcccaggccaacgactcgatgtacggcctcgccgccgccgtcttctcaaaggacgtcaccaccgccatctccaccgcccacaagctcaaggccggaaccgtctgggttaactgctacaaccagctccactcgcagactcccttcggaggatacaagcagtccggcatcggacgcgagctcggcgagtacgccctggccaactacacctcggtcaaggcggtccacgtcaacatttcccagccctcgcccatctgagccactccctagtcgtcactgtcgatacggtccgctgcgcgcgttcaaggggtcatgccaggtctgttttgtgacgcggattagtg

SEQ ID NO: 11280 - DNA, 331 bp, Triticum aestivum
  Clone ID: PAT_TA_11280
ggacggctacatcgcccgctccggcttcgaggccaacccccagggctacttcgcgggtctccaccacggagaggccgccaagtagagacgttctactgcatcagctcctgtctcagctaggctgccgcccctggtcactagtgttgaccaatgtttgtagctactccaataatgtatagactgcccgcgtgagaacagcctagcaagctacttttatcttgtaatccaagtcgatcgatctgaccgttagctagtaacgcaatgcatgatggggtcgacgcttgtacctctaatataagtgaatgtacgtccctgttaattaaaaaaaaaa

SEQ ID NO: 11281 - DNA, 481 bp, Triticum aestivum
  Clone ID: PAT_TA_11281
gctggtgcagagcctctaccacctcagcccgaaccggccccacagccaccagtgaaggaagaacagaagacagaaggttctagagcgagaaatatctgctgccgcttggagaacaacgtagggccgcagcctgacaagtgacaaccccagcagtgagcgaaagaagataagaaggttctagaacaagaagtttccgctggagaacgtcgaacgtcgtggggtagaccgtaggcgtagtggtggtggtggtagcggtagtgctgcctccatgcccccatgggcgttgggggctggtctgctttgttcattttctattgctagttgtagtacctgacatgttgtcggggccccgcggcctgcatgcgcaagttgcccgaaacagaaaggggccagcgccttttgcctggcgtggtggaataatgctccgaggctttaccggattaagtactccaagttggacgtagatcgatcaaaaaaaaaa

SEQ ID NO: 11282 - DNA, 788 bp, Triticum aestivum
  unsure (1)..(788): unsure at all n locations
  Clone ID: PAT_TA_11282
tatccttgctgagcttccgcagattgttttggtgcttatatcatctcaatggcaactgccccatccgatgtgcttgctgttgagcttttacagcgtgagtgccatataaaaaagccattgagagttgttccactatttgagaagcttgcagatcttgaagccgctccagcagcggttgcacgcctattttcagtagactggtatatggataggatcaatggcaaacaggaggtcatgattggatactcagactctggcaaggacgctgggcgtctctctgcagcgtggcaaatgtataaagcacaggaagagctcataaaggttgcaaagcattacggagtaaagttgacaatgtttcatggaagaggtggaacggttggcagaggagggggtcccagtcatcttgccatattatctcaaccaccagacacaatacatggatcactccgtgtaacggttcaaggcgaggtcatagagcactcgtttggagaggaacacttgtgctttagaactctgcagcgcttcactgcagctactctcgagcatggaatgcatcccccaatttcacccaagccagaatggcgtgctctaatggatgagatggcttgttgtggcaacaaangagtatccgatcaatagcttccaagnaaccacgctttgttgaaatacttccgctcgggnaacacctgagactgaatatggncgggttgattttggaaaccggcatccganggnaaanccnagggggggggnanaaaaaccccccggggnaattcangggttttttg

SEQ ID NO: 11283 - DNA, 558 bp, Triticum aestivum
  Clone ID: PAT_TA_11283
gggcaagaatggcagtttgcttcggcacttagtcggccacctagtcctctcgaagtcgatcccgggcaagcgggtagtcgtagccgtggaaatagcgcagtcagtgcggcagatgttttggaagtgcttgataactcggcatggggtgaatcgattaggaggagtttcacccaaaaaaggcgtagttagcgtccgatgggatttgtttatgaccgccgagaatatgtatggcgtgtgtcaatcacgtcgatcaaaatggcttggtacggcttcggcaaagggtcgagccagagtcggatggttcagagtggtgcacgacacgaagcctgttgcatgaacgtctggaatgattggatacgtaggcggctggcatcaacccgacacgcaacgctggtatgggactgatgggttggatcggtgttggggtagtgcttgtaacggtgtaatgtcggtggtggagttaacttttggcattgcatagcgtcggcgttgagcgattgatcaaatcaccttagatattccctatcacaaagctttacttctctcccaaaaaaaaaa

SEQ ID NO: 11284 - DNA, 1314 bp, Triticum aestivum
  unsure (1)..(1314): unsure at all n locations
  Clone ID: PAT_TA_11284
gaggaattcggacgagggccggccgtgcacngcgcgacgccgacgaccgcttcccccgacgttgccgcagccgccatacaagtagaagaagtactagttcaagcgtgagcaaaccttgcaaccaatggcgggggttctggatgctttggcatcctacgtgaccaacatgctcaccgagatggccaaagaggaggtgtccatgctaatcggcgtgtctgacgggatcagagatctgagcatcaagcttggggacctcaagaatttccttgcagatgctgataggcggaacatcaccgatgagagtgtgcgggggtgggtgggggaactgaagcgtgccatgtacctggccactgacatcgtcgacctatgtcagctcaaggccatggagcagcgtccatccaaggacatggggtgccttaacccactcctcttctgcatgcgaaatcctctccactcccacgacatcggcacccgcatcaaggcattgaacaaggagctggatagcatctgcgagcggggcaataaatttaaatttgccaagctagaagtgtaccaagacatgaagatgactcgatctcttgctactgaccggaaaacagattcattgttggagcggtcaggtattgttggcgagaagattgaggaggacacaagagcactcgtggaggtgctcacaagtgaggagggcagcgacaagactggtcgccacatggtggttgccattgttggtgttggtgggattggcaagaccaccctcggcaagaaggtcttcaatgacgaggctatcaaagccattactgccgctgggggagaccaacctggagggggtgggactcgagatagggccctacttgttgattctctcaaaaacgccatcgaggacaagaagttctttcttgtgctcgatgatatgtggggagctgatgcatggaacaaactgctcatgactccctttggctatggtggcctgggcagccgagtcctcatcaccacaagaagtgaaactgtggcgagaaacatgaaagctgcacactgccaccacgttgacaagttagggcgcgaagatgcatggtcattgctcaagaatcaggtactcactacagaggagaatggacacgaggttgatgtgctaaaggaaattgggttgcaaattgtagaaaattgtgacggtttaccactcgctataaaagtaatggggggacttctatgcagcaaggagaaatcacagtttgcatgggaagatgtcctgaatgatacatctatcagtatctccaatgtcagataactaacagcaattatctagctacaaggact

SEQ ID NO: 11285 - DNA, 894 bp, Triticum aestivum
  unsure (1)..(894): unsure at all n locations
  Clone ID: PAT_TA_11285
aattcggcacgaggcttatgcttactggaaagggaatgcagcagttgcgacatcacggcaggaattggttaagtgtaatgtctccagcacgcaagactggaatgcaaggatttacactcaggactggttcaaagagagcaaggaagggtataagacctcggatttgggcagtcagtgcactcacaggtctcttatgccgcttcagcattattggccagttcgggataacaataaatgcgcctcaatacaatatgctgttaactggggcaactctcacaagcaattggcacagcgcataggaaaggaagcaagcaatttcgttgaacaagaggttaatatggaccatgtgtatgattacatgcttcacctgttaagggaatatgccaagcttctaagtttcaagccaactaagccacctgaagctgttgaggtctgccctgactctttggtctgccaagctgaaggcactgagaggaagtttcttatggaatccatggtgaagtctgcccatgattcaggtccatgtgatcttcccccacctttcagccgccgggagctcacaatgctaaaacggaggaaagaaaattcgatcaggcaggttgaaatgtgggagcggagagcttcgataactagatgacatactttgggaactgggtttgctaatgtggcgccggccaaaacaagtactctgctattgagggcgcacaaagatgaggctgaggaagcacggtgcgctcggacgctgctccacgcgtctttcggcgcccagcattagaatttagaagttcggccttcctttcagacttctgtcttcaagttcaaggttggagatagcttcacacgtacattttaaaatacgatatgagttgcnnatatttttcanaaagggtccaa

SEQ ID NO: 11286 - DNA, 694 bp, Triticum aestivum
  unsure (1)..(694): unsure at all n locations
  Clone ID: PAT_TA_11286
atttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaagaaggtttccggtgtatctgcaccatcaggttgcattgcttcaagtatcgactggttgttcttggaagatgattggcagaggtgtcagcagaaacgtgcaagcggtctacagagttgagactgctggtggcaacccaccggctacttgcagtaaagctggagtggtcaaagtgtcgtacgcagctgagtactggttctacggttgatgagttttggaaaagaatgggagtttcaggttcatggtcctgttgataccgggtgtgggttgtcttgtttcgtgctggtggtggtggtatctttctttcgttttgtatatacctgggtcnaacgaccaaaagnatcgag

SEQ ID NO: 11287 - DNA, 710 bp, Triticum aestivum
  unsure (1)..(710): unsure at all n locations
  Clone ID: PAT_TA_11287
gggnaaacggnangtggtgggcgtggtggtgctggnacggnatggggcgaggcgccgcccgaccccttcaactgcatccacgtcgccgacacccccaccctcgacgccctcaagaagggtgctccggagaggtggaggctgatcaaagctcacggcacggccgtggggctgcctacggatgatgacatggggaacagcgaggtcggccacaatgcgctaggagccggccagatatatgcccaaggtgcaaaactggtggatttggcgctcgcctctgggaagatatatgagggggagggttttaagtacatccagcagtcgtttgagactggtactttgcacctcattggtttgctgagcgatgggggggtgcattcaaggatcgaccagctgcagctgcttctgaagggggctagtgaacatggagcaaagaggatacgggttcatatccttaccgacggtcgcgacgtattggatggcagcagtgtcacattcgtggaaacgcttgagaatgatctggcaaagctacgggagaagggtgttgatgcaagaattgcatctggtggaggcaggatgtatgttacgatggaccgctatgagaatgattggcaagttgtgaagcgtggctgggatgcgcaggttcttggtgaaaccccacacaagtttccaagtgcccttgaagccgtgaagaagctgagggatgatcccaa

SEQ ID NO: 11288 - DNA, 862 bp, Triticum aestivum
  Clone ID: PAT_TA_11288
gaggaattcggacgaggccgccccgaaccatcgtcgccgacgtgctctctgtaaagcagttcccccgcaacctcctcctcgagctaaacctgccatcctcgatcctaccgccggagttcggcatcgtctgcacacaccccatgttcgggccggagagcggaaagcacggctggagcaatctccccttcgtctacgacaaggttcgcgtcgcggaggaaggcgctcagaaggccaagtgcgaccggttcttgagcatcttcgagcaggaggggtgtcggatggtggagatgtcgtgcgcggagcacgaccgccacgctgcgggaagccagttcatcacgcacaccattgggagggttttggcgcagctaaacctccagtccacaccgatcaacaccaagggctacgagaccctcctgcagctgacggagaacacggtgagcgacagtttcgatctatactacgggctcttcatgtacaacgtgaacgccacagagcagatggacaaactggacagggcgtttgaggaggtgaagcagatgctgtacggcaggctgcatggtgtgctgcggaagcagatcgtagagcgggtccccatgcccggagccccgtcgtcgcgatcgagagaagccagggacagccctgctgcgagcacacaagagacgaagcccctatccccctccccttgtcatacgttttccacggtggctttcagcaccgcaaaatgttgaatctgtgtatctttctcgccgttgtaatatcgttaatcaagcatctgcgattagggctctatgcatgtaatattgaccaagctttttatttatttattttgcgaaaaaaaaaaaaaaaaaaaaaacctcgtgcc

SEQ ID NO: 11289 - DNA, 1157 bp, Triticum aestivum
  unsure (1)..(1157): unsure at all n locations
  Clone ID: PAT_TA_11289
cgtccgcccacgtggcagcaagaagctcgacccggagccgtggcggtgccgccgcacgcccggccagaagtggaggtgctccaaggaggcgcaccccgactcctggtactcggcggggctggctcgacccaggccgccgtcgttcaagaaagcctgtggaacgaaagtctgcttcccctgcgcaccagtcgcagcagcccccgctgtccgccgtcacgttcgcgacccgcgacgccgagcctctcccctccctcccggccggggctaacacccatggcctgtccctcggcggggctggctcgtcgcagatgcacgtcgacgccttctcatacggcgccaaatacttccttggagctcaatctgatgtgggtgaactgagctttcttctctggagcatcaggaaacaacaacaggggcttcaccatcgattccccaacggacagctcgtggcactcgatggggtccagcctgcccccgtaccaactgtcgaaacctaggagattccggcctcatgcaaggcggcttctcgtattcccactatgagccgtcgcaggagcttgggcaggtaaccatcgcctcgctgtcccactcccaggagcaggactgccgctctttgggtggtggaggtggaggaggtggaggtggaggtggagggctcatgggaaatgtcaagcaggagaaccagccgctgaggcccttcttcgacgagtggccggggaggcgggactcgtggtcggagatggacgacgagcgctccaacggcacctccttctcgacgacccagctctcgatctccatcccgatgcctcgatgcgattgacgggtgtgagcggcaggtgcagggcgtgcacgtgcacgtgcacctgcgctgtggtctctcgtggttctttgtgtccattgtattcgttcgtgctatgaacttggtttaagagcaaaacccttgcgtgtcgtgagataagaggaacctgtagtagctgttttttcaagattccacgttgctttgtacgctcaatgtcgaacctgtaggtgtttgcgtgtgtcgttgcggcagatcatcttgtggaatgtatcgtgtaactgcctatttgtttgtgttgaatgatgactctgatgttgcttacttggacacggaaatcatacctgggacgcgnncctgt

SEQ ID NO: 11290 - DNA, 1202 bp, Triticum aestivum
  Clone ID: PAT_TA_11290
gtgaccccttttttaatagtatttacttttactggggtttttcttgtgaactatattctgttgagctcagcagcagcggaagctactcacaatgtgatccacacctttcacgatgctgtcgagctaatgaacgagatatttacgagttccatggcaccacttgtgttgttagcggtccttctcttttcgagccacatcatcgctttgacatctgttatcgctagccatgtagtcacagagcatttctttggcgtgaacctgtctctgtttgcgcatcatgtgctacttaagcttctttccatgattcctgcaatctattctgcaaaggtagcaggctctgaaggggtatatcagttgatcattctgtgtccagtaatccaggcgtttaccctgccttcagctgttattcctgttttccgcatcgcctcatcaagttggataatgggcaactacagggtatctctacgtgtcgaaatattagccttccttgcattttgtcttacgttgtttataaatatcatcttcgcggcggagatcctgtttggcgacagcgcctggacaaacagcctgaaagggaacactgaaacccctatactaattcccacatactgtactaatcctaatgtcttgtgcatctattgcttttgcactcttcctggctgctaccccactgaagtcatcaagtagggaagctgaaactcaggagttgtgtgtgcactctcaaagagaagctccagaagaaattcaaaggtcctgagacccttgaagtctgccaaaggtctctactgccaccgcagtaaaacaaagtcagctagcaggaaatatccaaatgaagagggcggctgagagaaatgttgaagtagaagcagatgtttgcacagacaaggataatcggacttgacataattgtcgaattcaacaagtccatgcaagaagaaattcaaacaaagcaaatttgggcagagctcctggaaatctcaaagttcacatgacgtggacacagtgaccaggttccatagctctatgcagtcaattataaacaccaatttggtcccggcatcatttggataaatgtatggtgtgccaagtgctgagctgaatggggtatggtgaaccctgagcagtgaaaaggtatcctggcataggttgctcatccatgtagagaagatcctttaacgtctggcattaaatttaagttcaag

SEQ ID NO: 11291 - DNA, 1197 bp, Triticum aestivum
  unsure (1)..(1197): unsure at all n locations
  Clone ID: PAT_TA_11291
gcttttgtaccttatttccttgatgaagagacagggtgggggctagaggttgacgagcttaaaaaacaagtagatgaggctcggtctaagggtatcactgtcagagcgctcgtggtcataaatccgggaaacccaactggacaggttcttgcggaggaaaaccaaaagaaaattgttgaattctgcaagaacgaaggacttgttcttcttgcagatgaggtttaccaagaaaacatatatgttgaggataagcagttccactctggcagatcgtctgcgcggtctcccggtggcaccgttcctgagcttcctttggtatcggtccggtccgtttccaaaggttactatggagaatgtggtaaacgaggaggctacatggaagtaactgggtttaatgccgatgtaagagaacaaatttacaaggtggcatcagtgaatctttgttccaatatctctggccaaattctctctagcctcataatgaacccacccaaggtaggggatgaatcctatgaatccttcatggtagagagagatggtattatttcatcgctggctcggcgtgcaaaggccttggaagaagcattcaacagtttagaaggcatcacctgcaacaaggctgagggtgcaatgtatttgttccctcgccttcatttaccccagaaggcgattggggctgcccaagcagctggtgctgccccagatgcatactatgctctccgccttcttcaagccactggaattgtcgtcgttcctggatctggatttggtcaggctcctggaacgtatcacttcagatgcacgatcttgccacaggaggacaaaatccctgcaatcatatccagattcaaggaattccatgagaaattcatggacgaattccgtgatgttagccgtgatgaagcgcccaccggcgctacgattgaaagcggaggagattaaacgggcaattcaaactccggatacaatcaaactttctgtcgaaataatgaaggtcatgcagtcgtgccacccccgttcaatggatgaatcaacctaacttgtgcgggcttgttttacatgtagcccccgtactagacctcgcgaattctcgagttccgtatccttgcgctgtttgccttgttcttagggcctgggggatgcaagattttactaaaccttgatgccaactgagatgtcgcatcggcagcgcatncc

SEQ ID NO: 11292 - DNA, 1054 bp, Triticum aestivum
  unsure (1)..(1054): unsure at all n locations
  Clone ID: PAT_TA_11292
gcaagacgaagacggtgtgcgtgaccggcgccggcggcttcgtcggctcgtggctcgtgaagcggctcctgtccacgggcgagtacacggtgcatggcaccgttcgcgaacctcggtgatcgcaggaccggccacctgagggcgctggacggcgccggcgagcggtctgcggctgttcaaggccgacgtgctggactacgccagcgtggcgtacgccgtgtccggctgcggcggcgtcttccacgtcgccagccccgtccccgccgacaagccccagaaccccgaggtggaggtcctggctccggcggttgaggggcacgcagaacgtgctcaaggcctgccaccaagccaaggtcggccgcgtcgtcgtggtgtcgtcggcagccgcggtggccatgaaccccggcttccccagggacgccgtcctggacgaggacgcgtggtcagacgaggaccactgcagaaccacggggatgtggtacgccctctccaagacactggccgagcgcgaggctctggcctacgccgagaagaccgggctggacgtggtcaccgtgtgcccgcccttggtcctcggcccgctgctgcagcgcgtggccaacaccagcagcctggtcctcgtcaacctgctcaaaggcgactgcgacaccgtggaggacaaggcgaggaacgcggtggacgtccgggacctcgccgacgcgctcgtcctggcgtacgagaccccggaggcgtccgggcggtacatctgcggcgcgtaccgaaagaagctgtctgaaatggtcgacatcgtcaagagcttctatccagaccttacacgccccatgaagtttgttgaaggggaagaggaaaggatgatgagctccaagaggctgcaggcgctggggtggaagttgagggcggtggaggagtgcctcagggacagcgtcgagtcgtacaaggccgccgggctgctgccggagtgagcggctgagaccttcttggagaagaaagaagcgtggcagtggtgaactgaaggacggtgtgttacgttacattctgtnctgngaatcgaatg

SEQ ID NO: 11293 - DNA, 601 bp, Triticum aestivum
  Clone ID: PAT_TA_11293
gagcatctcaaggggagggctctggccccgcgggcgcaagaagagctcgcccgtctgctgctgctgcctgcacagctgggggaggtagcgctcgcccccccggtgcagctggcgggggatactttggcggccgcccagatggccgcggtggcgctggccctggagcctttctcgactgtcctgagggcccagcagccgctcgcccgtgagccctcctcgcgaatcctggctccgccgccgcctggccccggtggcccccccgccgcgcggggcaccccgctggcgcccccgggccgcgcttccgggccccttgcgctgcggtcacgggtgctgggccgcggctccccgtctggcgccccgcgtcggccgtcctgcttctccctttctggcggtgcgtcacgtcccgcgcggttcggcacgtccctacttgtttcagctatcgtggagttctatcttcttgcctgcggtccatcgctcgtgccgtcggcccttcgcttgtgtaccggccgttgtgtttgtgtgccagcagtgaagcatgccaggcggattgctggcatgtcatacatttcaatacgcagtaaatgctgatataaaaaaaaaa

SEQ ID NO: 11294 - DNA, 543 bp, Triticum aestivum
  Clone ID: PAT_TA_11294
gcaccaccgacaaattcagaaactgcacagatctagcagcttggctagcatagctgtggcggctgcactcgcactagctagctagcgttgtcctggtagtttatcaatagattgatggccacttcttaaaaaaagaactttcttagtagcctgtgatttttcgactgatggtcatgctcaggttcagagatatgtttacgaatcacaggagtaggagcaatgtttgcagggcatcaagttgcagtgaatttggatgacacgctattaacttacataataagattcttaagggtgaaaaaaggccactagctatgtttctctgtgctgtatatctgttttttctctaaatgttataagataatgaccagcctaaaagctcattgaggaaggaagttatcatcgtagcataccctttgttttatagaatggcgtgatgtgaataaatgaaacttattaaagatgtattaacgtgtatttctctgttttgcaacatgcagcatgcatgatactaataatatatctcttcatagtttaaaaaaaaaa

SEQ ID NO: 11295 - DNA, 154 bp, Triticum aestivum
  unsure (1)..(154): unsure at all n locations
  Clone ID: PAT_TA_11295
tcggcacgaggctcctcccggctctgctagctgcacgcgagnatgcggggatttcagttgcactttgccgggccatcatcttctcgaacatgctagtgctcgcattttcctgaatttattgaaactgcctaaccgtccgtgtcgaaaaaaaaaa

SEQ ID NO: 11296 - DNA, 1080 bp, Triticum aestivum
  Clone ID: PAT_TA_11296
ggaaaagattgccaatgcgggatgctgttctcttgttgttcatcaaactgtaaatgtgagaacgattgtgccaataaatcattccagctccgtcctttgttcaaaacaaaattgattaagacagagaaatgtggctttggattgatagccgaggacgaaataaagaaaggagaatttgttatagaatatgtaggagaagtcattgatgacagaacttgtgaggaaagactatggaaaatgaagagacaacgttacactaacttctatctttgtgaggtcagtagtaatatggtcattgatgcaacaaacaaggggaacaagtccaggttcatcaatcatagctgtgaaccaaacacagagatgcagaaatggactgtagatggagagaccagagttggaatttttgctcttcgtgacatagagagaggggaggagctgacctatgactataaatttgtccagtttggagcagatcaagattgtcattgtggatcttcaaactgcagaaaaatggttggcacgtctaagtcggtcaactcatttgttctccacaatggcaactcagcaagctcacaagatcagcacgacatgaagaaaagaaagacaacctcagataattgtattggggagatcatccgtttatgggatcgacgggacaaaatgtatgtcccagcagttgtacatgactatgatgagtacactggaatgcataccttactgcttgatgaagaaactactgaaaattttgatatgagagaggaagattgggacttcctaccgcgcccagaagatccagaagaagactgaatattgaaggctacaatgatgactaactacttataacatagtgctattttcatgtttagacccttctgtacaattggctgttgttaatttttttcatcctgttaattttcttttccgtttcagttattttaacatgttgtataagcacactgagaatatatatccatacattgcaattggatattgttttacttcgttttttcttccctcccctcgccggttccactctcaaaacagattatttttccctgcattatcaacccatctcaaata

SEQ ID NO: 11297 - DNA, 517 bp, Triticum aestivum
  unsure (1)..(517): unsure at all n locations
  Clone ID: PAT_TA_11297
ggnctgcaggcaattcggcacgaggttcaaaagggaggcaaggncagagaagcacagnaacattgttcgactttacttggcaaacatacgtctcaagaatgcagcaactgatgtagttatcaccgcatatgagccgctgttgataaatcctttgagtgaaagtgctcaggccattgcagctggaccagcagtgcccgcggaacaggcaggatgcttgccaatgtccgaggtcttcagactcgcagtcatgaacttcgatgtccatgattggaaccttttcaatggcagcggttgaagtagagagggtatgacatctcaatgctagagtggttctaaaaaaagtgttctgcaagagtgtttggggaatgtactttccttgagagaaactggtatctgaattgtccttaagagtagcttttttttgttgctgaaaatgctatcacttggcatatgtagtgtcatccaaagaaccctggtcgaagttcaatatatcatgttagcttctagaaaaaaaaaa

SEQ ID NO: 11298 - DNA, 495 bp, Triticum aestivum
  Clone ID: PAT_TA_11298
tacggcagcgagaagacgacagaaacgggcagcaagataaaggtgtgtgcggttgagggcatacacttcagaaggattgactatttgtgattaggcaacagaacaaaaacagtcagccagatcaaagtgtctgcgattgatggcatacacttcacatggatgaactgtttgcgattagccacaacaaactgaaacagttagacacatcaacgtgtgtgcgctagacgggcacacacttataattaaaagaagcgtgtgtgatggtaataacgagcgcgcacggttgttggaacaagacgtgtgctgacattgcctattgaggtgcaccctatggtgcaaacgccatgtacgcagccgagaaggcgtatgtgcccacgttacgccttccgggaatagtgccgcacttataaccgtcagtaaattttgagcatgcgtcccgtcacattccaaattgcaaacctgttcacaccgatcaaaacctaaacggtttcccac

SEQ ID NO: 11299 - DNA, 417 bp, Triticum aestivum
  unsure (1)..(417): unsure at all n locations
  Clone ID: PAT_TA_11299
gggccgaagcggccttcgccgtcctcctgaaatccgtggggctgttgttggtcgtcgacgaggtcgtgctgcacccatggcggagggtgctattggtggccgtctacccgatgatcagttagtgcatggtggtcgtcatcccgctggctccgcacctgctggggctacagctcagagttcgtcggctggtgaattgcgccgtcggcgctgagagatttgtttagaaaagcgtcatgttgattttgttgccggtgagttgacgcgactacatctgtttaggaaaatgcttcggtgatctgcgagtgcatgcatgcatgcaactgtgtaggtttgatgtgactgcgtgcatgtnctgtggtccgggcttcccccgtggattgcattagtatccactatgtttgtggtctaaaaaaaaaa

SEQ ID NO: 11300 - DNA, 718 bp, Triticum aestivum
  Clone ID: PAT_TA_11300
cacgaggccgaggtgaattttccgcctgtaccaccagtatggccgacaggaaagtagttctactcgattctggaagcgagaaggaagtggaggttggtgcagatggcatgatccagctatctaggtgtgtcgcttccgtcgaattcaccggagagctgaaggtttgtgtggttgcatggtggcaaggcgaggtgaaacccaagaaagcttggaaggttttcaagcccaagaaagctggtaggaactatggcaccttcaatcttggccgcgcgtgtaaggtgaaagtcaccgttgcctggtcgcttctttcctactatccggttaaccgccccaatagtccttacggttcactggctttactcagggaggcagagggacagagtactgtctagcagtgttagagttgtgatatacttctggtgcgccttgttccggcgttgcatgaacacatgaagtttagattgtactagtagtaatcatgtgttgtagtttcttcgaatcccatggccaactttgtgtggatgcgaagaagcgctatgggttgagttgcttggggggcgtccatcatgtgcagtgtcgactgtactgccaaacaggtcgtgtactttctgttggagtccctgggcctccccgctgtggatgcaaagcagcgctatggattgagttgctttggtggtgccaagttatccatcgtttgcatggacaagtgtggtgccaa

SEQ ID NO: 11301 - DNA, 1395 bp, Triticum aestivum
  unsure (1)..(1395): unsure at all n locations
  Clone ID: PAT_TA_11301
ccaccaaacagttcagcaagggaaaacatcatagctactggaaggacagggactatgtacagggcagtgctacctgatggttcttttcttgctgtcaaaacgctacaagattcacaacattctgaatcacagttcacttcagaaatgaagacacttggccaagtaaggaatcgcaacttggttcctcttcttggattttgcattgctaagaaggagaagttgttggtgtacaagcacacacccaaaggttcactctatgatcagttacacgaagaggggaaagattgcaagatggattggcctctgaggttaagaattggtattggtgcagcaaaaggtcttgcatatcttcaccacacttgcaatcctcgaatccttcaccgcaatataagctccaaatgcatcctcttggatgacgactatgaaccaaagatttcagattttgggcttgctaggcttatgaaccccctagacacccatctcagtacctttgtcaacggggaatttggagatattggttatgtggcaccagagtatgggagcacgctggtggccacgccgaagggtgacgtctacagcttcggagtggttctccttgagcttatcaccggtgagaggcctactcaggtttccactgctccagataacttcagggggaatctagtagagtggatcacctacctatccaacaattccattctccaagactcaatcgacaagtcgttgatagggaaggacaatgacagtgagctgatgcagttcctgaaagtcgcgtgttcttgcacagtcaccacggcgaaggagagacccaccatgtttgaggtttatcagctgcttagagccattggggagaagtatcatttctcggccggggacgacatgatgctgccacctctaagcacagatggagaaaccccggacgagctcattgtcgccatgtaatcacagattcatatgttgcagaaggcaagtatgaccgcaagcaaggcgttttccctgtatggtctttaatattttgtccatgagcattattaccatgcttcaagtggagtagcggtacgctgcacacaatgtatatatagttgttgtagcttggttctcttatccaccattggaaggtggtgctagtagcagcgaggataattttcatactacctatctaagaatggggtacctgttagttagctaactcttgagttactatgtgattatgccatattgggatttgcggtctgtggtgaacacccattatatggccttctggatttggcgaaggcggcgcttcctgaaggcgttgttttcgattattcgacgaagtacctttgtagngcatgtnttgccnangatgatggttaatgtngatcntggnagcgtgcncttttgcgtgtncatgtg

SEQ ID NO: 11302 - DNA, 171 bp, Triticum aestivum
  Clone ID: PAT_TA_11302
gttcttgccaggacagtcttcatgacttagttgtctggcaaaatgcccaagcgcactttgggtagtggtcgcaggtccattcgcgttacttgtcaaggctcttagtggtctatgtgtatcttgtaaatgtctattgttagttccgcaaataccaaaagctgaaaaaaaaaa

SEQ ID NO: 11303 - DNA, 990 bp, Triticum aestivum
  Clone ID: PAT_TA_11303
ttcggcacgaggccacacctgtgaagcgtggtcgacccttgcaaaccaaatcgcattccttccttgccatagcaccgagcgcgaccgtactcgcgccacaacgacaggatgagaatcgaaacctgctacttctgctcttcgcccgtatacccgtcaaagggcataacattcgtgcgcaatgatgccaaggctttccgcttctgcaaatcaaaatgccacaagaacttcaagatgaagcgcaacccccgcaagctcgcctggacaaagtctttccgtcgcgcgcacaacaaggaaatgaccgtcgactcgaccctcaccttcgctcagcgccgcaacgtgcccgtgcgatacaaccgcgatctcatccagaccaccctcaaggccatgggccgtgtatccgagatccggcagaggagagagcgcgccttctacaaggcccgcatgcgtggcaacaagcagagacagcgtgaggaggacaggaagttggttgaggagaaccagcatctgctgccgccgagcgagcgattcgccaaggaggaggttgagcaggaagacatggaggtcgacgtgcagaaggtcaaggagaaggttgcagcaaggaggaaggagctcgaggctgaggagagcgagctcagtgagcttgaggagacgacacccaagacgaggagcaagactaagaagatgatgatgaagaggaaggttggtggcggtgttgaggctatggatgttgacgagtaggactctgtcgcaccatccagatagtcttggagtttggcgtcccacattatggtagattacggacatgatttcgataccacagcaaaagcatgtttcaaccccaaaatagtgtcgttccagttttgtgcactggtagagataagatggggtcgctatggcttacatctggactctggaatgcagatcatgactcggcctagagggtagatttcatcagaacacgtacaacattaaacaaagactcagtacaca

SEQ ID NO: 11304 - DNA, 1306 bp, Triticum aestivum
  Clone ID: PAT_TA_11304
ccccgcgcccgggagacgccgagcccagcaagtacaggcaagagcttgctgctgcatctcagaagctgctgcaggagaagtccaccaacagtgcagaggtgggtaagctgcaagagactatccggatcagcagtcgcgagctggaaaaagtttctgaagagaaatctctggtggagcagcaggtgaaggagctggaggaggcgaacgccgaccccgttcggctgcggccggagctcctccagcccgccctcaccctccccgaggacggggcctggctcggcgccgcggtccggacctggcagcagggctgcgggggccgggggccgtggctcgaccgcctcgctgcaccggagacgccgcgggctcgcgggtgcgcgcatcgcggccgtcccgtggcgcctggacgcagccgcgtcgctcccccggttcgacccggggtccccggggtgccattgcgattataaggaaaatggaaatggcgccgatcatgctaccaaaattagagacattgatgcaacaggctcgtgtcaactaaggagaagctacaatcttcacaagtggtagatcaacaatcttgagcgctggctcgaagtcgctgcaattttgtcagaagagcactccaggctgctggaacaaaacaagggactggaagctgaaattgtgagtctgaaggaagagatgacttcagctagacggcgtttcaacgacaaaatatccgagagtgatgccgagatcagccagtacaggcaagagcttgccaccgcgtccgagaagctgttgcaggagaagtccaccaacagcacagaggtaggaaagctgcaagaaatgaaccggatcaccagtctcaagctgggagaaagtttctgaagagaatctctagtggaggaccaggtgaaggagctggaggaggcgaacgcccgaagccgaaaggcagagcagactcgtccatgccgccgaaatgctgtcggaggacaagttcagacatgaagctgagatcctgacgatgcagcacagcaccgaggacctgaagccgaaacttgagagcatcgcaagagagaaatcgctgctgaaactctggttcgcggatctggggcgcgtcgtggagcgaggaaggagcgttgtcattcccccgggataacccggtttcgtctggaaaattcagtagctagaatttcgcctactagccgtcccttctctttggcttttgggcctgagatgtaacatcatacggaactgtgaaaccctaccgtggacatcagcttttccttttcttggattatttcttgcactgtgaggtgatgggtgg

SEQ ID NO: 11305 - DNA, 632 bp, Triticum aestivum
  Clone ID: PAT_TA_11305
ttacaatcagcacttggcaaaacgccttctatctgggaaaactagttctgatgaggctgagaggaacatgcttgtgaagctgaagacagaatgtggctaccagtttacgtcaaagctggaaagcatgttcactgatttgaggacgtctcaggatacaatgcaaagtttctatgccaatctcgcgggtgacagtgatggcccaacaatatctgtccagatactcaccactggatcctggccaacacaaccatgcgctacctgcaatctttcacctgagatccttggtgtttctgagcagttccgggcacactaccttggcacgcacaatggcaggagactgacatggcagacaaatatggggaatgcagatatcaaggcaacatttggagaacgcaagcatgagctgaatgtctcaacttaccagatgtgtgtcctgatgctgtttaactcgacagacagtttgacctacaaggaaatagagcaggccacagccataccacctgttgatctgaagcgctgcctccagtctctcgcctgtgtgaagggcaagaacgtgctgcggaaggagcccatgagcaaggacatattcgacagcgacgcttttcactttaacgacaagttcaacagcaagt

SEQ ID NO: 11306 - DNA, 1698 bp, Triticum aestivum
  Clone ID: PAT_TA_11306
cggctccaggtgtccacggcggtgtggcccagcagtgcatcgagcgttgcgactgtggtgagtacctgaagaatgccgagaagcggcttgctgaggaatctgaacgtgtttcgctgtatatggacgccaaaactgcagacaagatagctaatgttgtggacaaagagctgctctcgattcacatgcagaggttgtttcttatggagaattctggtcttgtgaatatgctcattaatgaccagcatgaagacctgaccaggatgtatggcgtgtgcagacgtctccccgacgggcggagaccgcaagcatgagctgaatgtctcaacttaccagatgtgtgtcctgatgctgttcaactcaacagatgctttgacctacatggaaattgagcagaacacagccttaccacctgttgatctgaagcgctgcctccagtctcttgcctgtgtgaagggcaagaacgtgctgcggaaggagcccatgagcaaggacatatccgacagcgacgctttccacttcaatgacaagttcagcagcaagttggtgaaggtgaagattggcacggtggttgcacagaaggagtctgagccggagaagcaggagacccgccacagggtcgaggaggaccggaagccccagatcgaggcggccatcgtgaggatcatgaagtccaggagggtcctggaccacaacagcatagtgacggaggtgacgaagcagctccaggcgcgcttcctgcccaacccggtggtgatcaagaagaggatcgagtccctgatcgagcgcgagttcctggagagggacaaggtagataggaagctctaccgctatctcgcgtaattaggttttcttttgctgtcgaaacattagacgtccagtgtccatgaatgaagaaaaaacatgtcgcgtcggttccgttgacttggatcttggctgtagttctgctgcagagtcgtggtggcttggaaacttccggtctgccatctttggtacataatatagaaccatcttatatctcagaatgcagacctcaaggcaacggttggagagcgcaagcatgagctgaatgtctcaacttaccagatgtgtgtcttgatgctatttaactcaacagatagtttgacctacaaggaaattgagcaggccacagccataccaccagttgatctgaagagctgcctccagtctcttgcctgtgtgaagggcaagaacgtgctgcgcaaggagcccatgagcaaggacatatccgacagcgacgctttccacttcaacgacaagttcagcagcaagttggtgaaggtgaagattggcacggtggtcgctcagaaggagtcagagccagagaagcaggagacccggcacagggtcgaggaggaccggaagccccagatcgaggcggccatcgtgaggatcatgaagtcgaggagggtcctggaccacaacagcatagtgacggaggtgacgaagcagctccaggcgcgcttcctgccgaacccggtggtgatcaagaagaggatcgagtccctgatcgagcgcgagttcctggagagggacaaggtagataggaagctctaccgctatctcgcgtaattagattttcttttgctgtcaaaacattagacgtccagtgtccatgaatgaacaagaaacatgtcgtgtcggtaccggtgacttggatcttggctgtagttctgctgc

SEQ ID NO: 11307 - DNA, 323 bp, Triticum aestivum
  Clone ID: PAT_TA_11307
gctcctgcgggaggtggtggaggaggcaagggcgtcgccgatgcggtggccgcggccgccgagatgaatgagaggaggatgacgcgcacgcggcaggcttaggctagcagaagatcgtgcgtggcactgtaaataccttgtactgcgtagttccacttccaccacgcatatacgtacgtaacgtacttctctattcgtgttgtaatctacagcgtactgtacgctttttcagtagtattatgtacatcgttgtgatcggaccgggtcggagaggcaccgactccgactgatagtcgcaacgaaggctttatataaaaaaaaaa

SEQ ID NO: 11308 - DNA, 1183 bp, Triticum aestivum
  Clone ID: PAT_TA_11308
gcacggtggtgatttttgcggcagctcgtgcaactcatgggactggtgatgggagcacaatagtgatttcttgctctgaagcaactgatatcaaaatatggcatatgacagagtggcaaagagttgggaacagttgacactaatcagttgaaaaacaacatggctgacatatccccaaatggccgcttcattgctgctgcagctttcactgctgatgtcaaggtgtgggagattgtttattcgaaggatagttcagtgaaggaggttaacagggtcatgcagctcaagggtcacaagagtgctgttactagtttgtgtttcactccggattctgagaagattattactgcgtcgaaagatggtaccatccgggtatggaatatcaatgtaaggtatcaccttgatgaggatcccaaaaccttgagagttttgccagtccctctgcatgattcaaaaggctctacttgcctgtatgaacacatgggcatctccccagatggtaaagttctggctgtaacaagcggatcgacgttgcaatggttatgtgcagaaactggcgcggttttggatacagctgagaaggctcatgaaggtgctatttctggcattgcgtgggctccacggacaattccaaatggtggtgctcctgcgtacattctggcgacttgtggggatgacaaaaaggtgaaactgtggttagctccggaggtgagctcgacatgagcgtcttctgctagatagcttccctgaggaaacaaaaagaaacaagggaagattaaaacttcagtgttggcagttgggttcctttgagcttgagagtagcccagagccctgggtggcgagagttttacagaaaaagagacatagcgtgttgtgtaaacgtgcattgtgctggtagtttctcttgtctgtgaatctgttgttttctggaggtaactaaaagtatttttgcggcggttctttgaactgtagactagacatagtagtccgtgcgactataagctatgatctgctgcaaacccatagtttctatgagttgcggtgttttcaaaatgttgggtgcatagattagtattgatatatttgctgggtggcattgctaaacccatagtgtcgaatccaacatggtatcaaatcttggtgtttgttgctcctgttgaaaataactagactgcccgctgag

SEQ ID NO: 11309 - DNA, 394 bp, Triticum aestivum
  unsure (1)..(394): unsure at all n locations
  Clone ID: PAT_TA_11309
gtgccagatgtgtccctgctgcccgaaatccaggttggctctgtcgatggggaagctggcatgtatggagatctctccccccatgccacagcttgtcggttgccgttgcctgtcgtgccagttgcttctaggagtgaagtcattgtcgaggttgtggctnctggtgctgcagattatgcctgagcttcagaagctnctgtggggagaccacttcgcctatttcgatggtgcttcctgaggagatggggtctncttagaggggacttggcgatgccgaccgcgacctcatcgtncttcgttggagccgagtcaggcgctcgcctttgtggaccttggaggtttggttgttgttgctgctctctcagctgagcttgttggcccggtnaaaaaaaaa

SEQ ID NO: 11310 - DNA, 768 bp, Triticum aestivum
  unsure (1)..(768): unsure at all n locations
  Clone ID: PAT_TA_11310
cttcgtcccaacatcttggttttaaatactatactcttcctcctactcaacccgataaacaaaacaacatgcggccatccgtagccacagtaatcctttcatttgctcttactatccttgcggcgcctgtctcaagtgctgaagcttctctcgaaagcatctcatctgctagcgcaagccatcgacggaatgcaattcctgtggctctaatcgagccactgggggcacgcagtcaacgagtcaacactggcactggacgtggaggacggtcgatcgtagttgaagacgaggagatcgaggcacgatcccaacgggtcaacactggtactgggcgtggggggcgatcggtcgtagtcgagaatgaagctttggaggcaaggactcaaagagtcaacactggcactggtcgcggaggaagatcggttgtagtcgaggcacctgttgaagcacgaagccaacgtgtcaacaccggtaccggtcgcgggggaaggtcggtcgaaatcgaggcacctgttgaagcacgaggccaacggatcaacactggtactggccgtggaagatccatcgcagtcgaggcacctgttgaagcacgaggccaacgcgtcaacacaagcaccggtcgtgggcgtcgattagctaaggctgaggctgaagcgtttgaataggtgtctcttctttnctatgtagcttcttttncttattggtactgtagntncttgagccctgctggattacagggcgnatagatatcggtaacgcgagtagtat

SEQ ID NO: 11311 - DNA, 983 bp, Triticum aestivum
  unsure (1)..(983): unsure at all n locations
  Clone ID: PAT_TA_11311
gcatcaaagaattcatttcagnaggttgtcagcataggacgtctccagcaccgcaatctagcgccattgcttggctactgcagacggagaggtgaactgtttctggtgtacaagtacatgccaaacgggagcgttgacaagtacttgcacggtagagaaggcaaaccaattttgaattgggctcagaggtggcatattgtcaaaggcattgcatcatgcttggtctaccttcatgaagagtgggagaaagtggtcatccaccgggacatcaaagccagtaacgtcctcctcgatggcgacatgaatggaagactcggtgactttggcctcgcaaggctgtacgaccacgacaccgacccgcaaaccacacacatggtgggaaccataggatacctcgctcctgagctagggcatactagcaaagcgacacctctcaccgacgtgtttgcctttggagtgtttattcttgaagttacttgtgggcagaggcctgtcaatccaaacttagaggatagccaagtattgttggtcgaatcggtgctcgatcaatggaacaagggatcgctccttgatcccgtggataagcagcttgggggcaactacaacgccgacgaggcatgtgtggctctaaagctaggcctgctatgctctcacccattcgccaatgcaaggcctaccatgcggcaggtgatgcagtaccttgatggcgacatgccattgccggagatgtcaccgacggatttaagctttcagatgatgaccataatgcagaatggaggatttgatcaattcatcatgacgtatccttcatcaacagcgcgtattgacagcacatccgtccttacagttgggaggtgaattgcatgatcctcactgtgatatgtgacttgagtcattctgccttncttagtgcccggttaattcgagcttgtgttncttttgcttgtcacttttgtacgatgtttttttcgaaaaggaggaat

SEQ ID NO: 11312 - DNA, 1188 bp, Triticum aestivum
  unsure (1)..(1188): unsure at all n locations
  Clone ID: PAT_TA_11312
cgggctgaggaattcggcacgaggctgagatttttaacagggaggaggcagccttggtccttccgatgtttgaaggggcatcagaaacggggaagataaaaagatctgctctgaaaaattgggtggtaagcgcatacctggaccgcaagtcactggcgcattctctgaatgacacaaaaactgcagttagccaacttcacagcctcatcagaattctagtactcattataatcatcattatcactctgttgttgatgggcatcgccacgaccaagatccttgttgtcatctcatcccagcttctagttgtggtcttcatatttggaaatgcctgcaagactgtatttgaggccctcatatttgttttcatcatgcatccgtttgatgttggggaccgctgtgtcattgatggaatacagatggttgtcgaagaaatgaatatattaaccactgttttcctgaagaatgacaatgagaaggtatattatccaaactctgcgttgtccacaatgccaatcagcaacttctaccgaagccctgacatgtatgacaccatcgactttgctattgatgttaaaacatcaatggagagcatcgcagctttgaaagccagaattaaagggtacttggagagcaaacctacacgctggcacccgatccacacggtaaacctgaaggacatcttggacgtgaacaagatcaacatggctctgtgcgcccagcacacgatgaacttccagaatatccgggagaagagcatcaggaggtctgagcttgtgatggagctaaagaagatattcgaggagatgtccgtcagctaccaacttctgcctcaaaaggtcgagcttagctatgtcggcacaaacccgctgcccgtgaatgtctctcaaggcaggtaggaagcgtggcgaagattaacaactgatgatgccacggaaattgacgactgatggctagtttagttatgcagtttgtaccggagcttttatcatccctgtacatgctttgcgtttgcgagttgcgattgtctgtactggatcactggataattatgtgtcagcgtcagcagcgtatgggttgaactaagaatttggaccaagtattgtcgctcatcgtgggtcgcgatggggaagttaaggatggacttagtattattacatctcatncttgttataacatttgggatca

SEQ ID NO: 11313 - DNA, 706 bp, Triticum aestivum
  Clone ID: PAT_TA_11313
ggctgcggcgcgccgcccgatcccctccccggccctcccgcctcgcggcctcgccctcgcccccgcagcctcgcccacggccccgcctcgcggcagcagtgggcgggcgggggggccggcggctcggggccagccgtgttcttcccccgtgctggcgcccggggccgacgccgacctgcacgcacccacgccaccgccgtcgcctcgagtgcgcagtgggcgggtggagggggcgccgccgcctcgggcgctggggcccgacctgcccgcctgggtcatggcccgcctgcccgacgggcgctgcatccttgcgtctgactagtcggcctcctgcccggcgcacttgtcatggtttcgcctcctcccccatcttcccgcctgggtgtcatccccaccttccttgccaggctctcgcgcgggcgccccccctcctctcccatgggcgctctctcttttcacgcctgccgtcgccccatggaagcattggaagcgaaaaaaacccttcacatacctaaatgtaagtgaatctccccgtcttaatttaggttgaccttgcagtctcgcttacccgttctgcttcgcccatcgttcaatgtagtttatgttgaatagctaggttggtccatgagatcatatattgtactaccgtttatttaacccaactgctacattgaatattgataatctgaacacaaaatgttgcaat

SEQ ID NO: 11314 - DNA, 681 bp, Triticum aestivum
  unsure (1)..(681): unsure at all n locations
  Clone ID: PAT_TA_11314
ggtcgacccacgcgtccggtttgaggaagaatgtactgcaagtattcaacagnagtccacgccagttcccagaagaaatacctggtatgtcatacaatcactctgaaaggcaacatgaattcttctggggggaacaacagagcagtagctacatgaaggctgtttgcgaggtgcagcacccggcaacaccgtctccaagatcagcggtggtggattccaagatgccacaacaagtcttggagtcgctgttcaaaatacctgaaagacgcacatacgagccaagtaaaatggactggaagaaggtagtgaagaagctgcagtcatacaatcatcccatcacagcaagcaatcaagaaagaccaaaaaatggggatgggtatcgagagttccgtggtgtttctgctaggcattatgatacgatgaaagggtactatcagaaagctgctgtggcatattccaaaggagataaatcttatgcctcgtaccttgcagaggagggaaaacattatcgggaattgggtcacaaggaagatgagaaggccagcagggagatatttgaagccagaaacaagcatataacaaacacggngactattgacttgcatggncaacatgtcaagcaagctatgaagctccttnaaagntcacatgctggnttgngnatgcatgccatctaccctt

SEQ ID NO: 11315 - DNA, 280 bp, Triticum aestivum
  Clone ID: PAT_TA_11315
caacgtcaacaacatcatcccttccgccttccgccctctctccgccctccggactcctggccctccaccaccaccacacgacaaccacgctatacactcatatacaccatcacatagctgccgttgccgcgtcctgatttgatgtgatactgagagctcgctgctggccatcccgatatccgcccgacagctagcccgagtacccactcgtcctcattcctcacctcacttcagccagaccacctgcgccgcaatagcttgctcacgcagacatttgatg

SEQ ID NO: 11316 - DNA, 1059 bp, Triticum aestivum
  Clone ID: PAT_TA_11316
cagtctgtcttagcgaggcagtgtggcctcccacccgtattcctccaatgctgcttgcctgtgaggcacttaaggatgtccttcctcttatagaaaagcttccttccagtgaatctggtgactgcctttccaatattttgcacaacatgagagaggctttcaggagattaatggaccataccaagcaccacatagaatccaatatgaaaacgcatcaggatgacattattcatccaatgacatgtttcctcatatgctcagtgagatccctccgcagtcacagaaatttagtgcaatccactcttgcccctggtgatgactccaactcatttggccatcttctgcatgacgtgattacctgctggaaatctggtctcactgagtatgcaaacatatatcacgcagatgtgcagcagcgatgcattttcctattgaacaacagagaccattttaataggaagacagatggcctgttgaatgagttgctatctgattggcagattgttgagcagtatgataatgagttcaagttactcttgattaagagatatacagatgaggcctgcgctccggccaagtcttgtttaaatcgcagctgctggtggtggtggggcagtcagcgtccatccttagacgcgtttacttcgaaattcaacgagacttttgatagtcagagaacttggaaggttcccgatgttgccctacggcaggatctgagagatagcatagaggagtgcatcctgtcagactacacaaggtgtctcgagaactgttcaagttcggggctgttttgttcatgcttgcagatagattcagcaggggagatatataccactgagaacttacaaacaacggtgcagagcttatttgaaggttgctgacgtcctaggtttttttcctccctttatctccccttcgctgcgaggaagtagttccctttctccttgttgtaacaattgtgcatagttgtgcttgtatagttgagattaccagaagaacaatacgtatagcagcattttttggcaccacaaaccccattgttagttgtgccaacctagg

SEQ ID NO: 11317 - DNA, 731 bp, Triticum aestivum
  unsure (1)..(731): unsure at all n locations
  Clone ID: PAT_TA_11317
acagcactgccgacaagnacacctgctcgtccgattgttacgacaagccactcagcgcccactctcacctagcccgccgccatgctggtcctattctccctcttgaccctcctgggcaccctctcgagctttacctctgccaccgccctcacctacaagctcacgcctaatgagaaagagtgcttctacacacatgtcgtcaagcagggcgccaaagtagccttctacttcgccgtgcaaagcggtggatcgttcgacattgactactctgtcaccggaccttcaaaggaggctggcaaggagaaggttatcctggaaggcgaaaaggagcgccagggtgattacgtcttcaccgcgaacttccctggcgaataccgcttctgcttcgacaactccgtctcgactttcacggacaagcttgtcgactttgagatttcggtcgaagacgagccccgcgccaacctcccccagaaatccggcgcatcccccgagcagctcagcggcgtggaagagacgatcctcaaggtgtcgagccagatctccaccctcacgcgccagcagaagtacttccgcacgcgcgagaacaggaacttcagcactgtcaggagcacggagaagagggtgttcaacttcagcttgctggagggcgctgtgatggtcggcatggcttgcttgcaggtgtttgtcgtgaggatgttcttcacggcggtctaagggnatatgtgtaaact

SEQ ID NO: 11318 - DNA, 738 bp, Triticum aestivum
  unsure (1)..(738): unsure at all n locations
  Clone ID: PAT_TA_11318
tcttcggcagcacccacttcgtctccaagcgcctgcagcccgacctctccannaccgagctcttcaccctgctgtggttcatcctctccggctgcatccacatcttcttcgaaggatactacgtcatgaacgtccttgacattggcacacaccagacgtggattggacaaatgtggaaagagtacgcgttctcggacagccgctacctcacgcagaacgcctttgtgctgtgcatggagagcattactgcgatcgcctggggaccgggatgcttgcttgttgcggccatggttctcacccgtcacccgttgaggttccctctgcagggtctggtcagtcttggccaggtctacggcgacgttctttactacggaaccgcctactttgagcacattgtctacggcttgagctactccaggcccgagcctttctacttctacttctacttcattttcatgaacgccatctgggatggtcatccctggagccctgatctaccaaagcgtcgcccgatctgcaagcgccttggccaccgtgcagcgtcttgaagcctccaagaagatgaagtgaacgtcacgcaattttcgaaataaagttacacgcatggaaaggaaggagcggacaccgattcattgtttggcgcattgtttggccatgagcaagcccatggatgggctcgagatctactcgtgagcctgaaattcagcgncggcgctgtggacaatcggttttcccaag

SEQ ID NO: 11319 - DNA, 976 bp, Triticum aestivum
  unsure (1)..(976): unsure at all n locations
  Clone ID: PAT_TA_11319
actgtcagtggtgatctatctgctatccgcagttcccggggcggcccgcgcccccggatatgccagaagtatattgagtgtcctgcgcttttccaaggaagaaagtttgaccttcggtacattgttttggtccgcagtatatgccctttggatatacttctttgtgatgttttttgggtcaggttagcaaacaatcagtacactttggagaaaactagcctttttgagtacgagacccatttcactgtgatgaactataacggaaggatgaaccatatgaatactccagagttcgtcaaggcgtttgagaaggagcaccaagttaaatggctggagattcatgaaagcatacgtattatgataaggcgtgtctttgagtcagcctcagctgtccatcctgagatgcagaactcattctgtcgggccatctatggtgttgatgttatgcttgatgataaattcaagccaaagattttggaggtgacatattgcccggactgcacgagggcgtgccagtatgacacacaagctctcgttggaagccagggccccatcaaaggcagtgattttttcaacacggtgtttggctgcctctttctcgatgatttgacgaatgtgtcaccactgtaatcatcttgtcaagagctgtttccccctcgaatgccaagagctgttgtaacaccaatgtccttgcatcatgatatgatcaagggttcttgtacgcttatgcatcaacgaactgcatttgtgtcaggatagaaactctgatatgatcatgtattcatgtgaatgaagcttaagatgggatttgcttgtgttacttgataaatattgctgcttnctgatactaatgttgcatgcatatgagattgaactatatcaagtagcaaattattacaatgccatgccattgcaagagtattgcaatagtttaccggggtaaaaaaaaaaaaaaaaaaaaaaaaaaaaaaaaaaa

SEQ ID NO: 11320 - DNA, 589 bp, Triticum aestivum
  unsure (1)..(589): unsure at all n locations
  Clone ID: PAT_TA_11320
gccgagctggtcaaggaggtggttggattccaggggaagctagtgtgggactcgaccaagccggacggcacgccgaggaagctcatggatagctccaagatacatgggatggggtggaagcccaaggttcccctcaaggaggggcttgtcgagacatacaagtggtatgtggagaatgtcatcgccgacaagaagtaatggggtggtatcatgttctcctttgcctcttaaagtttgtatcttgatatcatgatcaatagtgtgtctattcttgttggatactggatcacacaagtaccaggtattagtgcaccaaagaaaagaggttgctacgtgttggttgaataatatattggtcaaattagtgtaccattagaatcttaattcatgctgagcatgttcttttattacagaaagtgtaacactttatacattggatggtaactggcctacactcgttctttgccaattcagcatgaaacagatattgaagagttcgcatgcttcaaatncctttaattgtacctctaacaaaagnnaaaaaaaacncaggggggccggtacaaatccccaanggagnccttancgc

SEQ ID NO: 11321 - DNA, 1131 bp, Triticum aestivum
  unsure (1)..(1131): unsure at all n locations
  Clone ID: PAT_TA_11321
gggcagcgcactagagccgctcccccgcctcaccttaccgccggcctgtatgccaccacccggcccccatatctccgtcggaaccccatctcctcttcgcgtggctgacgtgcggtcgcacgcaggagtatggaaagtagtgcgtctaggccgtgacggcgtgtcgttcccgtcgccgttggcgtgggcccttgcaagagggttaggcggcgctgtggtggagggtactacgccggaatgggaaggccacggtccggtgctctgggctaccgcgagagcagctttggctgggagggatactgctcaggcgtttggtgcggcggcagggtgcgcagctcgcacatccagtttggcggcagggcgttggcacagcgccaccggcgccgaggcatgcgaagaacaagacggcaacaccgcgggccgcctcggcccacatcgtagtcgtccacctcgacatcccggcgtacgctcatgaaccgtcacgctcgccgtcgcggatgttgaggccccggggccgccgagggcgcggccgcgccgggggcgctcccccgggcggccccctcccccgggccccccccttactttgatcctcctcctctgttggccgtctcacttagcacgcggccatgctctagcgcaattggctgatacgaccacgtgttgccgccccggccgagtgttaccgcgagctcctccgccgggtgccctccccttccttgcctgaagaaaagcagttgcagctcacagaagacggcatgttgaccacgccgacaaagaaggttggatgttgcggagcaggcgatgtcgaggcccgtttggctgatgtgtatggtcgttcgcccgcccctccgggttctcagccagaggttgtcacttctggggcttctctctcgcccctttctgtttctccttattctgcttcgtgggcttctagtcccccctcgtgctcatggcctcaagtgcggtgggtccatcagatgtcgccgttctttccgtgcgcgtgaggtcggcggtttaccgcctggaacaatttgcatcttgacccgggagccaaacttcacaggaaaaaaaaaaaaaaaaaaaaaaaaccggtccagattacctaatnattcttctttgtcaatcggatcc

SEQ ID NO: 11322 - DNA, 514 bp, Triticum aestivum
  unsure (1)..(514): unsure at all n locations
  Clone ID: PAT_TA_11322
gctggccgttccgccatcgccgatgttgtcgctcgcgagtacaccatccacctgcacaagcgtgtccacggtgtttccttcaagnaagcgcgctccccgcgccatcaaggnagatcaaggctttcgctgagnaacgccatgggcactcgcgacgtccgcctcgacccccagctgaacaagaaggtctgggagtgcggtatcaagggtgttcccttccgtctccgcgtccgcatctcgcgcaagcgtaacgacgaggagggcgccaaggagaagctctactcctacgtccaggccgtcaacgtcaaggaccccaagggtctccagaccaccgttgtcgaggacgcataagcgtatcgccacggcatgctggattgaacttgattgttttcacaaaagggggcgctggtcaatggattgggaatgaacaactgttttacattttttactgagctgggatgcatcggtttacggccataaaccatcgagtcacgacatggcgggaaaagcaaagtac

SEQ ID NO: 11323 - DNA, 243 bp, Triticum aestivum
  unsure (1)..(243): unsure at all n locations
  Clone ID: PAT_TA_11323
acgccgggcggcgtggcggaggcggtgaccacggcggcgcggctcaaccaggnagcgcccgtaggcgtagcgcctctcctccctctccatctagactcgtacagcgagcgtacgcccgaggtggcaggcagcggttcttggttggtactttgtacgaataaaatggtgtgctcgtctagtcgtttttttttttctttttttgacgngctcgtntagtcgtttnttgtatanaatggaagtatg

SEQ ID NO: 11324 - DNA, 457 bp, Triticum aestivum
  Clone ID: PAT_TA_11324
ggcaacaccaccgcgactaagtacactaccgcaatcatgggtgtcccattcgaggctctgctgccctacgccattatgacgggcttcttcgcattcagcgccgtgtctgtcggaaagctcaaggagatgcagaacggaggaaagaagacaaggaggggtatcgatgcatgggacaggcaaatgatggagcgcgaccgccgactgaccggattcatgcgcggacagacagacaagccggttgctccggaaggcttcgagctcaacaacccatggaggtgcgagcaacgattcatctaagcgatgcgagcttctcccgcgtcgaaagcggaactggcatacctacacagtatattacatacccaatagtgactacatcgtgctgcgaaaggatcacagcatatacggcagttgtagggacatgcaagcaatcaacaattctcaacgttcaaaaaaaaaa

SEQ ID NO: 11325 - DNA, 633 bp, Triticum aestivum
  unsure (1)..(633): unsure at all n locations
  Clone ID: PAT_TA_11325
cccattgaacgttcttgctctcatacactcaacatcctggtttccttgtacttctttttcagaatctttgcaaaagaaaaagtataaattaccgcttatttagtagcttcccttgttcacatagtagtttgccacaaagtacttctaccacgtcgtctaaagaacaaacctcctactacgtacagtacacatatgtgtcggtgaaacaccctctaatccaaccaaactcagtagccggtgtccacagggaaagcgtacggcaggtcgttggccaccggcacgtcgctgaaaccgtcgcctccggtgtagaaaccagtgaagtcgaccctgggttctcgcacgaaggcctcctgccggttgatgccgcaggacagcccgtcgccgtcgacgcgcatcttcttcttgcccacctggacctccccgtcgagaagcaaccgcggcctcttggcctccgcgccctcgccggggaacaatccgccgccgcagctcgagttgcctacgaggcggcgcagcacgtcggggtctccgacgaccttgaggaggaaggcgagcatcagcttgggccgacgctcggcgtcctgcacccggcgccgcatcgacgccaagcggtccccgcgggccctctgctcctnc

SEQ ID NO: 11326 - DNA, 801 bp, Triticum aestivum
  Clone ID: PAT_TA_11326
ggaattcggtccggggtggcgttcgtcgccgtcgccggcgtcttcttcctcacccttcacctctacctcgcgcccctcctctacctctgctccagctagcgacggacgccatgatgttgtcctggctgtggctctgtcgtggttgttaggcggcggtttgtggttggccgattcgtgcttgtctccggaagaaatcctctttctggtcttaagccggatccggcgaaggcgacggcgacacgcgcgggcgtcgtactctttcctggaagcatcgtccggaagctgtgctccttccctctcctcacgtccatgtcttcggaagttgtgctccttccctctcccatggccgccacagcttcggaggggaacttagatccgttgtatcgtctcgaagcagcggcctcttgcccgcgtgctttgctgaggtgttggcttcttttggcgacgatgatggcgtcaggaggagttagggtcgaggctcggcttcgatagccggattagcgtgtttgatgtgcttttacgtggtttgctttattgttgccaaatcggaaatgcggttgggcaagtccaggtagaggtagtgacgatgacatttgatcgtctgcggagggcttgcttgctctgaaccctgcatatttcccttgtgatttgtgatactcgtcgttaaagttgtagtggtttttttgccatggcccataagccgagagtccctgtcggacgcccatgtgcgtcaagaagctctggcttcacacagggtccatccaactgggccggcccaattacagttccaataaaaaacaa

SEQ ID NO: 11327 - DNA, 615 bp, Triticum aestivum
  unsure (1)..(615): unsure at all n locations
  Clone ID: PAT_TA_11327
aaatgggacccaaggccgtatccaagacccctaccaagactggcaagcaggccaatgctgctgctaaggccgctctccgtggctcgtatgcgaacaagaagcgcgcgatcaggaagaacaccagcttccaccgccccaagaccctcgagctgtcccgcgccggcaagtaccctcgcaagtcggtcccccatgccccccgcatggacgctgagaaggttctcatccaccctctcaacaccgagtccgccatgaagaagattgaggagaacaacaccctcgtcttcatctgcaacgtcaaggccaacaagcgtcaaatcgccgccgctctcaaagaagcagtacgacgtcagctgcgtcaagatcaacaccctgatccgccccgacggctcaaagaaggctttctgccgcctcaccgccgatgtcgacgctctcgacattgcggctaccaagctcgccatcgtttaaagaggtggtctctgtaaaaagggaaggcatggttatgatggggtctggttatacccggcaattgaaaagcgatgtgatatgcatggcgggcgttcatgggataaacgtagtcacggtgactcgaanaatcagatttccacanacgccaag

SEQ ID NO: 11328 - DNA, 423 bp, Triticum aestivum
  Clone ID: PAT_TA_11328
ggcgaagtggacgggaggcgcgctcacccactcgcggtactggcccgtccacgagtaggcctcctccggccaagtgggtggaggcggggagcgcttacgcgtcggcttcggctccagctccggcttgggctggacgggcggcgacggtggcggtggcggcacgaagagccggggtgtggacggagtcccccgccgccgacagggcaagggcttgctccagcccatcccagtgcgcgtcctcctcgaggcggctagcctccagcgcgtgctgcagggcctcctcgagggcggcttggtactccgcctccgcctccatgtcctccggctctacctgcgccggcggcggtgggccacgtgaagtttggacggcacagaggtgaagtttgcggtggcggaactgactgtgccgcttcaaaaaaaaaa

SEQ ID NO: 11329 - DNA, 441 bp, Triticum aestivum
  Clone ID: PAT_TA_11329
cgaccccgcgtccgcgtctccgtcccaagataggagcccagcacaaactcccacgatcattctcttccagaacttagagacaaaaatgaagatcagttagaggagggttttccaattcctactcgcctcgcgcttccagtagttagcgcattgttccttctgctccgtcgtttcttccgtcccgcagcccgcagcggttgcggcgaggttcttccattcgagaagatggcgctagctctgcggctcctcctcgcgctcctggcaattggatcctgcatagctgccgaccacgtcgacctgtggccgatgcccaagtcggtgtcccacgggacgcagaggctctacgtcagcaacaacgccaccatgtcgatggcgggaagcaagtattccgacggcaaggcgatcctcaaggacgccttccaaaggatgctcgatttgatg

SEQ ID NO: 11330 - DNA, 2004 bp, Triticum aestivum
  Clone ID: PAT_TA_11330
cgtccgcccacgcgtcccccgcgccgcccacccacccgcaacctgcggacccacctcgcatccccacggtcattctcttccagaacttagagacaaaaatgaagatcagttagaggagggttttccaattcctactcgcctcgcgcttccagtagttggcgcattgttccttctgctccgtcgcctcttccgtcccgcagcccgcagccgctgcggcgaggttcctccattcgagatgatggcgctagctctgcggctcctcatcgagctcctggaaaatggatcctgaaaagttgccgaccaagacgaactgtggccgatgcccaattcggtgttccacgcgacgcacaggcttcacgtcagcaacaacgccaccatgtcgatcgcgggaagcaacaattccgacggcaaggcgatcctgcaggatgccttccaaaggatgctcgatttgatgaagctcaaccacaacgctgacggtgcaaacccaagctccttcccgcttaccggtattaacatagtcgctcttccgacacaagatgaccctcggttccgaggtgctcgacgtatacaacctcactattccttcaatggcggagcccctgtatgcccagattaaggcgcaaataatgtattggagcacttcaagccttacattcatcaagcgcatcccgtgactttgcggtcacatccgattttaataccttcatacccgaaactgtggagctgttcatactcttattctgagagatacacaatgcctgatgccatcgacatcgtacgatatgctgaaaaaagaggtgtaaatgtcttggccgagattgatgttcctgggcatgctcgctcatggggtgttggctacccagaattgtggccatcagatagctgcagagaaccgcttgatgtcagtaacaactttaccttcaaagttattgatggtattctttcagattttagcaaggttttcaaattcaaatttgtccacttaggaggtgatgaagtcaatacaagctgctggactgaaacaccccacattaaggaatggttgaataataaccacatgaatgtgtcggatgcatacagatattttgtgttgagagcccaaaagatagcaatatcacatggatacgaagtcattaactgggaagaaacgtttaacaacttcggagataagttggaccgtaaaaccgtggtgcataactggcttgggggggatgtagcaccaaaagtggttgctgcagggctgagatgcatagtaagcaaccaggataagtggtacctagatcacttggatgccacatgggaaggattttacctgaatgaacccctgaaaggaatcaacaacacagaacagcaacggttggttattggtggtgaggtttgcatgtggggagagcaaatcgatgcatcggatattgaacaaactatttggccacgtgctgcagcagctgcagagagactgtggagtccacttgagcagatttctgaagacaccaggtcagccacatcaagactgtcacgcttcaggtgtttgctgaatcagagaggggtagctgctgcaccattagctggcgatggtcgtacagcaccatatgaacctggtccctgtgtaaggcaataggatattcatagcaaaatttgaagtagcattcaaagaggatacacatcattcacaagtgttagttcagcattatgaatctggagtagttatatggttgtgtagactatagaaggtttcagggagtccttaccctctttatgtatttctgcccctctccaattttcaactataatagtttgaatggtagggccatcaggagattaaacaaatctgacagaaaatggacataaaggttgcctgaacaaatccagtagggtcccaaatcaatggtactgtattacaaacaatcgaaataaataatatgtttattgaaaaaaaaaaaaaaggattaattggttaatggttatattaattatattttataatggggggggcgttttataggg

SEQ ID NO: 11331 - DNA, 667 bp, Triticum aestivum
  unsure (1)..(667): unsure at all n locations
  Clone ID: PAT_TA_11331
ttcggcacgaggcatgacccccgggctgcgcgactgggacctctggggcccgctcatcttctgcctgctgctgagcatgctgctcagcttcaacgccggggtcgaccagcgggacgaggtgttcagtggcgtgtttgccatggtgtggatcggggaggcggttgttacgctgcagatcaagctgctgggtggtaatatctcgttcgcgcagagcgtctgcatcatcgggtacacgctcttcccgatcgtcatcgccgccctcctgtccgcgctgcacctgccgcagatcccccggatcccggtctacctggtgctcgtcgcctggtcgatggcggctggcgttagcatcctcggcggcagcggcgttgtgaagaaccgggtcgggctcgcggtgtaccccctgtttgtcttctacctgggcctgggctgcctgtgcttcatcagctagacggaggggtacttgactgctggcggcgttgtgaggacaacctggcggggcttttagagaaaacgcgatggcaggtcacactggggttccacggttcattgcattgaagctggcgcaggcaggatgaacgggatttttcttttctggtcgttgagctacgatgtatttctagatatccaggtatgatgggcaggggccgctgaaagcacatnccggagg

SEQ ID NO: 11332 - DNA, 869 bp, Triticum aestivum
  Clone ID: PAT_TA_11332
ggctccggcgacgtcggctcctccctggcctgctgcgctgccccctcggcgcgcccacccggccgggcggcgtgcgcgccggcgtcggctgcgcccgcgccttctccgtcctccccccgggctcccgcccggcccggcggcagcgctcccgcatcggcgagccggcgcggtctgctcggcctccccccgggtgccctgccgggccggcagggtgcacgacagtggatcgcctctcagcctgctcggccgcccccctgggggcctgccgtgccggctgtgcgagcttcactcggcccgccgtcgcccggcggcgccggcccgcttcgtaccttgcgtgccggcgggccgagcttggcccggcgcagcggggcgccgcggccgcatcgtgggtcagtcccggtgggtatctgcgcgctcccgggccaggggcttcggacctccgcgctcgcgtctgttctggggggcggtcgatacctgcctgcccccgggccacagcctgggctccttcgctccggcctttgctctgtagtgaagttaaaaccaacaagcctcttttatacgcatgttcttcttctgtacgtacattatatgtcgtttagacgctcctagattctggatttctgatcagcctgaagcttatttctgtgagatgtatgtgctgctagtctccctaggctcttcggccccgtctggtgctcaagcccccgccctgttttgacgctgtcttgttaaagtactccatatgctatttctgtttcattgtggtttcagtaatggactcttgagtctgttttttttatgcgaataattgaatcagagtctcagaagctggacaattgtaacattttcttcatattttcataatatat

SEQ ID NO: 11333 - DNA, 817 bp, Triticum aestivum
  unsure (1)..(817): unsure at all n locations
  Clone ID: PAT_TA_11333
ttcggcacgagggtgccttggttagacacgtgggctgagtgggtgatgcatggactgccccgcacaaagtttggcgggttccaacacgagacgtacaactcgttcaacaaggatgaactatgggacgacacgcttatgatgagcgcactgcctctcgcaaagattggtcttacgctcaacagaccagaatatgtagaggaagcaaagcgccaattcatcctgcactgccagtacctctgcgacacatccacaggcctgttcttccacggctggaagtgggaggacaagggtggattggaggtcggccacaactttgcgcgtgcgcgatgggcgcgtggtaattcgtggttgacgattgcgattccggatttcattgagttgcttgacctcaaggagacagacccccttcgtcaattcctcatcggcatccttgaatcgcaatgtcaagcactgctgaagttgcaaggcgagaacggcatgtggcgcacacttcttgatattcctgtctcagaaggcagctacgaagaggcgtcggccacagcaggttttgcatacggtatgctcaaggcgtgccggaaacgatatattagcggagacgtatacctccagagcgcagtcaaggcgatcaaggccgtcatgggttgcatcagcgcggagggtgagctggagcagacaagttttggaactggtatgggacacgatttgcagcattacaaggatatcgccatcaccagtatgccatatggccaggctatggctatcatggcgctgggagagtttatgaggacttttatctaagagaggctatanaatacac

SEQ ID NO: 11334 - DNA, 741 bp, Triticum aestivum
  Clone ID: PAT_TA_11334
gcatccgatgctcgcctgtgctgcaagtgcgctccgcctgcgcccgcgccttgtgcctgccctgcgcgggcctcctcgggccgctcggcgccgtcctgccctccgccctgcggcatccgccttccgcctgcgcgctgggcctgcgccccgccggcgtaggccgcctcggcatccaatgctcgccggtgctgcaagtgcgatcagcctgggcactgggctagagactgcccatggcaggccacctcgtacggctcttctgcatccaaagctcacctgtgcagcaaatgcaatcagcctgggcactggtctagagactgtgcggtgcaggccgccttacacggctcttcagctggaaacggcaacggcagccttggtttctgcttcagatgtaatcagtttgggcactgtcccagtgactgcccagccccctactcttctgcaggtggtaacggcgggcgcgggtggtctgggcttcaaaaataatcagcctgtgcgcctcgctggactgtcccccctccagcggcaggctgcgccgcatcaggaggatgcctgtgttggtaatgtctgaagtattctgccgatcatatagcatcttgattcggcttagttgcacagtatgttaaatcaacctgctccgtgtggcttgctatcgttgttcacttgctacctacgtatgtatggacctttgtattagcactttattaagctttatataatcagcgtaccccaagtagtactaaa

SEQ ID NO: 11335 - DNA, 614 bp, Triticum aestivum
  unsure (1)..(614): unsure at all n locations
  Clone ID: PAT_TA_11335
tcttcactttctcatcactacaagcttccacagcacgcacatcaacccctcgcaaacatgtcctggcaagaatacgttgacaccagcctcgtcggcaccggcaacattcgacaaggccctcatctgcgacgtcgagggcgcaactgcctgggccgcatccgccgacttctcgctttccgctgaggagagggctgccatcgccaggtctttcggcgacaagtcagagcccaagaaggtcatctcggagggtgtcaaggtcaatggcgtaaaatacatgaccatcgaggcaagcgatgactcgctcaaggcaaagaagggcaaagagggcgttgtcgccttcaagaccacccaagccgtcattatcgcccaccaccccgacaccattcagacccccaacgccttcaactcagtagttgagctcggcgagtacctgaagaagcacggaatgtaaagcgccttcgattcgagactgtctgtactttagggatatttgcataaccagttgaggagcgatgaatggcatcatgggtgactgctcatggatatagatatgattgacgaggacgaaatagcgatattaaggatcctcttcgatacaanacaaactcaacccc

SEQ ID NO: 11336 - DNA, 849 bp, Triticum aestivum
  Clone ID: PAT_TA_11336
cgtccgcggccccgtggcgcctcagctcacgcatctctccctcagctccggcaagcaacaccagctctcctctcccctcgcttccctgctgcaatgtcgaccgacgtggccgccgatgtcccggcccctgaggtggaggtgaccgccgaccccgtcgtggagaccacggccgaggccgccgccggcgacgcgaagccggccaaggagaccaaggccaaggcggccaaggccaagaagccctccgccccgaggaagccccgcgctacccccgcccacccgacctacgccgagatggtttcggaggccatcaccgccctgaaggagcggacggggtcgagccagtacgccatcgccaagttcgtcgaggacaagcacaaggcgcacctccccggcaacttccgcaagatcctgtcggtgcagctcaagaagctggtcgcctccggcaagctgaccaaggtcaaggcctcctacaagctgtcggccgccgcggccaagcccaagccggcggcaaagaagaagcccgcggcgaagaagaaggcgccagccaagaagaccgccaccaagaccaaggccaaggcgcccgccaagaaggccgccgccaagcccaaggccaaggccccagcgaaaaccaaggccgccgcgaagcccaaggctgccgccaagcccaaggccaaggcccccgccaagaccaaggccgccgcgaagcccaaggctgccgccaagcccaaggcccgcccagccaagggctgccaagacctcggccaaagacgcgccaggggagaaagcgcccgccgccgcggcgcccaagaagcctgcccgccgggatggcgcccccccaagagaaccacg

SEQ ID NO: 11337 - DNA, 247 bp, Triticum aestivum
  Clone ID: PAT_TA_11337
gtggacacctaccacctcccggtctgccaggcagaatctgaatcagagtagtagaatttggccctgccggtgctgaatctgtgtcactggtgaatggtgattaagattgtactgctagctggttcgctgttgtgcgtttgttcaggattaagccaagcttgcctccttgtggactatgatcgatgaaagaaagaactgccgtggaaactttggttcgtggcatggattcttcttgccaaaaaaaaaa

SEQ ID NO: 11338 - DNA, 691 bp, Triticum aestivum
  unsure (1)..(691): unsure at all n locations
  Clone ID: PAT_TA_11338
naactgtgactntgtaagttgcccatgtncaacgcggatgagttaccgtgcgctccgtggccctctccgtgcggcggcatcgccgcccaggacactcccccgccctccccccggacgcctcctggcacgccacacacgttcgccccacgttgccccaccatcggttcccttccgttcagcgccggcgcgcgggttacacgttgacaaacgcggtgcccatgcacctcgtggcggtgtcaaatcggaggttggtgggcccaattccagcactatcaggatggtgtgtacaatgctcatcctgggacacggttgaaccacgggtccacggttgtccgggtatggggaggacgaggtgactggggagagttactggatcgtgaagaactcatggggtgagaagtggggggatagtgggtacctcagaatgaagaagggcatcatagacaagcccgaggggatctgcggcattgccatccggccatctttcccgttcatgtgatgtgatcatgtgtggtgtggtgggttcattgttctttccctagcaggggccaaagcttagccaacttgttgttacaagtacgatacttgtaaggtagttaatacgtgcttgtaaaaatgggagtatattcaaacatttgtgaataataaacatgggaattgcttgaaaaaaaaaaaaaaaaaaaaaaaactc

SEQ ID NO: 11339 - DNA, 1244 bp, Triticum aestivum
  Clone ID: PAT_TA_11339
gggagacctggaaggtcgccgccgtcgacttccaccggatcccttctggtgccgccgctcctgcaggactcctcgtcccacctcaacctagcgaatccgcgacctctcccgcccaccaccagccttcccatacctcctcccaccacaccgtcccagtaacagagaaggggaaaagaagaacctacgttctctttccggcagggctgtttcttcccgatgctccggattgcctctcgctcggggttgcttggtggcaggagatgctacagcgccgccccgaagggcggcctctcaatcagtggcgtaagtgacatcattgctgtcgcctcggggaaaggcggcgtcggcaagtccaccactgcagttaacattgctgtagcacttgcgaaggagtttaagctcaaggttggtttgctagatgctgacatatatggaccatccattcccacaatgatgcatctgcatgaaaagcctgaagtaagtgaagacatgaggatgattccagttgagaaccatggagtgcgatgtatgtccatcggatttcttgtagacaaagatgcaccaatcgtttggagaggtcctatggtaatgagtgctcttgagaagatgacaaggggagtagcctggggtaatctagatgttcttgttgttgacatgccccccggcactggtgatgctcaactatcaatgtcccaaaggcttcggttatctggtgctttaattgtttctactcctcaagacattgctctaattgatgctagaagaggagcaaacatgtttcgtaaagtccaagttcctattctaggcttagtagagaacatgagttgcttcaagtgcccaaagtgtggtgagaagtcttacatttttggggaagggggagctcagagaactgcggaagacatggatatgaagtttctgggcgagatacctcttgaaattgacatccgaactggttcagacgaaggcaaaccaattgtggtatcatcacccgactctgcatcggcgcaagcctacctgcgtgttgctgagaaggtgacacagaggctcaaggagttagccgtggagcgactgatgggcccagagatttcgctttgagaatgtgccggcctacatgtaccctcctccttcgccctgtctccgtccgaccatttaagctctggaaccgcctctcgctaacccgggctctgtcgctggctcttgtgccctccgctcgccgggaattcttaaataaacctggtaccacg

SEQ ID NO: 11340 - DNA, 419 bp, Triticum aestivum
  Clone ID: PAT_TA_11340
gcgacgactggttcattgaaatcgcgcaggacaacatcagcaggatcagcgggaaggcccgggccggcaactcggagagggaggtgcacagcccgacggcctctgtctcggcgcagtctgtgtcgtcggccaggtcccacggcagctcctagctcgcatcatcttcagtatacaggtccttgcagtataggtgtacgtgtgtaagcagtacgtgttcctctttatctgtatatatccattctctgctgtatctgtgtccggtctgtgatctgttgtgcagctagctagttgtgattgtagcccagtgagtatagagtatatagactgtatagtatagataaagaaataatttgcattggaatcgcataagaagaggaaaatatatgttcctctgttgaatcaaaaaaaaaagattgttc

SEQ ID NO: 11341 - DNA, 787 bp, Triticum aestivum
  Clone ID: PAT_TA_11341
cggacgcgtgggcggacgcgtgggcggacgcgtgggtgacctctatccagtccctgctgtgcgacccgaacccgaattctcctgcgaactctgaagcagccagaatgtacagcgagaacaagcgcgagtacaaccgcaaggttcgtgaggtcgtggagcagagctggacagcggactagcgtcgccagatcctgcaataagcaatgcctggaacgtctccatttctggctttgctggtctgtaccaccgaattaaaacattgaaaaaccccatggcagttgtgtccctgtgcttgatctcctcttgttttttcggtgcttgtgacctattcagtgtaaccctatgccattttatagtatttcttcttcgagatcgattttttttacagtacactttacattacgcacagatttgcagaaacttacaagggttacttggccacacggcacgtgaaccatgagcacgcacactgctaattatatattttttggcgagtcgctgctaattactataatcagtagtactaatccatgcggtgctaggcgttggggccccacatggagaggaacatgacggtgcggagcgactcctcctgggccgccgcccgcctccgctgctcctcggccgccttcctggccagcggcgccttcgcccgcgccgactccgccggcgccctgccggccctggccatggactgctgctgcgcctgcgccctgtcggccttgccggcggacctgccgacggcgtcccgcacggcctgcgccgccctcgcgcccacccggctcat

SEQ ID NO: 11342 - DNA, 1324 bp, Triticum aestivum
  Clone ID: PAT_TA_11342
gccggccgggcttcggtctccattctctctctggaagctttcgtctattccggacgcaactaaacctgcccgacgcgactggcggggagagtgcgtgcgtacgtgagccctagcgggtttgaggcagcgccggcggcggagatgtcgacgccgtcgagaaagcgcctgatgcgggacttcaagcggctgcagcatgacccaccggccgggatcagcggcgcgccgcacgacaacaacatcatgctctggaacgccgtcatcttcgggccggatgatacgccatgggacggaggcacgttcaagcttaccttgcagtttacagaagattaccccaacaagccgccaactgttcgttttgtctctaggatgtttcacccaaatatttatgcagatgggagcatctgcttggatattctacagaaccagtggagccctatatatgacgttgctgccatattgacttctattcagtccttgctgtgtgatccaaaccccaactctccagcaaattcggaagctgccagaatgttcagcgagaacaagcgagagtacaaccgcaaagtccgcgagatcgtggagcagagctggactgctgactaaggcagggcgaggcggcggctgccagaaagttgcaataagcaaccatgaaacctttgtttatggctctctatagttggttcttagatgaaatattaaacatctccagtgattgcttgcaggtcaaaccgtcaaagtatctttagtctccgtggtaattttgtgttatgtctcgtggtactgttctcatatgttgtgttgatcctgcctcatgaatttaggggcatcctatgtaaaaagttatagcgtggtaaaaattattttcctcatttacttcgaaagtagtgtcctggggtgctatgggttatctgtccctgaatccacacactatacttagtttacttatttctatcgtggtttgctatgcagtccctgctgtgcgacccgaacccgaattctcctgcgaactctgaagcagccagaatgtacagcgagaacaagcgcgagtacaaccgcaaggttcgtgaggtcgtggagcagagctggacagcggactagcgtcgccagatcctgcaataagcaatgcctggaacgtctccatttctggctttgctggtctgtaccaccgaattaaaacattgaaaaaccccatggcagttgtgtccctgtgcttgatctcctcttgttttttcggtgcttgtgacctatttggtgaactaaggcatgttatagccattgtaaagattttatgttatagctaagaagttggtgctgcttgcgagtcttt

SEQ ID NO: 11343 - DNA, 379 bp, Triticum aestivum
  Clone ID: PAT_TA_11343
atccaccattgctctcatcccggtctgccattctatctcccacggaatcccttctgggactttggtctgtcctttgctccctggaaccaccttttcggtccgggtctgaccttttcccttttgaatcatgtctgtcgtcgtcccggcctgatcgtgcctctctcgaagcacctgacctatcatccctgtcagttcttctatctcttgagtgaccccttccatcatcatcatcgtccagtcttctacctgtgaaggcactcctatcatcttttggctccaccttcctatcccttgacgcatccctcccctcatcacgctccctgtgcttccgtgtgccctgacctccgggaggattgatccctccggtccacagtagaag

SEQ ID NO: 11344 - DNA, 1279 bp, Triticum aestivum
  Clone ID: PAT_TA_11344
gagatgttcttttattggacgtgttgatgatcattaggtgacagtttacagacgaagagattgaacagagctatgaagaattttatgaggacgtgcacacagaatttctgaaatttggtgaacttcaacttcaaggtatgtagaaatggatcattccatctccgaggaaatgcctatgtgcattataaagccttggattcagctcttcttgcctacaacagcatgaatggtcgatattttgctgggaagcagataacatgtgagtttgttgctttgacgaaatggaagtcagcgatctgtggtgagtacatgaggtcaagattcaagacatgttcacatggagttgcttgtaatttcattcattgctttcgtaaccctggtggagattatgagtgggctgattgggacaatcctccacctaaatactggactcggaagatggctgctctgtttggtccctcagatgatgctgtttttgacaaggcgagtgataccgattttgaacggttacacagttcagataggaagagacagaacagttctgatgacaggtatatttgaagttgtggaatggggatcgtatagcccaggcttctgatatcctccagtcagtatcttcccaggtaaatgctgctttggaaaaccgacctatctccatacaacttaggggtctgtttcagacatgcaaaaaaggctcaccagctagggccagggttgtatatgctccagtactggaagttggtggagaaggacgccttgtccgtgcttgcaaggtaataactgaagccttcgtcaagtcaggcctagttcttgaaagggatgccagacaagaattgaggttgcatgcaaccataatgaatgtgcgccacaggaagagcaagaaatcgaaccgaagaaacgattcgttcgatgctcggaatatattcaggcaatacggggaacaggattggggcgagtacccagtaccggcggtgcacctatcgcagaggttcaagtttgacaagggtggatactaccattgctgctgctcgatccccttgcccgaggtggctcagacggagtgagctccgtgtctttcgacacatcgcgacgcagtatcttatgcccttaagatcggtaccgggtcttttttgccgtcatggaatctgtagtttggtcgcgtggctttgcttctgttgttgtggacattgtgcacggtaacgagtgcacaggttatgttaactcatagacgatctgggatcactggtactagtgccctcaaaaaaaacccacgcgtccg

SEQ ID NO: 11345 - DNA, 1391 bp, Triticum aestivum
  unsure (1)..(1391): unsure at all n locations
  Clone ID: PAT_TA_11345
cggacgcgtgggcggctccccacccccgcaccgccacccggggaaccccagcgagaagggaggggagacgccggcggccgccgggcagggcaggacagcgcgcgcgcgcgtgcgcgccgggagcgagggatcggccgggatgtcgacgccggcgaggaagcgcctgatgcgcgacttcaagcgcctgcagcaggacccgcccgccggcatcagcggcgcgccgcacgacaacaacatcaccctctggaacgccgtcatatttgggccggatgacacgccgtgggatggaggtacgttcaagctgaccctgcaattcacagaagattaccccaacaagccaccaactgttcggtttgtctcaaggatgtttcacccaaacatttatgcagatggaagcatctgcttggatatcctacagaaccagtggagccctatatatgatgttgcagcaatattgacctctatccagtccctgctgtgcgacccgaacccgaattctcctgcgaactctgaagcagccagaatgtacagcgagaacaagcgcgagtacaaccgcaaggttcgtgaggtcgtggagcagagctggacagcggactagcgtcgccagatcctgcaataagcaacgcctggaacgtctccatttctggctttgctggtctgtaccaccgaattaaaacattgaaaaccccatggcagttgtgtccctgtgcttgatctcctgttgttttttcggtgcttgtgacctgtttggtgaactaaggcatgttagccattgtaaagattttatgttatagctaaagaagttggtgctgcttgcgagtctttaaaaaaaaaaaaaaaaaggggcggnacgccatattttttttgatatatgacttagatgtgcaatacttatggcacatttagatgtgctttagcaaaactgtattactttacattcggcttgtacgcacagatctgcaaacttagagtcacttaaccacacggcacgtaaaccatgtgcacgcacactgctaatcggtaatactaatttggtgctaggcgttggggccccacatggagaggaacatgacggtgcggagcgactcctcctgcgccgcccgcctccgccgctcctcggcggccctcctggccagcggtgccttggccggcgccgactccgccggcgccctgccggccctggccatggcctgctgctgcgccggcgcctgcgccctgtcggccttgccggcggacctgccgacggtgtcccgcacggccagcgccgcccgcgcgcccacccggctcatgctcatcatgtacctcaggctcatccaccaatctcttcttggttgcttgcttggtttggcttggtcgcggacgcgtgggcggacgcgtgggcggacgcgtgg

SEQ ID NO: 11346 - DNA, 1765 bp, Triticum aestivum
  unsure (1)..(1765): unsure at all n locations
  Clone ID: PAT_TA_11346
cgacgcgccgctccggccccccgcgcctccggccccactctccccgccccaccccgcctcgcggcgagcagtgcgtgcgtacgtgagccctagcgggttcgaggaggcagcgccggcggcggagatgtcgacgccgtcgagaaagcgcctgatgcgggacttcaagcggctgcagcatgacccaccggccgggatcagcggcgcgccgcacgacaacaacatcatgctctgggaacgccgtcatcttccgggccggatgatacgccatgggcacggaggacacgttcgaaggcttacccttagtcagctttacaggagagattaccccaacaaggcctgccaactgttctgttttgtctcatacggatgtttccacccaaaagtatttaatgcaggatgggacgcatctgcttggcatattcttacacgaatctaagtggtagccctatatatgacgtttgatgccatacttgactttctattcagtcctttccgctgatgtggatccaaatcccccaatctcttcaagcaaaattccggaagctgccagaatgttcagcagaagaacaagcgagagtacaaacgcaaagtaccgcgagatcgtgcagcagatctggggactgctgactaaaggcagggcgcggcggcctctgctaggaagttgcaataaacaaccatggcacctttgtttatagctctctatatttgcttgtcagaagaaacgttaaaaatctccagttattgcttgtaggtgaacaccgtcaaagtatgcttttgtgtcgttggttcttgtgtgttatatctcctggaacgtttctatttctttgtttgcttttcttgtaccacctaatttaagggtcagaaaactctatagcgtttgtgtccctgtgcttgatctcctcttgttttttcggtgcttgtgacctatttggtgaactaaggcattttatagccattgtaaagattttatgttatagcttgaaactgtgctttcggcttgtacgcacagatttgaaaaaatagagtcgcttaaccacacggcacgtaaaccatgtgcacgcaccgacactgctaactataatcagtagtactaatccatgcggtgctaggcgttggggccccacatggagaggaacatgacggtgcggagcgactcctcctgggccgccgcccgcctccgccgctcctcggccgccttcctggccagcggcgccttcgcccgcgccgactccgccggcgccctgccggccctggccatggactgctgctgcgcctgcgcctgcgccctgtcggccttgccggcggacctgccgacggcgtcccgcacggcctgcgccgcccgcgcgcccacccggctcatcatgtacctcacgctcatccaccgatcgcttcttgtttgcgtgttttggttagggttggccgcctcctaggcgagccactcctctcagcatttgagctctctctccgagctgacgagctgtgcttgcgtggaggcgacacacgctccctggccggagaacgggaccttgcgtgccccggcctcctaggcgagccagtcctctcaggccgtgacctctccctccgagctggcgggctctgcttgcgtggaggcgatacgcgctccctcgctggagaacgagacctcgtgtgccctgacctccgggaggattgatccctccggtccacagtagaagccattcctcacctgggccgccgtcgccgccgccgccgccgtgcgctcgncgagcagctggactcggtgaag

SEQ ID NO: 11347 - DNA, 1181 bp, Triticum aestivum
  Clone ID: PAT_TA_11347
tttctcgcacagaagatctcagaagatattgaagttggagcgaagccgttaattaatcttaagggctatctggttggcaacccggctactggtgaaaacaacatcgattatggatcgagggtgccatatcttcatggaatgggcataatttcagatcagttgtatgagacgataatggagcactgccaaggggaggaatatagcaaccccaagaatgcgctctgcgctcaagctttggacagggtccaaccaactgtggaatgaaatttcacatccacacattttgtataagaagtgtgtctatgcgtcttccagaccaaacgacgggagtacagaaagaaagatcctaaaggaggaagtaggagtacttaagcatccacctcctcgtcctccaatgggttgccaaacctatggcaattacctatcatattattgggctaacaacaacatcactaggaaagcccttgggatcaagaaggggagcaaggacgaatggatgaggtgccacaaacgagatttaccttattctttagacatcaagagcacaataaagtaccatcgtaacatgaccttaaaaggttatcgtgcactggtatatagtggagaccatgatgctattataccatttctcggtacacagtcttgggtgcgatcactcaatttccccattgtggatgagtggagggcttggcatctagatggacagtccgcaggattcaccatagcatacacaaacaacttgacgtttgctacggtaaagaacggtggacacactgcaccagagttcgaaccagagagatgcctcgctatgttcgcgcgttgggtttcccatgagccgctctgattaatgtgtctgattgccacatgcctgtaacctgatgtttggataaaaggaatcgtgccaggatgtgaattcttctacagtatttcagtttttagatatattgcatatatgaactactcgtggcaacagccaaacgcaaggaagattgttagtactatgctagagccggtgcttcatgccatggcggcacgggactatgattgaccggaagcctgtttctagcggcaagggtagtgagaaatccatcacacattaaaattcgtgcagctagaggcccacttcagtttgaatatctatgtattcacaaaccaactttttttaggcaatcgcacgaagc

SEQ ID NO: 11348 - DNA, 165 bp, Triticum aestivum
  Clone ID: PAT_TA_11348
cgctcctccaggagcacgaccaccagaagtaggagctgatcgtgtgcgtgcgtgtgtgtcgtgttgatcttcgtttcgtctgcgctctgcttaccaataccatgcatgtgtgtaacaaaagataaataataatcaagcgtggaagtggatcagttaaaaaaaaaa

SEQ ID NO: 11349 - DNA, 1038 bp, Triticum aestivum
  Clone ID: PAT_TA_11349
agaagacttttgttcttcagcccttcttttcagaaaaccagtcactcattacttgccgtcttccaactacataatactctcgatcttcttcggataatcacctaataccacacacaccaaccttcaaaatgtactccaagaccgccatcatcaccttcttcgccggctttgccgctgcccagatccacgctcccgttggcgagcccgctggtaaccccatcacccgtcctttgaacgaggttgtccccacctgcgagcagttcaccatcacctggcagccaactacccccaacactgtctctgttctcctcctcaagggaccctccaccaacgtcgtcaagttcggtccttctctcgctgagggaatcgccaacagcggtagcctcgcctggacccctgcctccactctcgaggccaccaacggccccaacggatacggcatccagatcattgacgatgtcaccggccagtaccagtactccacccagttcggtatctccaagggcaactgcgaggaggccgtctccagctccatgatcgagcccagcagcgtcgctgtcgctagctccacccctgccgccagcagcgcctacgctcccggctacggtgcctcaaccccccttgctagccacacccccatccctctcccatctgctgtccactccagcgaggctccttaccccaccaccgtcatgacctctgctatggtccctgcctacagcactggtgtctctgccaacggcaccgtccccatgcccactgctggcggtaacgctaccaccagccgtctccctgaggctaccaccaacgccgcctctggcgtccaggctgcgctcggctttgccggtgccgccgccgctttcgctttcatgctataagcgcattttcccggtctcccctggattatgttactatgtcatgactagctttgcgtttccttcccttctccgatgatactcctggtgtttattcatagggtataccaccgtcttgtttggttcgaattttgtgtgtcgtggtcggcggttgtatctaaag

SEQ ID NO: 11350 - DNA, 533 bp, Triticum aestivum
  unsure (1)..(533): unsure at all n locations
  Clone ID: PAT_TA_11350
cgtccggtcccttcttcccccaaatcgagcgacgatgtctgggcgcggcaagggcggcaaggggctgggaaagggcggcgccaagcgccaccggaaggtccttcgcgacaacattcatggcattaccaagccggcgatccgcaggctggcgaggaggggcggcgtgaagcgcatctccggcctcatctacgaggagacccgcggcgtcctcaagatcttcctcgagaacgtcatccgcgacgccgttacctacaccgagcacgcccgccgcaagaccgtcactgccatggacgtcgtctacgcgctcaagcgacagggccgcaccctctacgggnttcggaggctagattcatgtagtccgccagcagtggggcaacttcctcgtttgctctctgtgatgtgtgctgtggtagatgagatttactggtttgcgtgtgttgttgngttctggtcttgggggtcaataagctctgtaanaactttgntctgttcaatgcaatcagttcgattctgaatcaaaacnaacntccaaa

SEQ ID NO: 11351 - DNA, 676 bp, Triticum aestivum
  unsure (1)..(676): unsure at all n locations
  Clone ID: PAT_TA_11351
ttcaatcggcgattggcggagctgcaaccatctatttggtcgagctgcatccatcgacgccgggcggcggcgactgcaacgcggagcataagagctgcatacagcggcgagggcggctgcaatcagctgcgcccctcgacaacggagttgcaaccggcttttggtggagctacaaggttggacgttgagatgcgattatttttgctggaaccggaggtgttttttttttactggaaacaggtggtgcaggtcaacgacggtggcgagccgaagatggcgtcgccgtgctatgatgggctgcgtaatttgatggaccgacttttgttcagagttgcatctggcaagacgcggtgttggaacgacgacgagatgaggagggcgcacaacgacttctacttcaagttgcgaagagaagcggggagctgcagtcgacgatgatggcggtggccgtggaggggccgccggagacgcgggactccggcggctgcgcgggcggggacagcgaggcaatggatttcggcgatctgggctgcatcctctcctttttttcttttttttctcccatgtgtgttcagatgcgagatccggggngcaaacgagctttcgntctgacggttggcagtaagcgaagcggacgcaccggnngcgcccggcccaaatttncggccagtgcgcc

SEQ ID NO: 11352 - DNA, 653 bp, Triticum aestivum
  unsure (1)..(653): unsure at all n locations
  Clone ID: PAT_TA_11352
ggccaagttcacgccagnaaacgcttgatgcatacctaagcaatcccgatccatcaagtgagctacgacgatcaaatacagtctggagtgatgacttcgacaacatcatcggccccctgccaacatcaagcgacgaccacgagccctggtcacggaagcaagtctgccacagcaagtacccacacgacagcacgagcttgatggcacaaggaacccgatcttcacatctactcttcaccgacgactgcttcctcgatggactggtggatggattcgggatcatggtggtaggagtcgttctactaggagccatcgcagcattgctatggcttctcggtatgcgattgaggtcttgtcggtcgacgcgtgcccatcgtagaggctcttcggctttgagattgctcggtactgaaacagaaagctcggagacggactttgaggacaaactccacggagagaaggtgtgaatgggggtctagagggtggtgtggtgggagtgacggatctttcacaatataccagcatcgcgcagaaccgcatgccagcgtcaaaggtcgacgcaattgttcattgatgatcatgcaaagtatgagatagagataccaaatgtttgttgtgcgtcaaaaagaccatcacgatcttgaaaaaaaaaa

SEQ ID NO: 11353 - DNA, 489 bp, Triticum aestivum
  unsure (1)..(489): unsure at all n locations
  Clone ID: PAT_TA_11353
gtgcaaatcctcatgatgcaacaaccatcatccccttcctggccaccggcccgttcctcgccggagcctcaaccgccaggttccgtctctcctcccagcgccgccgttgtatgccctccgtgtggccaggttgatggccggcgaggctgccagaggaggccatgccatgaagggcctttctgccgcggccaggtcgctacagatccccgtcactaccgtcgcaaaccccaactcctgtcgatacacgcccataggccatggtcaccgcctgcggcggcgtcttgaggcgcttttgctaggatggtggaggctaccgtggaggcatgggcgatggtgggacaaacagaggcggcgtgatggtggacctggtggcttccggttcgtctggcttctgccaggggcgtatttgcgttgtcctncctggggttcaagcggccgtcattaatcgtgtgcgtaatggcggaaggtgtcctgctgctaaaaaaaaaa

SEQ ID NO: 11354 - DNA, 488 bp, Triticum aestivum
  unsure (1)..(488): unsure at all n locations
  Clone ID: PAT_TA_11354
gtccagacgtcgcaatggccaagtccaagaactcgtcgcagcacaaccaggccaagaaggcccacaagnaacggtatcaagaagcccaagactcacagatacccttccctcaagggcaccgaccccaagttcagacgcaaccacagacatgctcttcacggcaccatgagagccctgaaggaggtcaaggagggcaagagagagtccgcataaacaaatccaccacatcacgaaagtcaaaaatcggcgtctagtgttatgggttggaggctttgctagaaggagcacgaaacgactcctcacgacaaatgccatgaaactggttgtgcaaatgcgcccctcggtcccgccgcctgtcgccctggtccacctctacttttccgtcttcttccacctcaccccgtgacatcttccccaaaacaaaacaacacggcatcagtgtgtacagcaacttgcaaatactatgcagactctgctgaaaaaaaaaa

SEQ ID NO: 11355 - DNA, 1029 bp, Triticum aestivum
  unsure (1)..(1029): unsure at all n locations
  Clone ID: PAT_TA_11355
tggacgcagaagcggcagatgtacgcggcggccggcgggccgaggaaggaggcggcggcgggaggcggcccgtgggtcgtgccgacggtcgggttcccgcctccagggacgatggcgcacgcggggatggcgcaccatcccggccagcctccgccgttctgccggcctctgcacgtttggggccatcccaccggcgtcgacgcgccgctgccgctgtcgccgccgtccatgctgcccgtgtggccgcggcacctggcgccgccgccggcgtgggcgcaccagccgcccatggaccccgtctactggcaccagcagtacaacgctgcgaggaaatggggcccgcaggcagtgacacagtgcgttccgccgacgatgcctcctgcgcccatgatgcagaggtttgctgcgccgccgatgccggggatgatgccgcatcccatgtacaggccgatcccgccgccgccgtcgccggtgccgcagagcaataaggtcgccggcctgcagcttcagctcgacgcccacccgtccaaggagagcattgacgcagccatcggagacgttttacgtgaagccatggctgccgcttcccctgggggctcaacccccgtcgctggacagcgtcatgtccggagctgcacaagcaagcatacccaangcccgccggcggcgacaacnaactgcggcgggccgcctgaganacgtactctccacacaaacggngccggagccttaagccgctgtgttcccctctctctgggtganaaatcctcnatatcgtccgtntgaccnacngganacttanggggattnaacggccgttgncantnagcttgnctgaaattaaancaaagttnaaaaangattgccgggttttccgtngaatgnatgaaangttccggggtttccccntnggtnccccctnggaaaaaaannggggcaaatttggagggaaacnttttttgggggananaaaaaaanggggcgggcatttccaaagggnnataccgcnaagggtttttaactcnnggn

SEQ ID NO: 11356 - DNA, 738 bp, Triticum aestivum
  Clone ID: PAT_TA_11356
aggaaaaggagcaaagatgagcagccacgaggacgcgcaagttcgtggacgaggtgcggggcctggagaagaactggatgctcgacctcggccaccccctcctcaaccgcgtcgccgacagcttcgtcaaggccgccgggatcggcgcgatacaggccgtcacgcgggactcctacttcatggccatcgaaggcgagtctgggggcaccggagcggtgtcgggcgccaccggcagcagcaaacggacgttcccagacctcaatggagggacgagcaacagcaagtcagcggaggccatggtgaaaagcgtcagcaaggagtcgttccagtgggggctcgcggctgggatgcactccggcctcacctacggcctggcggaggtgcgcgggacccacgactggaagaacagcgcgctggcgggcgccgtcacaggcgcggcggtcgcgctgacctcggacaacgcttcgcacgagcaggttgtgcaatgcgccatcaccggcgccgcgctgtcggctgccgccaacgtgctctccgacatagtttagggagtgcattcgtatcataccacccgatgccccggcggaaggcgagcggtagtagtatgcggaatggacttgtttaggttacgtgttgttgcgacctgcgagcgcacttgtcctgtgttcccttgcctacgatcttttttttttctttcaaaacggtccttacttacgattctcggtgtagccagttcaaata

SEQ ID NO: 11357 - DNA, 438 bp, Triticum aestivum
  unsure (1)..(438): unsure at all n locations
  Clone ID: PAT_TA_11357
gnaattcggcacgagggggcgatccaggcgcagcggcggccccgttcatcatcggggtgctcgggccggccaccatccgagggtcgagccccatgggcgcatggccatgggcgcgaggagcaccgctgtgggtgtgtcctgtggcgtggcgaccctgtcccgggcgtggtgagcaccacgggcgcctctcctagcgccacgatggtcgcgtccagcggcacgacggatagcctggcgacggaaccgccggagtctacccagtccatggaaacggcgaccgtagcgtcggccatcctcgtggatcagacggaggaagaaggagacgaggctcggcatctcaccggcggcgagtgctctttccctccctttcttctctctttttgctcttcgctggttgttctacgtgcgtgataacgtgttcgagatcgaaaaaaaaaa

SEQ ID NO: 11358 - DNA, 1013 bp, Triticum aestivum
  unsure (1)..(1013): unsure at all n locations
  Clone ID: PAT_TA_11358
ctcttccaggccaagggcaagaagtacttcggtacctgcggtgaccagggcactctcggcaacgcccagactgctgccatcgtcaaggccgactttggtcagcttacccccgagaacagcatgaagtgggatgccaccgagtcttcccaaggcaacttcaactttgctggtggtgactaccttgtcaactttgctagccaaaatggtgacctcgtccgtggtcacactcttgtctggtactctcagcttccccagtgggtccagaacatcaatgacaagaccaccctcaccaatgtcatgaagaaccacattaccaaggtcatgacccacttcaagggcaagatctacgcctgggacgtcgtcaacgaggccttcaacgaggacggcactctccgcaacaacgtcttcatgaaggttctcggtgaggactacatccgcatcgctttcgagaccgcccgcgccgccgaccccaacgccaagctctacatcaacgactacaacctcgattctgccacctacgccaagaccaccggtttcatctcgcacgtcaagaagtggatcgccgccggcatccccatcgatggtgttggttcccaaacccatctcggcaagtctggttccttcaacaaccctgataacgtccctgctgccttcaaggctgtctgtgctgctgctcctgaatgcgcaatgaccgagctggatctggccggagctgacagcactagctacgtcaaggttgtcaatgcttgtgtcaacaccaagaactgtgttggtatcaccgagtggggtgtttccgacagccagtcctggagaagcagcgacagcccccttctcttcaacggaagcttccagaagaaggctgcttacactgccattgtcaacgccctcaagtaaatttctaactttggatattgatgttgatatttgagcgtttacttttcttcttgatgatgagtttgttgtggtggttggattctattttaggnatcaatttgnaggnagtagcaacgtta

SEQ ID NO: 11359 - DNA, 209 bp, Triticum aestivum
  Clone ID: PAT_TA_11359
gctcacggctgggctcgcgtggcagtgaagacggccggtaactacatagagcgtgctgcgtgagccatggattatgtgagtaaataaagtggatgtattagtgaatttcccgccgttgtatgtgcctcatcgcgtatctgcatctttagttgtcagtaagaaatgggacagagaacttgcgtctagcatatcgatcgacaaaaaaaaaa

SEQ ID NO: 11360 - DNA, 948 bp, Triticum aestivum
  unsure (1)..(948): unsure at all n locations
  Clone ID: PAT_TA_11360
gaggaattcggcacgaggggagntgggctnccgagttctactacagaagcttcctgcgggtgcacgggtacaagtccaaggtctctgctgcggatgttgtgtatggcgtcacagctttgcttgaatgtatgagtgccgagtccaacgattcgaaggagtgttctgctgctgagcaattctgggttgcatactctgcgctgtctccgagcaatgtggatcagctgcaaaaaggaatgcaatctgcaattgagatacagaggggctatattgaggcaagggagctcggcaatcaccaagagcggcttcatacggagtgcaaagaagttcaggtgggtgaagctcgatgacccagtggacacgagcaagctgtgccaccctcaggcgcttaccaagttctgcttcttcctgatggatgcactgaaggaacggggtgcaaggacgaagccactggtgtgtgcttgcttagggagggagcctgagaaggtgctggtagttggggtatgggggaagcccaggcttggggcagttcaggggaattcgttcggtaatgcatttaggtcagcggcaggggagattggcgcagactatttccatgacatgtttgagtcatcatggattgttcttgacgttgttgctgtcagttctttcatgattcggttaacggagaagctgtaatgatggcatgcgctgtctatgctagttatccttttagtcccaaaacaagaagggacttgaggcttgattctgcctccaaatataggagcttcagtcctggcggtacatgacatgtattctctccttatccacctgaactttttcatgatcatgttttgcagcgagaaaggaggttttcccactgtttagccaattcaattagcaaatgatagatcaataaaattcagatgcaaaccttgtcacaatatggagaggacaaggtataggtactgt

SEQ ID NO: 11361 - DNA, 1148 bp, Triticum aestivum
  Clone ID: PAT_TA_11361
gattgtactataatagctgccgaggatggtccaaattatgtgtcaagtgtgattgacaccacttcacagcagaagcggcctttggaaccagatagttaccagaatgcattgcagaatcgtgtatcaggcaccacacgcgctcggcacgcgcctgctcgcaaattacagactcctggtcatgtaatgtctacccaggaaccacaggcacattcgggcatgggagaattagtcactattgctgcaacctcgccactattatcaccagaccaggaccagcctcttgccgaagcaacacctgagcgctggagccatatgggagcaaagaagtcgatgtgggaacctttcaaggcacttcccagggatttatcaaccacaacaggttgtgctcagttcagacctagcattgacacggttgatttaacttatactgatgtggcgggagctaatcgttattatcccactcgccagccagtaatttcgacacttgaccactatacaaatagagcagttaactcagtccaggcaagaagttttccaagttcagtgtcaaccatggaagctggtaatctgtgtgatggaagaaatgttggacattcaggtttttatccaagagaaaccatgcctgctactcagcccctgagattgaccgagtcaccaatgttagccagtttcaactatgaagggtctagcaggaaccagatggaatttcaacttcggaattcacactgtccgcaggatcagtccatcggatcagctagcacaccgtatggagcacacaatcagtacataggatcagctagcacattgtgcgaagcacacaatcattacatgggattaactagctcattgtgtggagcacacaatcagtacattggatcagctagcacaccgtatggaagtaacctaaatggcatgggatcagctagcacgcagtatggaagtaacctaaatggcatggtatcaggtagcacatcctatggaagtaacctaaatgggaggattccattgacgcttgaggatttatcacgtcatccgctccagccaaatattgacagacgcgttctgtcactttctagagttggtgtgctcaggttccttggttgataaagggaattgcagactggtcggagagcttggggacacagtca

SEQ ID NO: 11362 - DNA, 645 bp, Triticum aestivum
  Clone ID: PAT_TA_11362
gcagaagcgcggcccctgcccggcggggggtcgccggcggcggtggggaccggggccccgacgacggggccgtcccctgccagggggcgggcaggcgggcgtcacccgcccgggccgcgcccgcccgcaagggttgcgcccagggcgacgatggcaatgccgtgcctgacgtcgggggcgccccgcgtgtggcgggccgcaggcccgcaccggcccggagggcggccccggggcgcggcggtggcgccaaggatgtcgacgtcgtggtcccgcccgatggggcgcgccgccagctgggatcgagcagaagggtggcgccaggtcggaggggattcaccaaggatgaagacgatgtgttgccgtacgaaggggcgcgcaagcatatggtaagcagaagggcaaccccatcccagaggagattcactgccgctagaggagaataggcagtagttatacaccattgatgccttttcttgtagcatgatatgataccgtattgcgcatattttagctgagcacaagtcacgaaataatatcgattttggcaaattactttccttcttgggactttagaaaaagtattgacagccttcatgtatacacttctggatgtgctgagaataatcagagtagttaaaaaaaaaa

SEQ ID NO: 11363 - DNA, 570 bp, Triticum aestivum
  Clone ID: PAT_TA_11363
ggattacctggacagagcggctgtactgactgcactgcagagaaacatacaggtaatccggcaacctagaatcatacatgaaactctgcaagcgcctatctgagacagatctgatcgcaccgtgcgtcctatatctgtatgtacggaaattcaagctgtggatgatgcgcatgctgtgagggtctcgacaaagccttgaatcatctgtgggtgcttcagacgtgttcatggcttcgattaggtgtagaatgtcccgactacggtgaaccaactgatgcacaatcatggttccttgtatatttttgaccggaaaggagctccccatgagcgttcacccccatcagagctgctgtcttattgtctgagcagactacatgaatgtaaattttcagtgtaccatccccagttgtgtggaatggagggcgctagctgctgtaggggagcatatacctcttacgaaacattacgtgtatatagttgaacaaaaagaaacttgtaaagttgtgatatacctcagttgtcttcgtaatcttgtacgtagcccttctctgtttttgttgaaaaaaaaaa

SEQ ID NO: 11364 - DNA, 1040 bp, Triticum aestivum
  Clone ID: PAT_TA_11364
agcctattgaatcggcttctcgacaccaacccggagacaaggatcaccatggccgaagtcatgcagagcaggtggtttcagaagggatttcggcccgtcaggttctatgttgaagacgatcagctgcacagcttaggggacagtgagagtgaggagctggggctagtcgaacctaccgagccgccgcctcctcctcctcttccgccgccgctgccaccaccaccgcagcaagaggatgatgactcagggtgggagtcggattcctccgtcgcatcctgccctgccacgctgtcgtccgaggagcggcagcggcctgccgggcgtctcacacggccagcaagcctcaacgcttttgatatcatatccttctccaagggatttgatctatcagggctgttcgaggagcgagggagcgaagtgagattcatctcagcacagcccatggaaaccatcgttacaaaattggaggagattgccaagatgaagagcttctccattcggcgcaaggactggcgtgtaagcatagaaggcaccagggaaggggagaaggggccattgacaattggggctgagatatttgagcttacaccaagcctcttggtgttggaggtgaagaagaaggcaggggataaggcagagtatgatgacttctgcaacaaagagttgaaacctgggatggagcctctcgtgcaccaccagccgggctcggctcgaaatgtaccttctgatactgagtagttctaaaggtagctctcttgcttgaaaggaatataaagaagttttggattaaaaggatgtgtcttttatatgtttaagcatgggacctgagcagaaaaatgccattcgtattccttagtccctttgtgttagtattattcatttttgcaatccagaattttttatgctagcgtttactgtgtttgttgtagttgttacatacatatatacagtctaaagggagttgtggacttcgctttctccacattatcaatgtttatcctatttaagtgttcacgctaaattatgtttattcaaaaaac

SEQ ID NO: 11365 - DNA, 1895 bp, Triticum aestivum
  Clone ID: PAT_TA_11365
gcacaacgcaccccagcacagcgttagggcgcctcctttgcctcgagtccacccccgccagcccgcccgcccgccgccgccccgcagaccaggaggtttgcatggtcccgccactcgcaaagtgcgcgacgccggcttggtgcctcccccgataagccagcgtcaccggcagcctctgggcgtccttgacggcctccccagcgccgcgcccgcgcgtgacagatccgtagaaatcgctggtgatcacggggatgtggcaggactccgtctgcgtcagcgacgtttagccctactacaaccgtctggtcgccggggagagcggcgttgaccccatcgaccgcttcgacgcctccaagtttcccacgcgcttcgcaggccagatccggggcttctcctcggatggctacaacgacgtcacgtacggcagccgcctcgacgactgccaccgctactccttcgtctgcgcaaaggaaggcgctcgcgtccgccgtcctcgcgctcggctccgacgccatggggaagattgactaggcctgtgcaggtctacttgtggggactggtatgtgtggcctccatgtgttttctgatggtgttcagtagcttttcgataagggctacagagtgataactccgttcttcatcccataggccataacaaacatgggatctgccctgcttggcatggacattggcttcatgggtccaaactactctatttcaactgcatgtgctacctcgaactactgtttctacgctgcagcaaaccatattcgcaaaggcgaagccgatgtgatgattgctggtggcactgaagccgccatcattccgattggtgttggtgggtttgttgcatgtagagcactatcacagaggaacgatgaccctaaaacagcatctaggccttgggacaaggagcgtgatggtttcgtcatgggtgaaggagctggagtactggtcatggagagcttagaacatgcaatgaaacgtggtgctccaatagttgcggagtatctaggaggtgctgtgaactgtgatgcttaccatatgactgatccgagagccgatggtctcggtgtttcatcttgcatcagacaaagtcttcaagatgctggtgtggcaccagaggaggttaactacatcaatcgtcatgcaacatccacccttgctggtgatttggcagagatgaatgccatcaagcaagtctttaaggacccatctgggataaaagtaaacgcaaccaagtccatgatagggcattgcctaggtgcagcaggtggtttggaagccattgctactattaaagcgataaacactggattggtgcatccgagcataaaccagtttgagcgggagcctgcggttgaatttgacacggtacccaacgtaaaggtcgaacatgaaatcaatgttggtatctcaaattcctttggatttggaggacacaactcggtggtcgtattcgccccattcaagccttaatgcggtacatgctcgacaaatcttggccagaacagtggaggtttttttttcaggaagctcttgagttatttcgatgtgttctcttccgggaagcaactgtcgatctgacagccagcaacattacagtgaacagaggatccaagatccattgcattttagatacacccatcccgattagatttgagaacaccgtgtaaccttctgcatcgcttgcagtcgattctacttgttttcgtgtaatttgtcatgtagaaacaaacactagttcttctgttccgtagagagagtgcattggagggcaaggagttgtttgtctgtactacctgatctggggggaaatctatattatcacaattttttgctgtttccagtcccaaaaaaaaaaaaaaaaaaaatatatttaatataaaaaatta

SEQ ID NO: 11366 - DNA, 655 bp, Triticum aestivum
  Clone ID: PAT_TA_11366
ccacgcgtccgccagtgtcatggacctgggtgcaatgcagttcagaagcagcacccagagttctttcaatcacattgtcagagaagaacatcacaggaagtatccctgaggagttgacaaagttatcggcattggtcgagttaagactcgatggtaactcattttctggtggaatccctgattttagtggatgcagaaatctgcagtatattcaccttgaaaacaatcagttaaacggtgcgttgccatcctctttgggagatctacctaacctcaaagagctgtatattcagaacaataggctttccggacatattccaagggcactttccaagaagagcattattttcaactcgtcaggcaataatcttcaggggccaagtgatagtattagccacggcaccatcataatcatcgtatgtgctgtggttggggccatcttgttacttgcggtggctattggatgctgtttgtgtacacacaagagaaagaaaaaaccttcacgtgaaactgttgttcttgcagcaccagcaaaaaagctagggtcgtatttcagtgaagtagctacagaaacagcgcacagatttgctttatcagaaattgaagatgctactgataaatttgagaggaggatcggctctggagggtttggcat

SEQ ID NO: 11367 - DNA, 948 bp, Triticum aestivum
  unsure (1)..(948): unsure at all n locations
  Clone ID: PAT_TA_11367
tgcgtccgcggacgcgtgggcggacgcgtggtcaaaatttatgtccaagtaaatgacaggtccacatcttgaagcctggttatttatgtactaccaattcggctcggttgatgttgttgggtttgatgtgacaccacttattttggaggaacataagttatgaaaaattctgaagttctctaataaatagcattcatgtgctatgcatttaccttgctgcacattttctgataaactttttacccacacgtccagaaatgaaatggaaaaattctgctttgaacgtaatttggaagctgttcatttaaatttgcttctgtctgcagcaggatctaatgtgtggaccaaatttggatctgaaatttcgtatcacgggtagatgcatcttgtgccctgctagatcttacctaaaggcttacccaagttaccccttggttacatatgctatcttattttggtgtgctctcatagccttcatgttcattgtctgccaagtataattccaggaaattatgtaccctgcaactgttcctgcagcataagacaaattctttttgcgcttctgtgtgtcatctctatctgaataaccatggctgtcaggatctggatcaggatcctaggcaggatcatttgaaggttgacatgatcagtatttttatatttttatgagcacgataggatgctagttagagctctggaatggccccacagcgctgtagtattataagatcctacataccggaacaactgtacttctatccttttaatacttcatctcctcgcacctggtgctgtactgtcaatacttttagaactttatttgcctatatatatatatatatatatatatatatatatatatatatatatatatatatacactatttttaggtgcaaccattgttcgagcatcacccgtttcccaagatacaatgatccgcataagnn

SEQ ID NO: 11368 - DNA, 937 bp, Triticum aestivum
  unsure (1)..(937): unsure at all n locations
  Clone ID: PAT_TA_11368
gggaaaacttaagagtgtctttctccctgatgatcttacttcctggaattgggacatccatacagtgcttgcaaatgaaaatagtttttggtgggtggatttgtgctgtggaatcctctcttatgatcttgaccagcaccaatctgctcttgggttcatcccaattccaacagcatgtttagaggatgggtacagacaagatcgttttgtcagcatcagcacaggagaacttaggtttgtccatatctttaggaaagacgatcttttctgtgattatggtatcaagtcacagcagtgtgaagattatgtcaagacttggagttggagagatgggcggtggattgaagagtacgagatgaaatttgcagatttttgggagggcacaagctattcttcaagtcgtctaccgaagtttgtaccagcatattctactgttgatccttgtaatcataatctagtacttttacttaccaactggccaacattttgatggtcatgtaatttgtgtcgatttgccctctatggagatcacatactgtggcaaagtacgcgagggcctacttcacgggctacggctagaaatatttgagttttcagaagcaggagcaaaggaggatcagcagcagcaggagtcctgggagatggctgtgtctggtaaagagactgcaccaagaacaaagcatcgtcggctggaggcgtaattgggccattcttatcctgctttgagttggcccaaagagcacacgggaaaacgggctaggcccattgactaatgtcttttaaaaaaagccataaacaaaaaaaattatagtacagaaaaatacagggaaacaaaaatttacaacttgccgtgctctaatatataaaaatttctatgatatattatttgaaactaggaaattttttatnaatttttaaacatgccacacggaaaaaa

SEQ ID NO: 11369 - DNA, 983 bp, Triticum aestivum
  unsure (1)..(983): unsure at all n locations
  Clone ID: PAT_TA_11369
tgagccggaccgcaggaacagaggcggccaaggctggagagccatcatgtgggatacgacggtgatttcaagatggttggagccagcgcttcagagttgatgttgataacatttcggtggacagaagttattctggtctactgcctcagctgtggaatgacgagaccagagaactagaactgaagagactgattttgtatacccccacgctgagcgtgcacgacgacaatcttctttacgtgatggctaagatgaacagtgaagacgacaaggcctgggtcatcaccgtcgacatgaaatgcgaggccgtggaagcaatcgccccgtattctaccagagggcgcaaactcacttcatggcatagtccatgcacctttccagagtacctcgacccggcgaccccaggggatcatgtggccatgcactctaggaggatttgtgcggcggactgtgttctgcaaatgctgttgactcgagactggttcagggaaattggtgaacgctttgaatttgagaggccaacccacgttgagtgcctgtcactaattcagtgttgcccagtatcatctgttctttcagatatccaagaagtggtaaaatatgctttctctactggtgaaggcgaagctgctcccaaagctgtggatttatgctcacgagcttttgaagacttcgatgtgctgctacgcgagttattgcatgatccagcgtcatctaccgaaggcatgagttgcaaaatcagtgttgcccttcgagctttagacagtatcttggacattgtgccaccaaccttgagggcgcttgcggatgcctgtcatcaaaaaggaggaaaacatattgatctggtgaggacctggtgatcaaaggacttgagacacagtgctctctaaacaacaacttacatggggcaagcagcatcgcatcaagacagntcgacantcacantgggatcaactgataacgttcaatngaggaggacgttt

SEQ ID NO: 11370 - DNA, 789 bp, Triticum aestivum
  Clone ID: PAT_TA_11370
gagatcacctcgcaaactgtaagaagtggcttctgctcgttgtgggcctcccggccatgctttcctcgtcggaggcgtacgtcttctacgccggcggccgcgacggctgggtcgtcgaccccgccgagagctacaaccactgggccgagcgcaaccggtttcagatcaacgacaccatcgtgtttgcgcgcggcgagggcgagggcgcgggcgcgctccggccggcggccgacccggccggcctcccgcgcgtcccgcgcgccccgccccgcccgccggcgggcgcccgccggcgccccgcccgccggtccggcccgtccggtcccgtcccctcctcctccgccgccgcggcccggtcccgggccggcagggcgtggtgcggcgccgcgtcggcgccgcgcccccggccctgggggcgcgccccgccccggcgccccgtgcgccgccgcgccggccccctgcgcctgggcgcgcggaggccccggacatgagccctggccacgaggggatgtcgcgcagctcgctgcaggcgccaccgccgacggcgagcgcggcacggttggacttggacgtgatagccgtcggcgtagtcgtgggggttttaggggctctggtgctctgagatggcgtacgaatcggactagacgttgtgttcgtgctgtcatggtgtggtctgtggatggtctgttcgttgtgtgatacgctgttggtgtcagttgttatatgtagttcaaggagttgagattcgtatacagaataaaatgatgtttatatgttacaaaaaaaaaa

SEQ ID NO: 11371 - DNA, 1011 bp, Triticum aestivum
  unsure (1)..(1011): unsure at all n locations
  Clone ID: PAT_TA_11371
tcgacccacccctccgtgttttcgtgttgcatctaagacggcccttaccaacatcctaatttctggccattcttcgcattggagttgcaaataagacttgcctgctatacaaatcaaaccgctgctggataacagtagtactactacttttgaatttaaatcaaagaatttcttaaatgtctctctctgggctaagctaagctaagctaaaagttgcatcattttctttcttctcctggttttctccggttgctctgctctgcctactcattgctcgcagaagccacgtgagcttcgtcgccgggtccctcctgtccaggccggatctgttcaagctgccgcagcacctcccgtgcctcgggccgggccgacggcgacgggtcgacgcactgcagcgcgagcttgagcgtgtccatgagctcgtccccgtccggcccggtggtcgcgtcccgcatcagctcgacgtcgaacacctcgctcgtccattcttccttcacaatggagctcacccactgcggcaggtccatgccgttggtcgtgtcggcgggcgacctgccggtgaggagctcgaggatgatgacgccgaggctgtagatgtcggtcttggcgttcgccttcttgagcttggacagctccggcgcgcggtagcccagggcgcccgcggcggcgagtacattggagttggcggcggccgtcatgaggcgggacagcccgatgtcggcgatcttggggctggacccgtcgtcgagaaggacattgctggcggtgaggttgccgtggacgatggtcgcgtcgtcgtggaggtaggccaggccgcgtgccgtgcccttggcgatcgtcatccgcgtagcccactccaccggcgtgttcggcgcgcgagcgtgcaagaaggcggagaggctgccattgggcatgtagtcgaagacgagaagcttctcccccttggggccaaggtagtatgccctgagaggcagcaggttgggatgccgggtncttgccgagcgccgccgc

SEQ ID NO: 11372 - DNA, 804 bp, Triticum aestivum
  unsure (1)..(804): unsure at all n locations
  Clone ID: PAT_TA_11372
cccagcccaagaacttctggaacaagctccgtcacgcagaagcgccggcaacggggcatcgaccccgccccgcacaagcccatggcctccggcgcagtcacggcggcatcgccgggcgtggaaggggggcaccgtaagccccgtgccgcggccgccggcggcagcctggcgcggacgcggcgtccgggggtccccccgctaccggggtgccccgagtaccggcgccccttggccctacggcggcgagctgcgcagcctgctgcacggcgaggtgcggcagtggggtgaggcggaggcgcggccgccgctcccggagccggcgccgccgacgtcagctccgccctgccaaggtcggagccccctcgctagggggggggctaaagcggcaccagcacctggaactacgacggcgtcctgcgcagcgtcctcgtcggttaggtgctgcactggtccttgtcggagctggaacaccagtacgactacccgtcagtgcacgacctcacgttaccctgccaagattagacactcattattctcaagtactattatacatattttgtttttctctgagccgtctcaccttatagtcgtagagctcgtacacgagaactttgctgtgtacactacagtaattatacacttgtaaaaaatgaaccttcccaccattagtacactacaggcgacacacaacccgcagggacctgccccggtgttcccttggcctcccgaagatacagaacaaggatggtgcgcgttgcggcaacatccattctccgactgaactatagaanttggtacaaataa

SEQ ID NO: 11373 - DNA, 1049 bp, Triticum aestivum
  Clone ID: PAT_TA_11373
ggtctgatgaagtaccatcccgtggtcgcggccggggtacatcctttaatgcaacatgtcccccttcgagttctacgatccagagggttattggataagattccgttcacaactgttatcaccgacttgagcacttgtcacccaacatggtttcacaagcttgtgactagatgttactgtccatcagctgaggtgacaaagagagcactaaaagctggactgaaaccttcacaaattaaagtctatggcctccctgtgcgcccatcttttgctaaacctgttccaccaaaggatgaattgcgtagggagttaggtatggatgaatatctgcctgcggttctattaatgggcgggggtgaagggatgggtcctattgaagccactgctcgagctctcgataatgctttatatgacgaaagccttggggaaccaaggggtcaaatacttataatttgcggacgcaataagaagttgaccaacaggttgcagtcaattaattggaaaattcctgttcaggtgaaaggttttgttacaaagatggaagaatgcatgggtgcttgtgactgtatcatcacaaaggcaggacctggtactattgcagaggcgatgattcgtggtctccccattattctaaatggttacattgctgggcaggaagctggcaatgttccctatgttgttgaaaatggctgtgggaagttctcaaaatctccagaacatatcgcaaagattgttgcggactggtttggccccaggtcagacgagctccagataatgtcccaaaatgccctgaaactggctcgcccagacgcggtgttgaaaattgttcatgatctacatgagctagtgaggcaaaagtcatttgtaccagaatatgcatgtgcaacataagctcctatatctcgtcttttgaatttagttagttttgttccttttttgtgcggcattagtcatagttatttgtgaggattcaaactatcaattgatttgcaaatgccattatgaaaggaaaaaaaaaaggaactcgaaaaaaaaaaaaagaaaaaaaa

SEQ ID NO: 11374 - DNA, 975 bp, Triticum aestivum
  Clone ID: PAT_TA_11374
gccgcggccgtgcgggctggggaccgagcgccggctggtttcgatcgagggctttctcgggccggcgcgggatcggatctgagccgccgtccatggatttctcgcagcttggctgcacgttgcttcggatttggtactactacctccgtcctgtcctggtttattgctcccctgcatgctccctccctccctctctctctccctcggtgtgaatcaggcgagcgctcgttgccggatcactgaaccatcgtcccggtggccgccgcgtcagttccgcaccgctacagcgccgccagccactgccgctcaatcggcttggatttggttgtggcgtgggcttggaaccgtacggtgttgttgtcctgatgcgtgttccgcgctgggaggtttggtcggctgacgccaggtatgagcagctcctgagcctgattgctccatgtttgcacgcatgcatgaatgtgatgtgtactccctctgtaaagaaatatcatggtcatgttgcttggtgtgcaacctcttttctcatcagagaaaatagtggcggagctatgatgaagattgttgctgaaataatcatgtcttgagcaatcaagacagccgtggtggtggtggtggtggtgggtactaagagcatctacacctggacttgctgactgacccattgtttgggtggccgccctatcagttcccgtcgctatggtgccgccagccaccgacattccatttccttggatccggttgtggcgtgggctgggaaccgtacggcgttgtctgagaggtgtccttcgagcgggagctttggtcggtcgaggccaggtatgagcagctcctcagactgatggatggatggccaccacggaggggacaccaggtgaagggtggactccttctggatgttgtagtcagtgaggctgcggccatcgtccagctgctttgccggcaaaaataaggccctgctggtcacaaggggggatt

SEQ ID NO: 11375 - DNA, 549 bp, Triticum aestivum
  unsure (1)..(549): unsure at all n locations
  Clone ID: PAT_TA_11375
gcgacgaccgtgactacagcaagcaacatagcaggagcagaaacatggacgacggtgaagaagactacaaacggagatcaggagctggtcgatacgacagggatgataagcccaacggtgaccggcgccacaggggcgatgatgaccgtgggaagggcgatcgtcacaggagagacgagcgtgaccgcagggtgcggagccctgatgctgatagacatagaagggaagacgccggacaccgcgaggcgagcaggcacagggagaagcggcaccaggatgatagatagatgttggctgctgtatcgcctgccagttttgccctcgccaattttctgcatacgctgagttttttatgtagcttgaaatgtttaggcgtagactgtataatatgggagctcggaaagttttcatcacatgttcattttcggaatgtttgttgtttttagatcaaaaaggacgttttgttgtgtggattcggaccggtggttcagccttcaatagttaataactgctctcctgtgtttccggcaaaccctgggntnccaatta

SEQ ID NO: 11376 - DNA, 647 bp, Triticum aestivum
  Clone ID: PAT_TA_11376
ggccccacttcctctgccacagagcacacttcatattctgccacaccacaagcctcaccaagacccgcgatacgcttagacgcttcaccagccacgaatccgcatctctattccaacgtcaagtcgacaacatcacaacagcaagtatgagctacccggcgcctcaacaacctggttactatggcccgccaccgcagcagggctatggacagtaccctcctcctcaacaacagatgtactaccaacaaggtccgcctccacctcaagaggaacccaagaaagacagaggatgcttgactgcttgccttgcgactttgtgctgctgctggctctgtggtgagacatgcgaatgctgcctcgattgtctagactgctgcgactgctgctagtccgcttcttcaagtatgcgacaacgataacggcggttcattggggaaggaatctggaaaacgagacgaccacacgctcactacatttccttgatgtaagggcgcgtatatccaccgggtttcgatgatgggcacaccagggggaggacttgatttaacggctttggtttgtcactgcagtggcaatggagttaagtggtattgctcttagtgtttgttgatacaaatctgaaattcacttctatctcaaaaaaaaaa

SEQ ID NO: 11377 - DNA, 874 bp, Triticum aestivum
  unsure (1)..(874): unsure at all n locations
  Clone ID: PAT_TA_11377
gggcggttcgagcagagcggcgggtggatccgggcgctgctggaggaggcggagaacgagcggatgcacctgatgaccttcatggaggtggccaaccccaagtggtacgagcgcgcgctggtgctggcggtgcagggcgtcttcttcaacgcctacttcctggggtacatcgtgtcccccaagttcgcgcaccgcgtcgtgggctacctggaggaggaggccatccactcctacaccgagttcctccgcgacctggaggccggcaggatcgagaacgtccccgccccgcgcatcgccatcgactactggcgcctccccgccgacgccaggctcaaggacgtcgtcaccgtcgtgcgcgccgacgaggcgcaccaccgcgatgtcaaccacttcgccgcggacatccatttccaggggctggagctcaacaagacgcctgccccgctaggatatcactgacggatgaatgcccagaccgcctagctctgcccttgtcagtgaagaacaacactcgtatatgtgtcggataggtaaggtagtgatgcttgagaaagaaaacggccgtttgtcacgacagctccaagatttctcgaggaactatttggttagctagcgatgaacggtggtgcactttggcttgtaatggaaggttgctttctgttagcaaaaggatatatgngcttgacatttntgctttnaaaattcacaagngcactttttagnttgcanacctcgnnnnnnnnnnnnnnnnnnnnnnnnnnnnnaaacttnganaatactttttaanagcggggcggggggncccattngatttttcncccccggggggggggtncccaaggtnaagngtncccccaaattnnncccnttaaan

SEQ ID NO: 11378 - DNA, 1003 bp, Triticum aestivum
  Clone ID: PAT_TA_11378
ccccgccgcgcgccgtctcacctctcaagcgctcgccagcgaaacccgatccaagaaaacaatacccactcccaaccttctgtggcgatggcagcactggcgaggagggcgggaggatcccctgcggcggcgctgtgggccgcggccaggggattcgcgtcggtcggctccgacatcgtctccgcggcgcccggcgtgtcgctgcagaaggcgcggtcctgggacgagggggtcgccaccaagttctccaccacccctctcaaggacatcttccatgggaagaaagtcgtcatcttcgggttgccgggtgcatacacaggagtatgttcgcagtcccacgttcctagttacaagaacaacattgataagttgaaagcaaaagggatcgactctgttatctgtgtagctgtaaatgatccctatgtgctgaatggatgggcagaaaaattacaggcaaaagatgcaattgagttttatggtgaccttgacgggagcttccacaaaagcttggatttggaaatagatctctctgctgctttgcttggtcgacgctcccacaggtggtcggcctttgtcgatgatgggaagatcaaggcattcaacgttgagaaagccccttctgacttcaaggtttctggtgctgaggtgatcttggatcaaatctgagctgatcggtaatcggtgctctgttttgcttttgtgatgcaaataagtgacagctcgagaatctgtgtgaagatgttgctgtctgtcgtgctagttccagggacagtcattttgctgctgcaaatctttatttcttttgttccagaacagtcatcgaattagtcaccggttcgtgtatgcgacagtttctgttattttacgcgtgaatttaagagatttggcctcggacaaagagcggggctccggtccaggttatctgtgaacgagcggagtgtgtatttcgtccaacaaaacttgggaccatataacataccccgaccggggggggcaaaaaaaa

SEQ ID NO: 11379 - DNA, 656 bp, Triticum aestivum
  Clone ID: PAT_TA_11379
gggaagcatccccacgtccacgtcggtcagcgagtcagctgtcatcgacgcgtctttcagcgatgtctggcacctgatcaagctccaggacttcagcaagttctggtccaagctcgacaagagcgaattcgtcaagggaacctcagacgagacggacatcgtcaagtggaccttcaaggacggcgccgagctcgaggtcaagcaagaggagcactcttcaatcgaccacttcatcacatactcggtcattacctccaagcctgagctctcttactcttccgtcgtctcaactatccgcgtataccccgtcacttccggcacccacgagaacaagacgttcatcacatggtctggcaacttcagcagtgatgccgatgctagcgtgatccaggatgccaagttcaagcgccgcgaagcccttgccgaccttgccaaagttgtctccaagaaataggtttcgggcaatggaggcctgactttttcagaggttgagaaattcatgcagtaaaagacatgttatggtggctcgcattttgcgattggttcgcaatgacgatgatgatgatgatatctgagaatcatgcaggcaatggacccgagttctgtagtttagcatagcaataccgatcaagatacaacgttcaagaaaaaaaaaa

SEQ ID NO: 11380 - DNA, 925 bp, Triticum aestivum
  Clone ID: PAT_TA_11380
ggtgttttggtttttggctgagattttttgcggggaggaggggggcatggtggtccgagcggacgacgacgacgagcgaaggcggtgacgcatggagatgctgcaaccactgtggtcgcgagctggaaccggctggcgggtgagctgcagtcttatgatagaagcatggggcggccgagggacgagcgcggtcgacacgggtggccggtgagtaggagcggcaaaacggcagcaacgacggcagccggcggcgaggggagcttgcagtggttcgtgagcagtgggaaggagagaaaaatcatggccgtggagtctctgctgaaggtagaagaaaggaaaaaaggagaggcaggaaaaaagataaggataggaaggggcggttgtgcgaggcccatcacatacacacgtcttgctcgggggttgttttcgtggacgttggggccagcgtggcgcgcgaaccggccgaacgttcggccggtgcctcggccccaaacgtttaccttcttcttatgtctgttggtatcaattagttcgtcacttcatcatcgggccatcagtcatcactacagatggagcaaggaggagcattcagctgtactttccacagccactgattccaccgcgcaggaattgtcagaatggaatgcgaaatactgggacaagtttgggtttgtcttcatgatatgcgcgtccaagaggaccgctcctgaggtcttagccgagcttaagttctgcatatgtccattcgagtagttgatttctgtaattgacgacgtgtatgcctgtttgggttgtcatctcaacaatcccttccaacagtatttgggaatcctcgccttaaattccaatgtgtggtttctgtaatcgatcgtgtatgcctgtttggaaaatctcaacaatcccttgcagcagtaatgagtttttt

SEQ ID NO: 11381 - DNA, 295 bp, Triticum aestivum
  unsure (1)..(295): unsure at all n locations
  Clone ID: PAT_TA_11381
gcaacctcgcataaattgctcaagncagttctgtcttttacttcttcggatgatacccactttgcacactggtttttaggggagatacttgtgggtttcaattaatagtacatcacggttttaatatttggttccagcataatttggatgcgccatgaaccccagatacccagaaagacgggatcggggttgcaacagatggataacacgccttctggtggaagtttttcttttgtttagctgcgacgatacccaaatcaacatgctcattgttcattatcgtggaaaaaaaaaa

SEQ ID NO: 11382 - DNA, 1133 bp, Triticum aestivum
  unsure (1)..(1133): unsure at all n locations
  Clone ID: PAT_TA_11382
gcaacatgggcgaggaccgtcaacgtcaagtatgatccgtgacaagttctccggcaatgctggatattgcttcgtcgacttcgcgagccctgatgccgcgtccaaggccctttccctcaacggccaactcatccccaactccaaccgccctttcaagctgaactgggcctctggtggtggtcttgctgacaggagccgcgatgagcgtggtcccgagttcagcatattcgtcggagacttgggccccgaggtcaccgagttcgtcctcgtccagctcttccagaacaagtaccagtccaccaagtctgctaagatcatgtccgaccccaccagcaaaaggccctcaccgagatgcagggcgtttactgcggcaaccgtcccatgcgcatctctaccgccacacccaagaacaagagcggcggtcccggaggtcctggcggcatgggcatgccacaaggcggcggcggccccggaatgggcatgtactccatgggcgctcccccaatgggcggctactacgggtgccccccagccgatgaaccagttcaccgaccccaacaacaccactgtcttcgtcggcggcctttccggctacgttaccgaagacgagctccgctccttcttccagggcttcggcgagattacttacgtcaagattcctccaggcaagggatgtggctttgtccagttcgttcagcgccatgctgctgagatggccatcaaccagatgcagggctacccgattggcaactctcgcgttcgtctcagctggggtcgctcacagaacaactccggcccagctggcaccccttaccgccctgcgccacctccaccagttccctttggcccaggcatgggtatgcctccgcaacacccctacggtggtggcggcggttacggtccgatgatgaagtaagcgcattctttccctctgtattgcttgcacggcgcttcattcgtggttcatcccgttggcttactgcaatgacccctttcatgactcggcatgatgaatttcgagcgatttggtctttagttctataacgggcggttctccaaaagttctcgacttcttctcacgacaccgatcttgcggagggccatagaagggagtnctttgtataacaggccat

SEQ ID NO: 11383 - DNA, 1020 bp, Triticum aestivum
  unsure (1)..(1020): unsure at all n locations
  Clone ID: PAT_TA_11383
cgtccgcggacgcgtgggtaaggatgaaacctcaggcgattccaccaccagccctaacactgacagtgaccaaagcgcggagcataacctgccggacagcccgttcgcgtcgccgaccaagtcgggggcctttgcccgtgatcctttcgcgcctactgagtcggagatcgccgccgccccggtctacgggttgcaacgcggcctacaacggcggaatcaacggcaatggtgcaaggaacggcgacccccttaatcaccatcttctggccccagccttctacttaccctaaccaaaacgcatcagttactgttagttgattactcctgctactactaatagtactaccaccaacaaccaagtactaccaccaccaccaaccccccattgatgtgccaccatactactagcaagccaagacgaatcaataaaattgcgactagtagtagtggtgctgcgtctactagtagcacattagatgagctcccttgcctaaacaagcacagaggactcctaccacaatgtttaagctactggcttgttcagcccccaggaggcgaagaactacaaagaagaagacgtttaggaacgacagggcttcattaacaggggaagatttgttagagaccatcgtgtaattatcattacattattcatttgcaccagtgactctgctccccctgttacaacaaagtgcaacaagatacggatgcatagctagctgtgccaccaagctcctgggcaaggcaagccaccgccaatataatacccactagtagtagttctcatgtaatagtagcacattaagtgtgatgtttagccaaaaagtacagaggaatactaccacaatgtatgacatacactagtgctctgctcgctgtattgcaagacagtgcaacaagatacggaagtgacggacaggcagggaggcatagctagctagttgtgttggcgtttacgttatgttataatttcactgggatgaatgaagatattgaacaggccgtcaaaaaaaaanaacg

SEQ ID NO: 11384 - DNA, 648 bp, Triticum aestivum
  Clone ID: PAT_TA_11384
tttgtcagggacctggctgtctgtgaccccctgtcccggcgctacatcctgctaccttccatccccgacgacctagccgccttggtgcagccacccgacgtgctgcgtttcgagcccttccttgctcctccggcggccgaggatgaggacggcttgtctttcagagttatttgcttggtgcagtgcaaaaccaagctggtcctcctcatcttctcttcaggttcaggtgctgaacaatggcgtgctgttacatttgacaattggatcagtttgctcacaggatcaggtaaccagccagagtcataccggcggtcagtaatacgccactatgcacacggctacttctgttgggtgctttctccggcaagcaagttgctcatgctcgacacacgcagcatgggtttctcagttgtggacctcccagatggcaccggtgaaaatgaagcacaggttgccattttggaggcagcgaatggaaggattaagatgtttattaatgagcatttcacaactgaactcaggtattatgtgttgcaaaatgatgggagttggtgcaaaccagtggctgtcagaggcaacgttcaatttacccgtaaataatggcggctatatattcatgggcgtagcgggggggatacttactcctac

SEQ ID NO: 11385 - DNA, 555 bp, Triticum aestivum
  Clone ID: PAT_TA_11385
ttgaagaggagctggacaagatgaacctcctgcaggcggccatgaaagaaacattgcggctacacccggcggtgccgctcctcatcccacgcgagtcaattcaggatgcgcagctgcacggctacgacatcccggccaagacccgggtcatggtcaacacatgggccatcgggagggataaagagtcgtgggagaacgccgaggagttccggccagaaaggttcctgggcggaaccatcgactacaatggcaaggacccccggttcctaccgttcggcgcagggaggagggggtgccccggtatggcctttgggacgcgcctcgcagagctcactctggctaacatgatgatccatttcgactgggagctaccgagtggccaggatccggagtcgtttgaggttgtcgaggctagcggggtgtcacctggccttaagtctcccttgatccttgccataaaacctctgtaagcatacatgggactttgttagagtaagtgttaatgagccccccttatagcaattacataaaggagaaaattaagcaaaaaaaaaa

SEQ ID NO: 11386 - DNA, 1243 bp, Triticum aestivum
  Clone ID: PAT_TA_11386
cgtaccggtaaagcccacgcgtccgcccacgcgtccgcgccttgcaggcaggcctccgctcgccgctcgccgcccgccgcccgccgatcggccttcgctcgccgctcccccgaggtttcaaccgttagcaacctcaagatggctgccaatgttggggaatcagcggcagtcggtggcagcagcagtgatgcagctggagggagcttcgagtgcaatatttgctttgagttgccacaggagccaatagtaactctctgcggccacctattctgctggccgtgcctctacagatggctgcacatgcacgccaacacaccagagtgccctgtgtgcaaggccattgttgaagaagacaagcttgtccccctttatggccgtggcaaggaccgcgtcgacccaaggtcaaagaacactcctggagtcgacattcctcagcgcccagctggccagaggcctgcgacagcccaacaagctgatcctaacaacaatttcggcaacgcccatgcaaatccatggttcatgggcatggggggcgcgggtgcaggggcgggtgttccgctggcgaatggacggtggggcaactatgcgttctcggctgcatttgggggcctgttccctatgctcagcttccaaatgcatgggtttccagatccagctgcatatgctcagcctgccgggtttcactatgggtttggtcatggccatggcttccatggcgggcagcacgcccacggcgtcccccgccaggggccgctagggcagcagcagcagcaggcagatgtctacctcaaggcccttcttatcatggtcggggttcttgtgatcgcaagcctcctcgcagcttaaattggttaccgctatcatcaaaattgtggtggtgtttggtaggagttgccagagcataccttggtgtaggcttatctctaccaaattggagataagttctgttcgttcgaatgtttgtatgaagggtccatggagtttgtgtatctagatctggatggtcttcctctgcatgatacatcatcctatgttttgtagttttgactcctttgatttgataaacgtggtgtacaattgttgggaggtcatccccccgtgtctgtaacctgtatcaatctagattggacagtgtagatgagtacatttacatgtaataattctcatgtttgcacaaagtgacagttcatgtaccttttgacagcaagttcgcggcgagccattcttcgtcactagtgaattc

SEQ ID NO: 11387 - DNA, 767 bp, Triticum aestivum
  unsure (1)..(767): unsure at all n locations
  Clone ID: PAT_TA_11387
ggaattcggcacgaggcngatctctcctttctctctctttcgaatttcctcttcgtcttgctaggcaccgtcggcggcctcgctcgggtcgcagcgttgccccacaaatnctgcttgcccagccatgtctctgtccgctgtcaccaccatccagctcagggagcaaccctgacgttctccccgtctccttgcccccagatctggacaacgcctccagttcggacgcggctcgtcggcccacacactgacgtgtgggcccggacccacccgtcagcggcccaacggcagggggccgtacgtcaggggatccggctccctccagttcatagatttggaggggaatatgagtcgaggggcgggatcggagacaagccaaagagaggttctggtcggctctagggcggaagctttgatagtggaaggccgggttgggtgttggagtattctctctatctgtttagttgatattgtgatggcggcgcaagtctgataattggggaggagaggtgaggacgtcacagatggatggaagcggcaacagaagcaggtgctctgttttatttctcttttcttgacctatgcagccatgagttcttccgtatgaatacgcaaatataccatattttgtgctatttagttaagtgggttttccgtgtgatttatggtgagttttgaatgaggtcatttgagctggccactccctagcccctaggatttgttggagctccaaagatatgtttattctngacaataatgtacgtatagat

SEQ ID NO: 11388 - DNA, 501 bp, Triticum aestivum
  unsure (1)..(501): unsure at all n locations
  Clone ID: PAT_TA_11388
aggaattcggcacgagggcttcttcttcttcctgctcgccctcttcggcttctcaaccctcacctccctcactaccttcgccccagagcgcctcctcttcgtccgcgagcgtgccaagggatactacaacccgctcgcttactacctggctaaagtcgtcttcgacatcgtgccgctgcgcatcatcccgcccgccatcatgggatgcatcgtctaccctatgacaggtctggtccctacggcacccgaattcggcaaattcatgctgttcctcgtgctgttcaacttggcggcggcgatgatctgcttgttcctgggaatcgtcgttaggaaccagggcgtcgccaacctgctcggcgtgctcgtcatgctcttctccctgctcttcggcggcttcttgctcaaccacgagacgatccctaaggggctgctgtggttgcaatcgctttccatcttccacttcggcttcgaaggcttgatcgtcaatgaagngcgctactt

SEQ ID NO: 11389 - DNA, 580 bp, Triticum aestivum
  Clone ID: PAT_TA_11389
gcggccggcccgtgggcggcccagatctgcgtcctctctcgagcatctcgactgcggcaagtcggtgttggcatcctcgcctcctccccatctctggctctaggagcagctcgcaggtatactcccttgagatccgtactcccttactcctaccactcatgatccggatccagcagtagctccggtggcgggctcctaaactccttcccctctcaagttcaacagcaagctagagatcccacaatacaagattttaatttatgctggtttgccatgcttgagtcttcagtacctctggagacgcctcatacctgttagaatatagatgaaaagaccggagtatcctttttgggaataaaagattattcaatggtgtggtccttcccagcaagaagcactacaactggaggtagaagctagagctcttttttcatgtacgtcaagaaatcaaaagttgatgcaaattttgacagcaatgtgtgttcaagagtgatcaccttcatactcggtcttgttggtcatggactaaaaattatcatgttatgttatgtgtaaacttgatatgtatgtaaaaaaaaaa

SEQ ID NO: 11390 - DNA, 2626 bp, Triticum aestivum
  Clone ID: PAT_TA_11390
aaggcatgctgaaggagttgaagtgcaacatgaaccactgggtggctatgtatcatcatacaaaagacagctggaagttcctgcatctgaaaccacaattgatgccactgcacaaggcattgcttccttgctgtgtgctcatggtcctgatgttgagtggagaatatgtaccatctgggaagctgcctatgggttgttacctctgaattcatcagcagttgatttacctgaaatcgttgtagctgctccgcttcagccacctactttgtcatggagcctatacttgccactgttgaaagtatttgagtatctacctcgtggaagtccatctgaagcgtgccttatgagaatatttgtggcaacagttgaagctatactcagaagaaccttcccttcggaagaatcatctaaaagaccaagaagtcaatccaagaaccttgctgttgctgaactccgtacaatgatacattcactctttgttgaatcatgtgcttcaatgaaccttgcttcccggttgttgtttgtagtattaactgtttgtgtcagtcatcaagctttgccagggggcagcaaaagaccaacgggtagtgaaaaccattcttctgaggaggccactgaggacccaagattaaccaatggaagaaatagggtcaagaagaatcgagggcctgttggtacatttgactcgtatgtgctggccgctgtttgtgccttatcttgtgagcttcagctgttccctatcctttgcaagagcgcaacaaactcaaatgtaaaagactctataaagatcctgaagcctggaaaaaacaatgggatcagtaatgagctacagaacagcattagctcagcaattctccatactcgtagaattcttggcatcctggaagctcttttctccttgaagccatcatcagttggtacctcctggaactatagttcaaatgagatagttgcagcggctatggttgccgctcatgtttctgagttatttcgccggtcgaggccatgcctaaatgcactatcttcactgaagcgatgtaagtgggatgctgagatttctaccagggcatcatccctttaccatttgatcgacttgcatggtaaaactgtgtcctccatcgtgaacaaagctgagcctctagaagctcacctgacttttacatcagtaaagagagatgatcaacaacacattgaggaaaacggcaccagctcatcgggtagtggcaacttggaaaagaagaatgcttcagcctcacacatgaaaaatggtttttcaagaccactcttgaaatgctcagaagaggctaggcgaaacggtaacgttgcaagtacatccgggaaagttcctgcaactttacaggctgaagcatctgatttggcgaacttccttaccatggataggaatgggggttatcgaggctctcagactctcctacgatctgttatctcagaaaaacaggaactatgcttctctgttgtctcgttgctctggcataagcttattgcatctcccgatccgccggccgccccggcaggtacatcagctcatcaaggttggagaaaggttgtagatgctctttgtgatgttgtttcagcctcaccagccaaggcttcaactgctattgttctgcaggctgagaaggacctacagccctggattgctcgagatgacgaggaaggtctcgtgccgtggtcggcccgccagcgaatagttaaactgatagctgagcttatgaggaaccatgatagcccagaagcattgataattcttgctagtgcttcagaccttctgcttcgtgctacagatgggatgcttgttgatggtgaagcttgtaccttgcctcagttagagctcctggaagtaactgctagagctattcatctcatcgttgaatggggagacccaggtgtagcagttgctgatggcctctcaaatctgttaaagtgccgtctatcacctaccatccgctgcctctcccacgctagcgcacatgtacgagcgctcagcatgtccgtcctccgtgacatcttgaacagtgggccactaggttccactaagatcattcaaggcgagcaacggaacggcatccaaagcccgaactaccaatgcgcagcagcaaacacggtgaactggcaagcggatgtggagagatgtatagactgggaagcccgcagccggcgcgccaccgggatgaccctcgccttcctcaccgctgcggctaacgagctcggctgcacccttccttgctgacaaggccatatttggagctgacaatcagcgacacttgacagttggcgcgagcagttgctgcatggtcagcgagcaggatggctaattaatcccttgctcaaggatggcttcccagtctgccctgcccccatgatgtgattcaaaactgatgtatattagctgatgttcccaatcatacggagccttgctcccgcggtgtgattttaacttgcaatctgacgttagatgttcaagcatattgaactgcttgtgctgtaacttgtattcatgatgtaaccgaaagatgtccgctatggtaaatgaagacgtgtcatttttcgttctccacaaatatgcatatctgcggcccttccccaccgagcctgcacgttgcgt

SEQ ID NO: 11391 - DNA, 1074 bp, Triticum aestivum
  Clone ID: PAT_TA_11391
gggccgccccgcgtccgcgatgctatgccaccaccggcgccggcaccggaagaggcgaccacccatggagcaacccgaggcaggagacggcgccccgcagcagcgccacaagaaatcctccgccgccaagaaggcgaagaagggcggcgccaccggcagcggcagcggcgcggcatggccggcggtaaagcccaagaaggacctcctggtcaatcgcctcaagggcacccagctcctcaccgtccctgacttcctcacttccgctgaggcgaaggctttcgtcgacgtcgctgaatccatgggcttcacgcaccagggcagccttgggccactcaagggggaggcttacagagacaatgaccggatatctgtcacggaccccttgctcgctcaaacgctctgggaatcagggattaacagggtattcatggacatcaacatctccggcaaagtggcaactggcttgaacccaaatatcagactttacaggtacgttgaaggtcagcgcttcggcaggcatatcgatgagagcgtcaaccttggggacggttctaggacgcagtatacattgctggtatacctttctggcaagggaagcgcgaaagattcgcaggctcttgttggaggggagactgtcttttatgatcaccgaggaggaatcgttgctgaggttgctcccgtgcaaggaatggctctactccatctacatggcgccaggtgcatgctgcatgaagctcgcgtcgtgaaaaagaacgtcaagtacgtgctccgttcagacgtcgtgtttgcttagctgaattttttcgaagccagtttcagaccaagggccaatgggtttagctttttgtgatatgtgtgaaaaacagaagccccagaggtaaaatcgagaagtagttgttgcaacattggaaatgccggcctgcctaatcaaaaattgtgttccatcatgcaccgctgtataagagttttgtaactgctgtaatgctggaaatgctcaaaaacattctaccgtttgtcatcatggatatgttttactctactttgtccccccccaaaaaaaaaaaaaaaaaaaaa

SEQ ID NO: 11392 - DNA, 626 bp, Triticum aestivum
  unsure (1)..(626): unsure at all n locations
  Clone ID: PAT_TA_11392
cggacgtnaggtacctacttcatctctcaccgtgagcctgcgccatctctctcctgggacagtaggacggcggccgcttgagggagtgcggggacggtggactgagggggcgcggccgtcggtggggtgacttcgacggcaagccggagcggttcctgcggcggtgccaccagtcccttaccccttactgatcccatcgtggtcacagtgcgctcccaggaactgtgtgccaggttcttcctcgggatcagtgcacgtgggatgaaccaatgacatcgaatggatcctctagcttccaggggttctacaggaacctccacaccccggcggtgctcatcggagccgggttcgtgctcgtcgcgctgctcatctcgctctggctcatactgcagcaccttagatcctacagaaacccttcggagcagaaatggatcatagctgtcttgtttatggtgcctgtatatgcgtctgaatctataatatcgctgtggcattcggaattctccttggcctgtgatatattgcggaattgttatgaagcatttgactttgtatgcctttggacgatacttggttgcatgcctggggggagaacggcaggttgttggcctgcttgaaaaaaaaaa

SEQ ID NO: 11393 - DNA, 646 bp, Triticum aestivum
  unsure (1)..(646): unsure at all n locations
  Clone ID: PAT_TA_11393
acttagctcctctgttctggttgagtngaatctctgaggtgcaacaatggccgcgagcaatgacgccggcgtggtggtcgtcttcgacttcgacaagaccatcatcgactgcgacagcgacaactgggtcgtcgacgccctcggcgccacccagcggtttgacgagctcctgctccacctcccatggaactcggccatcgacgccatgatgggcgagttgcactcgcaaggcaaaacgatcgacgagatcgcgggcagcatcaggacggcgcctctgtcccatcacgtcgtggcggccatcaaggccgcacaggctctcggctgcgagctgcggatcctcagcgacgccaacgcgtttttcatcgacaccgtcctcgcgcaccacggcctggccggctacttctcggagatcagcaccaacccggccagcgtcgacgccggcggccgcctcaggatcaccccgcaccacgacttccgtcatggctcctgcagcagccacggctgcgccctcgccacctgccctcccaacatgtgcaagggcaaggtgatggaggcgatgctgcaagaactgtccgcggcggcggcggcagggacgaggaggccgagtagagtggtgtacctcggcgatggtaggggcgactactgc

SEQ ID NO: 11394 - DNA, 877 bp, Triticum aestivum
  unsure (1)..(877): unsure at all n locations
  Clone ID: PAT_TA_11394
gcacgagggagggcccaagaaagtttcctctctagactcgagaaaaaaaagtttcctcccgcgtctaagcgctctgtcagatagagtccggacggcccgaccctaccctgccgtcggcgaggagcaaggatgacggcgccgaggaggtggaggttcgcgatggtctgctcgtcgaacatgaaccggagcatggaggcgcacgcggtgctgggccgcgcggcgctcgacgtcgagtcctacggcaccggctcccaggtgaagctcccaggcccgtcgatgcacgagcccaacgtctacgacttcggcaccccttacggcggcatctacgacgacctccgccgcaaggaccccgacctgtacaagaggaacggcctactgccaatgctgaagaggaacatctcggtgaagctggcgccgcagaggtggcaggataacgccggcgatggggtgtttgatatgatactcacctttgaggagagggtcttcgacttagtcgttgaagatatgaataaccgtgagcagaggttattgaagagcgtgctgataatcaatatggacgtgaaagataaccatgaagaagctgctattggggcgaagcttgctttagatttatgccacaagcttgaagcagtggctggtgattgggaggaaataatcgatgacctgattgctgcattcgagaagcagcacaagcggaagctcacatactacatctcgttttactgacttgacaccgccttgtaattgtttggatggatggatggttggtagtagtattcaggaaacagtagaaaactgaatagcaacatgtaacaactcttctcctcaggtgtccgtcctggttgagcagctttatcactcttctacgcgcccgcnc

SEQ ID NO: 11395 - DNA, 804 bp, Triticum aestivum
  Clone ID: PAT_TA_11395
cgggtattctgataaggctcctccaagtgatcagtttgcctcgcatgaagtcaaagtggattatgagtacaaaagcattctagaaccagacacagttattccaccagatcaaagaatccagggctatctttacgggccctcaagttgttcctatatcatctgctgaatgggaggctgtgaagttcaagccagagaaaggtgtgaaaagcttctaggttttgcagatagatccagcataccacggtcctattttatgaaagatgtgaactcctttgtacctgaaccgggaaacacaaaagcaatggttgcagtctctgccttagctagagcaatgcaagaaacgaacaaggttgcaattctgcgatgtgtgtggaggcaaaatcaagcgaatgtcgcttttggtgtgttgacacctaacatctcatcagtgaacaatgtgccagattccttttacttcaatatactgccttttgctgaggacatcagagattttccgtttcgctccttcagcagcctgccaccatcatcacagcctactgaagaacagcaggaagcggcagataacctagtgaagatgttagaccttgcaccacctggaagggaagagatcctcaggcctgatttcacaccaaatcccatgttggagaggttctacagctaccttgatctgaagtcaaagcacccagatgcaaatccaccaccgctcgatagctgtctaaggaggataaccgagccagatcctgacgtcattaattatcgagcaccgttaatccaaaatttaggcaaatctttcgaactgaagga

SEQ ID NO: 11396 - DNA, 628 bp, Triticum aestivum
  Clone ID: PAT_TA_11396
gtaaccaccaccacgatccatccgcacacgaagcggtaaccaccaccacgatccatccgcacactcgcagaccgagacctaagctcgaaccacgatacgagggaaccaaacgatagcgaaggacataatggcaactcaattcttgagggcggccgctcgcgccggcgttcgatcacccatggctgcttcccgcggattccagacaagcgcggtactgaggcaggatgctgttatcgcgccagtcaggaagcccgttggtgcctttaggggaggattgtttgggttccttctcggtgcgacgacatccggtgcaggcatgtactactatgtcattgacgaataccgcgtgtcaaatcagctcttgaccgaagacatctacgctctccaatccgcggtccaacggatagaaggctatgtccgcaccctcgaggacaaggtcgatgcgaagaagcgataaagaatccaccaagtacccaccgaatggcaaatacacagcagattgtgagggagacgttgaggaagacatacacgagtggggcaggcagtatcgcgcgctggaccggcggaatgggacgcacatgtacattacgagattggtctctgccgtgtcattacgaaagcgggcatt

SEQ ID NO: 11397 - DNA, 734 bp, Triticum aestivum
  unsure (1)..(734): unsure at all n locations
  Clone ID: PAT_TA_11397
tgcagtgaatcggcacgagggaaactcaagcagccagtcccatgctgcgcggggcggtcgccgcgggggcgcggcggcgcatctcccttgccccggcgagactcgcgcacgagctcgcgcagccgcaggctgagtcggtagtccccgagcggcgcggccttgagccgtcgtgggtcccgctctacaagaggatctcgaaggtgtcccacggcaggccgccggggatagtggcggcggagatggacgaatggctccgccagaggctccggctctcgcaggaccaggtcctcgcgtacgtccgcgaactaaccaagttccagaagaacgagggcgcgctcgagttgctggactggatggaagctcatggagcaaagttgaggcttgggcatcacgcactgcggcttgacctcatttcaaaagtgcgtgggatacaggcagctgaaaaatatttctggagccttccagatatatgcaactctgtgaaaacttattcctgttttctgaactgctatggtaaacacgggttggcatacaaaggtctggagctctacgagaagatgaaggccaaaaacattgttccagataaactggtgtacaacaacttgatggttttgtaccaaaaggcaggccaccagagaaaattctctcccatttgaagaaatgcgaggaagtggtgtaagtgctaataagtttacatacttcaccttgatagaaagcttntcacaatgaatgac

SEQ ID NO: 11398 - DNA, 1162 bp, Triticum aestivum
  unsure (1)..(1162): unsure at all n locations
  Clone ID: PAT_TA_11398
ccacgcgtccggccaccaccaccaccagaggagagtaagcaggcagcagcagcggcagcagatcgcgagagcggaggagcagcagaaggaaggagaggggagaacgatgctgcccacgacggcgtccaagggccggggggccgcccgctccgccccgccgctcttcggcccgtatctccgccgtatcgtcaagtggcagcaaatggatatcgaatacacattttggcaaatggttcatctctgtacttcaccaaaagtagtctatcagcacaccaaatatcacaagcaaacaaagaaccagtgggctcgggatgatcctgcatttattgtcattctaattcttttccttgtgtttgcgacatcagcttactgtgcagcgtttggagagagtgcgccccatgctgctttaacaatcatctcggttgtgtttgtccatttcttgtttgctgggctagttttggccacactttgctggtttcttaccaattcttatctgagggaggaacctaatagccatgtggtcgaacaacgtgtcgaatggctgtatgcgtttgatgttcactgcaactcgttcttccctgcattcgtcatcctatatgtgcttcaatactttttgtcgcctctgttgatcgcacatggattcttgcctgccctattatcaaacctcctgttcatggtggcaatttcttattatcactatctgaactttctaggatatgatgttcttccatttttggaccgaacgacatttttcttgtacccaatcggacttgtcatcatactatcgccactcatgatactcatagggtttaatccaacacgatactttctgagcttgtacttccggtaagagtgggtaactagtaaaagaagactggtgacaaaactaatggcagattgggacatacagtttgaagtagcattttagatctcttgtgctatcagggaagagcgagcctcaaaaaagttcagatcatatttggtgcctgtggaaggccttcagctagtgccttttgaatggcgtccattttggtgccaacttgttcatatatgtgttgtttcctttgatttaagcccaaggaccgagtgtacaattttattgtgaagtacagtatcatattaaatggcatcaacaggcccatgnatctttcttccatcaact

SEQ ID NO: 11399 - DNA, 398 bp, Triticum aestivum
  Clone ID: PAT_TA_11399
gaggaattcggcacgaggctgagcccgtcgtctacaggatactgctgggggcggccagaacgcacggtgatttgggcgtcgccgaggtggccgccgagaggctcagggagctggacggcgggaacggcggggactacacgctgatgagcaatgcgtatgcgggggctgatagatggagcgacgccatggaggtcaggcagcggatggaggataggcgtgtgaggaaattgcccgcttgcagtgtcgtcgactgctgacactgctagctatagagtgatgctcgggtccatggaccgagagaatgatgttaattactctgtagccaattttgtcataacgatgtgaataatgcaaagccagaaaaaaggatgcacgcccgtaggcacacaaaaaaaaaa

SEQ ID NO: 11400 - DNA, 869 bp, Triticum aestivum
  Clone ID: PAT_TA_11400
tgccgctgccctgcagctgcgaccccgtcggaggggagcccgtcgtgcacctcacgtacgtcgcgcctgccgggagctccgtcgccgggattgcggaggagtacgggaccacggaggagacgttactggcgctcaaccgcatgcccgacgccaagagcctcctcgccggccaggtcctcgacgtgccgctccgagcttgctcttctgccattagcagctcggccatcgaccgcaacctccggcgtcccgaacgcgaagctacatcctcacggccaacaactgcatcatgtgcggctgcagctccaccacttggcagctggactgccagccgacgcaagggttgacaccctcctgcccggcggcgaaatgcggagacctgttcctggggaacacgtcgacgtccgcgacctcgacctgcgagagcacgacgtgctcctacgccgggctacacgaacagctcctcgttcaccatcctcgccaacctcaccaccagctccgtgtgcaacgctgctgggatatcgccggccgcgcagccgtcccactccttggcgtccagattggggtcgccggcgcggtggtcggagctgatcgtcgggctccatgtcgctctcctgtgcctcgggtttctgcgccgtgattgagtagcaattcagattcttgtcgctggacgtgtagttctgtcttgtgagtaatttgggacgcgctgcatgtgcatgtgcggctccggtttgcaggatgtgttagaaggcagacgttaggggaacactcgctctgtgttagaaggtgctcgtagatcagatcggggcagatttgtagtgccgaacagtatttccagcgttcttggttttggcctggtgttaaaaaaaaaa

SEQ ID NO: 11401 - DNA, 485 bp, Triticum aestivum
  unsure (1)..(485): unsure at all n locations
  Clone ID: PAT_TA_11401
ggtcgctcgcccgtcgtccgatccggtggcctgtttcccagcgtcggccatgcccaagaagtccgcttggaagtcgccctcttctttctctgcctggcgcctcgcaggctgatgtgccgccgccgccatcatggatgccgaccactagcccgcgctcactaacaccgccaagaagaagagctccctcctgccccaggctccctcctcttctcagcccctcttgaagcatcctcaggttctccggcgaagatgatgccgatgccgcctcgacggagcggaggagtcggtcgagctcctcctggcgggcggggcggaaggactggacatggcgggggcagaggacgatctagacggtgcatatcatccgaagctgccgccatgcatcgccgtaggatgagcagatgatgccctcggccggcatcgttgttgggacatacctagaccagctctagctagctctctctctctttctctcnnaaaaaaaa

SEQ ID NO: 11402 - DNA, 898 bp, Triticum aestivum
  unsure (1)..(898): unsure at all n locations
  Clone ID: PAT_TA_11402
gaggaattcggcacgaggatgatcctaaatgtagccgcctgatctattgctctttatctgattgctgttgtaccaagatcgtcctaataggcctaggattgtagattgtttttctcctgaagcttgtggaatcattgagatagcgaatacatctagattagtgtcagatgtgcttgatttattaccctgaagctaggtttctcttagataataagcatgtctcgcagctgtgttgaatcattagatcaatgaaatctgtaaaacatttgtgttacatacgcttggacatatggtgtttatctttttaatgaaaaaaatatgttgtgctaatagaagcttgtccatgcatttgtgtttgttcttccatcattgtgagcttgtccatcctatctgtgattcttcttcgcagatgcagatctttgtgaaaacactgacgggcaagaccatcacccttgaggtggagtcgtctgacaccatcgacaatgtcaaggccaagatccaggacaaggagggcattcctccggaccagcagcgtctcatcttcgctggcaagcagctggaggatggccgtaccctcgctgactacaacatccagaaggagtccaccctccaccttgtcctgcgtctgcgtggtggcatgcagatatttgtgaagaccctcaccggcaagaccatcacccttgaggttgagagctccgacaccatcgacaatgtcaaggccaagatccaggataaggagggtattcccccagaccagcagcgtctcatcttcgctggcaagcagctggaggatgggcccgtacccttgctgactacaacatncagaangagtccacccttcaccttgngctgcgtctgcgtggnggcatgcaaatcttcgtgaanaccctcaccggca

SEQ ID NO: 11403 - DNA, 617 bp, Triticum aestivum
  unsure (1)..(617): unsure at all n locations
  Clone ID: PAT_TA_11403
cgggctgcaggnaattcggnacgaggcaagccccgtgcttcccttcagcccggtgccgtcctcatccttctcgctggccgtttccgtggcaagcgcgtcgttctcctcaagaccctcgaccagggtgtcctcctggtcaccggtcccttcaaggtcaacggtgtccctctccgtcgcgtcaacgcccgctacgtgatcgccacccgcaccaccgtccccatcaacggtcttgacagcaagaccctcgagaaggtctctgacgccaactacttcgctcgcgacaagaaggccgacaagaagggctccgaggaggctttcttccagcagggcgagaagccccagaagaaggaggttgccgccagccgcgccgaggaccagaaggccgtcgacaaggccattcttgagtccatcaagaaggagcactacctccagagctaccttgcctccaacttcagcttgaggaagggtgacaggccccacgagatggtcttctagattacgagcatggaagcggggtggagtcaagagcgggaccggctgccagggcgttatcattgcgtattagaaactcgatgcaagccacgtcggtagcttgaggagtgctgcaattcaaaacg

SEQ ID NO: 11404 - DNA, 819 bp, Triticum aestivum
  Clone ID: PAT_TA_11404
acaccaacaccaacaccaacaccaacaccagcaccatggtctacagcgtcatagacccaattgctgtatacgtatcgccacctgatcgtgataggtatgagaagtacacggattacttgcaggatgttgtccacttcatggactttctggctcgtcaccctggggcacgaaatgcccaggtcaaaaaccacgagtcagccgtgaccaagcgtctcttgaggcgtgaggttgacaagcaagaggaaatgcaagaggactcatccgcaagtgagactgagtacgtccataccccatccacttcaggttgcacctgaactgaagattgagccaactttgcctgaagtctccagggtcgatgagaaggagttccaaaagcgtcttgacgctgctgggctcttgaccaaggaggagcggaaggctcttgccactgtggacggagtctcgggctctgtgcagatcggtaagaaggcggccaaggccaggcttaagaagtattgtagtgacaatcttgttgaggagttaattgaaagaaatcggatttctcgcggcgaggagcatctgtttgcagtagagatgcagatggccaaggcgtacaagcaagctaagaggaaactcattaagagcgacctcaagaagccagagaaattgcagacgaaaccaaatcctcaaccgggacatgcttcttacacggactatgcagcactttgggaaagctctgaatctgaccaacattaggttcaatcggtcggcagaccgtaacagccaaacaaagatatcttattcccaggataaggttttcctcccgtaggggagttcgcc

SEQ ID NO: 11405 - DNA, 996 bp, Triticum aestivum
  Clone ID: PAT_TA_11405
ggcaccataccggcgtataggcggccgcgcttgcttcgttgcgttggcgagcgagagcgagtggacatggggctggagatggcgccggtggaagaggagagatcgccggagcagccggagctgcagatttacccgctgtgccgctactacttcggcgccagggacgcccggccatgcgccggcgagactgccgccgaccgcgccctccgcctcaaggccaacttcgcggctcgcgggctccggacctgcgtccatggcgtcctgctggtcgagctctcgggtcacccccacgtgctgctcctgcaggtcaggaactcctccttcctgctcccgggcggccgcctcaggcctgccgagcaagatgtccaaggcctgaaacgcaagctctccagcaagctagcggccgcggatccaaacggcgaccaccactggcagatcggggagtgcatgggcatgtcggcgcgagccgaattcgaggccaggccgtttccatatccgcctccgaacactcgtgcacccaaggaatgcgtaaagctgttcttggttaggctgcccatggctcgccagttcgtcgtgccgaggaacctcaagctcctagccgtgcctctgtcccagattcacgacaatcctcaggtatatggtccaatcatatctggagttccgaatctgctctccaagttctccttcaaccttgtcagggactgataaggtgctttgtgtcgggtttttttttgtaacaaggggctgcatttttggttagccgtagaacaatgtacagtacacggactgtcagataagactatgtttgtactcttttttttttgtggcgaatgaaactatgtttgtacttgccagctgcagctagttcatcccgtctccgttcggacgtggcgacggtggcacaaggatattcataccttcttgaaggcgtcgttgcggaaaaggttgatttagtcataggtgttattttcatatcttgtaatggttcgccctatg

SEQ ID NO: 11406 - DNA, 588 bp, Triticum aestivum
  Clone ID: PAT_TA_11406
gagagaaccgggcgtcagtgttttggatcttcctggtttgggatgtggaaattgcctcctcggaactcctggcttcaactttcagtcgccattggatggtgtcatgagattcgagatcatgtccggcaacaagggcctaggcaccgggggcattcgcctatgcgtcccggaaaatctcaaagaaggcattgactcgccggttttcatggtgcctttcaagcacattgagcaatccatcatcatcgacgaacccagcttggacaactccacgccaccgaccgagaaagcccaccgggtcatcatcgtcccaaccgccgctgttggtgcatcggctctgaagagggcctatcccaaggtcatttctttcacgctgcctaaccaagaggcaggctctgatttccaaggaaaggccggagaagatattgatgacccgagtgagacttatcgtagcttggtaacgcgagtgttcaatgcgcagctttctccatttcacaagggggtcgttgatgtcagctcggctgctgctgcttctgaggaagaggatgccagattgatgtgtcatgcggtcttgaagcaggataacagccc

SEQ ID NO: 11407 - DNA, 610 bp, Triticum aestivum
  unsure (1)..(610): unsure at all n locations
  Clone ID: PAT_TA_11407
ctcccncngccagacngagtntccgagttgcngcgttgntgccaagaanttgtcgatagaccgcggcgttgtcgcnttcccgggggacttatcatttacggcgccaacctaacgttcgttgacatggagcagntggacttgtacgggttggagatcaaaggggcagaggcccgcgcacgtggagtacgggcttggacggcgtcggcgaggagggcgccgtgctggtgcagccggacgccgacgggcgcggccgcgtcgtcacggcggtgctccccaaggacgaggcggaggccctccgcgccgcgctcgggagcacgctcctgcagccggctccctgaaacttcagctgggtggctttcagttggcacgaccttacgtttggtagttttcgagagtggtttgctggggttgtttcagtgatccatgcgggtgtggtgtcatcggctgtgtgtgcggtacgaatgtacgatgttacgaaataagttgctccaataacttatgcaaaatgtacccaggattgcaatgatttgtcaaactagtttagaggaaaaaaaaagaggtaaacctcgaactgcttggtctatgggtgtttgatttgataaaaaaaaaa

SEQ ID NO: 11408 - DNA, 605 bp, Triticum aestivum
  unsure (1)..(605): unsure at all n locations
  Clone ID: PAT_TA_11408
ggnctgcaggnaattcggcacgaggcacgcccgtgagcgagagagctgcagtgcaacgggtggtgtggtgctctgctccggcgaaggagctgcaacggaacacgccggtgttgctatggagcgtcgtcaggccgccaatgttgtattggatcattgccggaggcctctcgtgctgcgatgaagcatcgtcaggtcgccgatgttgtattggagcatcgccggccatccggtgccgcgcggtgcttcaatggagcttcgccgggtgcccatcggtgttgcattgggccgtgtcacgcggtgctgccatggagcttcaatggtgctccgccggatgtcgtcggtgttgctttggagctctgccacgctcggtgctgccatggagtagcagcagccgctccccgcgttgtgatgtagcagtcaccgctggctctcggagctgcgatgcagcactcggtggtgtagtggagtgctttgtcggcgatgccagtgttgcgaggttgccggagcaggtgccacggtgggttatgcatcatcgccgtttgctacagagagaggagctatgtggattgatgagcatggaggatgcaatacaacggagaaatacg

SEQ ID NO: 11409 - DNA, 551 bp, Triticum aestivum
  unsure (1)..(551): unsure at all n locations
  Clone ID: PAT_TA_11409
gatacatgcaagaatccggtccccgcatttaatacctaccttttatttattcttatttacnaagtaccaatttagttcctttatttggtactatttgatttgaggaccatcaatcaatatatatattcctgtaacanctcaatcatcgattcggctggnatatatatttcttggngccanggagagagccgtgagtatccatctccattgttgaacttggaagatgggggagaagattgggatgaccaagctttgggcgctttctcttgtggttttggtcctcgcggcggcgccgggcgtaccggcggtgcctatcaccctcatcacatccgccgtcgacaaagggagccgtgtgcatggatgggacgcccgccggcttaccacatgggatccggggctccggcgcaggaaagaatacctggatcgtcaacctagaagggaggccggatggtgccagagccgtgaccggcgtgcatgttccccgaggggagccgcctcgggtcttcgaatctcatggagaggcagctggagttccatggcatcctgagctc

SEQ ID NO: 11410 - DNA, 857 bp, Triticum aestivum
  unsure (1)..(857): unsure at all n locations
  Clone ID: PAT_TA_11410
gctgttttctctcatgcactcgctcaggttgtctactagtggcagcagcacggtactcggccggttcgccgccgcgaggttggcggccgcagctcgtggagggaggagcgtctcggccgctccgggcatggagcacccgcgcgacgacatgcacaacaccaaagaggacgagacgagccacccgttcggggtggcctactccacgaggtcggacgaggaaggcttcggcggggtgtacgcgagggacgacgaccggccggcgtccagccgtccaactgccgaggcgcatccgagccatcctcctcctcctgaccatgacacctcgcaggtgaaggaggagaaggcgggcagtctcaaggacgacaagcacgccacctagcttgctagctagatagtgcgtactgtacgtgttagcttcatggcagtagctagtcttgagtttgccatcaggtggctcgaactgctctgcttctgaggtttgcagcgaccgatgtaaagccatgttttaaggagtttatctgtgtgttgtaataatcatgtaaaataccaaggcatgcttctgtaccttactagctaggtgcacctagcatgagctgtaaatctaagagatggtttgtaaagtgatagtgctctgtgggcgtgggagctagtagaattcttctttgggctggtttagtaagtcggttgtagtgagtcttacctaacggactcgagtctccttgtaaaaaagagcatgttatcggaagcttatattgtgagcttgagctcacatgatctaagatgaacagtaaaatctaagttatacnaaaaaaaaaaaaaaaaaaaaaaaaaaaagaaaaaaaaaaaaaaaaaaaaaa

SEQ ID NO: 11411 - DNA, 1579 bp, Triticum aestivum
  unsure (1)..(1579): unsure at all n locations
  Clone ID: PAT_TA_11411
gggaaatggcgatgacgagaaggtggaaggcctccaccacgctcggcagcccccgcacggcgagtcttcttcctcctcccgccacgccacgaagcgccgacgcgctcacggcgcggcagcagccatggccgaccgcttcttccccaacgacctccccgacttcgtcgccgaggcacccgacagcggcgaccctcccgccgccgggctccgcggcctgctctcgctcccctaccccaggttctccgaccggctcctccgcgccgccctccggctcaaagacaaggtcgtgcaggagacatggactaggacggggggccaggtgacggactacacgctctacacgggcccgctcgggacggcgctcctgctgttcaagtccttccaggtcaccggcgaccgccgtgatctcaacctcgccagcgacatcgtccaagcctgcgatgccgcgtcgcttggcctgccgttcttgactttcatatgtgggagggccggcgtctgcgctctcggagcagtgattgcaaagcattgcaatgatcagttgatggagaccaactttctgagctcgtttgatgagataattatcacagagaaagttccaaatgagctgctgtatggaagggcgggttatttgtgggcttgtttgttcctgaatgagcatctcagtgacaagnacaattcctgccgaacacattagttctgtggcaaaggacataattatggagggaaggaagctgtcgaacaaggggagctgcccgctgatgtatgagtggcatgggaagaagtactggggtgctgcccatggactcgctggaatcatgcatgttctcatgcacactgaattgaagctggatgagcaggatgacgtgaagaatactctgcggtacatgatcagtaaccggtttccaagtggaaactacccctcgagtgaagacagcgaatccgatcgcctggtgcattggtgccatggtgcccctggtgttgctcttgcacttgctaaggcatatcaggtcttccaagatgatcacttcaagcagtccgctgcagaggctgctgaagttgtctggaaccgtggtcttctcaagcgagttggaatatgccacggtataagcgggaatgcctatgtattcctctcactttataggctaaccggcaatgttgagtacctctaccgggctaaggcttttgcttgctttctgcttgaaaatgctgatcgattgattgctgaggaggccatgcatggtggtgaccgtccgttttcattgtttgaaggaaaggctgggatggcgtatctccttttagacatggttaacccctcggaatcaaggttccccgcctatgaactttgagtcccagcatcaatgtatgtaggcccagcgatccgtcagtccaaacaatctgtgtcaaaaatgatcttacattttgggacggagagagtacttgtgttcttatctaccctgtaaaatgtaccttagtgcggttgatatccttgtaaattttagtgtttctgactctgcaaacttgcacctttgtaaaatatgcttgtgagggggttctggtaataatgctcacctttgtgtaa

SEQ ID NO: 11412 - DNA, 1215 bp, Triticum aestivum
  Clone ID: PAT_TA_11412
gacccacgcgtccgtctcgtccgttcttcctctccttacccaacatttccatacctctccactcggccttcccctcgctaccactccgcctgctgccgcgccatggcgctccacgccgtctcccctgcggcggcggcctccccgccctgcgccctctcctctgcccgtctgccccagcgcccaggttgtggttgtctctcaaaccgttcatccctgttaagttcgtccacaaacttcatgaaatttcagtctggagcagtgggtttctttggtgtgcctttggttcttcaacactcggacaagagagcagttttgaggcatgccactaatgaagaaattgaggaagaaaagatgatcgttgaagaacaagctaaagaaaagatggagaaggccattgaaacagttcaatcgaacttcaataccgtcaggactgggcgggcaaacccgtctatgctcgacaggattgaggttgagtactatggaactcctgtaaacttgaagactattgcacagataaataccccagatgcgacttctcttcttatccaaccatatgacaagtcttgcctcaagctcattgagaaagctatagttgctgcaaatattggggtaacaccaagcaatgatggagaagtgatacgagtcactgtcccaccattgacatctgaccgcagaaaggaaatgacaaaaaccgtagccaagttatctgaagaaggcaaggttgctatcagaaacataagacgagatgcaatcaaagcctacgataagctagagaaggaaaagaaactttctgaagataatgtgaaggatttatcagccgatctacaaaaaatcacagacgagtacatgaaaaaggttgaagccatccaaaagcagaaggaacaggagctgagcaaggtttagatcctgacccgactccgactgaacaaaaactggctacatgttttctgaagccctcctctggtcatcggatggctgccagtgcgatggggtgcactcgttgggttgttggagtctcgctaagactgatggatgcaaagttgagacagtgttgctgcgtccatcgtttcccttttgtaattaggccttccccgtcttcctgcccgactgccattgtcaatatttccatgaattaaattctgtgatgtgcactctaaaagttcttttcacgtttcctttgctaaaaaaaaacccaaaaaaaacactagttctctc

SEQ ID NO: 11413 - DNA, 1404 bp, Triticum aestivum
  unsure (1)..(1404): unsure at all n locations
  Clone ID: PAT_TA_11413
aggaattcggcacgagggggaaggagaggtngagtccgctgcagcagtgaaggaggacgctgaaactgcggaggatggtaatgcagagcagaaggccggggaaggagaggtagagtccgctgcagccaagaagaaaaagaagaagaaagaaaaagagaaggagaagaaggcagcagcaaaggggacagaggcgcggccggaggaggaaaaggacccagaggcgcctaaaggcaaggttgacatgaagaagctccctaagcatgtccgggagatgcaggagcctcttgcgaagaggcaggaagccgaggagcggaggaagaaagaggaggaggaacgtttgaggaaagaggaagaggagcgcttgaggaaagaggaggaggagaagaaggcagaggaagcaaagaggaggaagaaggagagggagaaggagaagctgctcaagaagaagcaggagggtaagcttttaacagggaagcagaaggaggaggccaagcggttagaagccatgaggaggcaattccttggtgagagtgaagttccagtagctgatggggctgcccctgagattaagaagaggccaaagtatgatagcaagaagaaaaaagctcaaacaaaggcttcagaggctcagaaggcagctgaagaacaacagcaagaggtaaatgaagccaacattgacgaggaagagtatgtcatggtggaccaggaatctcagtctccggtggcagaatctgagacgaaaacagaacccgaccaagaggtggaagaggcaaaacaagaagaggaggaggaagatgaagatgactgggatgcaaagagctgggatgatatcgatgtgggtttgtcgaagacaagtgctttcgaggaggaagaggagaaggaggacaagcctgttgccacgaagcaggaaacttctaaaccgcaacctgcagcgcctgctgtaaaaaatgttgctccgcctgttgacaactctaaaaagagtgaaactgaaaatgtgcgtgccaacaatggaattgctaaaaagaaagggaagaaaggatcttctaaagacgatgatgctgacaatgctagtgacctccgttcaccaatctgttgcatccttggtcatgtcgatactggaaagacaaagctgctggactgtattagacgaactaatgtgcaagaaggagaagctggcggtattactcaacagattggagctacgtacttcccaactgagaacattagagagagatcaagggaattgaaggctgatgctactctcaaggttccaggcctgctttgttattgatactcctggccacgagtccttcagtaatctgcgctcatgaggttcaaggttgtgcgacattgctattttaggttgcgacattatgtattggcttgaaccccatacaattgtat

SEQ ID NO: 11414 - DNA, 982 bp, Triticum aestivum
  Clone ID: PAT_TA_11414
gcaattcggtggcatctctctgcatagtggtcgacatggcggcggagggcgggagcagggaggacaggtggaccctggccggcgccacggcgctcgtcacaggcggcagcaaaggaattgggtacgccatcgtggaggagctcgccgggttcggggcgagggtgcacgcctgctcccggaacgcggcggagctggagcagtgccgccggcggtgggaggagaagggtctgcatgtcaccgtctccgcctgcgacgtctccgtgcgcgccgacagggaggggctcatgagcacagtccggcagaccttcaacggcaagctggacatactagtgaacaacgcggggcaactgctggtgaagcccaccgtggagtgcacggcggacgagtactccaaggtgatggctaccaacctggagtcgagcttccatctctgccaactcgcgcgccctcttctggtacacgccggaggaggcagcatcatcaacatgtcctccattggaggctccatcggttttgttggctccgcaatctacgctatcacaaaaggtgcaatgaaccagcttactaggagtttggccgccgagtgggctcccaacaagatccgtgtgaatggcgtggccccaggatttatcacaaccgatatgatcaaagatatggacacagagtccttggagcgggagcactcaaagtccccattactgcggagcggcaagccggtggagatcgcctcggcggtggcattcctatgtatgccggcagcttccttcatcaccggccaggtcatttgtgtcgatggcggtcgaactattagcgcttaattagccagcaccaccactgcataagttactcggcgaatagttaaggagagtgtgggagagtcaaacaaaaattagtgaatagataaataaattagcgatgccaactagtgtcatcatgtacaataagtatatgtcagtatgtagtgggatttctacaaagtttc

SEQ ID NO: 11415 - DNA, 721 bp, Triticum aestivum
  Clone ID: PAT_TA_11415
cccacgcgtccgcagcgccccattgcctagcgcggtcgctccacggcactggagcagggcggcgccccagcagcagcggcggcgcgcgccgcgctcgccggcccgggccttctccccgcgctccgcttccgcgcgtcgcccgcctctggtcggcagcgcctcgcccgcaacctcctctgctcggttcctcccagccggcgccgaatttcctgctctaggtggcagaatctcttcgctacagctttagggatgtcgtcctcttccacaatcgagggcaaggatggcgagttcaccgaggtcgtggtggtgcggcatggcgagacttcctggaacgcctcgcgcatcatacaggggcacttggatgcagagctgaatgagattgggaggcagcaagctgttgcggttgctcatcggctgtctaaagaagccaaaccagctgccatatactcgtcagatttgaagcgggcggcagagactgcaagaacaatagcaaaaatctgcaatttaccaaatgttgtgtttgatcctgcacttagagaaagacacataggagatgtgcagggcctgacgcttcaagatgctgtcaaagaaaagccagaagcttacaaagcttttatgtcccacaagagaaaccagcaaattcctggtggtggggagagtcttgatcatctatccgagcgttgggtcttctgtctgtataataaaggcgagaaacatagag

SEQ ID NO: 11416 - DNA, 405 bp, Triticum aestivum
  Clone ID: PAT_TA_11416
ggtcgtccaaacatgcgccaaactgccacattgctgcccacctggcatcttctgggagagagggaggaaggagagcacctggtaggatgccacatgggcggaaactggtagctttgactctttctccatctcctccagcaggatgtcagtgagcagcgtcgctctggaccgtattgatcctcttgtttgaatgagttggatggacttcttcaacaaagtgagcgcttggcgcatgtcgactgactgcgagtggtttcactcccatttttcttaatcaccaaaactttggcacctccgtcgcctgcctgtacctgtaacactggtgtgtacgcttgaacattccttggttattctattccacgtagcacggctgtacacgttgccagcatgttgtgaaaaaaaaaa

SEQ ID NO: 11417 - DNA, 662 bp, Triticum aestivum
  unsure (1)..(662): unsure at all n locations
  Clone ID: PAT_TA_11417
ggtttatggttgccaactatccaacaggaagttcagcaacgcaagcttctctatatgggtctctaccttttgatttggggcgaggcggctaacttgagattcatgccagagtgtctttgctacatataccatcatatggcttttgagctctatggtatgttggctggaaacgtgaggcccaatgactggtgaaaatgttaaaccagcttatggtggtgatgaagaggcattcttgatgaaagttgtgactccgatatacaaagttatagaggaggaagctcacaggagcaagacaatgaagtcaaaacactcacactggaggaactacgatgatctaaatgagtacttttggaaagttgactgcttccggcttggatggcccatgagagctgatgcagattttttcaaaactcccaaatttgcttatcctaatcgtctgaatggagaggaaagatctgctggcagtgtccattggatgggaaagattaattttgtcgagatacgttcattttggcacatattccgtagttttgatagaatgtggatcttcttaattttatccttgcaggctatgattattattgcatggaatggtggcacaccaagtgatatctttgatgcggagttttcaaacaagtttnagcatatttataactgctgct

SEQ ID NO: 11418 - DNA, 1063 bp, Triticum aestivum
  Clone ID: PAT_TA_11418
gcccaaatcccgtctacggcctacctcgccgacggccagtgcctgccaaaaccctcgatcgtctccttccgtgcgtccgaggtggtggtgcacataggagagatggcacacgaaaggtgctcatggaggtcacgaccgagatagggccgcacttggccggcaacagactatgcgcacggcgggaggtggccaattttcactgctggctaacctatccggctcgccccatggaggtggacagccattgggaggtcacggtcgttgcgagaggttgggtggaggcacagcagggcttcaacgttcttgcctctggacggcccggacgatcatccgtggcttttatggttccgctgcctggaggcgttcgtcaccgggcgaggtcggccttgctcccattgctgctgtccatggcggccgagatggacatggcaaactgcgggctatgtcgcatccttgccgcggtgagatgagccgaggcgaggaaggtggagcgcacgggagcacttgaagggaggagatgatgaaacagccgacctgctggatgtgtggggcccgagaaccaaaagtagcatcaagaatagtagatctttcccgcagttgggcgactattttgtcacacgcaagagcttccgcgcttggccgaacaccggggctcctcgactgtgcggaggtgttcaagaatcgagacccacgcatactatgatttgggcatcggtgtccggtagaccggcaccatcagcttccctcatccatgccttcaacgagccatccgtgtccgactccctcttccttgcaatcggaaaaagagatagcacagctcctgttggcgtgtggcccaccctctgtccactgtttctcctccaagatccggacaaattgtgatgggcgtttatctcctgtttgcgcgaagtcatcatatggatgtgtttcttaatcttgaaatattgtgcttgaggtgttaatgctgaagaattaagacttaactgtattgagtttgatttgtggataggcgtcattttacattgtactttgtgtacgaacaatatgttgtacatctagattg

SEQ ID NO: 11419 - DNA, 479 bp, Triticum aestivum
  Clone ID: PAT_TA_11419
cgtccgcggtacgcgtggcgcactcccgccaacacagtcgcgctcccgtcccgcctcctgatatcccaattccccatcggccatcgccgaatctctccagcccgccagacgccatggaagcctcagccgccggcgccgtcccgaaggcgatgaagtacgtggtggggcgcaagctcggcggcggcccgaggaagaaggcggtggcgcggttcgtcaaggccgggctgcagttccccgtcggccgcatcgggcgcttcctcaagaagggccggtacgcgcagcgcgtcggcatgggcgctcccgtctacctcgccttcgtccttgactccttgagtacctcgccgccgagctcctggagctcgccgggaacgccgccaaggacaacaagaagtcccgcatcatcccgcgccacctgctgctcgccatccggaacgaccaggagctcggcaggctgctcgccggcgtcaccatcgcccacg

SEQ ID NO: 11420 - DNA, 782 bp, Triticum aestivum
  Clone ID: PAT_TA_11420
cggccgctcgaggcggcgggccgggccttcaatcgtggcttggtggtgcggcggagtctgctactgggcggcgcagacgagagccagcgagcgagggatcgagcgatggcggcggcggcgctgcgggggatcggcgcgaagctgtcggcgaacccggagaaggtgacgagcgcgctgctgctgggctcgttcgtggcgctggcgttccggtcgtcggagcagcagggcgagatcgacgagctggaggcccgcaagtcctccctccgcgccgccaactccgccatgtcctccaccatgtgggcctggagggaggagctcgtcaagctcgccgccatgccctccccgcccatcaccgccgcccgcctccgccacatctacggcgaggaggacctcgccgtcccggcgcccaagccgtcaggcccggatgccgaggaggaacatgttcccctaaaaatatcatgaactcttccccgatgcttgttggtcaaattgcagaactggtccagagtagttttgcaccgagttgcaaatatggtttattgctacctaatataaagaaccatgcctccttgtggcgctgttttatactgataatgaacagcgctgaggtagtcttgtctaaaagctatgatgttgttagtccctcgcttgagctcgttttgcgtgaatgttctgcagacacaaaccttgcccttatatcttctgcctgaatatccttcacatacaaacaattatgagatgtatagctctcgtttgagctcagatagggctttggttgtgcc

SEQ ID NO: 11421 - DNA, 720 bp, Triticum aestivum
  Clone ID: PAT_TA_11421
cctcaataaaaagaggcgcgtagctcccctgttccctgcgcctcctccgcctctcctcgtccccggcctccgctccgtctggtaagcgccccgaatcacatacgcctccctcctttcttcgccggattttcgtttgggccgcgcgcttgtgtccccgggtctcgtgcgggtctgtggtcgttgcttgttcccgtggatctgtggatcctgctgtggtggaaccatcatatatgtgtggttcctggttcttgcccgccatgggagggagaagatctaggggttcatggggtttagaggcgtgctggttttgggttttgggtctggaaagttaggaaaagatgtgtacttcttggttgaatcttggccgtccaagctgtgcataagttactgctattttatcagctattgttagagttgcgttggttagcgtctggagatgaggattaaggaaataaaatatttccgtggtcttgatggtctatccattccacggagctgttactgaaaacggtcctattgctgtcctttcgtgatgaaccgcttacttttcggagtcatatgggggcacctcttcggttactttttactgtccagtgactgctttgagctaaccgtgtaggattcatgagattagcagcttgcaattcttatcagttctggatgaaagtccgccccaccagtacggagcactgtgtgggatgagaaatgaatagcgtacgg

SEQ ID NO: 11422 - DNA, 816 bp, Triticum aestivum
  Clone ID: PAT_TA_11422
ccgtgttcgggctcggccgccgccggcgcccgctcgcgttcgacccccgcggcccgcgcggcgtcggcgccggcgcctgccgagccccccggcagcggtgcccggctcgggcgccggcctgccgcgttagcggtagcacaagggtgcaggatgcgtggggctaagcagattattggagtggatctgaacccggagaagcgcgacatcggtaagaggctgggaatcaccgacttcgtcaatccgaacgacaccggggagaaggccgtgagcgaggtcctcaaggagatgaccggcggcggcgccgactactgcttcgagtgcatcggctcgacgtcggccatggcggaggcgttccaaagctcccggaagggctgggggaagacggtcgtgctcggcgtctccagcggcggcgcgccgatgagcatacccccgcacgacatcctctgggggagaggtcggtcgtcggctcgctcttcggcgggctcaagcccaaggccgacatcccgatcctggcgcagaagtacgtggacaaggagctggagttggacgagttcgtgacgcacgagatggggttccacgacattaacgcggcgttcgagctgctcacccaggggaagtgcctcaggtgcatcatctggatggacggggccaaggcgaacggcgtggaggccctcgataatggccgcgcgtgcaaggcgtgactgatatcgctgtcgtcctcggcaaccttgtgatcagccacgataaccactgctcgtctgtcggagcaggtcgacctgtcgctggagtgcggttggtcattgggacgcgagatcg

SEQ ID NO: 11423 - DNA, 389 bp, Triticum aestivum
  Clone ID: PAT_TA_11423
gccaacccggagcagacgccgtcggaaccaagcacagagtcgtcggtggagatgaagatggagacggaaaggcgagggggcaggttccccctggcggcgttcgtcccggtcatcctcgcaggcctcgccgccgggaagctcccggcgacggcgctggccgtgctctgcgtggccttcttcggccggcaccgtcgagcgaatttaggcggccggtgaccggctgtatgaggatcagagagttccgatcccctcgaaaccgggggagatccgtgagtccgttcaatgatccgtgagtccgttcgatgatccgtgagtccgtttgtaaaaaatcagagacagaagaagaagaagaaatccatacatgttgatttcagttttcaaaaaaaaaa

SEQ ID NO: 11424 - DNA, 709 bp, Triticum aestivum
  unsure (1)..(709): unsure at all n locations
  Clone ID: PAT_TA_11424
ggaagcttagggattatttggcatcggattagcgacgaccaatgccggtgcctcctcatctggagtggcatctgatgcgccggtgatgaatgctccaaccaacagcactgaatgggtggagctaattgtcaaggagatgtcagccgcttcggatttggccgatgccaggaatcgagccttcaggatacttgaaatgttcggcaaatctacggcaaactgcagtactcctgatgaagagcagaaactgcgtgaggagaacaagatactgaagcagatgcttggagccctgcttcagcaggccagcatcctgaagcgagccgtcgtcatccaggacaaccggctcaaggactaccagaacatggtgcaggagcggtcccagttcaacgagatcgtcgccaagtaccagcagcagatcaaggagctacaggatgtgaactatgcgctgtctacccatatcaggcaggcgaatcaaccgcgtgtcatatccgggcgccgcaaccccgacgtcttctaggcggccaccgctgtgccactgaagctgcgattcggacgcgagatcctgaagcttcgattgtcgaaggaatcatcatatatacaagaaaacatctctgtgtagtttatatgtttgacacaatatgtgtacacgttttgcgctgcacgatctttttgaatttcgtgtcggtattatggaggnatcatgtgtgaataa

SEQ ID NO: 11425 - DNA, 1159 bp, Triticum aestivum
  Clone ID: PAT_TA_11425
ggtcgccgcccacgcctcccctccgcctccgacgcctatcgccgccgccatcgccgtgtacgttctgcatcctcgcgtcactccagtctccaccctctcgataatcctggacgttggtctttgaggctgagtagatattctcttagccaatggctagggaatcaagtcctgagatagatgatgaactattcaatgaagtttatgggaaagcctacagcggtccagttgcatctgctgcaaatagcgtgatacctaaagcaaatgatgagaagaagcccctgacctgtgagaagtcagatgatgaagatgagccccgagatcccaatgctgtccctactgacttcactagtagagaggctagggtctgggaggctaaagctaaggctacagaaaggaactggaagaagaggaaggaagaagaaatgatctgtaaaatatgtggagaatcaggtcatttcactcagggttgtccacccccgcttggtccgtacgggggaaatgcagatttctttgaaagagttccagcaagagataaacaagtcagggatcttttcactgagaggacaataaatcagattgagaaggatgtgggctgtaaaatcagaatggacgagaagttcctgtttgtcagtgggaaagataggttagtgctagccaaaggtgtagatgctgtgcataaactcatccaggaaagtaagggtaaacatagttcaagcagcccaaaacgggatcgttctagatctcctgtgcgaaaatcagtcgattttcgtcccaggcattctgattcccaatggtcccatagcccaagaaatgtgtcacgctctcaaagtaaaggtcactataatgaaaggcctgtagatggtcgcttgcatgatgatattcccaagtatccaaaaggatctccacaagcttataccagctatggagcaaaagaccatccagtccaatcaaaatctccatttcgcccctcttatcttgatgaaccccttagatcacatggtgggaatagccaatatgctgtggcacatatgcccaataactgcagcactgagagacatggaacagatgcccatctagaccttaagtttgacctcccttcctatccacaaactttggaagagcttgaaattgagttcaaaagagaagcaatggaattagc

SEQ ID NO: 11426 - DNA, 633 bp, Triticum aestivum
  Clone ID: PAT_TA_11426
gaggggtggacatggtgctcttcataaggaagacggccctgcccctggcgatcgagtccttcatgaccttctcgcggtgcggctcggccctggagctgctcaaggtgtgcaccaacatcctggaggaggtggagaagtcctacacgtcgcggatgcaggactggaaccgcggctcgctgtcctggaggaagaaactgcagccgaaccaccgcgtcgacgagttcatctggcaggaggtgacgctgctcaaggcgacgctgctcgagacgagggcaaagctcctgctccgaggcgggctgttcgacaccggcgaggagctgtgccggacctgcatcagcatccggacggtgatgctcgggcatggcgacgcccagacggtggccgctcaggagacgctggcgaagctggtcagatacaggagcaaggtatgagatgacatccaaaaacccttgcgagctgttctagtttgcagcccttattagaagggtttccaggaattttcatttctcccggtttctgaggctccgacgtgatgccagccacagttttgtcagtgatctgtgcaatatccaagcttcatgatgatgccacgtgtaaccctgagttgttatgtacagtacagttcagttcagt

SEQ ID NO: 11427 - DNA, 538 bp, Triticum aestivum
  Clone ID: PAT_TA_11427
tcggcacgaggcacatacaacatgtctggaacttccaacgtcggtaacagcgcggtgtacgagtctcaggaccaggtcacccgctccaacgccgagatcgagcaggagaagaaggagaaccgcttccacgagggcaaggataactcccacaaggcacaggactccaaggacgagcgatccatcgccaacaagctcgagcgcgaggagaagcgtgagaaggagggcgaggagaagtctctcgaggaccgtcagcgtgagcaagatgccacccttcccgcacgcgcacacggcaacgagccctccaagggagccaagatcgaccaggagctgagggaagaggacgaggccatgctcaagaagaagggtgccaactaaagtggtcgtgatatataacgatttcgataccccgcacacagcacagtgtgctaggagttggaggaggaagataataacttggattgacgatgaaacgtctccatgaagccggcctgagacacggcaaaggcacgaatgaaataatttcaacttaaataaaaaa

SEQ ID NO: 11428 - DNA, 572 bp, Triticum aestivum
  unsure (1)..(572): unsure at all n locations
  Clone ID: PAT_TA_11428
gaacactgactcgcgactttgtgccctcagcatacagtggacaggcagccttgctgcttgcaagcaacgaggccgatgcatcagcctcgatttttgcactgaagaacctgggtattgggcccatatatacgatagggttcagatctcacgggccactatccactgacgtgtcaccggtacgatcggtagacgacgtgaagcggctgcagcagccgtttgttatcatctcggctctgcctgctgagaaatcgctcttggtggtgcccctgctgaagcactacagggttgccggaaggaatggaagcaccaacggacatggggcgacaggaacgaaggctgcaggcaaggtgttcgttgacttggccagtgggccccgtaaggccgacccattggcaattgctacatcggccggatggacagcatatggtattgctgacgtctcagcatggacgacagttgaaacaatacggaagctcgtcggccaaaacgtgtgttatgattttgtgcgtttggcatccggaaggggacatttttaaattcagcaattagcaatgtacacatttgatgaccnc

SEQ ID NO: 11429 - DNA, 1114 bp, Triticum aestivum
  Clone ID: PAT_TA_11429
cggccccgccggcccggcccccgcgtgggctcgcgtgggtgggctggggttttcctcttttcgccctcccctcgccgccccaattgggataacagtacccaccttttatttacctctcctctcccctctcctctctgcgttcgttccgcaggccggctgatcggaggagggagatttttctggtttggtttggttcccgatcggatttgtgggtgggaggagagaagaggagcgaaaatggtgcgggggaagacgcagatgaagcggatagagaacccgacgagccggcaggtgaccttctccaagcgccgcggcggcctgctcaagaaggccttcgagctctccgtcctctgcgacgccgaggtcgccctcgtcgtcttctccccccgcggcaggctctacgaattcaccagctccagcatgaagaacacaattgaacgttataagacagtcacaaaggataatatgagcagacagacggtacagcaagatatggagaaaataaaagctgatgctgagggcttgtcaaagaagcttgatgctcttgaagcttgcaaaagcgcatgcttgggtcaaaatttggaagaatgctctattgaagaaccgaatgaagaactgcaaagcttagaggtcaaaattgaaaaaagccttctaggcatcagggcaatgaagactcggcggtttgaagagcagctctctacgttgaggcagaaggagatgacgttgcggcagcacaatgaagaactatatagccagtgccagaaggaacagcaccttgcgtcggaggcggcggcgccccctgctccggcgaccttggcggcgctccctgctccagtgaccctggaggagcagggccagcagatggtggatgtggagacggatctatttcttggactgcccggcaccggccgctcctgagattcaggcaggctgacaacgcttgagaaaaatgcccagaataagctggcaatggagttgcaagcagcggcaggcaatggatgcggacggcctatagatataatataaaccctgtgcagcggaaacctcgagactacatacatgagttagtcgttgttgttgttgttgccccgggcgctaaaaaaaaaaaaaaaaa

SEQ ID NO: 11430 - DNA, 610 bp, Triticum aestivum
  unsure (1)..(610): unsure at all n locations
  Clone ID: PAT_TA_11430
ggaaggtcgcgaagcgcgccgagnaacgccgtccaggaaagtcagccactctggatgaattcatcgccactgagctctctggcgcaccaattgctgagcctagtatcggaagcacgatcacgaacggaggtcgacacacgaagtctgagcgtgagcgtcgtgaagagaacgagaggcgcgagtacgaagaagccaacttcacacgtctggctcctgatagtaagaaggaggctgcgaagaagaaggcaagacagcagcgtgatggtgggtttggcggtgaggaatggaggactttgggcgctggtattgatcgtattgagcgtttgacgcagaagaagggtggcaacctggggagtttggagaagagcaggaagaggcctgttggagatggtccgaggggttctggatctgctgctggagatgcgtttgagaagaggaggaaggtcgtaggaaggtacaagtgaggagtttgattactttgatcctgcaacaaagtcccaagagagatagcctacacaatcgtcatactgccatgtatacactgtggcgaaatgttttccattccatatgtcattacattggagaatcgctaaaacgcctaaaaaaaaaa

SEQ ID NO: 11431 - DNA, 351 bp, Triticum aestivum
  unsure (1)..(351): unsure at all n locations
  Clone ID: PAT_TA_11431
ggnctgcaggnaattcggcacgaggggagatgggatgagggggcgtgcccgggagctccggagcatggcggccgcggccgtcgctgatggtgggtcgtcccggctcagcgtcgacaagctggtgaaccacatcctgtcgctgtagagatctgtgcccgagtccgtacgtagtttgttgctgtgccacgagcccacgaatgttttgtttgtcccgcctctcgaccagtgcttgcattttgtctggagtacttcaaaggacaaagggggccctcaaatcaaatcgtcctgaaaacgttcggaccaggctgcatcaaccacggaaagatcgcacgaagttgaataaaaaaaaaa

SEQ ID NO: 11432 - DNA, 1297 bp, Triticum aestivum
  Clone ID: PAT_TA_11432
aggaagataggagcatgccatggcctcggatccgcgccgccgtcgtcgtagaacgtcgtccgccaccggttctcggaccacagttactggatcaagttgccccgtctccgatctacctcgtcatcgggcatgcacagagacggctatggccatccgattctcgagcgccgccggccaaggtggccgcccgtggccgcctgatgcacgagcgccgccggccaaggacccgcctgcgtccagaacccctccacgcatcatgttttctatggttttgttttccccgcctccatctcttccatgacaagcagcacaattttctttgtttgtaaattaagcagtctggtagacttggaaagaaaggaattgcagatttcaaaaggaggaacagggtatatacatcggcataagatttggaaaggaggaacagggcgccggagacagagggatccggtgcagactcgatgccctccaccgaaacccctactcaattgcttctcgtgctcgaatttgacacaggcgccatcgcagctagggacgctgatgtggaggccggagacagagggatctcgtgttcatggaggccgccaacacatgggccgtggacacatcgtagtgttccttccagggctccagacgtggatgggcgtggatttctcccaggcgatcgtcgacagagcttgctccaggagctctaggcgctgcgagatactcccaattgtgcgccctattattcaaggaagtgacagccactggaagcacggatcgacaaattagacagtagacccaggccatggatcggttgattcaacaccgaaggaagaggcaataggttataaaaacgagctgggggatttttactggcctgaatcttaaacatggccgccctgctgatggactcaagctccagctgtcagaagtctacggacagtcaagtaatagatacgaacccttgattgaaggagaactctgtgcacttctgatagcatccggaccgtaaatctgtagcaggtcctcaacgaatcattccaaggcatacatgtagcaggtcctgaacatatcatccagaccatgtttcacacgtcgtgtgcttatgtaattcggtttttacaatacatcttttttgatcaataagcatctacattgttcttgtaatctaattaaaggccaactatttctctggcatatggtgaattgaccatggaaggatttgtcttgctaagcatatctaatgtcgttatttgagtgtaaaactcatatgcatggtgctactaaaaatgttataatatagtacagaaaa

SEQ ID NO: 11433 - DNA, 1108 bp, Triticum aestivum
  unsure (1)..(1108): unsure at all n locations
  Clone ID: PAT_TA_11433
ggagcaatccgcgcgctccagtcgcctgcataccagaaagcccgtgctaagaaccctctcctccccgaagtcaacgaccgtgcgtccgccgagaattgcttcaagctcctacccctctctctccttgcgcttcgagtcacaaaggtcgacgagaacgcgcacgaaggtcacaaccatgcgaagcctaagcgtgtcaagggcttgtggacagtaaagatcgagcagcaccaggacgcaaacgatgacaactactacatctggctatacgaaggatcgcaatggaagcagaagctgtacgctgctggtgccctgcttcttgtcatcgcaatagtcttgttccctctttggccgcttttcttgcgacagggagtctggtacctgagtatgggcatgcttggccttattgggttgtttttcgccatggcaatcgttcgactcatcatctttatgatcactatcttcgcggtgcctcctggtctatggctttaccctaacttgttcgaggatgttggtttctttgactcattccgaccagtatgggcgtggcaagagacccctgaagatgtcaaggcaaagaaggctgccaagaaggagaagaaggctgccaaactagcagcaaaggccgcaggtggaaagcctaagaagggcgctatcgatactgtacctgctcaagctgctcaagctgctccagcgcccgctccagcgcccgctgcagcccctgcttctgcacctgtcgactcggcaccacagcccacaggttcagaagccgcgccagagggtgctgtcacgcagcgagcaccgcgtgcgacagtcgaggaggcggaggacgagtaggatacgtgctcttgagcggactgaaggtagtttgatactttgcatgggttagcaggacggagcataggcgttcatgagagcggttcacatccatcaacacatgtgcaaatactagactgagatgtctaacatcgtacgagcgtttatggattctggagacatatggtacgaagcgttctggcggatcccagggtcactgtacacgatttggtgtagctaccgttncttgctacttcctttcgagcgcttaacatttttcatgttcgaaccaana

SEQ ID NO: 11434 - DNA, 951 bp, Triticum aestivum
  Clone ID: PAT_TA_11434
ggcggaaggtgcccgcccctctcctccgcctccggcatcgccagccccctgtaggtgcgtctccattcccaagaacctgagctcccccgtgctcgtcggcgcaaggtgggtggagcagctcggcgccatgacctccaccatggctccgtcgacgcgctccactgcctgctcgccggcgccgacctctgcttgcccctgcacatggacgccgcgaagcgctgctgggcgttgcagcccttgcgcaagcgcacggatgtggtcgaggcaggggatcgagcaggcagcggacagaggcggcttcagcagacggacttggcgaggcggcggaggcgcagggagtcccggcggaaccggatccgacgaggatggacgccggtgacgtgggcggcgaggaggagggctccggctggcggagaacctccaggcggcggctgcttgcagttcggcgtcggcctcctgtaggtaacagagaaagagtgagttggtgtgagagagagagacaagaagaagagccaggggaggaaggagaaagggagaaggaagagtggcagggcggcctggaggagctgttgttgctgcgcagggacgaggaggaggcacacgggtcggagacgacgcgcgggcaggggagctcctacatggacgccgtcgagctcgcggcaaggagcaatgacaagcagcagcagctgtggcaagcagaggcagcgggcagcagcagcagggggcagaagcggggggctgcagcggcaacgggcagcagaagcagagggctgctgccacaacagaggtatgtatccccttgaaagcagcaagcatcactgcatcagccttctgttctttgtgttctctgtatagatgtgtagtactccctgatcaacagagggagcagtaaccaagaagcagcaggctgctgctctcctccctatcccctgtatataaaagcagagcgca

SEQ ID NO: 11435 - DNA, 441 bp, Triticum aestivum
  unsure (1)..(441): unsure at all n locations
  Clone ID: PAT_TA_11435
ggnctgcaggnaattcggcacgaggcggagnacgtgtgggtggagaaggtggacaagatcaggtacgtctacaaacccgtcaccaggccttctgtttcccctaacccgaggccggcgacggtgacgaagaatctggccgccgccaacgtcgccatctccaggaagaacagcgggacgaccctggtccgcggcgtggcctcgccggaggacatcgacgactacatcgccaggaagaagagggagtttgctctaggcctgtagctcaaatggattttagtacccacgatggcatgatcatgggctaggatgctttaaattaattaactagttagctatgaaagctgcctgctgcggttgtgattatgtatgatatggagttggtcatgactcatgcatcaacttaattagcgtgcgcatcgtaagttctaagcaaaaaaaaaa

SEQ ID NO: 11436 - DNA, 773 bp, Triticum aestivum
  Clone ID: PAT_TA_11436
ggagtcgtgagagagagaaaaaacagaaacagaaactagaagtgggggagaggcggagagggagatgccggagctgccggaggtggaggcggcgcggctggcgctggaggagcactgcgtcgggaagcggatcgtgcggtgctccgccgcggaggacaccaaggtcatcgacggcgtcgccccgtcgcggctggaggcggcgctggtccggaggaccatcgccgccgcgcgccgcaagggcaagaacctatggctcgtgctggactcgccgccgtccccctccttccagttcggaatggctggtgctatttacatcaagggtgtggaactgagcaaatataaaaggtctgcagtgagcccaactgaggaatggccttcaaagtactccaaactatttgttgaattggatgatggcttggagttctccttcactgataagaggcgttttgcaaaaatacgattgcttgacaatccagaagctgtccctccaatttctgaacttggaccagatgccctatgcgaaccaatgcagcttgatgattttgtacaatcttttggtagaaagaatgctccaataaaatcccttttgcttgatcagagctttatgtcaggaatcggcaactggatggcagatgaggtgctttatcaggcaaggatccatcctatgcaaacttcatcgaagatatccaaggagaagtgcaaggcactccatcggtgcatcaaagaggtgattgaaaaatccgttgaagttggtgctgacagcaacgaatttc

SEQ ID NO: 11437 - DNA, 723 bp, Triticum aestivum
  Clone ID: PAT_TA_11437
acaagtttctacgcctgttcccagcatctcctcctttctttctctcgagcgcgtgcccatccatatcccccattccccctcggcccaagaagaccaaccgggcaacaacccaaagcccacgatgagcacggagccggaggtcgtccacagcggcggctgccactgccggcgcgtgcgctggcaggtggaggcgccggcgagcgtggtggcgtggatctgcaactgctccgactgctccatgcgggggaacacccacttcgtcgtgcccaaggacaagttcgcgctccaggccggcgccggcgatttcctcaccacctacaccttcggcacccacacggccaagcacaccttttgcaaggtgtgcgggatcacctccttctacatccccaggtccaaccccgacggcgtcgccgtcaccgccgcctgcgtcggcgccggcaccctggcgcacgtcgagtacaggaaggcggacgggaggaactgggagcagtggatcgaggcgagcggcatctccgagttctccaagcccaaggccgccgagtaggaggacctgacctggcccgtgttcggttcaggatttcaggtcagtttggttggtggttgctggctgaattcctctccttgttagtcatgaaaagtacgtatgtgagaataaacttggacatgatggtccaaacttgtcctgaatttttctccttgttagtgaaaagtttggttggtggg

SEQ ID NO: 11438 - DNA, 725 bp, Triticum aestivum
  unsure (1)..(725): unsure at all n locations
  Clone ID: PAT_TA_11438
ttcggcacgagggtgaggccgtccttgaggtcgtcttcgtggtcgacgtcaacggtatcctgaaggtcaccgctaccgagaagnacctctggccgcagcgccaacatcaccatctccaacgccgtcggaaagctctcatctgctgacatcgagaacatgatcaacgacgcccagaagttcaagtccagcgacgaggcctntctccaaggaagttcgagtcaaggcaacagcttgagtcttacatctcccgtgttgaggagatgatctccgaccccaccacatctatccgcctcaagcgtggccagaaggagaagatcgagtctgctctctccgacgccatggctcagctggaggttgaggatgcccccgctgatgacctgaagaagaaggagcttgccctcaagcgcactgtcaccaaggctttctccacccgataagcgcatctcaaattagcggcgccacgagggcgtgcaggaaggaaggaagggcgcacgtgcaggatacccagactgcgagctgcgaacggagtttcatctattgcggcatttaacgatagacatggtgtgtttggttccttatctttcatgggttcccggtattcaggaacgcggaaaagtcttctttgtactttcacgacgatgcctgacgaaacgatcgtaatggatgttctgcaaaagtatgcctagcggtcaatgtctcttatgtacctcaccgaagtagataca

SEQ ID NO: 11439 - DNA, 299 bp, Triticum aestivum
  unsure (1)..(299): unsure at all n locations
  Clone ID: PAT_TA_11439
cgaggcaaaggttgaggggaggaaagcatgggtcaagggctggttggagacgattcccaaggcagggcaaggnagccgctcatcctaacggaggcagaggcattgtttattgagccgagacaggcggcgcagatgaggagggttgttaattagatttggggtgaaaagggatggtacggcattctcagggcgttgggggagtatcacgtttaatgtggacggtcgttcgttcgccgatagacttctagagttgcggtctggaaagacaatagtatggtttacttcagtgaaaaaaaaaa

SEQ ID NO: 11440 - DNA, 1472 bp, Triticum aestivum
  unsure (1)..(1472): unsure at all n locations
  Clone ID: PAT_TA_11440
ccgggggccgtcgccggcgcccgccggctccctgccctctgcctggtcctccgtccactgagtccctgacagcgccgcctatgcgaccgtgtcttcgacggtctcgcccccttcggcgacctggcctttattgctgccgtgcgcactcaggcgctgcacatggtatcattcggcgacgccatttcttcctccagccgctcgccggagcgccctcccagcgtagtggacatgtatgaggctgtgcgggacatcctcccggaccttgaccctgtattctcggacccttacatgggtgcactccgcgcagaggtctctgcagtgtgcaaggcccttggttccggattcagtggtatcagcatgggcttggaaaatctcatccgtcgtgaccctgcccgggttgccacacctggtggtggtatacaccccatcactcggtatgtcatgaactatctccgtgctgcatgcggttcgcgacagacattggaagaggtgatggaaggcgaccttggtgctggcggtagagcttctgctgccgtggaccctgaccgccccacgtcttcacttgctgtgcacatcgcatggcatcatgggacgttctgcacaagaatttggatgcaaaatctaagatttaccgagatccgtcactggcttgcatcttcttgatgaacaatggcaagtacattatccagaaagtgaatgacagcgagctaggtgttctactcggcgatgactggatcaagcagttgtcaactagagtgcgtcgctggagcatggattatcagcgttcaacatggggcaaggttacaactgtgctgcagattggtggttcaggcgttggtgcactcccagccaaggcaatgctgcagaaattgcggatgtttaatacctacttcgaggagatctacgcagtacaatcagaatgggtgatagccgatgatcagttgcgaatggacgttagggcagcagtggaggattcagtgatgccagcatatgcggctttgattgccaggttaaaatcagctcctgaaaccggacgtgacttgtacatcaagtacaccccagaagatgtcgaagcacatatccatcacttgtttgaaggagcagcaaagtgatcagttgatcagtaccttgtggttccggtgataatctatttttctctgagatttgttaagttgctggcagggatcttggtgaatatctgttcctcagtaatggtgatattcttacctcaaccttgtagtgttgtatcatttgtattttgtccctccatgaagaaattgtggggtttgacaaatggtgtacatgattatgattgtaggtgtgtgtatgtcaactagtaaggtgattattttgtaacaaaattagggtcccattttggttccaatcactccttcagtttatccttgtgactgttttatgggtgaattccaatgtttatttaaaacttcatggctcnaacatttccaaagaat

SEQ ID NO: 11441 - DNA, 704 bp, Triticum aestivum
  Clone ID: PAT_TA_11441
cgcctgcgcggcggcctcctgcaccaagttgcgtcggcgcactccctcctcccacatctccccgcctcccatcccccaccaccaagccgaccgcgtgtgtgctttgtcgtgcaaacgatggagcaggggagcaagattccggacgaccccggtcagctcccgctcccctgcgccagcggctgcggcttcttcggctccccggacaccgacggcctctgctccaagtgcttccgcgacagcctccgccgcgccgaaggccctggcccagctgcacgcgtccggcgttcccccggcggcggcggggtcgtgcttggcggtggcgctcggggggccgcgcagggccaacgcttccggcaggtgcgcgtcgtgcgggagggaggtgggcctgatgggattcgagtgccggtgcggcggcgggttctgcggtgagcaccgctactcggaccgacacgactgctgctacgactacaggggcgccggccgcgacgccatctcccaggccaaccccgtcgtcagggctgacaaggtcgacaagttctgagctcttaagtagggttccctcggctccaattatggatcgatggtgtggtacgtgcgatcaatggattgtactcctgaattccggatacagaatccaaatgtgcgattctgtcattctgtgtggtttctttcgctagcacacgtgttgcatttcaaaaaaaaaa

SEQ ID NO: 11442 - DNA, 735 bp, Triticum aestivum
  unsure (1)..(735): unsure at all n locations
  Clone ID: PAT_TA_11442
tctttcttgnntctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcctcatcgggctcaacctcttcgcgcagatgcacaacgtgctgctgctgcagggcatccgggagctgcgccagctctacccgtccacgaccatcgcctacgccgactacttctcggcctacgtgcagatgctgaggggcgcgtccaagatgggattcgacgcggcggccgcgaccaaggcgtgctgcggcgcgggcggcggcgcgtacaacttcgacatggacaggatctgcggcgcgccggggacggcggtgtgcgcgaggccggaagagtaccttagctgggacggcgtccacctgacgcagcatgcctacaaggtcatgaccgagctgctctaccaccgaggcctcgcgtctcctgcgccggtgaatttcccgcgcatgtagatcgcctgtggttggtttcgagtttcgacactttcaaagtgttcgccccgccgtttgtattttattttccttttcgagtcttgtggagtgtggacggtagtttggtgttgatgtatgtaagaacttttgggcggcacanaangaagaaataacatg

SEQ ID NO: 11443 - DNA, 804 bp, Triticum aestivum
  unsure (1)..(804): unsure at all n locations
  Clone ID: PAT_TA_11443
ccacgcgtccgcacggcccagcagtccagcactagcctcactcccgaacacaaacccctgcgattttgcctcctcctccggtctcgccgtcgccgtagccaccgccaccgccgtacaagtccgagcccccgcgccaccgcccccctccccgtccgtgctagtcctcgccaggccggtgccgccccttcctaaccgcctcgttcctcgccgcgccggcgctcgcttcgccagttagcgacagaggaagggagtggcgacgatgtcttcgtgggaggacgaggactccgccgccgcgtcggccgcggcgaccacggacgtggagctgctgaagcgggcctggcgcaacgagaaggccgcgccggagatcctccacttcgactccgccctcgtctcccgcgcccgcgagcagatccagctcctcgaggagacgctcgacgacttcacggataacggcgtcgacgacctggtggtctcgctgtaccagatggacctcgaccgcacgctcttcctgctccgctcctacctacgcctccgcctgcagaagattgagaagtacatgtcccacatcgccaactctgaggacctcttgagccggctgttccaacaggagcaccgattccccaagagctgcaaggagatcatggagaagcatcttgagcagtcggtgctgttgaagcttccgtacgggtaataactcggttttcaagcantcgctgttcagcactgangattaaattgtgcccgagnctcaagctttaaaaactttgtcttctnttaaaaacaaagggcgaagtaagtgcantt

SEQ ID NO: 11444 - DNA, 687 bp, Triticum aestivum
  unsure (1)..(687): unsure at all n locations
  Clone ID: PAT_TA_11444
gcgggggagagagatcccctgcacccgcagcatcccaagcatcacttcattactctccatcattcatcgccagcttcctcctttcttccttcctcgcatagaaaacccaagcagcgctggtcccctccccagctcttcttgagctgcttgatcgaccagtcagtgcctggcctctcgcacggaggaagctgccacatccatccatggaggccgaggacgaccagcctgccgccgggtaccggcacgggccgccgtgggtgttcaagggcagcgcattgtaccagctgcatttggtgaaggcggccacggcgcgggcgttcgtgcccaaggagctgcgcctggtggaggccttcggctacacgctcggcggcatgttcctggcgcgctaccacgacagccccgccggccagttcgacgagctggtggtgatcgccggcattgtgtggaatccgccgacttcctgcgcgtgggctgcccgggtgctagtaaacagcgctgaagcctgccggcatggacgcaaggaagtagggcttccaagccatgtcgcggcattctcacagaccgaagattctacgctcagaaatgaaccaaacaactgcctcaacattctcggaatgggggcaggctgctccaagcagggaattgcccgcgccttgggatcaaggaggcctcgggctcatcatcaan

SEQ ID NO: 11445 - DNA, 628 bp, Triticum aestivum
  Clone ID: PAT_TA_11445
agtattggcaatggagatatctgatgaaaatgctggattatatactcttatatctgacctgtatgccatgggtgggcggtgggatgatgtgttgaaggttaggagattgatggaggaacataatgtgcggaacaacagaggatcgagctccattaaggcgggcaaaccacctggcttgattgttcctgccgtcagttgatcttttgctcggttcaacgtctgcaaagttttgggttgaattgtttggatgatactctttttcttagacttgccacagatgtattcagcggatagttccacacgttggttgatgaaatccagctgggccttgtgggaatcagcggaatggatacaaatttccggtctaatctcctgcaatattgtgttgaggactggagatgacagagaaagatttctttgagtacattgccattttggcctttcagagatgacgaatgcagactaacaatggggtgtcagtatggcaggtgaaatctttgcggtgcatacacacggcagtgctggttcgtcctgtcacaactgttttaaagcctgttgtattccagtgagaaactgtgctctgatgtaaaaagaccctctattcaaaagatattgttgctgggatcat

SEQ ID NO: 11446 - DNA, 506 bp, Triticum aestivum
  Clone ID: PAT_TA_11446
ccctcctcactccgatccactccatcgagccctagccccgcatccccgaccccgacccgattccggccgccccgatccgatcctctccctcccctcccgtccaccgcatgcgaggctccggccggcggtagcctcggctcgcgcggacagacaggcaggccggcggccatggagccgcgcatcggcaacaagttccgcgtcggccgcaagctggggagcggctccttcggggagatctacctcggcaccaacgtgcagaccaacgaggaggtcgcgatcaagctcgaaaatgtcaagacaaagcatccgcagctgctgtatgagtcaaagctgtacagaatacttcaaggaggaactggaatccaaacgtcaagtggtttggtgtggaggtgattacatgttttggtgatggactgctgggccaagctcgaggggggcccgtaccagtcgcctacgtgatcgtataccgcctcacggcgtcgtttaaactcggacggaaacctgca

SEQ ID NO: 11447 - DNA, 630 bp, Triticum aestivum
  unsure (1)..(630): unsure at all n locations
  Clone ID: PAT_TA_11447
ccgggaaaattnacgggtacccctttnggcgttggcnttcccccnttatttggaanntttggagccnnggattttntttggccaattntnngtggtggattccaacaaatttttnggccggngtntttnttgaccgaagtnngttaanttnaatggcgaaatgaactgatccaacttcagcttacgctgaccatcgcgtctttcggcatagccgtcaataccttcatagctggggcatttgcgatgaacattccatgccatttttatgacacagatggcagcttcttttggccatttgtcggaggtacatcgtcaggctgctttgtgatctccgttgttttgttagggtacgcctggtggaagaagttgctcggtccctgaactcacagtgaaggctcataagatggtgagagagctcatcattctgaaggtggcaaacacttttgcttctctggcctccggtaaggagcaagccctcgaagggcagaggtgtgcctgttgggttagggagaaactctgtgtgttcatgttttgtagtagtagataacagagtgagtaatatgctgtgatgtttcattgccataaattatacgagtacgtcagttcatcagcatgttaaaaaaaaaaaaa

SEQ ID NO: 11448 - DNA, 619 bp, Triticum aestivum
  Clone ID: PAT_TA_11448
gcaccgacctcctcaactcaaactcctacccttgccacaatggcgcagtccgacagcccatgccccgcagcgccggcgctgttccaccccgctccctagcgcccgtcgccccggtgaggatcacgagccctcgacgactccccgcccgtagattttgctccaattccaaatcccagccagcagaaagccgtccagatgtctgattcctcagagccctcgaaagaaggttcttcagccaatggttccagtgctctccaaaaaactggagcctggagtagcatattgagcactcttgtccagcaagcttcagtgtatggcttggctgctggttattgcctgtcagcatctttgctctccattatcaacaaatgggcaatcatgaaatttccgtaccctggggcactgacagctctacagtacttgaccagtgttgttggagttctcctatgtggacaagcaaagcttattgagcatgatggccttaatttcgcaaccatgtggaagttcttacctgctgctgtgatgttctacatctccatcttcacaaacagcgaactcttgctgcatgccaatgtggacactttcattgtgtttcgctctgctgtgccaatatttgtgg

SEQ ID NO: 11449 - DNA, 1093 bp, Triticum aestivum
  unsure (1)..(1093): unsure at all n locations
  Clone ID: PAT_TA_11449
gaataatntgtcgactgttcacgtccaaaacatctctgctcagacctctgagaaggaagtccgcgacttcttctccttctgcggcaagatctccaacatctccgtcacccccgagtcgaacgaggccgacagcgtcaagtctgcttcggtcaccttcgagaaggagtccgctgctaagactgccctcctcctcgacaacactcagcttggtgccaaccaggttcacgttgccgctactgcctctctcgacgagctttccggcggcaagctctctgctgccgacaacgacacttcagacaaggacaacctctctcaagaggacaagccccgctctcgcatcgttgcagagtaccttgctcacggctacaccatcagcgacaaggccatcgagcgcgctcttgctctcgaccagcagcacggtgtcagcgctcgcttcacctccactcttcagcagttcgatgccaagtaccaggccaccgcaaaggctcagggtatcgaccagaagcttggtgtcaccgacaagggcgctgctgcctggtccggcctgaactcatacttcgagaaggctctcggtacccctaccggtcagcgtctcagaggcttctacaaccagggcagcaagcaggttcttgatgtccacaacgaggcccgtcacctcgccaacctgaagaccggcaagaacgacgtccactctgtcggaaacgacaagactcagtgctcttgtgctagcgatgctggtgcctgcccctgcgctcctggtcactgtgcctgctccggatgtgccaagaactccgaaaagtccactggcgccactgctgaatccgccaacatgaaggtcgtctcggaggagcccagaaagaccaagtgcaactgtggtggtgctgagggctcttgcccctgccccgccggccagtgcacttgcaatggctgcgccaaggcctcgtaagtgctaaggctatgatggagtcgctactgaagaaaaaaattggcttggatggcacaggtgtttacttgcttgctctttttggtggtaattgataccagcacgtattatcgtgcaccgacgacgactttatgctanaataaaaacagt

SEQ ID NO: 11450 - DNA, 661 bp, Triticum aestivum
  Clone ID: PAT_TA_11450
cgttcgtccttctccaccgaccaccgaccctatccccccagctccgcctgcgcctccctgttcgccgcctccgccttgcttccccggtcgcggccattgccacggtgacggccgccgtgccccccgacgacatctcgcagctcaataaccgtctccgcgcgctcgtccgccgccgcggtgtctcttccgctgccacatctcccatggaccccgcccaggcggacgcctacctccacatgatccgcgagcagcagcgcctcggcctccgccagctccgccggcacgcggccgaaccggaatacgagagagacgtcggaagcaacgcggaggacgaggaggagggcgccggaaggaggaaggggttggcggccaggagctctttggggcaccgtgtggaccctcgtgagctggagcccggcgagtacgtcgttcacaagaaagtcggcgtcggcaagttcgtctgtataagcggagaggacggagaggactacgtgttcattcagtatgcggacgccatggcgaagcttgcagtcgaccaggcagcacgcatgctctaccgatacaaccttcctcatgagaaaaagaggccaaggaatctaagcaagctgaatgatccttctacatgggagaagaggaggctgaaaggaaagcttgctgttca

SEQ ID NO: 11451 - DNA, 1037 bp, Triticum aestivum
  Clone ID: PAT_TA_11451
tagcgtggtcgcggccgaggtactgcaatgaggtggcttcagagctgaaatcgagaggtatccgcgccgaggtatgccacggcgaacgtctgccgaagttaatcagaaacgccgaaacacaaaaggtgccgctcatggcggtcgttggccccaaagaagtcgaggccaggacgctcaccatcaggtcccggcataacggggagatgggcaccatgcccgtcgacgatttcatcagcaaaatccaatcggccgttgctgacaaatcttccctgtagatatcccagtctgttaaaacttcagttcatatcgtagagcagtagatcttctgctgcacatacaccgtacctgcccgggcggccgcaaattgaggacgctcttggaagaaaatggcaatgttccactgtgcaggttgacttcaatttgcctgaacggtttgacatcacttatgttgactcgcatactgagaagaaacggcctatcatgattcatagagccatccttgggtctttggagcgcttttttggcatcctcattgaaaactacgctggtgattttccactttggcttgctccaacccaagctcgtattctacctgtcacaaacaatgagctgcagtactgtaatgaggtggcttcagaactgaaatcgagaggtatccgcgccgaggtatgccacggcgaacgtctgccgaagttaatcagaaacgccgaaacacaaaaggtgccgctcatggcggtcgttggccccaaggaagtcgaagctaggactctcaccatcaggtccaggcataacggggagatgggcaccatgcccgtcgacgatttcatcagcaaaatccaatcggccgttgctgaaaaatcttcgctgtagataccccagtctattaaactccagttcatattgtagagcactagaccttctgctgcacatacaccgtacaggagcgcctccgacgaaactgagcgacggaggtccaacaattttgtgcagaactgccatcaccacattatactccagtcaggaacagaagcccaaca

SEQ ID NO: 11452 - DNA, 732 bp, Triticum aestivum
  unsure (1)..(732): unsure at all n locations
  Clone ID: PAT_TA_11452
gcgaaagctccgtatcgccggcctcccccccgatccaatcccaaagataccttttgccctcttctcttgcgcggccctttcgctaccatggcggcggaaggggaggacaagaaggatgctaattccgttggaggcggcggcggcggcggcgagaacaccctggaggcggcggaggaggcgattctgcaggcggtagggcaagagcccggtcaagaattggagggcgaggtggaggagagcgcagatcgagaggggaacggcgacgacgctgggaaggaagatagtgggtgtaaagatctggtcctggtagaggaccctgtcctggtcgaggatccagaggaagcggtagcaactgcagcacttcaggaagaaatgagagcgcttttcgcgtctgtccctgaaggtgctggggcatcatttactgcgatgcagctgcaggagctagagcagcagtctcgggtataccagtatatggctgtgtgcctgtgcctacccatctcgtctgtacctgtacttctctggcggtcgcatccaagaacttgttccgtccattgttaagcacgcaagaaacttttctgtgctgttatttggctctattagctgactgttggtagtgttcaactgtaagatgcaataatacaatagaagttctatggtgttcttgcgtangaatagttgcagaagaaacagtatagctggttttcgggtgttgctaattttaaatttaacaat

SEQ ID NO: 11453 - DNA, 1294 bp, Triticum aestivum
  unsure (1)..(1294): unsure at all n locations
  Clone ID: PAT_TA_11453
tcgggcccgcctccccctcgccccagcccccgagacccctgcagcccccgcctcttgccccgttcttttcccaccgtgtccctgtgccctcgcctcttgcgcggccctttcgctagcttggcgccggggcgggggcggaaggagcaccctaattccgttggaggaggcgattctgcaggcggtagggcaagagcccggtcaagaattggagggcgaggcggaggagagcgcagatcgagaggggaacggcgacgacgctgggaaggaagatagtgggtgtaaagatctggtcctggtagaggaccctgtcctggtcgaggatccagaggaagcatttcaggaagaaatgagagcgcttttggcgtctgtccctgaaggtgccggggcatcatttactgcgatgcagctgcagtagctagatcagcagtctcgggtataccagtataaggctgcccgtgtgcctgtgcctacccatctcgtctttcccatgtgtacgagtgtaaccggtgcctcctctcagggcgtgcccaactagcctacaccaacgggatgagtgacactctgcttatactctgaaaggaggcaaaatccagaaccagtaaggtgccggcgaacagatggaaaaaggtggcggtgctggacaaaaacaatcccaaacgagaaatattgtgaacgccatatgcaccgtggtcgcaagcgtcctgtacaggttattgttgaggatgacgagcctgattccgcatcagggtcaaaatcatcatctggcaaagtcactgaaggaggcaagaagactgacgacaagagttcaagtagcaagaagcttgcagtggcagcaccagctgctgtggagtttacatgattgatgatgtagcatttggaagctgcaagaagagcgtaacggccatggcaattagactaccgttattgtaatcctcaaaagactttagtgttgtctagctataacctcattaagcaagcaaaatgtcttgtcggaagaagccacaaaaacccctgtttagctgtcactgaatttttcagtttaggtgtatagtttgaattagcttggtcgtgccttcggcctttaggcaggtgatgcggcataattggataagtcttccctcattgataagtcgcattgtgactcaagaaactggtggatgaatctgcagagagtagatactatttggtgtgtgcttttaagggcctgctcaattgtgttgtttgtcagttgcataacaattggaagatcaatataattttngaccctatggagattcagttaaaaaaaaaaaaa

SEQ ID NO: 11454 - DNA, 554 bp, Triticum aestivum
  Clone ID: PAT_TA_11454
agcgtccgaagcacgtgccggagcgcaacggcgaccgctacgaggccatctacagcatctacttcggcgactacggccacatcaccgtgcaggggccctacctcacctacgaggagtcctacctcgccgtcaccggcggctccggcgtcttcgagggcgtgtacggccaggtcaagctcaaccagatcgtcttccccttcaagatcttctacaccttctacctcaagggcatcccggacctgccgagggagctgctctgcacgcccgtcccgccctcccccaccgtcgagcccacgcccgccgccaaggccaccgagccacacgcatgcctcaacaacttcaccgactagctacccacctactcctacctaggtagccagcccaaaatatctagtattgctcctgctagttgaacttgcgtgtgtgtgtgtgttgcaacttcatcgactagctagctctagctaggtaccccaaaatatagccatgtacgccaaattgcttgtactcctactggcgttgaatgaatgtccgtgtgttgcaacggtggaataaaa

SEQ ID NO: 11455 - DNA, 1142 bp, Triticum aestivum
  unsure (1)..(1142): unsure at all n locations
  Clone ID: PAT_TA_11455
cccggcccgcgcaaccccgcaccggaccgcaccccctcggcggacagcagatcgaatccgagagtatcgtcgtcggttaggcgtcgccaccaccaccaccagcagccagcacctcggccgcgaccatatcatcatccgttagccgtcgccaccaccaccagtccagcaccatggcagcgcccccctcctccgtgtccggtcaggggccggcgcgtccgtctcggcgaagctgacccctcgccaggccgcgagggctgggttcggtggcagggtcagcgtcagctcgggcaggaagtgcggcggccccgtgcgggcgtcgctcttctcgcccaagcccgctgtggccatggacgcgaggccgaccaaggtgcaggagctgcacgtctacgagctcaacgagcgcgaccgcgagagccccgcgtacctccggctgagcgccaagcagagccagaacgcgctcggcgacctcgtccccttcaccaacaaggtgtacaacgggagcctggacaagcggatcgggatcacggcggggatctgcatcctgatccagcacgtgccggagcgcaacggcgaccgctacgaggccatctacagcatctacttcggcgactacggccacatcgccgtgcaggggccctacctcacctacgaggagtcctacctcgccgtcaccggcggctccggcgtcttcgagggcgcctacggccaggtcaagctcaaccagatcgtcttccccttcaagatcttctacaccttctacctcaagggcatccccgacctgccaaaggagctgctctgcgcggcgcccgtcccgccctcccccaccgtcgagcccacgcccgccgccaaggccaccgagccacacgcatgcctcagcaacttcacagactagctaccttagcttagcccaaaatatctattattgctcctgctagtagttgaacttgcgtgcgtgtgttgcaacttcaccgactagctagctctagcagtctagctaggcagcccaaaatatatctatgtacgaccaattccttgtaccagtgttgaatgaatgtccttgcaacggtggaataatttcaagtacggaaacttgatttctttctcaataaaacattcatatttgtttgaaaaaaaannaaaaa

SEQ ID NO: 11456 - DNA, 1773 bp, Triticum aestivum
  Clone ID: PAT_TA_11456
gggatccatggatttggctgatattccacaacaacaaagattgatggctggtttggctttggttgttgctactgttatttttttgaaattgttgttgtcttttagatctggtggtggtaaaaaacggccgccgccgacgatcccgggggcgcccgtcgtgggcgggctgctgcgcttcctgcggggccccatcccgctcatccgggccgagtacgcccgcctcggccccgtcttcaccgtccccatcctcacccgccggatcaccttcctcatcggccccgacgtctcggcgcacttcttcaagagcaacgagtccgacatgagccagcaggaggtctaccgcttcaacgtccccaccttcggccccggggtcgtcttcgacgtcgactaccaggtcaggcaggagcagttcaggttcttcaccgaggcgctcagggccaacaagctccgcagctacgtcgaccagatggttgccgaggccgaggagtacttctcaaagtggggtagaaagcggcactgtggatctgaagtatgaactggagcacctcatcatactgactgctagccgatgcttgggaagggaagtgcgagaaaaattgtttgatgatgtttctgctctcttccatgatcttgacaatgggatgcagccaatcagtgtcatctttccctacctcccaatccctgcacaccgtcgccgtgaccaggcacggacacgtttggcggagatctttgccacgatcatcaagtcccgcaaggcctctggacagtccgaggaagacatgctgcagtgcttcattgattccaagtacaagaatggccgccagaccacagaaagtgaggtgactgggctacttattgcagccctgtttgctggacagcacactagctcgatcacctcaacctggactggggcctacctgcttaagttccagcagtactttgcagaggctgttgaggagcagaaggaggtcatgaagaggcatggtgacaagatcgatcacgacatattggcagagatggatgtcctctaccggtgcatcaaggaggcgctccggctccacccgccgctgatcatgctgcttcgccaatcacactctgacttcagcgtgaccacgagggaaggcaaagagtttgatatccccaagggccacatcgtcgcaacatctcctgctttcgctaacaggctcccccatatcttcaagaacccggactcgtatgaccctgaccggtttgcagctgggagggaggaggacaaggttgcgggtgccttctcgtacatctcctttgggggtggcaggcacgggtgcctgggtgagcccttcgcgtacctgcagatcaaggcgatatggacacacctcctgaggaactttgagtttgagctggtctcaccgttcccagagaacgactggaatgcgatggtcgtcggcatcaagggcgaggtgatggtcagctacaagcggcggaagcttgtcgtcgacaactagagagcgggtggtcccatagggggtgtttgcttctgtatttgttccatttaagttttttctattcgcacgccaacctgtagggtatctatcttgccattgttttagggtactttgatttgcttccagtgattatttagacgtgtagcatctgagtgttgtttctctctcctttcatctttgctgctgtccattctcttagacgggttcagacataaaatgtgaacagacaaccctatgtaaggaacacaacaactgtgactgagttcattcaaaatgcagttcttgctgc

SEQ ID NO: 11457 - DNA, 1884 bp, Triticum aestivum
  Clone ID: PAT_TA_11457
gatatctccatcctcccgcagcccgtctcgccggccgcccggccgccccccaatcgtgcgtcggacgaggccacggcgatggatctgctaacggacgcccactcccagtggcccctcgccggtggtgcgctgcagcgcgccaccggctccttgctgaggatcctgctcggctccgtcggcggcgccaaggggccgcggccgacgctgccggctgcgcctgccgcgggagccctgccccccctcccggggggccccatcccgccccgtctggcggagtacggccccctcagcctcgtgtccagcgacccctctcttccgccccggattaccttcctgcttggccccgatgactcggagcactactagccgcgcaacgagtccaacatgtgccaggagccggactaccgctccaccggcctcatcttcggccccgggcaccaggtcgagcacgaccactacggcagctgggggcagacctgctgcagtaccaagctgctcagttgcacaaggcagggccgccacgccacagagaagtgaggcgacagggatgcttactgcagccctgttggccggactgcaaaataggaccatcacctcaaactggatcagggcctacctgcgtaagttcccgaagtcctttagagagggtatgaaggagcaaaggttcttcatgatgatcctgagcgatggcatcaaccaggcaatgtcatcctgccaaactgtcccatccctgcccaccctcgcaatcctcccaccccgcccccgtgtgaacgcgctcacacgttacgcggacatgttcgccactgtcaccaagtaggacaaggaagcgggtgcagtctccaaaagccacgttgcagtgattcatcgagtctacgtaaaagaacgcccgccaagcctacagaaagtggggtcactgggccctctcctgtgcacacctgggtgctgggacggcaccattgctcccttcatctcaaacctgaactgggggctgcctggttaagagcgagcggtaatgtgcaacggctagcggggggcagaaggaggtcgtgaagaggcatggtgacaagatcgatcatgacatcttggcagagatggatgtcctctaccggtgcatcaaggaggcgctccggctccacccgccgctgatcatgctgcttcgccaatcacactctgacttcagcgtgaccacgagggaaggcaaagagtttgatatccccaagggccacattgtcgcaacatctcctgctttcgctaacaggctcccccatatattcaagaacccggactcgtatgaccctgaccggtttgcagctgggtgagagagtgaggacaaaggttgtcgggtttccttctcgtacatctcctttgggggtggcaggcacgggtgcctcggtgagcccttcgcgtacctgcagatcaaggcaatatggacacacctgctgaggaactttgagttcgagctggtctcaccattcccggagaacgactggaatgcgatggtcgtcggcatcaagggtgaggtgatggtcaactacaagcggcggaagctcatcgtcgacaactagagagtgggtggtcccatagggggtgtttgcttctgtatttgttccatttaagttttgttgtccgcacgccaacctgtagggtatctatcttcaccattgtttagggtactgtgatttgcttccagtgattatttagacgtgtagcatctgagtgttgtttctctctcctttcatctttgctgctgtccattctcttagacgggttcagacataaaatgtgaacagacaaccctatgtaaggaacacaacagctgtgactgagttcattcaaaatgcagttcttgcttttgctcaaagttttttgtcccccccccccccc

SEQ ID NO: 11458 - DNA, 566 bp, Triticum aestivum
  unsure (1)..(566): unsure at all n locations
  Clone ID: PAT_TA_11458
gtnaggatgcctcactccttcggttaccgagcgcgcacgcgtcacatgttctctagggacttcaggaacaagggtgtgatccccatgtccacctacctgactacctacaaggtcggagacattgtcgacatcaaggccaacgccgctgagcagaagggtatgccccacaagttctaccacggtaagaccggtgtcgtctacaacgtctctccccgaggtgttggagtcatcgtcttcaaggtcgttggcaaccgatacatggagaagcgagtcaacctccgaatcgagcacgtcaagcactccaagtgccgacaggagttcgtcgctcgagtcaagaggaacgccgccctcaagaaggaggccaaggagaagggagagaaggtccagctcaagcgaatccccgctcagccccgagaggcccaccacctctccctcaagggcaacgccccccagaccgttgctcccctcgcttacgagacttacatctaaacgaaacccccatttaccacccttcttgttggcaatggatttcggctcgatatggcatgatgcaaccaaaaaaaaaa

SEQ ID NO: 11459 - DNA, 780 bp, Triticum aestivum
  unsure (1)..(780): unsure at all n locations
  Clone ID: PAT_TA_11459
caccggacaacaccgccaaaatgggtatcgacatcaccgaccacaagcacaagaccaatggtcaccgcaagggcgcccaagtcaaacaacgactacaagctgcttttgcacaagctctacagcttcttggcccgcaggaccgactctgctttcaaccaggtcgtcctccgtcgcctgaggatgtcaaagatgcacagggcccctgtctccctctccaagatcgcctccctcaacaagaggccttcctccaacaaggagtacgagggcaagatcatggccactgttgccaaggtcaccgacgacgtccgcatgatcgagtgccccaagctttccatctgcgctctcggcttcactgctgccgcccgcgcccgcatcgtcgccgccggcggtgagtgcatcaccttcgaccagctcgccctccgcgcccccactggcgccaacgttatccttatccgtggccccaaggcttcccgtgaggccaacaagcacttcggcttcggtccccacaccgacaagaagcccttcgtccagtccaagggtcgcaagttcgagcgtgcccgtggtcgcagacgctccaagggtttcaaggtgtaagcaccttcaggataaccctgacgaggaattgcggatcaagcatggctacgcgactgtcccgctggtcgtctgcttttctggaagaggccaaaaacttcaagtctactttgcgacggatattagtgcacagcgaagcacatggcgttgtatggaggctngaaggagtcaaataaaatgctgcaagat

SEQ ID NO: 11460 - DNA, 1053 bp, Triticum aestivum
  Clone ID: PAT_TA_11460
cgtccgctcctttgaaagtgaatggtgggatacatactccagttaacactcatgtacctgactcggaagaggtgacaaacgagaactgtactaggtcttgttcgcataattcgcacgaaggtctgaattcctctcgggatctcgaacattgtggagtgtacagagaagatccctgccagcctgatatatctgatgaggatctcaagggtgcaaagaataacagtccggatttggttgaaacttcaatatctgatgaatgttccctgttccagaactctgagggttctgtatcatcttataacaagacaagtgataacacatcttttgtggagaaatgccaggccactgatgtaacagttcatgccagcagaaataaggtgattacaacaaatagtggttcagatgtcgaattcccaagcttgtcccagtggttgaagcctccaagttcgagtaaggcgatcagagatgaaagctatacaagtgacacatttaattctgctaagagttctgatgaggataggcctatcattggaatggtcgcggctcactggaaatccgaagagccagataattttactcctaaatggtgggatggaaatggcattcccaactcaacaaataagtacaaagaagatcagaaggttagttggcatgcgatgtcattcgaggagaggcttgaaaaggctttatctgaagagaagctgctttctcaaaggaaatgctccactggaaacacatctcacttttcaggtgtagaaggtgaggaaagtgatactgctgcatctaaccatctacgtgttgctgcttttacatgatgtcttggtctgcgaagagttatgaagcttccaagtaatttggctttttgctgccacattcctaatggcttctgcacagttttgttaacctctactatcctccagtatgtagcttctagaagcggctgttctatcgactgctttatattaaaggagtaatgttcctagttccaggacaaatcaacatcgttgatttcaaatataattgacatcaagattcaaaaaaaaaaaaaaaaaa

SEQ ID NO: 11461 - DNA, 658 bp, Triticum aestivum
  Clone ID: PAT_TA_11461
catggccgccgcccccctcccccctcccatcgccgccgccgccgccctcccgcactagctacccctcccccgccgccactagatccgtccccttcctctcccggccgctccctccggcttcagcgttgctcctccgggcagggtccggcggtcttgatcctgccgcgggggcgccttcctcgtctgtcgcgggtctcgttgttgctccatgtcggcgggcgacggcgcggcggtgtcggccgtcgaggggaagctcgcggagctctccaccagctgcgacctcaggacgctccccaagaggggcaagtctgcatcagcaaggacattgaacactgcccagattcagcttgtcgcaagccatccggaagtttatgaaccatgtgatgattcatttgcccttgttgatgcgctgctctctgacaaggctcaacttctgacgctacagccgagtttatgcatggaggtgggatgtggcagtggttatgtcatcacttctctagccatcatgctcaggcaattaggcccgggcaccccgtacctagcaacagacatcaaccaacatgccgtggagacaactcaagcaacacttgaagcccatggtgttcatgcagatgttattgctacagatattgtgtcaggtcttgagaaacgtctggct

SEQ ID NO: 11462 - DNA, 793 bp, Triticum aestivum
  Clone ID: PAT_TA_11462
gcgtctccaaggttctctcaacctgcctgatccttgtgtcattttcttattacatgttgttttgcggctcgcggccgtgggggttggtctcctttgtcgtccgggggctccagggtttccgcctggtccgccctcctcgccatcagctccaattatgaggttatgatagatgtgaaccacctgttaggtgctacattcagtcgtgatggtattgttagattgcttgttactgatcgtatttctgctgatcctattttatttgcagactgagagcgatttagtagaagccgtggatagtgacctcagaaaaatgttgataaatcctagagcagcagaccctttagcattaggggttcgagtgtggccacaagcaataccacagtttttgattgggcaccttgatcgccttgctgctgcaaaatctgcactgggccgaggcggctatgacgggttgttcctaggaggaaactacgtcgcaggagttgccttgggccgatgcatcgagggtgcgtacgagagtgcctcacaagtatctgacttcttgaccaagtatgcctacaagtgatggaagtagtgcatctcttcattttgttgcatatacgaggtgaggctaggatcggtaaaacatcatgagattctgtagtgtttctttaattgaaaaaacaaattttagtgatgcaatatgtgctctttcctgtagttcgagcatgtacctccccgggcggccgcgtagaataagctattctgcaaaagcagtgattttttttgaaacaaaaaaaaaaaaaaaaaaaaa

SEQ ID NO: 11463 - DNA, 883 bp, Triticum aestivum
  Clone ID: PAT_TA_11463
ccttcttcttcctcaaagcgacgcacgtgctgcctggaaactaaattagcgttaaggtacgttggccgaagcacctgaggagggacgccgacggcatggaggtacgtgaggaaaataatcgcagaaatctctacggagccagaaatgttcttcaaaatgaggacgttcgcgatgatccttgcagattgttgcttctctagcatatacttccagaagtggtagctcgactttatggatccaccttgagtaggaaacatggcgttcatgttctgttacagaaattaatgctggtgtggtttgatgacaacggcgatacgtcggaatgccaggttgtggttagtttacattatcgtgggagtgatcgtgatttttgttgttcccttgtcacgtgccgttctcagtttcgttctggtagcaaagttcccagaccaagattgcgtcctgtggagctaacggtgctgctgggctggactggctgttgagggccggcgttgcgtgtttggaatgcttcggggtagatagccggcaataagtcttttgctggtagcaaggcttacaagcctggggctcttacgcatattagttgtttcaagttttgactttattcatccgctggccatactctctgaagtccggtctcgctggcaggccgcggggggggaggcagcgcagagacaaacggcgcattccgtcatgcatgtgtgtggatttgtatcatcctactactgtgttcctttgttttacagtaataaataaagagatgaatcagcgattaattggtggtgcgggctggacgacaccgaagtagtcatcttcgccggccccctcactgcgtaccggcccgggcgcccgcgccaaaaaaaaaaaaaaaaaaaaaaaaaaa

SEQ ID NO: 11464 - DNA, 869 bp, Triticum aestivum
  Clone ID: PAT_TA_11464
gcgacgtgtagccctgctctccgcctctccggccggcatctatctacctacaagtagagccaagccattcctgcacacctccatacagaaacacaattcagatcgactagctcgctgctggctgtagaggacgatcgacgacgatccaagaggagcagcataaccgaggagagcggagcatgtgcggcatactagcggtgctggggtgcggcgacgagtcgcaggggaagagggtccacgtgctagagctctcgcgcaggctcaagcaccggggcccggactggagcggcctgcaccaggtcgccgacaactacctctgccaccagcgcctcgccatcatcgacccggcctccggcgaccagccgctctacaacgaggacaagtccatcgccgttgccgtcaacggggaggtctacaaccatgaggagcttcgggcacggctctccggacacaggttccggaccggcagtgactgcgaggtcatcgcccatctgtatgaggaatacggagaaagcttcattgacatgttggatggtgttttctccttcgtgttacttgacgcacgagataacagcttcattgctgctcgtgatgccattggtgtcacgcctctctacattggctggggaattgatggttcagtgtggatatcttcggagatgaaaggactaaacgatgattgtgagcacttcgagatcttcccgcctggtaatctttactccagcaaagagaagtccttcaagagatggtataaccctccttggttctctgaggtcatcccctcggttccctatgacccactgcgtctcagatcggcatttgaaaaggctgttatcaagaggctcatgacagatgttccatttggcgtc

SEQ ID NO: 11465 - DNA, 891 bp, Triticum aestivum
  Clone ID: PAT_TA_11465
ggcgccgcgccggcagcccccgtacgcgccgcgccgccggtggagctcacaagcgccgccatggagctcaacggcattggaggcccgttctacaacatctgcctccccgagctcctgcctggtggcttcaacgcccgccgccgcttctccagctcctcccgctggtgtggtgggtcgtcagtccagggagaggaagaaggcgcctgcacgcctcgccttccgctggatcccgagaacttggccgcccgtggcgtggcccgccccctgcggccgtggcgctgtttgtcgctggggcgctcgcgcgggctcgacgaggcccggccaggcgggaaccgtcgcgcggccgggacggtcgcttgcgcggggtggcccctgagggccctccctcggttcctcgccgcccgcccgcccctgtgccccgtttcctcctccgctcctcctgccggccctattggcctgttcccgcctctcctccgcggcaccctgctggtcgcttttgctgcatctcgcggcgagggcgtgcaaatgatgtcattgtcacttctaaaacctttatggatgttcattgccgttctgcatcattatttgtgtctcttttgaaacaaggcaagcttctgctcattcacctaattattgacgcttgacacacattttccaacttggcattgatggtcatatgttatttgtccagcaataatttcaaacctatccagtaaaggatccattatctctggtgtttgcatatttgaaatttctagtttttattggatgcagatctctgagagcacaggatttgtagcgaatttcccaaattctatatttcctaggatgccttttcctcgcagccctttgaggaggatatttctccggagaatcataaggcagaaaagg

SEQ ID NO: 11466 - DNA, 608 bp, Triticum aestivum
  unsure (1)..(608): unsure at all n locations
  Clone ID: PAT_TA_11466
gncccaagctgcctgggttggatatactgaacgtgacccggatgacggcccaacgaaaagacggccacctctcagtgttcagaagtcctttgagttcaaggcaagcccttaccagcaagacatcagaagttaaagaggtagaggattgcagccactggtgcctgcctggagtccctgatgtctggaacgagcttctctacgccctcttcatgaaaaggcaaatcatgttggaccaaaatgtctccatttctggctcgagaacactgatcaccgatggacaaagtacaggggatatatctacctgatgctctcttgctgatgtggaaattaaagtccagcaggtctcatgacaaggggtttctgtgaataggattcagggagggctgcggcctcgattatcagtgtaaatagcacaaaactacccatgcacccttagtttcccgaaaattgggaattttgctgactcaaacgtcggatcaaaatgatacacccacaaagagtttatacatgggcacttgtaaatagagaatgtgatagacatcatagcaagtttatattgtcaaaatatttctcatcataaaatggtacttcatttttgccaagtccca

SEQ ID NO: 11467 - DNA, 946 bp, Triticum aestivum
  Clone ID: PAT_TA_11467
ccacgcgtccgggcattcttgctgacgagatgggtcttggcaaaactgtgcaggctatggcattcgtcccccgcgtccggcaggataaaaacatatggggtcccttcctggtggttgctcctgcatctgttgtgaataattgggctgaagaggtaatcagattctgccctgatcttaagatactcccatattggggcccagaaagggtggttcttcgcaagaacatcaatcccaagcgtctttatcggagagatgctagcttccacattctcatcacaaattatcagatacttgtgaatgaagagaagcttttgagacgtgttaagtggcagtacatggtattggatgaggcccaggctataaaaagttcaagcagccagcgctggaagactttgctgagctttaactgtagaaatcgcttgcttcttactgggaccccaattcagaacaacatggctgagctatgggcacttcttcctttcatcatgcccactttgtttgacagccacgaacagtttaatgagtggttctcaaaagggattgagggccatgctgaacatggagggaccttgaacgaacatcaacttagtcgactgcatgctatattgaagccgtttatgctccgccgtgttaagattgatgtcatagcagaaatgacggaaaagaaagaagaaattgtgccctgcagattgagttctcgccagcaaatcttctatcaagccataaagaataagatctctcttaatgagttgcttgatggaagtcgtggcaatctaaatgataagaagctgcttagcctgatgaatattgtcatgcagctacgtaaggtctgcaatcatccagagctgttcgagcgcaatgacggaagctattacttttattttgcggaaatcccaaattctcttcatcctcccccatttggggagttgcaagataaacattatgc

SEQ ID NO: 11468 - DNA, 855 bp, Triticum aestivum
  Clone ID: PAT_TA_11468
tcgcggccgcgtcgacatggcaccacaaccaacccgagaggaagaggcatggctgggacgaggctcagccgctgggagcgtccggcggcgcccgttgtcaacttccccgaccgatgggtgcggctcttcttccggtggtgtgggcttggcctactttgctttctgcgtcttcgaatccggttccagtagcacttgggattgtgcggaatttggccagggcgaaagccttgctcggctcaccggtgctggcggcagcgacacctgcgggtgccgtttccttcttagaggtgccgccatggcctcttctccgcgcccctacgcgagtatcaggggaaaccctagatctagttcactagatcggaccggcggcgtctcccccgcgtccccttcatgaaggcgcggtcttgttgctcgtggtgtgtttggtgttggatccgaagattttggatgctttgctggtctgggctgctcctcttggcgtgggtatccggggcgcaatgtacggccttgacggcgctctctccatggcttctccttctagccgggccaggtcctgcaccccacttgccgatcttctaggcgcataggtggggggtacgttgatccggtccgtcgtgaagtcgtggttgtgtgatgatggtgcccggcattggtcatgacgcgcccttgataccttgtatctcgcctctttgccttgtcggctggagtccgagctagaagagtttggtgctgtgttgtatccctctttgtttttcccacaccttgtgtggtgcttctcccttctcttgtatgcctctgtatttttcttctacctatcaatgaaatgatatacaagctttacggaaaaaaaaaaaa

SEQ ID NO: 11469 - DNA, 590 bp, Triticum aestivum
  unsure (1)..(590): unsure at all n locations
  Clone ID: PAT_TA_11469
gggcggccgtgccgcggnggaggtgatcttcggcgagccggaggtgacgacgggcgcggcgggggacctgcagcaggtgacgcaggtggcgcggcagatggtgaccacgttcggcatgtcggagatcgggccgtgggcgctgacggaacaggcggcgcagagcggggacgtggtgctgcgtatgctggccaggaactccatgtcggagaagctcgccgccgacatcgacaggacggtgaaggccatcgttgacgaggcgtacgaggtcgccaaggcgcacgtgaggaggacgcggcccgccatcgaccagctggtcgacgtgctcatggagaaggagacgctcaccggcgatgagttcagggcgatcctgtcggggtacgtcgacatcggcagagagcagagggacacggccgcgaggacagacatggtcactgcttgaaacttcaaaagtgtagaattgtgtagtgcaagactgtgggacgatggcatatatagcgtgatgtaaatttcaactacgcgtnccgccggccgatcgttttaaaagatncgtgtcgggtcgccagccatgggatttggtgcatcgagtggcc

SEQ ID NO: 11470 - DNA, 951 bp, Triticum aestivum
  unsure (1)..(951): unsure at all n locations
  Clone ID: PAT_TA_11470
ctgcaggnaattcggcacgaggggagctcgaacccgaccccccgcacggnagatctgaagcagcagcaggacctcgccggacgcagcagctgcaccacaagtccaaacaatggcgccgccctcatgaaacatggaagcagaggctaacccttgcggcggcggtggcgtgtctttccagtgctcccccttgcggccttcccagacttggtgttcgcttggtgttggtggacagtcgaggaggaccatctcccgcactggcctcccctggacgcgcgcagccggcggctccgtcgggtccaacagtggtcgcgactcacgaggcgactcgagcagcagctcgaacgcacacagtgcctccccgtcggcctggtacgccgcccgagcgggaggcaccagcggaccggagaggcgagtagtagcacgccccagcggcagcactgggcggcatcagcctcatgcccaggataggggcacacggcaggtgcggcgcggctgcaattcaggggcggtagcagttctcggccgcatccatggcagccgccgtggcgtgctcctactcgcgcggctggtccatggctgtcggcgcatcgcaggacagggacgacagcagttctaggccgcatccatggcctaaatatgagtaaaccaaaagaagcttagtgtttagcatataataaatattaaatataaagctagcttgatttgaaagaggacagtttgtattgagagtctgagaccccacctgtgcagcttaaatcgataacaaaaacatcaaacaaagtttgctcagagaaattcccatatttcttagttgaagcagtttcggagcaaactccgtgtgcgattccgaagtctgaatgcttgtatggcatcttggtgccaagaaaaagagatgaccactttttcttctgttgcttgatgtattgttcgcttagatgtaattccaacttc

SEQ ID NO: 11471 - DNA, 962 bp, Triticum aestivum
  unsure (1)..(962): unsure at all n locations
  Clone ID: PAT_TA_11471
gcttaccatatgcgcaaagcgacagagagagcaagacgcggagctaccgcgtgagaagagcaagcaagctcaacaatcgccgcagggcaggggccgccatgagcactggctccgacctcaacgagtccgcggcaacgacgacggcagctacctccttcgtgtcctcatcatgctccctgcagccgcagacgcccccgccaaccgccgggtgaagaatggcccggaggcagaggaggtgtggtgtagttcgcagtgggaggcggcgtggccacggagggcgcggccggtggtgctcgccggggaatacgggaccccggacggtgccagggcaggcgccagggattccaagggcgcaacttggggcgtgccaggagcctgatggatgacgacctggaggaactcaaggggtgcgtggatctggggttcgatttgcagcagcagcagaccccccgccggtgagccaacctcccggcggcgcttctccctcccatcctgtcaccgatctactctctctcctcacaccctctctcttctttctcgaatggtgccgccccccatggagctcagaactgcctccgtcgcaccaacgcccgccattgcgacttcgcctctatacatctctgtgcttgtctgatttggagttcccttcgctccaccttccctcttgcgggattaattccttcattttgttcccctcgcaagcttcttgatttctgatgcggcatagtagcctgtgtatataaattgattgaagtggatgcagaggagcgaggtgggactaaatcacgacacgggagattgagaaggttacggcggaggtggccagagaggactcgcggcggcggacggggtcgcaacggcgccacgtctggataagacaaatcagaggatcgcatttgaattcttatagatgtaggggtttttgtaaaaagtnaacgtatctagataatagaaaagggact

SEQ ID NO: 11472 - DNA, 706 bp, Triticum aestivum
  Clone ID: PAT_TA_11472
gaagaacgtccagatcgaggaggatgagtccagcgacgagtctgagggcgaggagggcgaggtcagcgtacccgcgggctcctccgtcgctgtccactcccgcaacgagaagaaggctcgcaaggccatcgccaagctcggcctgaagcacatcgacggcatcacacgcgtcaccctccgccgaccgaagaacatcctcttcgtcatcaaccagcccgacgtctacaagtccccttcaagcaacacctggatcatcttcggtgaggccaagatcgaggacctcaactcccaggctcaggcttccgccgcccagcagcttgctcaggccgaggccgcatcccacgaccacgccggccacgaccacggcgacgaggccagcaagggcaagggcaaggctgtcgaggacaagaaggacgaggaggaggaggaggatgacgatgaggagattgacgactctggccttgaggccaaggacatcgagctcgtcatgcagcaggccagcgtttcgcggaagaaggccgtcaaggccctcaaggagaacgacaacgatatcgtaaactccatcatggcgctgagcatataggctgctccagtctaggtgtctgggtgtaaaaggtggatgatgacttccaaggcatcgcggagtcgaaagactacccgcctgctcatgtaaaagaatctatcagcatgaatctttacgaaagat

SEQ ID NO: 11473 - DNA, 778 bp, Triticum aestivum
  Clone ID: PAT_TA_11473
aagatggtatcctctgcccggctctcccctcccggtttcaatcctgtctctctgaagactactcccaaattctcaactggctcaactgctgccgctgccgccgctgcttcttcctcctactctcggcgactcgtctccacaattcaccccccctcttcgtcgtcgtcggcggcggggacgacggggcacagccgagaacccaggctgccaggaccagcggcaactccaagcttgcttcttggtgcttcttcttcttcttctgcttcagcgcagcgcgagatccgtcggagccgagccgagctgagctgaccccattggactgaactttagggggcgtaatggacaacacccaattcgccatgattgaggagctggcctcgctcatcaaggacaacctctacagcaagcacctcgtcctctccaccgaggagatcctcgtcaccctcctacagcacagctacctcgatgacgacgatggacacgaccgcgccacaactgaaacaagtcgcggggcagctgggaataccatagagctccagcccaccagctcctacaatcgcctccttttgcatcgtctcgccgacatatatgggtttgctcacgaatctgttggcgagggtgaggatcggcatttggttctccagcgctgccctgagacagccatccctcccgtccttgtcagcgatgtgttgtggaattatgacgacggtgatggtccttcagcctctctcatgctagcgagaaatgagacagatcttcagaaaatttatgagccaga

SEQ ID NO: 11474 - DNA, 637 bp, Triticum aestivum
  Clone ID: PAT_TA_11474
gcgtattgcccttgcggctgccgagcaacgatcaaaagaaatcaacgtaccaatgaacatcgccatcatggacaatgcgtgccatctgcttgcgttcgcccgtatggaaggcgcaaagctcacttctatcaacatcgccatcgataaagcttttacagctgcaggtcatcgagcgccaacctcggtgtacaaagacaacgtgtatcccggggggcctgcatatggcatcaatcacagcaaccaagggagatttatgacgattgcgggaggtgttccgattgtaaaagacggagttgttgtcggggctgtgggatgtagtactgggttgccgagtcaagatgaggatgttgcgaagaagggtgttgaagctgtggagaaaagcttcgggcttaaggcgaagctgtgaaggtttgggggtaggagaaaggagaaatatgaaatagatcccggtgagctgtcacatcgatgcgagcgccagcgacaacctgtccctgatcacaaccgtctttcaattagtctcaacgaaagtaagcctgtattgcggcaagctatctttccaatttctacatccaatcatgctccaacacatatgtactagcagcacggcttattcatcgtcgagaagcggaaaaaaaaa

SEQ ID NO: 11475 - DNA, 302 bp, Triticum aestivum
  Clone ID: PAT_TA_11475
gctggcatgcccaccaagaccggtggctacgtcaagccttccacccctgctgagttcactggtgctgcctctgctctcaacgtcggtggcttcgttgccggtgttggtgctttcgctgctttcttcttgtaaatgtcataacattcaattgagcgtgtccacgggcaagctatgactttacatgatacattgcattggggattgaaattcactgtaaatatccttggtgtcggaaagggtaattgtaattagtctgcggatggtgttgttgaaattgaacttaaaaaaaaccaaaaaaaaaa

SEQ ID NO: 11476 - DNA, 461 bp, Triticum aestivum
  Clone ID: PAT_TA_11476
aggctgccacgtgaggcctgccacgccagtcagatgctcagaacctcggtcgatcccgacaagcacttcaaggagaaccgggagacggtcgtgaacctgcccgagatgagcgccgtcgtcctagaaaaggtagtcgagtacctgctctactggtacagataccaggataaggaagacgttccggacatggagatcccagtcgacatgtgcctcgagctgctgacggccgccgactacctccagatggacaatcagttccgatgaggtgacttcccgctcgggtttcttttgtgtctacggctctttggcgttcagaatgacaacaaggtaatggaccacgtggcgtaaggcaggggcaggcgtctgggaacaatccaatggtccatggcgataccctttcggtctatgaaaaacaaatgtcaagtagatggcaaatactggccatcatatcaaaaaaaaaa

SEQ ID NO: 11477 - DNA, 410 bp, Triticum aestivum
  Clone ID: PAT_TA_11477
gctgggatccactacgataccattgctcttgtgccacgcggtgtgtcacctcaagacccctcgcaagatatcaagttgtttgacgcaaaggacgacgtaattcttgaagcggccagggaactctgtgggcagttgcagaaagcacattattttactgatacacaaaagttcgacatcaagtgcaacaagtgcggctggaagggggctggagaacggggtgcgatacagcacgcaaccgagaccgggcatagcgactttggcgaggcggattgagtactcttccgttatatcttccttcccggccagacttcgtgcatctcaatcgactagagcgtaatacatatcttatttgtacgactacaagcacacgaaaagggcttgtgaaatggagctcttgttgaaaaaaaaaa

SEQ ID NO: 11478 - DNA, 1404 bp, Triticum aestivum
  Clone ID: PAT_TA_11478
ccacgcgtccgcgcaacttgaaggccttgaagaagttcattttgaggtggaacttgttcagtttactcaggtgagggatatgcttggtgatggacgcctcataaagcgccgtgtagttgatggaagtggtgaatttccgatggactgcccccttcatgatagcttgttaagagttcattacaaggggatgctccttgatgaaccaaagtcagtattttatgatacacaaattgataatgatggcgaaccattggagttctgttccggagaaggattggttcctgaaggatttgaaatgtgtgttcgactaatgcttcctggtgaaaaatctattgtcacctgccctccagattttgcgtatgataaattcccaaggccagtgaatgttcctgaaggagctcatgttcggtgggaaattgaattacttggatttgaagttcccaaggattggactggcttgaccttcaaagaaatcatggaagaggcagataaaattaagaacacgggtaacagactatttaaagaaggaaaatttgaacttgcaaaagcaaaatacgagaagttgcttagggagtataaccacgtgcatccccaagacgatgaagaggggaaaatctttgccaattcaagaagttctctacatctaaatgtagctgcttgctaccagaagatgggtgagtacaggaagtctattgaagcgtgcaataaggtgcttgatgcaaatcctgtgcatgtcaaagcactctaccgccgaggaatgtcatacatgttaggtggggactttggtgatgcaaagaacgattttgagaagatggtaaccgttgataagtcctcggaacctgatgctacagcggcccttgttaaacttaaacagaaggaacaggaaattgaaaagaaggcaaggaagcagttcaaaggactatttgacaagaagccaggagagatatctgaagttggtgtggagtccaagaatggtggcgacacggcagggtctggcgaggcagtgacaagtagggatagaaatggaagcgggaagtctagtcctccgagtgcagagtcagatcatgcctttgatgaagagaggccaggacttattggccgcatctggccttctgcgaggcggattttctcctcccttggtctgaacaggtgcacaatactctgagcagccagcagtgacgagagatttagttgtaaacaaggaattttttcacatatacagtcctcacttatacagaattaatcttgtatcattatgaaaatcataccaatatatatggactggagtgatactgaaaaatcgtgaggaagcaccggttgttgtaacagtgaaaattgattgccgtttgtgtctgctaatgcattgttgaagcgaacttatataaaaaaaaaaaaaaactcgaa

SEQ ID NO: 11479 - DNA, 920 bp, Triticum aestivum
  Clone ID: PAT_TA_11479
tgaccacctcatcatgttccgcttcccagagggcgcttgcccttctctcctctgcactgggcgggcggcgcgtgggcgagccaaagggaaagttacaagccttatcgcaaagaaagatgtgggtttagcgacaaggatcgaagacgccatgaagaaaaacgagagcttagaatcgctgacgactagcagcctcagcgcggagtccgctgtcgctctagccccaagcaccgagggtgccacgtcggcaagcgcggcctggggttcgcaggcgcctagcaacgtcaagagggattccgccaactctcaaaacccaggcaccaaaggaagggcctctgctcgcccgccaaggactccacttcctccgaggaagcggtcgtcgaccaagagaccagccatcttcgtccatggaagcacgcaccgtctaagaacccgcccgaaggccaggccggcagaggccagaaacgccaagcccgcagcggcctcctggcagccgcgcctccgacaagagccggccgtcctcctccacgaggcccgcgcccgctaaggggcatgctctgaataaggcgggcagtggcctgagcggccaagccggcgagagccggtagccgcaagggtcgcgacaaggtcgggaagagcggcaaggccaggccggtgggcgggaaggggggtgctctgaattaggtgggttgtaagctgagcgtggttggattcagagggcgcagcaccgggaaatcggcgcaggcttcatgataatcgctcctgagcatatttgatcctgtaaacctgtaaatatcagtgacttggtttttgccattttttgtgctttttggcttacaattttgataatcttttttaaaagagaaaggaaacatttgagatcttaccacggcatctgtaataataaaaaaatgtttgtgctt

SEQ ID NO: 11480 - DNA, 470 bp, Triticum aestivum
  unsure (1)..(470): unsure at all n locations
  Clone ID: PAT_TA_11480
tgcaagtaaacgnaaggaatgctggaaagctagagaccattttgttcagtgcacaanagactataaatccgaagaggaccaagaaaaacattgcgctactttgaaaacggcatttgaaaacgcttgtccgaaagtttgggtgaagcattttgttcggcaacaatcttggaaagattataaacaagacgttcttcagcagcgtgccaatcaacaaagtaatccgcaataaaatgtatgaaaaagtgaaaacccatatccttcctgaaagttcctcaagtttgtatggtaatttagacgtgaaatatgagaacgacagggatacgggacataaatcaatgactttgctgtcaattcataacactaatgttaatttattaagcttccaaagtggcacaactgtacacgcgcttatttcccctgacaacccaggctctaaaaataaaagtaatgtagtagctgcaaaaaaaaaa

SEQ ID NO: 11481 - DNA, 388 bp, Triticum aestivum
  Clone ID: PAT_TA_11481
gagggtggcgcggaacaacggcgacggccggcagatcgcggcgatgctacagaggatggcgcggctctgcggcaagggccaggccgtgccaaattagtgggctttttaagtggttttggtcgaaaatgaaagaaggaagtccatttctcaccccgaaatgcgcctgatgggacaacccccgaactctatttgggtacaattttgaatttgaccccaaatggccaaatgtacaataccggttaaatctctcccaaagaccgcgattgggatgggtgtaaaatggagcaaacatgggggtgctttgtttagtggtgtaactaactggcttggctaatgaccaatttccgccgggataaaaaaaaaacaaaaaaaaaaaaaaaaaaaaaaa

SEQ ID NO: 11482 - DNA, 666 bp, Triticum aestivum
  unsure (1)..(666): unsure at all n locations
  Clone ID: PAT_TA_11482
ggtcgtcgacgcgccagtgctgcacctgcgacacgtcggccgtctacgccggcgcggacagcgggtaccacctgctcatggtcagggnactactcgcgtaccaagcttcagttgcccaccggcgagagcgccaccaccggccttttcacggtgggagaatatgactggtacatcgagtactaccccaacggagaaaacccgaactgccgggacttcgtttcgctctacgtcacgaggcataccctctacgactgcgagggcgaagaggatgtggaggccaagttcagcttcagtctcgtcgaccagcttgagaagcacaagccagtgtacattcatggaaccaataaaacctgcaccttctccagcagtgctccctcctggggcagcgacagatttgtgagacgagacgccctggaacgatcggcgcacctaaagggcgattgtctcaccatccggtgtgacatcatggttgtttgcaaggatcacaaaatcgaggatgccgctggcgccatatctgacataaaccaacattttgcccacctccttcaaaacaaggtgggtgctgatgtgacatttgaggtcggtggcgagacgttcgccgcacaccggtgtgtgcttgcagcccggtctaaagtgttcatggcgcagctctttggccccatgaag

SEQ ID NO: 11483 - DNA, 516 bp, Triticum aestivum
  Clone ID: PAT_TA_11483
ctattcagtacaaccttcatgtgcaccttgacttacatggataatcttctgagtggtcaacaccgaggaagatggcccagacagagccagcaaggaagatggctcagccctgccgacgatgcccaccggctacttacgtttgtcgccatcgtaggaggggcgcaccttcgaggagcagcaggggaggagatgaggatacaccgctggactccctcttcactttatggtcgcatcttccccgtctgtgtacaatttattccactgctcgactcagtgtccgtctcaacaaaacctaacatgtcggtgcgaaattctgctatgttcagtggacatgtatgcttaatatcccctcactggacaagattggattttagtgtatacaagccctcctgtcagctgctcaggtgaatgcactgcattggactttttgagaactaggccggcgttcattgacaacctgcccatggttctggatttaccgaggagtacaaccgtacatgttggtcggctgcctgc

SEQ ID NO: 11484 - DNA, 487 bp, Triticum aestivum
  Clone ID: PAT_TA_11484
gcagggaattcggcacgagggttgaagttaatgctgcagctggtatgaaaggtatggaagagctgactgctgatgaatttcaggaggaggacagtgggcggctagacaagacttgccatgattttatggcaagcgacaatgatgcaaatatatttgatgtgcatgttgttgatgatatttgcttctccactgaagttaaaggcctgattggtcgaagcttctctgatgcaacaatgcaagcagacaagttgcagaatcgagctgccgcagatgatctcctggggaaaagtctgaatgcgatcgaaggtgcacaaaacaagatgaggcttgcagcaagtggaaggaggcaatcattacagttgcaactcttagaggatatagctgaccaacttcaagaaatcaaagatgttgcagatgcagggcgacacttacactgtatttctcctaaaatttcaaagaaaagctaggtatgaatggaaaaaaaaaa

SEQ ID NO: 11485 - DNA, 236 bp, Triticum aestivum
  unsure (1)..(236): unsure at all n locations
  Clone ID: PAT_TA_11485
gnaattcggcncgagggcgcacgcggcaggcttaattaggctactaggtagcaggctagcagcctagcagaagagcgtgcgtgccactgtaataagttgtactgcgtagttccactttcaccacgcacctacggtacgtacgtagtaatgtacttctctatccgtgctgtaatctacagtgtactatacgcttttttcattagtattacttctctatccgtgctgtaaaaaaaaaa

SEQ ID NO: 11486 - DNA, 483 bp, Triticum aestivum
  Clone ID: PAT_TA_11486
gccggcgcccggggaggctaagaagctgatgaaggaggagccatggacctggcaagaaaaactgaaggaacaagataggcctcttcctcttcctcttccagcttggtactacaggcagccttctttgcttcgactcataggcaatgcagataccattctgaagctatcagattgacacgctgtctctggagttgcatggcttgaagagatgtgaagaatcacaaagagagccatgtgtcacagtgcttgtagaacaactaaacgggatgtcgatggaattgcacaacttattttcttcccgtcattacctttgttggtaagaataatgtgtaatataatctgtcatgacttgatacttcagagatgagcgactgagtatgaaataatacacgtggtgggcggctgggtacgtctcattgctcctggggatgggctggagtcctcacaatgttgcaatggaatcctcggacgcctgggtcgaaa

SEQ ID NO: 11487 - DNA, 480 bp, Triticum aestivum
  Clone ID: PAT_TA_11487
ttcggcacgagggagaaacggaatccgatgaagaagaggattatcgtcgccaagaggatggggcccataagtatgatgtgtttgcaattcatccggagcataatgttatcttccttactgactggaaggaggtaaatctgtcgtacgatatggacagcaggcaagtgcatcccatgtgcaccactggagatttcctcggtggtctaccttttattccctgctttgcggatttggctcgacctttgcaaaaatcactcttctagttggttccgtggcactggtttggatatggcctcctagcattccaaattatatatgctctccagatgttttgtggcgttgaacaatgttggtcgccggtagagattttgtaagcgataaccaatccagtgggtaatgcttgcttagttgtatgaatgacttggtcacctaaatttatttgcgtttatgtagtactgattaatgtggtcaaaaaaaaaa

SEQ ID NO: 11488 - DNA, 274 bp, Triticum aestivum
  unsure (1)..(274): unsure at all n locations
  Clone ID: PAT_TA_11488
gccttgccgcgctcgagcgcgactacgaggnaggtcgccgccgactctgccgagggtgacgagggtcttgacgccgagtactagacgtgaagctggaggtgtgtgaagccggagtttcttgttgagcgagagaaaattatgttattggccgagcgcagggctttactagggtactggtactactgaaactgcaagccgcagtggatgcgctgtttttctttgatgcacccaccatgactgtttaattgaaagcgattttcccccaaaaaaaaaa

SEQ ID NO: 11489 - DNA, 318 bp, Triticum aestivum
  Clone ID: PAT_TA_11489
attcggcacgaggtgaagaaggagcttggccaggacttcaagttcaagtttgacgagaagatcaaccccgtcatggctgagggcggttcttctgccatcgcctaagtgttgattgggaacatcaaacggttgatacgaaggtcttttttcctttgttgtagataagcatttctctggcgtttatgggttttatatccttgcatagcgaagctagcaccaactttatagattttacgaataacttgggtccacggattcttggtctcttttatagattgcgatgaattctaaaagtcttctacctctttaaaaaaaaaa

SEQ ID NO: 11490 - DNA, 1482 bp, Triticum aestivum
  Clone ID: PAT_TA_11490
tgcacatccaccgggaccgccgccctgccctcccccgcctcccctctctctccctctctctctccctctctctctctcctccgcgccgctttctagggttttttccctcgccccgcccgcgcacgcacgcacgcacccgcccgcagaggagccaggcggccgcagggtctccgcctagaggaggatgggatacgacggcgccccctcgcccgcatcggccgctgcgcgcgacgccaagaagaagaggggtaaccgctcgtcggccaagctgaagcagtgcaagctcgacgcgcgccgggagcagtggctgtcgcaagtcaaggatgggaaggaggccacggccaagcctttgccagcgggcgcaggatcaggggcagggtcgaatgctgggtcgccaatccttgcttcgccacaccctccactcccccggcggcgcgccgatgcaaggtcaaggggtggagttctggaggatgacaaggaggatgctggagctaccgggcaagaagtaggcggcagcgaccttgactcccctatgcacagcccttgttcagacaactctcgaggtggaggctgtgctcagagtaagcgctgctcaagcaatggaggtggccccagcctcagcagtgtgagcagtctatggtccagttccaggagtgtgagtgatgctgaggatgatgacacgggcagtggccctgaggaggaaaacggggtgctggatgattgggaagctgttgctgatgcactttcagtcgatgataacagtcattgccaccagagtttaggtaccacgatgcccccagcagctacaagtcagtcggcacctctggcaaatacatcaaaaagaacagagcctattcgtagcaatgcaagagcttggacaccagatgatacgttccgtccacagagcttgcccagtatctccaagcagtcgagcttcccagcgaggattggcaactgctgggggatgggtatgagtgcagcacatcagagtatcctctctatgccattatcttgcccgatatgctacgaggatcttgacccaacagactcgagcttcctcccctgcccttgcgggttccatctgtgcctcttctgccacaagaggatcctcgaggcggatgcgcgttgcccagggtgcaggaagctatacaattcagggtctgcaggagaaggagcgccaacaccagtgcgtctatcccgttcttgtagcatgggtccaagacactaggctgtgtgaaggctatgatagctctatgccgtagttctgctttgcatgttactgtcggatatgctgtttttggtctgtatacaataaagaaatgtgaatatttgaatagatgctgtgcccatatagagtctccaggaccttggtatcctttttgtactgatgcattgggtgtgatgcatatgttgctggagattggagaggaccttttgttgttacagttcgtgagatcatatataatagctatggtgactgtt

SEQ ID NO: 11491 - DNA, 1345 bp, Triticum aestivum
  Clone ID: PAT_TA_11491
ccacgcgtccggtggaacaaattttgggcgcaccgctggaggtcccttcatcaccacaagctatgattatgacgctccacttgatgaatatggacttgcaagagaaccaaagtatggacatcttaaagaacttcatagagctattaagttatgtgagccggccttggtttctgttgatccaactgtgacttcccttggaagcatgcaagaggcccatgtctaccgatctccatctggttgtgcagcttttctcgcaaactataattctaactctcatgcaaaagttgtcttcgacaatgagcattatagtcttccaccttggtcaatcagctccccccccgcgtccgaaacagttgtttataacactgcaacggttggtgttcagacatctcaaatgcaaatgtggtccgatggggcctcttcaatgatgtgggagaggtatgatgaggaggttggttcactggcagctgctccgttgctcaccacaactggtctactggaacagcttaacgtcacaagagacaccagtgattatctttggtacatgaccagtgtggatgtaagcccctctgagaagtttctacaaggtggcaagcctttgtctctctctgtgcagtctgctggccatgccttgcatatctttatcaatggacagctacaaggctctgcttctggaaccagggaagataaaagaatctcatacaagggcaatgttaaccttcgtgccggtactaacaaaatatcactgctgagtgttgcttgtgggctaccgaatatcggggttcattacgagacatggaatactggtgtcaatggtcctgttgtgcttcatggtttggacgaaggttcgcgagatctgacctggcagacatggacctatcaggttggtctgaaaggtgaacaaatgaacctgaactccttagaaggtgcaagttcagttgaatggatgcaaggatcattgatagcacaaaaccaaatgccattggcatggtatagggcatactttgatactccaagtggtgatgaacctctggctctggatatgggtagcatgggtaagggacaaatctggataaacggacaaagcattggacggtactcattagcatatgcaactggggactgcaaagattacagttacactgggtcattccgggcaaccaaatgtcaagcaggtttcggtcagccgacacaacgctggtatcatgtgccaaaaccctggttgcaaccatctagaaatccgttaattgttttccaagaacttggcggggatactccaaaattcgcttgtgaaaaatagtgtgacaaggtgcgatgctgatgtttcaccaagttcaaaaagtat

SEQ ID NO: 11492 - DNA, 659 bp, Triticum aestivum
  Clone ID: PAT_TA_11492
gaggaattcggcacgaggccggtcttcacccttgatgaatgggagaggagaaaagcaggcggttcaatgtccacagcagaaaggcatatacaagacaccagtcgagacgaggaactggcaagacaactccaagaacaactagatctagaagattcccacgcgatgcccgtgacttcagaggccgaacgcctgcggatgaacatgttcagcttcaatggccctgaagaaatgggtggcgggagaagagatttccgagggcgcgggcggggaaggggccgagggcgaggtcgagggaggggaagattttagcacagtttcaaaaccgtgtttttttagggtactctgcaatcttcagagatggtggcagtaatagtggtattgatgatgatcatcatcaccttttgaaacggaggcggtagtgtcatgatggtcatcttaaaagcttctctctgtagtaccttatgacgatgatgatgaccttttaactctttattaagcattttcgtttcactctgagttgagttgcctcacctgatgccagctagcaaaatgtcaagggttcagaaacaagtcaagcaacatgtgtatttccatggaagattttgattttactcgtggatttgtggaattggcagatgttctgaacttcaaaaaaaaaa

SEQ ID NO: 11493 - DNA, 693 bp, Triticum aestivum
  Clone ID: PAT_TA_11493
gcttcattgcagaacaaatacagcatgaagagaaggatattccatgctcacacctcatcaacgttgagaagaattcgcactgcggtgtcataatggattacgaatcagcgatatctgagccatcatccacaggtccctttgagtttgttctgctgtctcgcagcctatggcgcgagccctcacccgacagccggaaacctggcttgaacaccatgcaccccccaggtacacccatctggaacggagagcgattcctttgggactcgcgcgtccacgaccatgacgagcaatttgcgaccggaccctggaagatgctgaatgtcatgctgattaagtgggtcggtgagcatgcggagcgagtggcgattgcgcggatacacgaagacgagtggctacaacataaccctacgagggcggacattgtacttcgttgaatttcttttgtttggtgacgcgcgtttacgaagggcgtgatcgtgtcggtttcaacatgcttgcgcactacatgacgcggcctgtttctttctggagtgatgaggcggatagtgtagaaagataccatttgatagtgctctacaagcacgggaggtagcacattctgctacacgtttgttttgtatcaatacaaggggatagtatgactcgctctcgattcggagagtgttctcatttaccagacgataccagatcaac

SEQ ID NO: 11494 - DNA, 685 bp, Triticum aestivum
  Clone ID: PAT_TA_11494
gttggtgctcatctgcggtcgcctcgtctccggctgggtcatccggatcgcgggcttctccgcgcggcgccacttcgtgctgcgcaagcgcgtgctctacttcgtctacggcgtgcgcggcgccgtgcagaacgcgctctggctcggcctggtgctcgcctcctggcacttcctcttcgtcgagaacgtccagacaaacacggcggtgctgccctacgtgaccaaggtgctcctctgcctcctcgtcgccacgctcgtccgcctcgtcaagacgctgctcctcaaggtgctcgcctcgtccttccatgtctccacctactttgatcggatccaggaggcgctcttcaaccagtacgtcatcgacacgctctccgggccgccgctggtcgacgaggactacgtgctcgccgaggtgcgcgagctccagcgcgccggcgcagccatcccgaaagagctgcgtgccgccttgccagccaagaatctttcggggcaaaagagcatccggatctcgggtttaatctctaagggagaccaatcaagcaggcagctgtcaaaggagaagaaacagcgtgagattgacgaagggatcaccattgacaagctccacaggctcaatcagaaaaacgtctcggcatggaacatgaagaggctgatgaagattgttcgttttgggacgctcaccaca

SEQ ID NO: 11495 - DNA, 1626 bp, Triticum aestivum
  unsure (1)..(1626): unsure at all n locations
  Clone ID: PAT_TA_11495
tttatctcggttgccatgttttcatgcccggattatttacttccatagcgtaggggcagggggatctcaagggggggtggcagatcgaggggtcgcagggatggtggcacttcaggctgcttaagaggcttggctgtggcaacattggcagttttaacttatcagagcttaatggcacgaaatgctactttgctatgaagatcatggaccaggcatctttagctggccgcaaaaagctacttagcgcacagactgaaagggagatattgcagtgcttagaccatccttttcttccgactttgtacacccactttgagactgataaattctcatgcttggtgatggagttttgccctggaggagaccttcataccctaaggcagaagcagcctgggaagtatttccccgaacaagctgccaagttttatgtagcagaagtgcttcttgctctagaatacctgcacatgctcggtatcatatatcgggacctcaagccagagaatgttcttgtgagagaagatggccacatcatgctgtcagatttcgatttgtcccttcgttgtgatgtgaaccctacacttcttaaatcttccaaccctggtgtagatcctaaccaaaagggcaatcaagcttattgtgtacaacccgtgtgcattgagccagcctgtatccagcctgcttgcgttacgacaaccacatgcttctctcctcgctttttctcctccaagtccaagagggagaagaaggaaaagaaggcaaaggcagacatggcaacccaggtcagaccgctccctgagcttgttgcagagcccacagatgcaaggtctatgtcattcgtaggcacccatgaatacttggcacctgagatcataaagggtgaggggcatgggagtgctgtggactggtggacttttggcatattcttgtatgaacttcttttcggcaagactccattcaaaggttcagggaacagggcaacgctattcaatgttgttggccagcccctcaggttcccagaatcacctgttgtgggttttgctgcaagggatctcataagggggttgctgatcaaggagccgcagcatcgattggcgtacaaacgtggagccacagaaataaagcagcacccattctttgaaggtgttaactgggcattgataaggtgcgctactcctccagatatccccaagccagttgaaatccctcggccaggagcctcgacaagtcagaaggcaacaccgtcagccgagaaaggtccagacaattatcttgaatttgatttcttttagtggattcttccaagaccatttcatgtgcaagctgtaaagttcttttttcctagacattttctgcattctaataacttgatatgtagatggcatatgttcctagcgttgttggtaagctccgtttgcagttcatttcacctccattgatcacattggatgggagcctctaccaggtgtaagctgtaatccctcatcaattattgagaagtagggtctctttaataacaaataaatgtttccgttctgtccgcaactgctgttttgaaagctatatttggtggtgtaccggaagcanatcacaccttcgatgangtaaataaatgtcagctggagcagc

SEQ ID NO: 11496 - DNA, 762 bp, Triticum aestivum
  unsure (1)..(762): unsure at all n locations
  Clone ID: PAT_TA_11496
ggaactagtctgttgtcgcggcgatggttgccgacggtctgtgtcgggagcgcaggatagaggatgcttggcgggctttggaggatatgaggttacgtggatggaagccggattttgtggcgtacaggattgtgtccgaggggttcaggttagctgaaagggcagaggaggaagggaggatcttgaagcagaagaggaagctcggtgttgcaccaaggaaggtggactacagagaggttttgcttgcgctggtgtctggcaggcagatttctgacgcgaaggagatggccgaggcgattgtattaggcgatttcccgattgatgacgacgtgttgaatctcttggtgtgttcggtgtccgaggttgatgctgatgctgccattatgttctgcaagttcatgatagggaaggagagattgccaagtacacagatgctccgtgcaactttgcgagagcctttgcaagaatggcaagggcgatgagatgtgggaaatgtttaagagtgcttttgggataagggctattgcacgagtgtagagggagtatcattttggtgggtgtcattcctgggccagaggcaaggaaggtcaagagagcatatgatgttataaaaggagattaaaaaggaagaantagatcctgggattcaacaatatatcccctcaagggtagcactattnnaaatgatcnccttagcctgctaanaactgtgggatgagatttcnccatgggtgtnatccaaactgcaaactaanaaanact

SEQ ID NO: 11497 - DNA, 961 bp, Triticum aestivum
  Clone ID: PAT_TA_11497
cttcgtcggggacgtcgccgtttacttgcccgcgccaacggccaactactcccgggattcgccgtgtgcccgtgtacagccgccttccagaagccattcgaggggcggcccccgccgcccgcgcggaggtcccgacctaggaggtggacgaggctgtgtggctcgcggctgagctgctcttcgccggggtcgccatcgtctccgtgcgccacgctgacaggaagctggtcgccgagtccccgggcattcgccgcgcacccaggtactccgacgcctccccagtagctgtccgagcggcggaccgcgacgctcgcgcgagtgtccaatggctccggtggtccgatgagtgtggctgccggccatggccgtggtcatgtgccactgcctctcccgctggaaggacggagctcgcggccaagatccggggagaaggagctccgtgatggcgagctcctccaggagcagggcgaccacgtactccaagagcacgacgttgacgacaagcttgaggctccttcgggcgaccttaacgaggagaagggtggcagttggatgagggttaaaaccacgccggagtcaccgtgttgtcctctgacgacacagccggcgccccatgatcttcaggacggcggcggcgcggcagttggaccttcctgctagcctgcccggccaaactccacaagctgcggctcaccggatccaatccaagaaacgtcctgccagctagtgccatggttcccccacggaaggagcaggtgaattacttgctattacttagaacttctttctcctttcttcattctcctattacagaagctacaccatatggttgtttgatgatctgttaattcttcatggcaatgtggttcgtcaatagccattagtggtacatgcacgtgtgttgagtttaatttcagttatagtttgacttagtggtcacttgctttgtcggtctttgccc

SEQ ID NO: 11498 - DNA, 561 bp, Triticum aestivum
  unsure (1)..(561): unsure at all n locations
  Clone ID: PAT_TA_11498
ggaggaatggcttcgtcgganaagcgccgggcgagcacctcgccgtcggccaccgccctcgcctccaccaccaccaccaccacctcagcctcttcgtccacaaaccccacctcgtcgtcgccttacttcctgccgttggtcgcgagccgcctgacgaacctccaggacttcttcgccctccgcgccgcctgccgcacctaccgggatctcatcccgccgtcgccggccaacctcgcctcccaggctccgctcctcctcttcccccgcatggcctctgcctcgggagccctgtttcacgtccccctccgccgcatcctccgcttccgcctcccctgcacccgcctaggtcgccccaccaaattccactccttcggcttccgcgtttccacccaggaccgcgccggctatgacacctgccgcgagctccgtatccgccacctcctcacaggcgagcgagcccgcctgcctgatctcccgagaccgagagactctgaagaagtcgtcttttccggcgacctcgttgtcaccttcaggaaatgctgctgcgtcctctactactgc

SEQ ID NO: 11499 - DNA, 569 bp, Triticum aestivum
  Clone ID: PAT_TA_11499
tcggcacgagggcgctgccgagtaagtccgtcgtgtccgacctgctcgaagccatcgagacgagccggacgaacgggccgcgccgcgaggcacgccgtggcaacggcctggggtggtggagcctcaacgtcgagggcgtcatgatgctgctcagagtcgttcaggcgatccggggcaggaggctgccagcggctctgggtgtgggcacgaagagaccgcgcgatgatgggaacggaggcgccgggcaccatggtctcaaaggtggcagcggcgttggaccggcgctcggcggcagcggggcacgtcggtggtgcggcgggaagcagaggaagctggggaacacggtgggtgcatggggaagctcttgacgaggtttagttgtccccaaaggggacctgagaattaagtggtgattaaggagttcttttaggttttctggagccgggcttaattagctcgttcatctatacatttagatgcatgatctagtgctaagtgtgctaaagacctaagaatgttcatggttaatttaatcataaccttttagcctctcgcctctaaaaaaaaaa

SEQ ID NO: 11500 - DNA, 566 bp, Triticum aestivum
  Clone ID: PAT_TA_11500
ttcggcacgaggccgacccgatgcggctataataaatctcttctagtctaccgctgtgccctagtccctgtagccgccggccgccgtcaccacctccacctcctcccgtcccctccgcgtcgtcacgcggcgtcgccgccgccatcgccgtccctgctgtctccacccggtccgccatcttggacatcggattttcaggtttccactctttggcttgcaagggactgaatggagctcaaactagcattcccccaggacagcccaccactttccatcatttcggctgctaagattgcaggtgttcccctaatcattgatccgacccttgcctcaggttcagtgcccacactacacttcagttctggggattttatacatggtgtcaacacaattctccggtacattgcacgtgctgcatctctttccagcttctatggccaagacgatattcaggcagcacatgttgaccaatggctcgagtacgcaccactcattctgtcaggctctgaatttgaagccgcttgcttatttcttgatggatacttggcatctcgaacctttttggt

SEQ ID NO: 11501 - DNA, 1136 bp, Triticum aestivum
  unsure (1)..(1136): unsure at all n locations
  Clone ID: PAT_TA_11501
ggacgcgcccgtcgtcaagttcaagaagcgaggtgccaaagctgcgccccgaaaagtcgctccgccaccgcctcaatccgattcggatttctcgtcagggtcagacgcagagggcgaagatggtcacgtagtcaagcgacggaagactaacggtaatgcgctcaaggcttccaccgcagaccaaaaggcgaccacggccgtcgagggcacaacacagtacgcagcgaatcgctcggccgtaatagaagcaagcaacgatgcgaccaagcaatcaaactggtacgacgagaacgccgacgacgctctcagctccaaaaacctgctcggcagcacgcgaacgaagcctcaaaccttcattgaaaagaaccccgacgcgcccagtcgccaagtagggcctatgaaagcatcgacaaacatacgaacaattaccgtcacagattacacgccggatgtgtgcaaggactacaagcagacagggttctgtggttttggcgacaactgcaagttcttgcacgcgcgtgaagattatgcggcaggctggaagctggaccgcgaatgggagatgtcgaccaagggcaagaagccagggggtacggttgtcgcttctgcgaacagggacgagaaggaaaaggatgaggatggggttgatctcgcgctgttggagaagataccgttcgcctgtatcatctgcaagaagccatacaagaatcccattatcacaaaatgcggacactacttctgcgaggcttgcgccctaaaaaggtatcggaaggatcctacatgtgcggcgtgtagtgcaaagacatatggtgtgtttaatggcgcgaagaacctccagaagttgttggagaagaagcagaaatgggaggacaagaagaaggcagaagcggaagagaaggcaaaggaagaggaaggcggcgattgagactagtaggcagcatttggtgtcgagatatcagggaggtgttcagcaacatatacaatggccggtgatggaagctggacatctctttgcttcgctcccccacggccatatccgctagtcctcatacatgcctatgttgtagaggcaatcgggcacattacgacggaacacggcaccactcataaggctctcaatgtnnactagtagatgt

SEQ ID NO: 11502 - DNA, 686 bp, Triticum aestivum
  Clone ID: PAT_TA_11502
ggaacagcgaggaaccctaaccctaacaaccagtagatccgatctgcaaggtaggttccgacccctaaccgtaatcagtagttcatatccggttccaacccagcctgatttctcgagtcttcggtgattgattcgtgcttgtttgcacgatggcggcttcccttcgcgcggcggcgacgaggatcctccgtccggcgggccaggggcttcgccggctcgtccacacccaggagcaatctagatccaccccttccttggagggaggagaccgtgcagcgcaaatccagcagaagaaggaggagctgtatgatctcattgcccgtgctcagtccaagaaggttggtctattttacacggctgcccagggagacagacttgtgctcaggattctctccacacaaatcaagccaagaccaaatgaccctcaatggcgctggataactacagccaagaaggtgactatgtgttcttcggctgcaattgttcttggtattgctgcgttcactcttcctgacttagctactcgtcctgaatacaagccaatgaagtgaaagatgaaaggtatcttgtttgatggagaagcaagatgatgtatatcagttctattcctgcactattatctgtgactcttaaaatacattactatgatctgtcacctatgacttgagtattattatatctggatg

SEQ ID NO: 11503 - DNA, 582 bp, Triticum aestivum
  unsure (1)..(582): unsure at all n locations
  Clone ID: PAT_TA_11503
gttcgggctggcctcgggtcggccgaggatgcggcgacggcgacgggtggctggtcggtggacggcgagcgtgcgccgttgagcgatctcttcaagataagcaagtagatatgcgaaccagtaattcagacggcgctcactgacttgtccgagctgggtgagccccccctcacctcgcttgcgtcgtcgccgacgagcagcgcgccaccacggcaaagaaccccaccattgcctaccgggtcgcctctgtctgcgccattatcgaggagcacgacgccancaagacgcccatgancgctagccgagttgctgccatgtactccattgaaaggttggaagacttgtgatgcccatggaagttggaagangtgataaaggagacaaatcctctaaattagccatgtcgctccacaaccatgctctgcanattattatgggctatgtcaggttcatgatatacatagattagtggnaataaatctnttgactggtgttatgggcagaggtttcaagtatgctcggtnaatnattgatgcttgacacanagatntccaaaggttgttngatttcaagtcaacaatg

SEQ ID NO: 11504 - DNA, 486 bp, Triticum aestivum
  unsure (1)..(486): unsure at all n locations
  Clone ID: PAT_TA_11504
ggcgtcgccgacgagggacaacacgctggcgacgccgacggacatggtggccatggcgcacgccaggggcctgcaggtgcacccctacacgtaccggaacgagaaccgcttcctgcactacaacttccggcaggacccctacgccgagtacgactactggctcaacgacgtcggcgtcgacggcctcttcaccgacttccccgccagcctccgccgcttccaggactggaccgccgccaagaactgatcggcagaccacacatgagtaccctatacgttcagatagccacaggcaggttcagataggtttctctcttctccttgggttgttcaggattggattttgcattggcaatacatggaatggattcgttacatcgggactggtttctcttatcgtgcatcgtgcgaatgtgatggtgtcccctgttctcagttagtactgtataagctaccagcaacagtatcttgccaggtttcttcnnn

SEQ ID NO: 11505 - DNA, 665 bp, Triticum aestivum
  Clone ID: PAT_TA_11505
ggaacgtcccgctggcggagcggtggagccccgccgtgtcggatctctgcgggccgagcctccagatctcccgcctgcccgtcatcgccggcccgctcgcgtactacgggtgcgcgatcggcttcctcagggtccgcgaggagatgggcgcccgggccatctgatactcctgccaccgatcgttcacagtgcgatcacgctcttagtagttaatggcgacgctctgatgggcctctgcatgattgcgaacatggccaccacccacttatgaccttcgaagtggcagatgctacaacagtcttgggtcagaaagaggaattaagaaaggcgtttttcttgcaagctggattagtttgtttccagtagttagttatttggtggtgcagtttaatttggtgggtggattgatgcatggttgatacaacaatggttaattacagctcagaaccctgtacatagagatgaacatggctgtatcagccattgtttgatgtaaaacaagatgtggtgtggggctgggcgcgtggttctcgcccctgtcgtggctttcggctcggtccctcgtctcaacggccatgccattagttctgtttgtttgcagctgcacaagcacatcatgctagtgatgatttgcattaaagcaattttgtttcttaaaaaaaaaa

SEQ ID NO: 11506 - DNA, 1774 bp, Triticum aestivum
  Clone ID: PAT_TA_11506
ccggtccggaatttccgggtcgacccacgcgtccgcccctcgacctcctcacctagggttagggtttcaactccaccggctctctcccgctccaattcgaacgaatcctcccgcatggccgccggcatcctggtggacttcccctccatggggtccgcctgcttcttccccagcctcgagtccctcctccgcgactccacctcccgcttcctcgccgccgtctccgccgcccccgacccggacctcaccaacttccgctccctcttctcccgtgtcctcaccacctacccggaccctcccctcgaggccgtctggttcttctccgcgctcaccttccacgacgcccccgacgacctccgctccattctccacctcctctccgccttcccgccctcccccccccccgccgcccagcccctggcgcgcctcccccccgccgtcccccagctcgtcctctccgcctggccccgcagcgcgatcgcggccctcccgtccgagcaattcttcggagtcctgctgaacatgcttgtgaaccctccgctgcctgtttattcactactgagtgctgatgatgagatcttggtgagagatgtcctttatgatgctctgatcttggtggattattcattcctcaatggagctgaagttgatcaagctgatagttctcttttgcctatttttgtgtcaagattggttataactcttgatgccatcaatgatgccagggccaaaggagatcaagggagagcaatgtcgtttatcaacgccttctcaacttcaaatattcccgtttacctggctaggtgggctgctcgtcaagctggcactgaccaactcggcaaaccaattgctatcacacctcaagcttttctgaagtggcttgtagatctcgaagacaaggggctcacagtgtttggagagaactgttcaaggatcagggagaggctgatgcatgatgatgccaagaatgactatcactatcagagcaggatgggtcactcagacgccgaccttttcttcattgacaagcagagtcaccaggagggtatgcacacagaaggtggggaggatgaagaagccgtggagatggagacagctgataatgctttcatggctgccgctcagtccatgaaggtgacggcgaatggcataaggaaaaggaaggaatgtggaagtgaagacgcagcagttgtgaagtttgtgaagtacaaggctgaagacagctcggttaaggattacttcttgtctgctgctaccaatggcatgagcagtggcagcgaggtggagaatccacagtctgatgacgagatggaagaaacagcttgatatgggtagaaggaaatcactcactaatgcttacttgaggagaatcgttttgaagagttcactggacaagtgcctttctggagtctgcaagactgttgttgttttggtttccgcctcttaatgatgtcatgaagtagtagtatctcgtatggttcctgctcgatgatgacgatgagttgaagcgggttcctgcggtccgactccagcaggcctacggatatagtagtaactggtagctaacctaacttggcgcgtgatgccatgagctatatcatgttccttgttatatgcaattagagactttcaacatgtagatttgcttccaagacttctgtcatagaagagtacctttcctgttatcccacggtaccatcttgaattaatgaatcttggctaccttttagttcgtaattactatggaaaaaaaaaaaaaaaaaaaaactcgaaa

SEQ ID NO: 11507 - DNA, 437 bp, Triticum aestivum
  Clone ID: PAT_TA_11507
cgtccgtcgggaccgcccgcggaggtgtcgggggtcgtgggactcggccgcgggccgctctcgctggtgtcccagctgtcggtgcggaggtttatgtactgcctgcccccgccggcctccaggagcgcggggaggctggtcctcggcgccgacgccaccggcatgcgcaacgcgtcggaccggatcgtggtgcccatgtccatcaacccgcggtacccgtcctactactacctcaacctcaacgggctgtccatcggcgacaaggccatgtcctcctccttcaggagcagcatgaacgcgacgactccaggtacttcagaccccaaccccaaccccaaccccaatgtggcggcgtctcccgtgcccgtgtccggcgacggcgacggcggcacgggcccgaacgcgttcgggatgatcatcggcatcgcgtcaacgat

SEQ ID NO: 11508 - DNA, 516 bp, Triticum aestivum
  Clone ID: PAT_TA_11508
gctcctcgacaccatgccgtccttctccgcctcccccgacgaggccaccgtcgccgcgcgcctcgccgcctacggccgggccggcatcccgcaggaggccgtcaagctcttccgcctcatgcccgacctcggcatcacccgcaccgcgctctcctacaacgccgtgctcaaggccatcctctgccgcggccgcgaggccatggccaggcggatctacaacgccatgatcgccgacgccgtcgcccccaccctgtccacctacaacacgctcatctggggcttcggcctgtgcaacaagatggactccgccgtcagggtgtttggggacgtgaaggcccacggggtgacgccggatgtcaccacctataacaccctgctcaatgcctgggtgcggaaaggcgatctggagagtgcacgcaaggtgtttgatgaaatgccaggagctgggtttgaacgcaactccatctcatacaatgtcatgatcaagggatatgttgacgcgaacaaggtcgagga

SEQ ID NO: 11509 - DNA, 379 bp, Triticum aestivum
  unsure (1)..(379): unsure at all n locations
  Clone ID: PAT_TA_11509
gcctaggtgctggtgtctgtagtagtgttcttcaacggtggttttggtctgcggcgctgctctgcctccatggtgcgagcagaggtggtgcggagagcaggagacggccggttgacgccgtcgttttagcgggaggggggcgacggtggtctcgtctcgccagtgggtccgaagtaacaatcgacaggagactgttcatatggatagatagccttccaagggcaaagatcgatgtggctatcttccattttggtttggactttggaccagagcagaggaggtgtgtgctgtatnccttgggccgtnccatggcgtgatcctctatcgtttgttcaatcgagcaccaatgtcacagaaaagtttaccaacaaaaaaaaaa

SEQ ID NO: 11510 - DNA, 489 bp, Triticum aestivum
  Clone ID: PAT_TA_11510
ggcgtaccgctgcattgggcggccctgcctcgtgcagcgccttgacgcctagattcgacctattctggtggcaacgcacggcgaccgcgttcatggcgaggtagacgaggcagccgtcgtacctgcactgaagcatggcgttcttcttttggtcgtggggtagatgcagcgcacgccaccgcgcatgagcaggatctcgtgattcgagctgctggaggagagcacatggctagggcgctccacggcggctctcgggtacgacatccactaagaagcctaaatggaataactggtatagacatgttgtatattattggggagtatatggtgggctgcagtgcctgggtgcgcgcagcaaggtagtaggtcggatgacatcagggtggtggtttccgattttgttgctggttggtgcatgtgcctggttaggcatggttttcgaggatgacttgctacgtgcatgcataatagcaggagttgatgtgacta

SEQ ID NO: 11511 - DNA, 1042 bp, Triticum aestivum
  Clone ID: PAT_TA_11511
ccgtccgcccaggcgtccgtggcaacgttccaattaatcaccaggccctaaatctccggtgcgcgcgggttcatggccgcgccgctgtggccgcgcgccaatgagagcggcggctggccggagcagggcggcgccgggccgggggcgaggcggctggccacggcgctgctgttcctggcggccgtcgcgctgccgtgcctcgtgctgtaccgcgccgtcgcgcccggcggggtgctcgtccagcccgccgcccgcctgccgtggctacaggccggcgcgccgccgcacgacgacgacgacgtcgacctggagagcgagagcgaggacgtgaggctggagcgagtgctccgggcggcggcgatggccaacgacacggtgatcctgacgacgctcaactcggcgtgggcggagccggggtccatggtggacgtgttcctggagagcttccgggtgggcgagcacacccgggagctgctcgaccacctcgtcatcgtctcgctcgacctcgccgcgcaccgccgctgcaagcagatccacccgcactgcctggcggtggccacggagggcgtcgacttctcggggcagaagaacttcatgacggacgggtacctgcggatgatgtggcgccggatcgacttcctccggcaggtcctggagaagggctacagcttcatcttcacggacacggacatcgtgtggctgcgcagcccgctgccgcgcctctacgccgagggggacttccagatcgcctgcgaccacttcaccggcgaccccgacgacgtcctcggcaacgcgcccaacggggggttcgcctacgcgcgcgccaacaccgagacggtggagctctaccgctactggtacgccgccagggagcgccacccgggcctgcacgaccaggacgtgctcaacctcatcaaggccgaccgctacctcaccgaggttggcgtcaggatcaggttcctcagcaccgaattcttcgggggcctctgcgagcccagccgcaacctcagcgccggctgcaccatgcacgccaactgctgcg

SEQ ID NO: 11512 - DNA, 304 bp, Triticum aestivum
  unsure (1)..(304): unsure at all n locations
  Clone ID: PAT_TA_11512
ttttttttttcagcagcactacatgaacataataaaaaagatgtaccaatctgaaggtgctacgattgatctactcatatttcccctgatttgaataggcgggtgctaggcgccggcgcaccggcccaaatttgggccggtcacatcagcaccgtgcgattcagaaaattagagccgcccgatctttttccttcttcccctcgggccgcttccctcggaaacatccccatcgcgccgtggacgaacgatgcgcctgccctagaagcaccgcccgactcatctcgccggncgncacccctcgccg

SEQ ID NO: 11513 - DNA, 871 bp, Triticum aestivum
  Clone ID: PAT_TA_11513
cgtccgcccacgcatcggcggacgcgtgggcagctccccacctccatcccgtctcctctcctacatcggccgtgccacgcaggtctcgtggaccacagtcgcggaagcacctggagagagcaatgtcaactactgggtctccagacattaaagtcaccggcataaagtgagatcttgtggacatataggatgaggtgcaaaccacagaggtaaaatcttgctcaacattgcagagttaggtgtgaagatagaggttgccattgtaggtcgtggtattatgtgttccaagttccttggtccaattccgcggagtgctgataactaaaagcaggagcgccccgtctttatcgccaaaaaactcaccgtctttagttttccgctgccaacgagggttgtatcgtcgacgccgcggcccccagcctccatcccggctcccctcctgcgtcggctgtgccacgccgcgctcgtggtccagactcccggaagcacatggacagtgcaatgtcaaccgttggatctgcagaccttaaagtccccggcataaaaagagatcttgtggacgtgtaggatgaggtgcaaaccgcagaggtaaaatcttgctcaacattgcggtgtttcgtgtgtgggtcgtgtctccttctgtagctgggttggtttttcgtcgcttgtcccttgctccggtggtcctgtcctctggctgcttgttgtgggctgctgggttcgtttgtggcaaaaaaactcacaatctttagtttagaaggtttaactacgcttttctcgaacatcgatgtacattttgaaagttgtttgataagatccgctttgttaaaaaaaaaaaaaaaaaaaaaataaaaaaaaaaaaaaaaaaaaa

SEQ ID NO: 11514 - DNA, 748 bp, Triticum aestivum
  Clone ID: PAT_TA_11514
cgcggccgcgtcgtcttgcttgctttggctttgtgtttttgaccacatgtaatgttaattgcatcaacgagaagaaacattcaccccaatagtcaaatatatgcttatcaaggtgcccagatggggcgactacaaaagtaacagaacagagaatcagaagaaagaataattcaaggctggatttatttgattgccactttcaggccatgatcaattgtaatttgctccttgcctcctgctattctgcgttcctcttccaccaccggaattcgaattacggttgcttcttcctcttctctcgggccatccaccattaggccgagaggaaccacctgtattattaatatgatgatgaggaccagcaccggtgtcacggtaagatgcaccgctgctgtcctcgatcctcaagctactccccaacaccatgccaacgatgtgatcgttgaaatgatctgcagatgttgttcctcttgctctcccgcgctgacgccgaccaccgcggtaaccaaaatctggctcctgatgggttgtgttgtcaaagaatgtatccataatgtcatcagaaaaaacactatgatgaccatgtcgacgggaagagccaatcacggcttcagcagcgtcagcagatctaaacaatgggagtcgcattaaatcaaggccatatacctcatcaaagttgcggtggaggtagggatcagtgtagtcatcataatcttgttcgatgtcatcatcgggtatgatcatcata

SEQ ID NO: 11515 - DNA, 927 bp, Triticum aestivum
  Clone ID: PAT_TA_11515
ggaacttccaccaataccagatcacctatcagagcagtgcaaggacttcatcagaaagtgtctgcaacgtgatccttctcaacggccgacagcaatggagcttttgcaacacccgttcatacaatataaagtccgacttgagaaatccgttatgtctgatcctttggaacatttgcccgtgatatcttgtagaccgaattctaaggtggctggacatacaacaaatatctcgtcattgggattggagggtcagacaatttaccagagaaggggtgcaaaatattcttcgaagcatagcgatatccatatacggagcaatatatcctgtccagtttctccatgtggaagtcctctgctaaggtcaaggtctccccaacatacaaatggccgaatgtcgccatctccaatttcaagccccagaaccctttcaggcgcttctactcccctgtctggtggcaatggtgctattccctttaatcattcaaagcaaccaacctacagcaatgaaggatttgcaatcgcatcaagaggcccagatgatcacttccccaaccggcctacagaccgtaaccttgggcagtttggtcgagtgcatcaagtctcacaggggaatcaggagaggatagtatctgaagctaacattctgagccctcaatttggaaagaggcttggaaacgtttttgatttgcgtgatagactgtccccttctgaacatttcactcgtcctgccttggtggatcatgtgaagccaaatccttcactagacttaacaactggttctccccaccatggactcaagcgtgataactaactatcaaggataggccaagcgaatttttttggagcttggcagggtaactaagtggttttcagctgctttggccagtcagtggcttgaattgcatcataatataatatgactatggg

SEQ ID NO: 11516 - DNA, 556 bp, Triticum aestivum
  Clone ID: PAT_TA_11516
ctcaactttctgctttgctccgccctcgttcgcctgtgctgcagagcttggctgcactatgagggctgactcggccctgctcagctccgcccccggtggtgctcctcgtgccgcggcagttcgcctcctcgtctccttggccgcttcgcagccagtggcgttcgtgctcgtcggcaggacggtgcaaggcgcaactccgacgtggttcctcgccggttggacggtgttcaggcgcaaccccggcgcccactgagtactgcctcggctacaacctccctcggtgaccgctgtcttccagctggatgagttttccacgcagtgcatcgaccgctggcctttcctgatgaatgtgtagagatgattgactctgctcgaggccccaactctcctcacacaggatcctgaacctctccaacaactcctactgtcgggggcactaatttattatttgaacagctcatatcacatgaattcaaaattacttttctggaggaccaggagtccaggaccatgatacttcgaatactgttccatggcactgacaggcctattggtt

SEQ ID NO: 11517 - DNA, 528 bp, Triticum aestivum
  Clone ID: PAT_TA_11517
cgcactcgcgacactacgactcgctcccaccagccggcgcgtgccgtgtcaggcggccatcgcgctacgccggcagccgccacggcgcatctggaccaaagccccgccggccaccacccagcgcggctgcaaaggcccccgggactctaccgctagacgagagcgaggaggtcttgagagagagagagagagagagagatggtctgggcgctgacccccgtcggcacagagcgcggggcgcagaagtactacatctccgccgccgggacgtacacggtcggccgcaaagattgcgatatcgttcaaacagaaacgtcgatatcccgagtgcatgcggagatagcagttgaaaagatggttgcctgggagccacgttctggtgctccagcaagcccttcatgtgtcagtgtagttgatcgttcaaaatatggcacatttgtcaacaaggtacaggggactcagggcagtcgtctacgtaaagatgaagttgtggggctttccgacggcgataccgtggacttcggaaat

SEQ ID NO: 11518 - DNA, 660 bp, Triticum aestivum
  Clone ID: PAT_TA_11518
aagacctgtctaaatcatgcaacccatcacatcataaccctaaattcgccctgccatccgtcccaagctccgtgtcatgccgaggtgcgactaaactgatgcagccgagggttggttgtgcgaaaaatttgtatgttgatgggcatcgcgctcgcgggtgaggcacgtttactgctcggtctggaagtagttgaggaggatgctgcgctcctgggactcctcaccccagtccttgaccacgacccaggaccagttgacgccctttgcgggggttgcccttcgcggtcgatctggcagagaccggcccactcgccgagctgctttgccatcaggggaccttgatcagggggatcttgtgctcgggagcacagggcaacgacgagcttcttgtacgcctcctcctcgcacgcctcgttgaggacgcacatgtgcgcctcacgacggtcgagcgccttggacgcctcgcgcagaccacgggcaagtccgtcgtggatgagggcgagcttcagcacgcccttgagcgcctcgagcacgctcatctggcccttgccgccggatgcatccgcagagacctcgacctcggcggccgcgctgacttgggacttggtatcgtcttctccgtccgacatgatggctgatttatcctcgtgcgcacgaggc

SEQ ID NO: 11519 - DNA, 636 bp, Triticum aestivum
  Clone ID: PAT_TA_11519
ttttttttttttttttttagcaataataccgcggcctctgtatcttgattaactattgcacagtttacaagatccatgctaggcatttagtctagccttatcaagctcgctcggctaatttattgggatacaagtagagatcaaaccaccccgcaaaaaacctatgttctttgtaggttatttgtcagtcgtctgagaagtaacgacgccatatatttgtagagcacactagtcacaatatcccagatacatactgaaacgtaacacaaaaagggaaaccaagccatgtaattcaaatttgaactaaaaccacgacaataattatggaatagagggagtaactaatttacgcagctcggttaattccagaagaaactggcgccaatgacgagttcatggacgcttgaatctcctccagggtccttcctttagtctcttggtaccagccgctccacaaatacaacagtcagaccgcaaatgctcgcgaacatgaaaaatgtaccgtaggagctccacagcaggaggaagttgaaggcatacgagacgatccatgagccgagccagctcaccaaggtcaccaggcttcctgctgaccctttcatgtgtatggggaagatctctgacattataacccat

SEQ ID NO: 11520 - DNA, 665 bp, Triticum aestivum
  unsure (1)..(665): unsure at all n locations
  Clone ID: PAT_TA_11520
ttttttttttttggaaactttcagctgaacattcaaactcaagagtcccatcacaaacgtacgtgcgcacgcaagtaaatgtgcatacagggtaccagttgcattcgctgacatcactactgctgagaaattttacatggccaaaatattcgggcaagggagaaaagcaacaaactactggagtaataaaacatgcaccgcggcgtacgcagccatcacacgcgcacggcgacggcgtatcatctaggaatccttcttatcttcgtcggcgtcgccgtcgccgtgggtgcgcgccgcccgcccgacgcccgcgtcgctcggggcccgccggggcgccctccgcccgtcccggcccaggggccagccgcgcgcgttggcgccccagcagcccatgttggcccgcgcgggcctcgtgctaccgcggctgctggcaccagacttgccctccaatggatccttgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctncgtcacccgtcaccaccatggtaggcccctat

SEQ ID NO: 11521 - DNA, 974 bp, Triticum aestivum
  Clone ID: PAT_TA_11521
cgtccgcggacgccgtccggtcgacgtacgtacctaccaagcacctgcaagctcgcgacgcagacagcagctcggtcgcgcggtcaccatgctgggcctgctcgcgcacctccacgcggcgctcgtgttcctccccaacaacgggggcccggcctgggccgggccaggcggcggcgcgggggcggtgtacgacgtggtgcgctacggcgcccgccccgacggcatgacggacgcgacgctgccgttcctgcgcgcgtgggccgacgcgtgccgctcgccgcgcccggccacggtgctggtgccgccgggcatgttcctggtggggagcgccacgttcatgggcccgtgcgccacccgcgccgtcacgttcaacgtgggcggcacgctgctcgccccctcgggctacggctgggacagcgcctcccccgggcggtggctcacgttcgagtccgtggagggcctcgccgtctccggcggcaccctcgacggccgcggcgcccccctctgggcctgcaagcagcagcagccgcagcagccgcgcctccactgcccgtccggcgcatcgtcgctgacgatctcgaactcgagggacgtggtggtggacgggctgaggtccatgaacagcgagctgttccacgtggtggtgctgcagagcaacggcgtgacgctgaaccgggtcacggtggatgcgccggaggacagccccaacaccgacgggatacacatccacatgtccagccacgtctccgtgtacgacgccaacatccgcaccggcgacgactgcgtttccgtcggcccgggcaactccaacctctggatcgagcgtgtcgcctgcggcccaggccacggcataagcatcggaagcttggggcatcagcaagggctggacatggaggacgtgcagaacgtgacggtgaagacgacgtggttcaccggcacctcaaacgggctgagaatcaaaacctgggggagct

SEQ ID NO: 11522 - DNA, 383 bp, Triticum aestivum
  unsure (1)..(383): unsure at all n locations
  Clone ID: PAT_TA_11522
acatctgaaaataccgcgaaaaaagtgcgtttgcctccggacgtaaacaggtgtacatgggagcaatggtgtgtggggcaagggaggctatgtgagtcagttccttgctcctatcttggagnaacttccttgacagcttgcaacgccgagaactggtgcacggcttggctctccgtgatgatgccgaagctttcggggcgcttgtgctcttgcttctcggcggcggaagttgacctgcgcaggagctcgaacagagaggcgcctgaactcgagccgccctcggagcttgtgcctggtgcggctggctttgtctgtgaactgctgaacttcgctttcttggcttggctggggttcgcctggntcctgcacatccgagttactct

SEQ ID NO: 11523 - DNA, 629 bp, Triticum aestivum
  Clone ID: PAT_TA_11523
aggaattcggcacgaggcacgggctcgcctcctctccctctcgcccatggagtcatcgccgccgccaccacccacgctggccgcttccggcgacctccggcgacgcgcaacacgcccccgagctccccatggtccgggcctgcctcccctccggccagattctccgctcccgtcctctgccgcccacttccaaccccactcctgtggctagggtttcgggcagggcttcgccggcgcgtctccggcggccccagttatttggatcatcatcgtgtcgcaagtttccgacatcgctttacacaccgtggacttcatcggaaatccgtctgcacgtacttcgctgtccgccggaacttcgtctacctgtggacagaggaagctcccaaagtgccggctatatctcttgcgtcccctcgttcctgcaaccaacaggcggcacgacggattgtacgtcggcagtgtttggttttgcagcctccgccgggcgctccagcgctagctcctcggcctcaccttcctccacaccgtcggaaactggtaactcacagccgtgccatgttccggtggagtccactgtatgggtggcggtgaaacatgtatttgcatggtaaacgacggggaagctgaca

SEQ ID NO: 11524 - DNA, 781 bp, Triticum aestivum
  Clone ID: PAT_TA_11524
cttctctggctttcccaaactcacaactctcacacaagcaagcggtaacgttcaaccacaaagctcacacatggcaaggcacaagtttacaccatcctaatactcagttcatacaggtctccagcaagccaagctgcgctacctggcagccttcgacgcattggtcgtcaacttcttgttcttcttcttcttcctccttttcttgtccctcctagatttcttcccgctttttgcagattaggcctcttgcacggatgtcggcggttgtgtcgtttccagctgctgatgaattgcagcctatgggtcttgctggaactgagcattgttcagtacagcattcagttgagcagactctcgctgcactaaagcctgcttcgatttgcggttaagctttacttccgtctgctgctgggagctggctgtttgtggaaggaactcagaaagtgctgacagatcatatgctttcagtttcttctgacggctcctctgtttctttttcttactgatagcctttttggcctgtagggaggtaaccgcatctttcacttttgtatagaagctgagctccttctctagctttttctgagagttgagctcctgcttcttagacccccgccgttcgccggccgggggcgggcggagttcgggtcgccgcgcgcgctgggggcgcgccgcgcccccggagggggcccggcggggtggggcccccgcgccgcgcccccgatggtgtcagcagctgtggcgtcgcaggcgcggcggcggcccctcgtgccgaatgcct

SEQ ID NO: 11525 - DNA, 591 bp, Triticum aestivum
  Clone ID: PAT_TA_11525
ggcggcgccgatgggtcgagccccgccacggcggtcgacccccggaagggcaagggaatctccaccattccgtctcctccgaactccgcgagcagcagcagcggcagctccctcgacttcggcgcggccttcggagacgaggtcggggagtcgagcaagatgggcggcagaaaggcgcgggtgaggtggagccaccccgtggtggcggagacgagggaggtgcccaacgcggcggcgcatccgttggacttggaccccaagctggtggccagacagcggcttatcgagcggctgattgaagcgcaggcggccgtcgacaaggagcagccgttcgaccccaacacggtgttcgagcagacggtgatcgagcagctgattcaagagcaggcggcaagcgaggaggcgaacaggcgacgggaacagcaggcggccgtcgacaaggagaacaggcgacgggaacaacaggcggccgtcgaggaggggaccaggcgatgggaacagcagtacaactcgttgcgcgcggaagaggcgatgtaccagaaggaacaggagaaactatcacaagtacaggttgtggtaaaggtgacaccc

SEQ ID NO: 11526 - DNA, 1388 bp, Triticum aestivum
  Clone ID: PAT_TA_11526
ttgatccccagctcgaaattacccgcacgagtgggcaccagcgcgggtcctccgccgcggcggcggccccgctggtgcgggtcgagcccccggccggcacggagccggcaccccggggagtgagcagcagcgtgagcgccgagctgccgtacgactgcgcggaggggtcgccggccggcgatggcgttcgagtcgtcggcggagacggagcggttcctgtgcgagcggctgctggacgcggcgcagcccatcgcggagcgcttccgcgcgctcttctccctccgcaacctccgcggcgacggcccccgccacgccctcctccaagctgcaagggatccctccaacttgcttgcccatgaggctgcatttgcgcttggacaaatgcaggacgctgaggctatccctgcattagagggagttctcaaggatctttcactgcatccaattgtccgccacgaggctgctgaagccctgggagctattggcttggaaaagagcatttccctgttaaaagagagtttagcagctgatcctgccgtggaggtgcaagaaacatgcgagttggctcttagacggatagaagggcagaagaatgccagtggtgctgaaagcacaacaatttcgccttatctatcagttgatccagcactgcctgccaagcagggactttcggtagagcaactaagggagcttctcctcaacgagcaagaaaagatgtatgaacgttatgcagctcttttcgcgcttaggaatgacggtggagactatgctgtttctgctgttattgaggctctaggtgtgaaaagtgctcttctgcgccacgaggtcgcttatgtattaggtcagctgcaaaataaggctgcttcagatgcactttctggtgtgctgaagaacgtcaatgagcacccgatggtcagacatgaagctgctgaggcccttggttcaattgcagatcaagaaagcattgcgcttctggaggaattttccaaggaccccgagcccatcgtctcccaaagctgtgaagtagccctcagcatgctcgagtacgagagatcagggaagtcgttcgagtttctgttcctccagactcctcatgtgcagcaggagtcctgagcccagcttcggatacatactttgatggacctgtcagagtcgacggttcggtgtggtagtggacatgatgtctgaatgaagtgtcgtcgcccttttccggttctttttcgggagttcttgcttgacaccgggatagcaaaacggcgaaagataccactgtgaattgctctctgatgagaatatcatgtacgcgtgccccgtgaaaacagaaactgatactttgacgaatttgtttgcctgtggattgtgcctatcttctgtggtggtgtaaacac

SEQ ID NO: 11527 - DNA, 724 bp, Triticum aestivum
  unsure (1)..(724): unsure at all n locations
  Clone ID: PAT_TA_11527
acacacagggataaatangnttaaactgttaggnttaacctgttagntgacagttggnttatgtatatatctgcttgtagatatattttgtcgtatatcactttggtaatacaaactcagtataaggtaatgcaaacggccgctcttctaaaagctagagatgacactgtcagcatcaagaaacaactgagaaacttcagctcaggtgttgcgagtcatgcccctgagaatgatggccttccagagggcacttgcaatgtttctgcagctccaggtacttctccatgttgaaaccatgcttcacgcaaagctttctcctcctcgactcaaacatcctctccatgaagtcttgatacgtcgggtcccttgaggtgatgacgaagtaggcatagccaaccagcagccccgaggtggtcgtgaagaaggcaatcggctccatcacgtcccatgagaactcccagaacgtgagacggaagaagatcccaacctggagcatgaagaaccctaagccagtccacaggactcgccggacttgcttgtgtgccagcttgtcgatctcttccttcttttcctggagctgcttaaactctgcctgtctcgtgtcgttgtctggtgcgagtgcaagcggcaccgcccttctgaccaggtccacaaccttctcggggtggaggtacgccttgtcccggaagagaagcacgacgccggagtcgtccatggctcgggc

SEQ ID NO: 11528 - DNA, 1224 bp, Triticum aestivum
  unsure (1)..(1224): unsure at all n locations
  Clone ID: PAT_TA_11528
catggggatcnttntgaacgaacaaaaaactactagcagattagcaaggagagcagtaatccaccacaatgcaaaacacaatccggtgatccataacagtcatcaaattcagacttacgactccagtctatacctttgaattactcaaaagcgaaatctaatccgcacctggaatctgaaacacgcataagtccgcgaacggccccggcccccgagctttgtattcttatttcagccgatcagcgctgctgtccttacccattcagcttgcgcctctctccctaccgctctttgttcgatcctccgtgcccgctcccttgccgcgaaaacattcttaccatcaacacagccgcaatttgccgattctaggatgctcgcattgtaatcgattgcaggtcatcaatacagtttcaggtaagctcatctcactcccatcagtcgatcaggtccattatcgccttggtcacctccctggcaaggtcgctgcggcgcagctccaccttcatctgttgtaccctctgcttcttgatcttctcgtccagcaagcgtgccttgttgtcgtccatctttccgaactcccgcttgaacatgcccgaggcctccatcttcttcacctcctccgcgaggtatgggtacaactcacacatctcctcaaatcccttgggctcgtggtcgttcgccttggcggtgggagcagcagtagaagcggtggcagcgcgggacctgtacttgtggccgctccagaggatcttggacaggtcgaagagccggcggtcgtgttctttggtcgggagctcgtacttctccccggctgacacataccgatgcttgaggcttttgaccttcccctggagctccttgctgctgtaggcacggttgtcgagctttccggcgagggcttcgaccagtgcgtcgggctgcggcagcacgccgtgctctttttggtgagcggcgagggcctcgaggatacggacctcgtcgttggtggaccagacgcggtggaaagcaaggcgcggcttcttggcctccggggccttcgcctcctgcttcggagatggcttcggcggcggctcatctttgtcagattcggaacccccatcctcctcctcgtcggaactgtcggagtcctcactctgtcgcgccggcggaggctgcttcttgggggcagtgttcggggccgcgtgggatggctcctcctcctcctcttcagaggtcggacgcgtg

SEQ ID NO: 11529 - DNA, 589 bp, Triticum aestivum
  Clone ID: PAT_TA_11529
atgatggggacaagtcatctgttgattattcaaagaaaagatggattctgatggtacaagtgggcaaggagcatttgataggaaggattgctttgggaatgaagagccaagaggtggccaggttgatggtacagtttcagatcctcatcccacgtttaagcgtcgagtgaatgccacacacttgattaccccatctgaaattatctcaggtgtgctcccatctgatgaatcgactgctaatggcagcccacagaatgcagaaatggagtcaaaacttgtggttgagaaaaaagcagatcaaaatattggatttgaggatgttaaggagacccaaattgttcaagagaaaatggagagacttaacatgtcttcagagcaaactgtagagacaattagtgaacgttcggtaacaactgacaagtatagtgtggaagattcacagagatcagaccccacacttctgaaacaacattctggtgctcgggatgaaaatcttccaagaagaacagctgaagctactgaaaacatcaatggctcttcgtcaaggaacttgcaattaccctcacctaccaaagaggagaaagttctg

SEQ ID NO: 11530 - DNA, 2444 bp, Triticum aestivum
  unsure (1)..(2444): unsure at all n locations
  Clone ID: PAT_TA_11530
tgcaggnaattcggcacgaggagagttgttgcctttgaagactacaacccatgctagtgaataaattgaaaagggaaggtggctggtgaacttgagttaagacatgtccaaatctactcctgttaaagcaagcaagaattctgaattgaagaaatctacagccatcttaacaatagcaaatggccatgcttgtaagaaggatgcaattggtggagagcatcctgtccatgacatcaagtccactggtacttggatctgtagaaattctttctgcaagaggtgctcatgttgtatttgccatcagtttgatgacaataaagatcctagtctatggttggtttgtgcatctgaaaatgacgacaaacagtgctgtggttcttcttgccatatcgagtgtgccctccaacaaaagcgggtgggatgctttgatcttcaaaaaattattcatcttgatgggagttattcatgtgcttcatgtgggaagatatctgggatactaggttattggaaaaggcacgtggtgattgcaaagcaggctcgccgagttgatatactctgccaccgcatctatgtgagttatcagttgttggagggtacgagctgtcatacagaattgcataacattattcaagatgcaaaagcaaaacttgaatgtgaggtcggtccacttgatggaatgtcggcaaagatggcacgtggtatcgtaagcaggttatctggtggtagtaacatactgaaactttgctctctggcgattcaaaaagttgatgagttgttgagtcctccatctccaggcttgcatcttcgaggttcattaccagctgcgtgcagattcaaattcgtagatattacatcatcttcccttgttatcatcctaaaagaaactaaattagcatcatcggacaccatcaaaggttataagctatggtactggaagagcagagagcaaccaagcatggatgagcctgttattttgtcaagagatcaaagaaaaatacttgtttataacctcgccacatgcacagaatattccttcagaatcatatcattcacagatgctgatgcgaccattgggcattccgagtctaaatgttatactgcgagcaaggaggtatttgtcaaatctgtgacccagaaggccacgcaaatatgcccgcaggcgcagacaacggataggagccaggcttgtatgtccactggatttaggatccgaggtgctgggaagatcttgcggcgagcttgggctgaagaaggctgttttgaggatatgtacgaaggttcatgtgacataagtgccacagaagcagaccaggcagagaacagtgaacagggtcatttcttatctggtgcatgtcgcaaacttcagttcaatgcattttctgtccctgacctaaatgcacccatgcccatggacatggactcttcccctgagaagagctatgatttaaataacagacttttaagatcaaatgacagtggcggctcagaggcttgcgaggcagtcaggagcgcggancggctgctgttgaatctcgaccaggaggcaaggcaaagcagcccaatggtgctcagaatgaaagctgtgagcaggatggagtttcagccatctgccgccaaaagcaacttctgaaaaggcctagagtgctggatgaggactatgagtactgtgtgaaggtgatacggtggctggagtgtgacgggcacatagagactgatttcagattgaagtttttgacttggctgagtctaagatcgactgagaatgagcatagggttgtgaacacattcatcaaaacactaatcaaagaaccaagcagtctggctgagcagcttgttgattctttcggagagatgataaactgcaagagaccaaaagtaggtttcggcagtgagctatggcatttggacaaacaataacaattcaagagttccctaactcattggtatcctatagtttttccgatcaagggcagtgaatcccagaatgagaatgagggggttaggttcataaacttgataatcatcgcatcgacccagccgtcagattattaccataccttataagttcagatcagaacgtgcacaattttcttgagagtcatcatttcggccgtaccataccttataagttcagatcggaacatgcacaattttcttgagagtcgtcatttcgagcctatgggattaggatatttgatttacttagaaattcctatcttcttgattctacttaggaaaatcatttaggcggaaaatagattgcattgaaagattcctgttccacctgtaagtagtggaaacaattttatattctcattggtttagtactctctatattctgtccgagcccgggaaaaatcttatatgatgtcatgtatggcttacatctgcttggtacctatttttcagtatgggtgattttttggtaaaaaaaaaaaaaaaaa

SEQ ID NO: 11531 - DNA, 2158 bp, Triticum aestivum
  unsure (1)..(2158): unsure at all n locations
  Clone ID: PAT_TA_11531
cgcgagcagtacaaaatccatagtggaggaaaggaattgctagggagggagggagggagagagagagaagaaacaaaacccgcccgatctcctcgccctcctcctactcccactccgatcgctcctgcccgattccctacccgattgccgcgcgcctcctggtcccctcccgacacccatggagcctcgccccgcggctgcagccggaggaggaggagggggtggtcgggccggagaaggggaggccggccgtggcgcggaccccgacaccggcctcgaagggtcgatgtggaggatggggctggccggcgacggccgcggggagggggacggggcgcgcctgccggagcggccggaccaggcggactgcatctactacctccgcacgggcgcctgcggcttcggggaccgctgccgctacaaccacccccgcgatcgcggcggcactgagtttggtggaggtgcaaagaatgcagtagcattggactacccggagcggttgggtcaaccagtatgtgagtattacatgaagactgggacttgcaaatttggttccaattgcaaatatcaccatcctaagcaagatggttctgtgcagcctgtaatgttaaacagtaatggattccctctacgtccgggtgagaaagagtgctcctactacatgaagactggacaatgcaagtttggttcgacatgtaaatttcatcatccagaatttggtggtgttccagttactcctggaatttatccaccattgcagtcgtcaactgtaccttcgcctcatccatacgctcctcttacaaattggcaaatggggaggccgcctgtagtccctggatcatatatgccaggctcgtacactccaatgatgctatcgtctggaatgatccccttgcaaggatggagcccttatccggcttcagtaaaccctgtagcatcaggtggagcacaacaaactgttcaagctggacctatgtatggcatagggcaccatggatcttcctctacaattgcttatggtggtcctcacaccccctactcgccctccactattccggcacccctgtctcaccaagaacatggattccctgagcggccagggcagcctgagtgtcagtattacatgaggacaggagattgtaaatttggcgctacatgtaaatatcatcatcctngnnnttggagttcacccaagtctaattatatgttcaaccctttttgccttccacttcgtccaggtgctcagccttgttcatactatgcccaaaatgggtattgtagatatggagttgcatgcaagtatgatcacccgatgggtacgcttggctacagttcatctccctttcccctgtctgacatgccaattgctccctatcctcttggcttctctattgccacattggctccatcttcatcttcccaagatctaaggcctgaatatcgtccggctaaagacccatcagtcaaccaagtaggatcgccagtggcagcatctgagccgtctggatcaattttgccaaaaggggttttcccgccagacacggtaatgcgtgctcagactaatacgacaactggtggtagttcaagccctggtggtggtcgctgatttttctgagctgagtcgagagatctcttatctctcagaacaattttccaatcatttgacacagttctgataggcccctccgatgtgaataaaaagccgtggcctctgtagagaaggctcggcgagggtggttttctctgccacctcaataaaaaagcattgataggttacaagcaagctcgattcacttgcaaatttttgcgctcttctgttcatctctgagactggaaaaggaaggtttttggatatcaggttcgatatctcgcaatcggtgtggatactcatatccattcccttggtaaataaattcttgggcaaggaaatcgccacatgaagaaattactgggttttggtcctagccttcccaagtcattttctttttgttctgtatattgtcatatatattatattatatatatatatcatcaacagacttgagacttaaaactgcataagtacctgcccgggcggccgctcgacgtggtcgcggccgcggtacgtttatataatgaagtatcgctgtggaaacttatccatttcaaaaaaaaaaaa

SEQ ID NO: 11532 - DNA, 776 bp, Triticum aestivum
  Clone ID: PAT_TA_11532
acaaataacaaaggaaaacctatccgttcgccaaaactgtaagcaaaccaaaaactgaaactatctacagtgaaattagagtcatgctgctggcgacaactgcaaggtgtaacgcaaggagcaaggagcagcgccatgcgccggccaacaaacggcaatcccgtctggccggagcagtccacccccgcacgtgctgagtaccaccgatcacaaatacagagttgccggcccgacagcgcaggaagactggcatcggcgatgtacgcatgcattgtctgccccgaagcccctgtcccgcctccgctgtagtggtcgccgccaccgccccggcgaatcaccaaggagctcagggcactaactgctccatcggcgatctggccgccggccgtgaggagcatctcctaggcgtgctgtgggccgccaccgccgctccgtactcgcagcctcgcactcgcaggtcgttgccggagaagcaactgcaggggctgatggcccgcgtccccgtccgctgtagtggtcgacgccagcccgccaccgctgccgggaacgatcgaggagctcggaacacttctccattggcgatccaaccgcttcaccttcttggagtcgtgcgacacccgcttcaccgcgatatgatttgactttgggagcacgccctcttgtccctaccgaagccgccgatgcccagcaactgcctgttcttgaaacccatcggtggccttgtacagctgcttgtacgcgaagtggtgtcctcgcgaacggcggcatatcttatc

SEQ ID NO: 11533 - DNA, 789 bp, Triticum aestivum
  Clone ID: PAT_TA_11533
gcacgaggcccctcgccgccccttcttgccctttgccctcccctcgcctcctccaccggcggaattaatccgacacgagcgaaccctcaaacacctcgccgtcaaaccctcaaccatgggaccgcatccagccaccgtcccctgctccctccggtgcggcgccgccgccgccgccgtccggcgatccgggtgggcgcgcagcgccggtttcctcgtccgcgacggcggccgtagcaacggaaccggcgtgaagctgtcctgcgtcggccctactgcctggagctacccccacaacttcgactcagactcggaacccatgccgcctggccgttggtggggggaggcgctgctcgaagaagacgccgagttttttcctcttgccgatttcatcccagtcggacagggcaggaaggagctggatgcgatatggcacgccctcgtcgccggccccctcgagtccgtccagctgaccctgcgtgagatcctggccgccggcaacctgttccgctgccgcagcttccacctcggcaccctctcaggtgctttgctggtcgttgcttgggttttccaactctgcaaaacgtcacccacccttttcgtggacattgttcttggctctgtgttctacaagctaagcgttttatccggacagttgcaaagggagggcaagtcatttagcatatgtgcacggatacagctagtccttctgcttattttgtctttcaaggataacggtgcttctcaaggcttctaccgctttcttgtggaatcaatctggttgctcaacat

SEQ ID NO: 11534 - DNA, 1419 bp, Triticum aestivum
  unsure (1)..(1419): unsure at all n locations
  Clone ID: PAT_TA_11534
cacgcgtccggtggttgggaggggctgagcacagcgcgggtcaatttgagaggttactaaaggcgtccggtgctgatgatgacggtgaccttctaatagagtcttctgtgaaaggcattccgaaggtttttgctgtatcaactttagtcagcgccatgcctgcccaaccatatatattccggaactatcagtatccacccggcactctggaggtatcaccaggaatggcagaaagtccatgtactggcgcagttggaacggttgtttctggtgcaccagttgggattaaacgtggagcttttatggggagctgcaagcatcacgtatgggaagccataagagcatcatctgcagctccatattatctggatgatttctctgatgatgtaaatcgctggcaagatggagctattgtagcgaacaatcccacgatctttgcaataagagaagcacaacttttgtggcctgatacgagaatagattgcctagtttcaatagggtgtggctcagttccaactaagagccggagaggtggatggcgctacttggacactgggcaagttttaatagaaagtgcatgctcagtggagagagtggaagaaactttggatacactgatacctatgcttcctgagatgcaatattttcgctttaatccagttgatgaccggtgtggtatggagttagatgagactgacccggctgtctggcttaagttggaggctgcaaccgaagagtacattcagaaaaatttagatgtttttaagaatgtttgtgagcttttagttccaagatatcaagaggaagagaagtcttctggaattgtcaaatccctgtcattttcaagattgagtacatcaaaatcaggtttaagtgaaagtaatcctaccttgggatggagacgtgtggttctacttgtagaggcttcatttaatcctgattttggaaagaagataaatcatactcgttcgcttgaagctttctgctctcagaatggtattaggcttactctaatgaatagcacttctggatttggaaagccaactactgcactcccaactccaatcacctctcccttgtttactgggagctttccatctagtccacttctgtatagtccagaaggcactcaacggattggtcgaattgacctagttccgccgcttagcctggatggtcacccagctatgaagtcatcaccaccaacatcgccaataaagtcatgggcaagccatctggacatgttcggtcactgtacgacaagttgcaaaaatatgcctcaaggttggggtgatacacctgggctcttcaaaaatgattcnaactgggtttcggattanttgangctggcaagaatggacgtnttttggtacgtttgcttgagccaagggggaaacttgcaanacaaggttttctngg

SEQ ID NO: 11535 - DNA, 709 bp, Triticum aestivum
  unsure (1)..(709): unsure at all n locations
  Clone ID: PAT_TA_11535
gctcgtcgacntgaaatggatgatgcgctcaagtgatgcgttgtgcgctcaagtggtcgaagcagaaggaagaaaggtcgtccatagtgtagtcttgctgaccgtggtcttatatactcagctgagcaaagcagatgaagcaaaggaagaaatggatgagtgacaagttatcaactatgtagtcttagagtcaagtgacaagtgtgtacgagtatttcacgggcatgcttttcagtagtgcgagtgagatttttattttgaccattaattagtgtgaattatgatgatcaccattgatcaattaatgtaaggggtttgttttaccgtaaacccacgcgtctgatcacgcgtccgatctgccactagatctctttctatgttttcatctgttgtatgttcctgatgcgacagataaattctacactgttgaggtctacacttttctaatcagggcacacatacctgttcttctcctgaaaaatagctgcaatttggaatagttcaagcacagaagtagtctcccaactctcaaattgttgcttgttatattaatctgcagactaccaaattggaagattttcaatcatgatatgattctgagaatggatgcatgattgcagatggctaccaaactgtaaaatgttaacattcaaaggatgtattttggactggcagtttctatgcttgattgcagctgcatgtaggtttc

SEQ ID NO: 11536 - DNA, 1627 bp, Triticum aestivum
  Clone ID: PAT_TA_11536
gcgtccctcggggtggttgccggcctgggcgcgtatccagcacgcggcgcccctcctctcctcgcctcccctccggctctctctccccctctccgcattccgtcccaccgcattccgggtatattttcccgcgctcacacgtgcgacaacccccctcgtcgcgggggggcgcggggaggcgcgcgagcgcccgcgcggccgccgcccccggcgccgctccggccgccttcctccccggtccccccgccccccgggccgccgccccgtcacccttccggcgcccctggcgtcctccgacggtagggtgcgcgccttccgggggcgcgccggcggacggtcggttagggtgcggggccgcagagggagcctgagaaacggctaccacatccaaggaaggcagcaggcgcgcaagtgccccaatcctgttgcacggagctagcgacagttcaagccaatcacgggcgcgtgtctgtccgggatttggaatgcgttcatgccggatccggtgaggaggggccattggaggagaccatccgcgtgacacgcgccaagctaaggaggcgtgcccccgccgtacttgtggtaccccacctagcaggggaccatttacatttatggaactttctttaatgctcccattttatggcatgagaatgaaattgaccgtaatttgcttgagttgagagctcgggccagcgatgttgttgtcgtttatgtccagaaggttgctccttctggacataataccttctttgatgttttgaagtatgttgcgtcctagtcaccatcccagaaatcaaagcaacaacgtcctagggaaccacagcagtcacaacagcacaaccacaacgtacagcagcagcaaccacaaaggcaagcgcagcctgttatgcacagagctgcatctattgctgcacggcaagcagcaatggcacagcaagctcaagagaccaagcccatttcccccaagttcaagcgtcaagcatcagcaaaaggtggtccagcggcatccacgaaacccgccgcggctgctgcgcccacaacaaaacccgatgagaagacaaagaaaagcgaggcgaagcctgccgccgagctagtgccggctccagccgctgaagccgttgtgccaaggcccgagcctaaggcccagccggcccctgaggccgaagtatcggacgacatggcgatcgacgaggccgacgttgctgtggagggcgccgaagaggttgatcctgcgctagaggaggacggtcatggaggagaccatccgcgtgacacgcgccaagctaaggaggcgtgccgccgccgaggcgggcgcgtgaaacctagctgcaaaccattgttttattggcgcatggtgttgttgctcctattttttgagtcttttttagattgtcatgttgtctggtggagagaatatctgttggtcatccaattggtcgttctgtttcagaagttgtcacccgttcctttcttctttcctgtggctctcgctggcctgtttatgtgcctggaagttgtaaatatcaccgggcatgtgtatatacagattgttggcatgtgctacgacctacgaatgcatctatcctactgctctcaaaaaaaaaaaaaaaaaaaaaaaaaaaaa

SEQ ID NO: 11537 - DNA, 568 bp, Triticum aestivum
  Clone ID: PAT_TA_11537
ataccccctaccccgaggcctcggctcgctcgtaatcccgacccggacgcggcggaatctcgcgccggtcaaaccctatcgcacgcgcgcgcgcgctctcacgggctcggatcgggaggactagggttcgcgagctgctgccctccggcggtctccacggcgttggcgtcggcggcggcggcggagaagagaaagagggatggaggggctcctgcacaagctcaaggggctcgacgcctaccccaaggtcaacgaggacttctacaagcgcacgctctccggcggcgtcgtcacgctcctctccgccctcgtcatgctgctcctcttcgtctcagagaccaggtcgtattattattcagcaaccgagactaagttagtggtagacacatcaagaggagaaaggctaagagtaaattttgatattaccttcccgagtattccttgcacccttctcagtgttgatacaagggacattagtggcgagcagcaccaggacattaggcatgacattgaaaagaaaagattggactcacatggtaatgtcattgaatcaagaaaagaaggcatt

SEQ ID NO: 11538 - DNA, 1723 bp, Triticum aestivum
  Clone ID: PAT_TA_11538
ccgacccgaacccggcggaatctcgcgccggtcaaaccctatcgcacgcgcgcgcgcgccccagccgctcacggatcgggaggattagggctcgcgagctgctggccaccggcggtctccgcggcggccgcccgcgagcggaatccagggggtgggcctcctgcgcagtctcagggggcaagagggatgccacagagtcaacgagagcttccaccaccggacgctcacccccggcgtctacaggacgatcaccggcctccgctccccgcccccgttgttcggcgacaccccgtcgtcataatgctcctcatcaaggactcagagattggcacgtacagataaaacctaagcgatattatccaagttgtatagttgttaagggggtagatcctgcatatgcgtgccaatagacgactagaccctaaagggtgagcaggcccccgacattaatcatgctacacaaaagttgaggaaaacctgaaaagaaggtatcaataatagaagaaaagatgggggcaagtgatttaatgtccaatcaatagagaaaaaacatgattggaggcatggcgaacgagaggaatattgtggcacctttgatggagcggaggagtcagctggacaatggtgtcactcatgtgaagaaattagggaggcctacaagaagaaagggtgggctcttacaaaccctgacctaatcgaccagtgcgctagagaggacttcgttgaaagagttaaaacccaacatggtgaaggctgtagtgtccatggctttctagatgttagtaaagttgctggaaatttccactttgcaccaggcaaaggatattatgaatcaaatgtagatgtgcctgagctgactgctgaaggaggtttcaatattactcacaaaataaacaaactgtccttcgggacagaattccctggtgctgtcaacccgcttgatggtgctcagtggacacagcccgcatcagatgggacataccaatacttcataaaagtcgtccctacaatttataatgatataagagggcgcaagatcgattcaaaccaattctcagtaacggagcactttagagatggaaatgttcaaccgagaccccaacctggggtatttttcttctatgacttctcacctataaaggtgatattcacagaggaaaatagatccttcctccactacctgacaaacctgtgtgctatagttggagggatcttcaccgtcgctggcatcatcgactcgttcatataccatggacagaaggcacttaagaagaaaatggagataggcaagtacagatgaaaccacccaatattttccaagttctgtggcttgtaaggaggtggatccggcatatgcgcgccaaaagacgacaagaccccaaagggttacaaggcaatcgaaagtgatgatactgcacattagttgatgaaaacttgtaaaaaaggaaagacagaataggctgggtcttgggggcaagtgctttcatgtccattgatagagactctagttgactggcctgaactggcgcaatgcttactgtacttggaagttgttggtgcatcacagaatgttctcgtcaatcgcttcactcattgtgtgtcacatcttcgttactgtgggttgtgttgattttgttttattttgcactttagcgttttggcagagatatatactagttgacttgagctcttacgaaattatatttgtaattcaaaaaaaaaa

SEQ ID NO: 11539 - DNA, 1209 bp, Triticum aestivum
  Clone ID: PAT_TA_11539
cgtccgcccacgcgtccggccgatccaggctcatggatgcggcgtgctgtatgatgagaggaccgagacctacttatggtacggggagaacaaggatgggaagacctacaaagctcacagcaagggtgctgatcgagttgacatcgttggagtgagttgctattcttccaaggacctgtgggcatggaaaaatgaaggagtcgtgctccgtggcgagaaaaagaatgtgacacatgacctccacgtatccaacgtcctggagaggccgaaggtgatctacaacgatcggaccggcaagtacgtgatgtggatgcacatagatgatgctaactacaccaaggcgtctgtcggcgtggcggtcagcgactcccccacaggcccgttcttcctacctctacagcaagcgcccacatgactgcgagagcagagacatgaccattttcaaggatgacaacgggaaggcctacctgatatactcatccgaggacaacagcgagctccacatcggccagctgaccgacgactacctcgacctgaccgacgacatgaggaggtttctcatcgcgcagcaccgggaagcgccggccctcggcaagtttgacggcaccgactacatgataaccgcagggtgcacgggggtgggcgccccacacggcgctggctcacgccgcgacgtcggtcatggggccctgggagacgctggggagcccctgcgtgggagggaacgaaatattccggtcgacgacgttcttctcccagagcacattcgtgctgccactcccaggcctgagaggttcattcatcttcatggccgaccggtggaacccttcggacctgcgggactcgcggtacgtgtggctgccgctgacggtgggtggcgtgccggatgaggccgcggactacagcttcatgttcccgctctggtcccgggtgtcgatttactggcaccggcggtggcggctccccgaggggtggacagattcttgaaaatttgaaagtttaagttgctatacgtttgttacacatgatagatacgggtttattgacattcgacacacagtggagggtgtgtgttgtataggtcagatgtagaggctagcagagttgtaaatgtgcagttttgagtttgttctcaagtcacataaatatacctgtgtcccttgtgtgaataatgtggctacaccttcagtctaaaaaaaaaaaaaaaaa

SEQ ID NO: 11540 - DNA, 831 bp, Triticum aestivum
  unsure (1)..(831): unsure at all n locations
  Clone ID: PAT_TA_11540
tttgttctgaaattccatgggctggtttatttaccgctggcttgctgatggatggccactgcagcatgatcagacgccaagccatatggctgggtatgctggtgtaccaaggttctatccaacatgttattcacgggcgcagcatactgagtcagcgaatttactgagatcgccgactgagattgtaaagacggggcgttactttggatgtgtgccggcaaggncagaaactgaagtatagggttgtgaaggcaacggactaacaacatttgagaagctttggtgcacttcgcttgcaaaaggtgtgtttccattatttggtagctgcgcctgctgcgagtttggggccctcgcatgcgtcggaaaatcagatctccagcccacacttgctggaagatcttttggaggagtcggtgatggaagtgaagtagggatagtttcagggacgggttcaggcttgtttggaaccccagcaccgttgggcagactattgaccagctccgaaagtccaaggccagtctgcttcagcatgtcaaggagcacgacggtctgctcggttggcaggttccccacctcgttagatgatagagcaaatacaagctgtggattcttgagcagcactgcaagcagctcaagatctggctcagaagctgcaccatttgcaccagcactgactgtcagagatgatgacgaggttgatccaacttgctggatctcaccaggaacaaccatgtttggaggggcagctccgacgccatccacctccatagtgtcagcatctggtggctgctcaattggaatttctggggtcaggctgtcgtcaaagtccat

SEQ ID NO: 11541 - DNA, 752 bp, Triticum aestivum
  Clone ID: PAT_TA_11541
tttttttttttttttgttactacatacggatacggtatcaccacacacggacggattcagatacagaagtggacatcaattcaaatcaaagaaagaaaaagatacataggtggacatttatttactacgtagacataagcatggctgcgcccatcacagaaagggaaggggaacggcagatgaagaactcagaagggaaccggcgagacttggatgagagttggctcatagtgatgaggggcctcgaaaccatggaggttgatgactgtcgccgcaacgttggcaagcccggcatccggaaggtcctcccggaatgtagcccctggcgcaagccctggacctccgatggcgatggggactggattcagtgtgtgtgaggtaaggggctgcacattcccgtctttgtcgcgaattggtttcccggatttgtctcttttcaccatgtcctcggcattgccgtggtctgcggtgaccacgaagatgccacctacttgttcaatggcgtcaagaataatcttgacggcttcatcagcggccttgcacccaacgatggtggcttcaaggtcacctgtgtgcccaaccatgtctgcattcgggatgtttacccgtacctgatcaaatttgccactgaggatggcatcccgtgccttctctgcaacttccacggccttcattcttggctgtacattgaagggtatgccggtgtcacttggaatttcttcgtatctttccaggtttgggttgaagtagcc

SEQ ID NO: 11542 - DNA, 678 bp, Triticum aestivum
  Clone ID: PAT_TA_11542
cgtccggtttgttcttccctagcctaggtagagtaaggaggtttttattccccagttaaggaatgtgtgtttggcaaaaaaaaatcccttaatttcagactgtttttctatctcttgcgagtttaattattgttcaggtgatctttttttacctggggaaaactcagattcatggatgacctttccctgtacggtcgaagggggttgtttgagcccaacgttagtgttaaaaatcacctcatctccactggcgaacccagccgcaacgcatccttcacatcactgatggtgtatcattctccagtgtctcaacatagtctgccttttagttatccaacgtcgatgttatatcattcaaactcaaagttcagcttgcaagctcttatgtttttatctaaccagtgttttgtttcaaatgctttgccttaattcagacctttgattctacgatcatatattggagttagtctttgttagtttttattgtaatactgctcggatggttgacacctttctttatgggcatgataaatgttctttaatcttttgttctggtcgtcctgtttgagtggtaaattattcttaaggtttgtaagaacaaatttatatattatgtatccattgcaatgcatgggttcttacctacatattaaaaaaaaaaaaaaaaaaaaaaaaaaa

SEQ ID NO: 11543 - DNA, 952 bp, Triticum aestivum
  Clone ID: PAT_TA_11543
cgtccgatgcaatggagtcactctaccatactctgcttaccaaggaacggaaaagcaatgatgaattgcaagatgctcggaagaagctgatagatggtttacagactattacaactggtctagcaaatattggcattaaaagaatgggcgaacttgatcttaaatcacttgcaattgtttgcggacgtaaattttcaaaagaagatgcagaagtgactgctgccattctttgttcgaagtgggaggctgatatcagaaaaccagaatggcacccttttagggttgtcatggttaatgggaaaaaaaaggagcttatctctgaggatgatgcgaagcttcaggctctaagagaagagtatggcgaagaagtctattctctggtgacaaaggcgctgcttgaagttaacgagtacaacccccgtggccgctatgccgtaccggagctgtggaactacaaggagggccgcaaagcaacactgaaagaggccttgcagtacgtcctgaaacagtggcggacacacaagaggaagcgatgaactactaccactggcctatacatacatgaacttgctgtttatttagcatttactagtacacgttagataagagctgtacgtgtggctctcaatggtgagacttctagaatgttcaactgtcgcagtcgtttacttgtccgagtttagctgggattatgaaacgtgcggagattccgttttccagggtttcaggtcaggtgtaagtaaatgatgcctgaaaatgttgtgcaggagacaaaagattccggaacactgctccagttccaaatccacgatgatgaattgctaccatactatcaaataagtctgtagattgaattgctggtgcctcttgctttgattttgaattgagttgcgttaaaaggcatgtactacctttcggcgaataaacttgttgtatatatacttgtaagtca

SEQ ID NO: 11544 - DNA, 512 bp, Triticum aestivum
  unsure (1)..(512): unsure at all n locations
  Clone ID: PAT_TA_11544
gccgaaccccccgaacgtccggccccatccacgccgcggcgtctccccagctctgaggcccgaccctccatggcctcctccaaccccagctccggcgccaccgccgccgacgacctcgaccagctcctcgacagcgccctcgatgacttcaccagcctcgatctcgccgccgcccccaaaagcagcggcgaggcatcggcatcgtcgtcgtccgggagcgcgaggccggtgaagggtctggggatgtcgctgcctgaccccagggcgccaaggaggcgggcggcgaagcaacccccgccgccgccgaggggcgcgcacgcgtcggaggcgctcgagaagctgacgcgcgagacgcgggaggcggcccggggcctcgagacggcaaccggggggatcgcaagcctggatgacgaggcgatgatggattgctaactttcgcagattcgctgggccaagatatggatcatgttgaaacaatgatgaacaattcttcaagggatcttncnaaccaa

SEQ ID NO: 11545 - DNA, 902 bp, Triticum aestivum
  Clone ID: PAT_TA_11545
cgtccgtttcttcctcctctgactctcctccccctcctttccccacccgtatcaccgccctgccgagccgagccgggctgactccaactccggcccccccgccgcgcaagcaccaccacggagaattattatataccgcctaatatttccaaagaggttacaaaaggattcggtgtggaaggacttataggaagggggtgctaggtagacgtttccgagggagcttgctagcggatataccatgcctccaagttgcttcatgccgatacggtgctaggacttgatgaccaacaatatatcaatgaagttggtaaccctttgaaggttaagcatccaaatatcgtacagttacttggctattggtatgaaatacagaatgaactaattgaacacaatggtgctaggccatgttgccagcccatatatcgtcctcggcggtgacctcttgcagggtgggcgcccagacatgcttctgtgtcctcgttcttgcgctcctattcggagcgcacttttcgatctcattggggcgatccgtgttgcccgacacgtccttcgcgtccgctacccccagttctggcagcgtggttgcctgcccacccatctttgtctagactcttccgcgccgccttggggcgcgcgtttcggattgtaaaggctattcactccatcacacacacatatcacacaaagaatcataggaacccggaagtacatgccaccagaattccttaatgaaggcaaaatctcacctaagaatgacgtcttcggtttcggtgttgtaatgatcgagataatggcaggacctgcaggttactccaattcttttgaaatgcatgatgtggcacaattaatgcagcaggtaagaaaaaatattgtcagttttggcactcgagttcatataa

SEQ ID NO: 11546 - DNA, 809 bp, Triticum aestivum
  unsure (1)..(809): unsure at all n locations
  Clone ID: PAT_TA_11546
gggtcgacggggtaagttcgcgttattcgtgagaaaatgaaaacatcccaatctcgtcaaaagggccaatatgaccgcaaacataagctcatgacttatgaagtcggcgagaaggattaccttcgggttactcctttaaagggaacccatcgtttcggtatcaaaggcaagttggctcctcgttacattggaccctttcgcattcttgccaaacgaggagaagttgcctaccaattggaactacctccgcatctttccagagttcacgatgtcttccacgtttctcaactccgacgttgcttcgctgagactatccatggggtggaccacgaaacacttgatctccaagataatctcacatcccgggaatatcccgttcgaatcaaattggctcctcgttacattggacctttccacattatcaagtaacgaggagaggttgcctaccacttggaactacccccacatctttccgaagggcacgatcgcctccgccttgcgcaccccacccgctgcccctcggatctttccgcgcggggcgccacgcttcgctgggtcgctgggtggcctcacccttgctgggtcccccatcggagcgcggcatcccgtcgctctcccacgtccttatactggggccgactgcaccccgccccccccggatgaccactggggtggacgtagtctcgccccgggggcccctgccatgcccttcttgatctcatccccctgccgcgctttgaaccctgccggaatcctgcgcacctccaagccacacaagatnatgaataaacatacttactgcattgggn

SEQ ID NO: 11547 - DNA, 1087 bp, Triticum aestivum
  Clone ID: PAT_TA_11547
cgccgtcccaccaacccgcccgccccccgcattccatttcccttccgcttcgcgattcgatccctcccagacgcaggcccagacccggcgcggcggcctgatcacgcgcgcggccatgggcacgacgccggggagcagctacgactgctccttcaaggtgctgctcatcggcgactccgccgtcggcaagagcagcctcctcgtcagcttcgtctccgccgcccccaccgacgacgacatctcccccaccataggggtggactttaaaatcaagtttctcactgttggtgataagaaattgaagttgacaatatgggacaccgctggccaggagaggtttaggacaatcactagttcttactacagaggtgctcatggaattatcttagtttatgatgtcacaaagagacaaagtttcacaaatttggctgatgtatgggccaaggaaatagaattgcactcaacaaacaaagagtgcgtcaaaatgcttgttggaaacaaagtggacaaggatgaggacagaatggtaacaacagaagaaggtcttgcctttgcacagcagtgtggatgcctttttctcgagagcagtgccaaaacaagagaaaatgtggagaaatgttttgaagagcttgcgctaaagattcttgaggttccaagtctgtcggaggaaggctcgtcggtcgtcaagaggaactcgctgaaacagaagcatgagaagagcggtgggtgctgtcagtagatccgatccagtcactgtatgcaaccaactagatcctgcgatcggtgcctaggctaggttgttttggtgttctgatgtaaatgagttgtatctaagtgctcatcggtgcgagtaaagggaggaataacaacttgaggttttggtgtgatgcgaagggtgggcggggaattagttgacctgtacaaaaaagaaaagaagccgctgttttctaactcagcttgatctggtttgctgattgtaatgaggtcgagtggctcggcgagctgatccgcttccttccacactggtgtggcgtgcgtgggagtgtactgctggtacataattcaggggtgttttctggtttccact

SEQ ID NO: 11548 - DNA, 1058 bp, Triticum aestivum
  Clone ID: PAT_TA_11548
cgtccgcggacgcgtgggctcgtttgcccatcggtagcgaaaccctagaatcgaatcgaaccgaggcgaggcagaaggcagaggcggcggcggagacgagcggagaggaaatcgaggataaggcgaaggaagaggcaatcatgtccctccggcggaccgtcggtctcgtcctctcacggaggttctcgccgcgggtgatccgaagggcggctcctgcacgctctttccacaccttgaaggaactccctgtaggtgatggccttcgtggtgctgctggtgtggccgcggctgcgattgccggtgttggagcctgggcagttcagtatttcaggaaaggcccagatgatgacgagtcagctgctcgcaagaaagaggaggacatgaaggcgaggttcgaggattggatgaaggagtacaacaagacataccgcgacgaggaagagaaggctatgcggttccaagtgttcaaggacaccgtcaagtcgattgaatcgttgcccccatctacccagaagaagttgcttccacctaatggttttgcagacttaacaagcaaggaactcccgtgcatcgagccctgtatcgatgatgatttagatgatatagacggcgaagagtaccgccagaacaagttccttgccgagaatgagaacggagaagaagtcgtatggtagccagaatggaagccagccgtgaacaatcaggcaactcaagtctctgcctagaaacaatatccggtgcaaatcaggtggctggtgtagttaaaattaaataacttggggcactgctttaagtttggtgctatgttaatctgaaccatgtgtggcttgtgtagttaaattaagcagcttgggcactgctttaagtttggtgctatgttaacctgaaccatgtgtggctggtgtagttaaattacgtagcttgggcattgccgtatgttaatctgaaccatgtgtggctggtgtagttaaattaagtagcttgggcattgccgttaagtttactgctatgttaacctgaatcatgtgatgccctgtagcttggatgcgttttaagtt

SEQ ID NO: 11549 - DNA, 1494 bp, Triticum aestivum
  Clone ID: PAT_TA_11549
gacccccacgcgagggaggatgtgaagattcttaaggcccttgatggccatgagaacattgttcacttcggatggccattccgggacgattgatatttttgtatcaacttggcactttgataaggtggctaaccatgggaccgaattttggcacaaaaaaagacacgctgtagtgagaaagacgctgcagtattggtgcggcaaatgctcaaagtgtctgctgagtgtcaacagcgtcggttagtccatcgagatatgaagcctgagaacttcctttacaaaccaaccaaggaggactagcctgtgaaggcaacgcaagttcctacgtaccgcgagcatgaacaagcggacaagcccgtccgtatttctgaatctgccggctctgttgcaaccgactaggtgagtcgatggtgtgagatggtgttgagcacaggagtctgttgatttcttcttctttcgtgctgttttccgcggtccgtgcgttgggagggtttcggatttgtcagcatccaggttctgtgtgcagtcattgtttgggtacacaagtttccaggtaaatgtttacggtcttgcgtggaaggcgcagtttacagttaattgctgcacaaacctcgcccgctgttgcccgcagctcaagctctctcacatccatgggtgagagaaggaggagatgcatctgagatccctgtcgatatatctgtgttgcgcaacatgcgccaagctgtcaagtacagccgttttaagcaatttgcgctgcgggccttagcaagtacagtcaatgaggaagagctagcggatctaaaggaccaattcgatgctattgatgttgataaaagtggatcaattagcattgaagaaatgcggcatgcccttgcgaaggatcttcctggagattgaagggccctcgtgttctcgagatcattcaagcaatcgacagcaacacggatggccttgtcgacttcaaagagtttgttgcggcaactctccacatacatcagatggctgagctggactctgaaaggtggggcctccgctgccaagctgctttcagcaaatttgatctggatggggatgggtacatcacccccgatgaacttagaatgcacacgggcttaaagggatccatcgagccattgctggaggaggccgacatagacaaggacgggcggataagcctgtccgagttccgcaagctcctacgaaccgcgagcatgagcaacctgccgagcccgtccggagttccgaatccccaggctctgtgacaatcggctaggagcatctagggggaaggagcacagtagtctgtttatttcttcttctttcgtgctgttttccgcgttccgtgcgacgtgagggtttgtgatttgttagcatccaggttctgtgtgcagtcattgtatggatagataagtttcaaggtaaatatttacggagttgagtggaaggcccagattacagcttctttcttgtacagctttttccccattttatgga

SEQ ID NO: 11550 - DNA, 1151 bp, Triticum aestivum
  Clone ID: PAT_TA_11550
tcgacccacgcgtccgcccacgcgtccgcgcagctatgcgtttacaaggagaaattcaacgcatcaaatctcagaaggttcaacttcaacaaaagatcaaacaagaatccgagcaatttagatcttggaaagcggctcgtgattcggcacggctccagctgaagaaggaagggagacggaatgaatatgagatgcataaactcctggctttaaatcagaagcagaaaatggttttacagcggaaaactgaagaagctacgatggccacgaaaagactgaaagatttgctcgaagcaaagaagtccacccgtgatgctcatggaacaggcgcatcagggattcaggccttgatgcgaacgattgacgatgaacttgaagtaactgtaagggcgtatgaattacgttcacactatgaccgacaaatacaagagagagcaacaatatctaaggaaatagcaaagctgaaggagtgtcccgaggctatgtctcctagcgctaggagttccagaatatcagcactggaaaacatgctgtcatcatcatctagtgctatggtatcaatggcttctcaactgtctgaagcggaggagcgggagcgtgtgttcaatggtagaggcagatgcgaccatgtaaggtccctgcctgatgcaaagaacacaatgaattacctttttcagttagcatcatcttcaaggtgccaactacatgataaggaggtgatgtgtatagagaaggatctcatcattggagaactgaaagaaaaggtggttgcgcttaatggcagaactagacagttagaagcacaagttaatgatctacataaccaaaatatgcagcttttcgctgcaatgaacaatgcgaagaaatctggtagggcctcaaggcgtgatactactattgatccagaagatggtcaaatttatgctttgcggaagagtgctcgaggttctcaatcccagcatggtaagagcagcttctactggtcggatgacatggacatatcagatgctgatgagtcgggagaattagaagatatgagtcatgatggatctgatacagactgggtagagtcatccaggaaaatcaataatacacggcggcgaacatctaacccgagtagaaacaattcacttacagatgtgaagtcagag

SEQ ID NO: 11551 - DNA, 476 bp, Triticum aestivum
  Clone ID: PAT_TA_11551
gtaccggtctcttatttcccgggggacgccacgcctccgctcaagttttagttttctctctttttactagttcggaaactttgccttcctaaattgcaggaaagtcatcaatataatgtatctacaaggaaggtggtgcctccactcatcttgttgtctcatgctgctacaagcttgccaccataagacttgtcaaggtccaatggggacgtgccactcaataatatgggatgggtcctaggctgccgcaccttttgccatggcccaccccatgacaggcagcagcaaagggtgcctttccagagcaaggtggctgagatgggtgttcatgcgcccatccatcactggcctcaacaaattttatcaagcttgggccgccgcaccattttgccatggtgcagcccatgacaggcagcagccataaaggacgcctcttcagaagagcaggtgtttgagatgggtgcccatgcgcccat

SEQ ID NO: 11552 - DNA, 1545 bp, Triticum aestivum
  unsure (1)..(1545): unsure at all n locations
  Clone ID: PAT_TA_11552
gaaaaatgctgacttgtgatgacgcgatgattttgagaatgaaggaacgcgtaaaaataataaacttgtagctaatttagctaaccaaattgaggtaaagtataagtatttacaggagcttgaacttagatactgtgagacaactgtgtcacttgagaggatgttggcgcaaagggaacaacgtctccaggcatataatgaagaaattacgaaaggacagcagcttggagcccaaacttccgaaaagatcatcgccctcctgcaaaatccgcgttcagaactggagtcgaagatgagtgatctaaattcaggatccaattagctccatgaccttacgactacgactgctcataattaaccctctcttgagcgggcgaagccgggggctcctccgcggtcgcgcccgctctagttcgcgtcggccccccggccggcagctgttcggcacctggtgaagcttgtgagagatcagaagagagagaaagttgctgctttaaacaagatcctggagttagaacagcagttggaagcaaaacagacgcttgaattggaaatacagcagctgaagggcaaattggaagtgatgaagcatatgccaggtcatgaagattcagtctcgaaggataaaatcaatgaacttagtgaggagctgcaagataagatggatgaactggatgctatggagtcacttaaccaaactctggttattaaagaaagcaaaagcaatactgagatgcaagaagctcggaaggagctggaaaatggcttgcttaatctttcaggtggccgagcacatatagggatcaagagaatgggcgagcttgatctgaaagcagtttcaaatgttctcggacagaagttgtcgaaagaggatgcagaagttactgctgccattctttgttcaaagtgggaagctgaaattaagaatccagaatggcacccttttagggctgtcatggttgatggaaaggaaatggaaagaatcaatgctgacgacgcaaagcttcgagaattaaaagacgagcatggcgaagaaatatattcgttggtgaccaaggcgctgcgtgagtacaatgctaacagcaccaggtatcccgtaggagagctgtggaacttcagggaagaacgcaaggcgtctctcaaggaagctgtccaggtggtcctgagacagtggcgagccaacaggaggaagcgttgattgagcccaatcaatgtcgcttctttcctcctggtctggacagcagcatcattgttgtcgtttgattgataaatctctagtgaccatctaccccatgttggacacaaatcgaataatgaataatgaatagtcctgttgttgcagtagtagtatcattagtgaagtctctgtcgatccatctgtgtaaacaagcttgaataaagacttgcagtagtatcagcacctgcaagcacgccatcggcccgatcatcggcgtctgttggtaagcgccgctgtatgctttcttgtcttaagttgctgatagtaattcagaggagtgtttgtttgttgtctaannnnaaaannnn

SEQ ID NO: 11553 - DNA, 1621 bp, Triticum aestivum
  Clone ID: PAT_TA_11553
tccgggcacgcgcccagcagcagcagcaggtgagggtgccggatcttgcccaggacctccagctcctgctgtaactgctgagttccaaaaccttcaagggagttcaaaactttcactgctgcaactgtatgctgaaacttagccttgtagacggtcccatatgttcccttaccgatcacaagatcgcttgaaaatgatgaagtcgctgcctggatatgctcccatgagtacctattatactctgtaagacatcgcccagtatttttccgtcctgtttcgaggtcactagaattttggtgatcaccattactgtcctgttcagaagagctttgtttaggctgagcttctctttcggccacctgctcttcttctctttccatttgtcttaccaatctcttcaccatctcttctgtcaggtcaatctctctaagcttaattccgtcctcgacacgccggatgcccaagtcgttgggtaatttctgagtggagtcaaccggctcattctgagaaacatcatgaagattctgaagatgacgcagtttgaccttcatactctcaatttgaagcttcagatcatcctggtcatgagaatgcttcaggtctgttgcagtttctgaaactgctgcctgcagatcagagatatctcggaagctatctcctcggaagctcctgtaaactgaatccccactgctgctgctgctactgagctgcgctactgatgtgattgagtgtgaatttgtcttcagggttgtatcagcatggtaagagatctcgctgccagcactgcctgaaggggtagctcccctgctggccgacctgtttatatttgcgagtgcgtgatcacgctgcgatgacagagatgactggcggaataatacagctgctgttccatttctgtcatcccactctgagggcgcactggaaaggcttttggagctaggagaagaaacggttgaagaagatatggtcttgggtgtttcgcaggcatcagatgtagccgagcgcacgaatgacagtttgccctttgagacgacgtatgccgtacagaagcttggaatgcattcggagattttggttgcagtcttgcttcctttcggacgcgtggggaatatgcttctcgacgaagagcccaggaccagcttgccaatgttgaatttgtcgatttcctcgcttatagcagcaggcacatcgtcagattcaagtaaaacagcttcagcttccacctgtctctgagcacacatcttcttgtatgggagcaacatattccttgcttgccattccagctcttccctgtacgctgatgttacgtcgtcgcgcacttgcgagaccgggaggtaattgcccatgggagtgggcaccatggtgatgggcgggcggacgtgcaggatccggaagaggaccctcccgccgggcacgaacttgtcgagggcccacttgagcgcgtgcctgctgctcctgctcccgctcaccgcgatggccaccgtgctcacgccgggcgcctccatctccggcgccgtctcgccggagtcctcctcctcgatctccatcgacatccgccctcccctctgtatctgtttcttcccctctcctcctaatcaatcaatcaatcaatcactgcccc

SEQ ID NO: 11554 - DNA, 420 bp, Triticum aestivum
  Clone ID: PAT_TA_11554
tcaccgggcaaccccacgcgccccccgatcataagggcacagaagaaggatcaggacagggaagctaagaaagccgagggagaagcagctaagaatggcaaagctgcggtcgctgcataagtcaccttcgctgcaaagatgattcgcgccactacggatctacccaatgcactttctgaatgatgacctgtgtctctcttttctctttgacacgtagtctttcgtgttgaattttcgtagacagggtgcactagaatcttatcaagctttgttaaggcagcaagattgctgagaagcctgttgagttgagttgagaggcgctaaacctggaaacgctcaactcctcattctgaatttccttttcgatcctaaacttgtcagtgtaattttgtattgcaaataaaactcagtgcattatgc

SEQ ID NO: 11555 - DNA, 1274 bp, Triticum aestivum
  Clone ID: PAT_TA_11555
cgtccgggacctccccgaccccgccgcggccgccgacgacgacgacgacgacgctatcgcgggccccgcgcttgcgctctccgtccgctccgagttcggcaccgccgcagcaaaatccacgtcggagcttggcccgagccccgcccccgccaccaggccttctctcccgcttcctctcctcctcctcccagaaggccccgccggctgcctcccctccctcgtcctccgcacccgtccctgcgcccggatcccctgcaccgccggcctacaccggaaacctgaagaaagcactcgcagggttgaggagaattgatttagaagggttgcggtggcgtgtttttgatgcaaagggccaggtacttggacggttggcatcccaaatagctgttgtgcttcaaggcaaggacaagccaacctatgcacctcatgtggaagctggagacatgtgtattgtgcttaatgcaaaaaatatctgtattgctggaagagcaataactgtcaaaatttactactggcatacagggtatattggccatctaacgaatagaaagctcaaggaccggattgcaaaacactctactgaagtaatccgtaaagctgtcatgcgcatgcttccccgcaataaattgcgtgatgacagggatcgtaagctgaggactatttgctgaaggcgagcatccgtttcacgaccggcctcgcgagtctttcatgatgacgctccactacgcgcgtgagatgtgccccctttcgtcacgccccaacgtcaaggccctgaagtgcgccccgggcacgaaacccgaaatgatcgagggagaagcagctaagaatggcaaagctgccgtcgccgcataagtcacattcacatgcgtgtggaccatggagaccgatggatgattcgcgcccctacgggtgtgccctatggagaccgatggatgattcgcgccgctatggatctacctgatgcactttctgaatgatgacctgtgtgtctcttttctcttttgacatgtagtctttcgtgttgaatttcgtagacagggcgcacgacaatcttatcaagctttgttaaggcagcaagatagattgctgagatgcctgttcagttgagttgagttgagaggcactaaacctggaaacgctcaactcctcattctgaatttccttttcgatcctaaacctgtaactggaattttgtgttgcaaataaaactcgatgcattatgcagaaccgcgtgccgcaaaaaaaaaagaaaaaaaaaaaaaataaaaaaaaaa

SEQ ID NO: 11556 - DNA, 477 bp, Triticum aestivum
  unsure (1)..(477): unsure at all n locations
  Clone ID: PAT_TA_11556
tttttttnttggttgctggcaaaaccgaaaacaggggacttatttttagtgtatgctttgtacacagtagcttattcttgatnctatcattgacacaagggagtacagtaaggaagaaactaggtgcagaaattgatagacaatagaccaagnaaacaaggtccagaaactgagagaccacagaccacggtcaggtaacctactaacctttgctaaactgtctgaaactccacacctgctcacagcgcctctatgaaagaattggcgcccagatcctcagatttgccactatgaactacgaacaacttcattacttcattttacgcgtagttttggtcaggtactggaacttcaaaagatcaagctactgcgctctgctgtcctaagacctctgtccactcagccggccaccagtctggcttaatcgccttgaccctcacatcttggttgtcgctgatggtaaggatagcgttttcc

SEQ ID NO: 11557 - DNA, 716 bp, Triticum aestivum
  Clone ID: PAT_TA_11557
gacactgtgaagctgataattctctcaaattagttcactcccttaacttacagtaaacacctcaggcaggccgctaaacataatacactgtaatgatagctaaaaattcagagtaaaaaaggaaagagaggaaaagagcgtctctccccctaggtacattccggcggcattacaagaagaccgacggcgaggggttgacgacgatgtgcctgagcgggttcgtgacgtcgccgccgccggcgtgcttcacgaactccgccggcgtgaggaagttgccgtggcaaacgcacactatcctcacctcctcccctttcctgtacttgtacaggaaagccgtcgatcttcttgccgttggggccgtccaccttggacgagaccatccggcatgtcctccatcatgcccttccgcaggtcgccggtgctcgtcgtgcgcatcgtcagcgaccggagggtccgcaacggcggttgctccttgacgatgccgttcggcagcttcccggccgccggagatggtgccggcggcgggagggatttgttctggttgctggcattgttattattatcggaagatatctccatgcttcgatgtgctcttcacctcagcgccatcaccgctaccttgctcgggcatgcttgagggaggggttcccctggtcgacgacggagcggcggagctggaacgcgctggggtagagcggctctggggcgtcgtcccg

SEQ ID NO: 11558 - DNA, 929 bp, Triticum aestivum
  Clone ID: PAT_TA_11558
cgtctctgtcgccctggccggtcctgtccgttagcctttccgcaacaccagcttcttataacacgccggcgcgccgcactccctaccgatttgacctgggcgacaccatcccccagcgcctctgccacggtgccgacgccgacatcctccgccggactcctgagcgctaactccgcccggcctgaccgatgcgcccccggcgcgctccacgcgcctcctctggccgacgtccgccccaccgcctccgccccaccgagccatcgctgtcccataccatgatcgcctcccgcgagagcgacaccccgagtacgcctccgtagctctacgccaagtggccctcaccgtttcttttgtgtcctccagttcactatgcagcacgttgcggttgtggggcccgatgcggcgagatcattggatctaggagatggactaacagcccgggcgtaatgatggataaggatgacacaaaaactacagatcaagttgcttgtgacacaaaatttgcgccttcactcctaacccttccactgtgcaattaagcttaatctcaagtgaatggtgagacagaaggagccaggttggaggtttgggatcggatgcgccaataacaagggaccaaggtgctctactaacggcacgggcagaatgattcttcatgtaccaacatagtcgccgactagagaattaagttaactgtttgatttacttgaagctccatattgtagttattttattcattcactaatttggtataatcctactctaggaggattatcactgtatgatatgagatcatgacgtttagcaatgataaaactctgacattggatggttcttttctgaagtacagttgtaagatctatgattctagcttcgacctttaactggacagtactaattggacatataattgataaattatgcccaag

SEQ ID NO: 11559 - DNA, 642 bp, Triticum aestivum
  Clone ID: PAT_TA_11559
caggccaagatttcttgtattagaatctaaagtgtcagaattgtggcactagtgaaaagatcgctccgccaatgcatcgtggtccagatggtccaaggactttgtgcaatgattgtggacttatgtgggcccacgcgtccgccctgagaagttgctccaaggcaaaagttgaagctcctatgcttgcaattgagcagtgcaacgctgctgtcgcccagtgtcagaccggaaccgatgtcaaagcactgccagctccaaacaactacgacgtcgctccaagcaacggcgaagccatggataacagtgtgactgcaaacgcaactgctgctgcgatggaaggagcgccgaaagcgcagtcagaataatttacatcagcatttgatcatcgaacccaaaagaccccgaattcatcttgtgtagccaaaattcacgaaacacaggatccgctaatcaggaatactgattgtcatcaagtgtacatcaaaatactgattgccagcgccagatatgtacgtaattaacataagagcgtctgatcgaatcgccgcgatgttggcattccaggtgttacattcggttgccctttgcgagcagcgcatttgcataatcccattgatcgatcgttttacgatcttggtcttt

SEQ ID NO: 11560 - DNA, 1285 bp, Triticum aestivum
  unsure (1)..(1285): unsure at all n locations
  Clone ID: PAT_TA_11560
gcggccccgcgcccccgttccggggcccccgtgcccgtggccgccgccccgccccgccgcgcccacgcgtccgtccccatctagggttgcgtgagccccgccaccaccggccatgcccgacccggcctccgcccaggggcccgacgccgagatgcgcgacgccgccgcggcagccggcgacgaggacgacgcggaggaggaagaggaggaggacgatgagttggaagaggaggaggaggaggaggaggaggagctgccacctgccgaggagccgccgtcgccggcggccccagaaccggtctcggcctttcccgggaacccgaaccagctgacgctgctgttccagggcgaggtctacgtcttcgagtccgtcacccctgactaggttcaagctgtcctgttactgttaggaactggtgaaattccacccggtctatctgccatggttttacccagtcaacgtgaaaataggggtctatgaggatttacgttcagaggacagacattcctgcaaaaagggttgcttcgctcatcaggttccgcgaaaaacgcaaggggagaaattttgataagcaaatacgctatgcggtacgcaaagaagtggcacacaggatgcagcgtcggaaggggcaatttgttggaagagcaaatttggagggggaatccccttctccaggctgtgatcctgcctcccagggctcaggccaagatttcctgtctcgagaatcaaagtgtcagaattgtggcactagtgaaaagatgacaccggcaatgcgtcgtggtccagctggtccaaggactttgtgcaacgcttgtggactgatgtgggccaacaagggcacactgagaagttgctccaaggcaaaagttgaagctcctatgcctgcaattgagcagtgcaacgccgctgtcgcccagtgtcagactggaaccgatgtcaaagcactgccagctccgaacaactacgacgtcgctccaagcaagggcgaagccatggataacagtgtgactgcgaacgcgactgctgctgcgacaggaggagcgccgaaagcgcagtcagtataagttacatcggcatttgatcatcgtgcccaaaagaccccgaattcatctcgtgtagccaatcctcgcaacgctgcgccgctctcggattccgattgccttctggtcttcatctacgttcgcatccccggcgccacttatgtacgtgactctcatcagtccctctgttcgacccggtgttgccgctccaggcgcgtttacataatcacatnatcattttacc

SEQ ID NO: 11561 - DNA, 755 bp, Triticum aestivum
  unsure (1)..(755): unsure at all n locations
  Clone ID: PAT_TA_11561
gaggaattcggcacgaggcttntcgcccgcttcctcgtcgtcgccatgctcatgcgccgggccgaggcggtggaccacctcgtcgcccgcctccgctcgctcgtacaggaatccaagtcggcctaccccaaaaccaacttcaaggaatggaaacaagtgcttcaagagcttgacagattcttgaaagctgacggagcatacaaaggatctagatcacttagatatgataacttgtttgattcttatgcatcaaaccttgcatcaatagcaagattccattcgaaaagagtactgaaactgaaggaagctgtattaacaagttaccaccgaaacgaggtcaagttcacagagctaactttggacactttcagaatgctacagtctttagaatgggagcccacagggtcttatcagatagctgttaaagaacttacagaaaatggcactatgagtgatcagagtggaccctctggtctgatcgatattcacctttctacagagatctctgatggaaatcttccttcaaatcctcaaagagcaatcatatatcaccctacagtctctcatcttatagcggttcttgccacaatctgcgaggagctttctcaagatagcattttgctaatttatatatcagcatcaggccttgctgatcaagaatgcatatcataagtatgcatctagctcttcatcacgctcgaggtcggccccggctttctcaatcgataagccaaattcacataccgggttagatg

SEQ ID NO: 11562 - DNA, 1631 bp, Triticum aestivum
  Clone ID: PAT_TA_11562
cggcacgagggaactgcctcactcccgatcctctccgacgacgagatgggctccatggagctgtccaccgcgccggagaacggcaccgcggcggccgccgcggcgtgcaacggcggggccgccccggcgaacggaggggtcgagaggaggctgagatcctcagccgcgtccgcgtcctgggcggcgcatctgccgctggaagtggggacgcgcgtgatgtgccggtggcgcgaccagaagccccaccccgtcaaggtcatcgagcgccggaagtccgccgcctcctcctcccccgccgactacgagtactacgtccattacaccgagtttaacaggaggttggatgagtgggttaaacttgagcaacttgatcttgataccgtcgaggctgatgttgacgagaaggtagacgataaggcaacaagtttgaagatgacacgacaccagaaacgtaaaatcgacgaaacacacgtggagcaaggtcacgaggagcttgatgctgctagtttgcgggagcatgaggagttcacaaaggtgaaaaatatagcgaagatagaacttgggaaatatgagatagatacctggtatttctctcctttcccaccagagtacaatgactctgcgaagctgttcttctgtgagttttgcctgaacttcatgaagcgcaaagaacagcttcagaggcacatgaagaagtgtgatcttaagcatcccccgggtgatgaaatctacagatgtggaactctatcgatgtttgaggttgatggcaagaagaataaggtttatggacagaacctttgctatctggccaagctattccttgatcacaaaacactctactacgatgtggatttgttcttgttctatatcctgtgtgaatgtgatgatcggggatgccatatggtgggatatttctccaaggagaagcactctgaggaagcttacaacttggcctgcattctcactctccctccataccaaagaaagggttacggaaagttcctgattgctttctcttatgagctttctaaaaaggaaggtaaagtgggaacaccggagcgtcctctctcagatcttggtctgctcagttatagaggctattggactagagtacttctggaaattctgaagaaacataagagcaacatatctattaaggagctgagcgacatgacggcaatcaaagcggacgacatcttgagcacgctgcagagcctggacctgatccagtaccggaaagggcagcacgtcatctgcgcagacccaaaggtcctcgaccgccacctcaaggccgcggggcgggggggcctcgacgtcgacgtgagcaagctgatctggacaccgtacaaggagcaaggctaagcaaagcacatctgccatgcggccatgccatgtcgaattagataagctgaccaatcgagtcgtgtatattttaggaactccttccttccccgtccctcgtgcagtgactctactagtctcttttttccgaactgtggctgtagtggtcttgtgtaacatcagattgttgtgtctctcagcacgttgtttgccaagctttccgattaataactatgtcacctgttctgtatttgtggtcttcctgctcatataattggatggaaaagcaa

SEQ ID NO: 11563 - DNA, 764 bp, Triticum aestivum
  Clone ID: PAT_TA_11563
gccggccgggccgggacccacgcgcccgccgttttccccacccccctcccaatcccctctcccaagcaaagcgatctccggcgaatcggaaggcgcgagatccggccgcgatggcgctggagtgggtggtgctggggtacgcggcgggcgcggaggccatcatgctgctgctgctgaccctcccgggcctcgacgcgctccggcgcgggatgatctccgtggtgcggagcgcgctcaagcccatgatgtcggtggtgcccttctgcctcttcctgctcatggacatctactggaagtacgagatgcggcccacctgcgacgacgagcacgcctgcaccccctccgagcacctccgccaccagaagtccatcatgaagtcccagcgcaacgccctcctcatcgccgccgcgctgctcctctactggatcctcttctccgtcacctccctcgtcgtcaagctcgaccacctccagcagcgcgtcgacaagctcaagaagcgcgacgactgatcccctcctccccattgcgtcccggccccggcaggccgacggtgtcgttgcttcgtcttcccccgcgtttatgttcctcctagatacaccctgtgatgcatgcgttccgtgttcttcttcctttgtagtgtggatgtttgagatcgcgatccggatttcgctagcgctctgttatcacttgcctgcttcagatctagttcgagtaaaataggtctttatgcgaaaaaaatcaaaaaaaaggcccctgttcctgcc

SEQ ID NO: 11564 - DNA, 1064 bp, Triticum aestivum
  unsure (1)..(1064): unsure at all n locations
  Clone ID: PAT_TA_11564
gccctccccacccccctccccaatccgggctctccccatccccctcccaaatccccctctcccaagcaaaccgatctccggcgaatcggaaggcgagagatccgcccgccccagtgctgcagagtgccatgtcccaagacaaggcgatcctccggggcatcgggaaggcgagggtgtcgggccgcgatctggcgccggagtgggtgggtgctgtggtactcggccgggcccggcggccaccatgctggtgctggtgacccttccgggccttgatgctcacggccgtcgaggggatgatctccgtggcggccgaccgccctcgacgcccatgatgtcacgtcgttgcacgcttctgcgccccccctgctccaaggacgacgaccgggagcaacgccatccggcccacctcgccacgacgcagcacgtctgtcatccccctccccacgcaccctcctcctcaccatcagagcccctccatgaactcgcaggcgcaacgcccgcctcaccgccgccgcgctgcccctccaccggcttccccttccccgccacctgcctccgttcgtcaagctccaccacgtccatgctccgcctacgtccaccttagaatccgaggactcctgcccctccccatcgttgcacgtccccggcctacggttccggtgctccgttcttctcccgcgtttatacctcttccttagatacagtcctggtgatgtatgttgtttcgtgttgtggatcctttgtagtgtggatgctggagatcgtgatacggtttttgctagcgttttgttatcacttacctgcttcagatctagttcgtgtaaaataggtcttaatgcgataaaaataatcatgaaccctatccttgttaaaaatgtgtctcagaaccataaatttggataaaaattctaaaaccatgctttaatcatactgctcctcaaggatgtttgttgatttctcttgtcacatgcttgccaaattaagttcaggcccccagatgctttgccttggtaggaactggaatagtgcgtgtttagttgcccggttgtaaaggtangagtctc

SEQ ID NO: 11565 - DNA, 558 bp, Triticum aestivum
  unsure (1)..(558): unsure at all n locations
  Clone ID: PAT_TA_11565
cttttaggggngaattgggtacccgggccccccccntggggttttttttttttttttttttcatctttntgggggctcagattcnccttttgatagattcatacaacttagctccaccatcttctttcaccagatcaacccccccccaatgaagccgagctcctctggttatcactcaacagaatgacccatccaagagagagccgtcaatattcgatgagaatgaaagggttctaaaagaggggggagggggtttttttatgcccacagctccttgaataatcgaagaaaagtttatgtcagccaagttttatcatcatcgccccagataagtttccaacatggttcattttgtgctgagcttttccaaaaagggtcaaaacactgaattctgccgcaacttgatacacacatacatgcatgcatacgtcactctggggttgagagttctgacaccattgacaatgtcaaggccaagatcaaggacaaggagggcatcccccntgngaccagnagggccttatttttgccggnaagcagntggacaatggccgaagc

SEQ ID NO: 11566 - DNA, 674 bp, Triticum aestivum
  Clone ID: PAT_TA_11566
atggtatcgtgcgcaaatctacatcactcctttgtttctaagatccactttctttcttgtccctaggggatacacagaactgtgatctggcgcagccttcctacagccttttccccaacaaacatcaaccaacacttcaagaaaaaacaagatagtacagaaaggtaagaatcagacaaagagaaaaattgtttctgccttcgccatagctacatgtcttgaaagttgaggtcaacacgcccaccccgccccccgctacgggagtacggggacgggaatggatacctgggagctaggcagcaaggatgaagtgtcttttcagttgtcgtcgtttgcggtcgtaggagaacgccgatacgcatgcaagaaccatgtgctgaagaatgctttgggtgctatcatcaaagtctcttatttgtttcttttggaaaggaaaagacttagttgcggcccgaagtgaccacggcggtgcttgtgtgcgtgtcggcggtagtcagcaccaacagtggtggtgacgacgacctcaacgatggcaacctcgtatacgacaccgtccttggtgtaggtagaggtagagacagcctcgtcacccgcgacagcatcaacgatgtcagcaagaggagtgacggcaggtgcggcggggtagttgccgtagtcagcgctggagctggact

SEQ ID NO: 11567 - DNA, 1339 bp, Triticum aestivum
  Clone ID: PAT_TA_11567
cgtccgaaacgaacttcctatatcctaggttttttaccataagatctcgattttttgcccattaaatgccaattttcataactgatccgttcttggttcccttgttattatgaagtgctgtagacaatttccgaaggcaatttgctaacttggaggaaaatggagggaagggaggggcaatcgttccatcggacaggaagcatgtttcactccccaggactactacagttcattctacaccaattcctccaaaagatcagaagtcttcccaagttccccaaaggattccaacaggtagaccaggaagagtggttggcccggtaataccatttgagaattcatgtgctatggatccttacagtcaacgaagggtggcaaggaatccagtacttcctgcagctgctaccaatgtatcagcatacgcataccaccgaaagtcagacagttcagagagagagttacagcaggagcttgaaaaagaccgcatgcagtaccaaccgatgcagcgtttcatggatgccaagatggtctcccctgacttgaggtctacctcctattacatgccaaagggtgtcccaaaagcagatgtagcagaaaggactggtttgcagccaaacatgatgcagggaattgccccgtttaatggcattgctgcagttggaggtagctacaataaggccagtgctgttcagtatggagtttcaaggatgtactaaatgatctagtgcaatggctacttccaaaatgcttggcttagctgaagaaataacatggaagaatcgaagtacttcctgagttgccttataggctgaaggttcagacagtggatcgatgatcttcgatcgaggaggaagttgatgtctcgtgaagaacaaaaaaaaataagattatgcaaagacaacatcctgcctgttgatctagctgccaaggaaagaatgacatctggtaacttgctgctaaggggaaaagccgaagttgggggtacaagatgattgaggtctatgtactttgaaagaacggaaacatatcggaataatggaaatggtgaacttctgtacataaataacttgatttttctttgtattactgtcggcgagagctgtcagttttgctccatattcatgtggcaatgtgatttatttttctgggtttgaagcacttatgcagttatgcttctgtaggagttcagcgttgtaatactttggagtatgtttagatctgtaatagaataacaagaccaaacttcagtaagatagaatggtaatgaactgctagttttgggggctgttggctcaaccgtggtacttattaaaccagggttgatgtataggaacagtat

SEQ ID NO: 11568 - DNA, 523 bp, Triticum aestivum
  Clone ID: PAT_TA_11568
cacacaaccacgttggatcccatctctcccgtcttcctcgatcccctttctccatcccacgccgctgccagattccggcaaaccccgcggttccccaccacctagctctcctccccgaggtcacctctccccgctcaccatctccactgaccggtttctctcctcgcccaggaaagccacgcccaggcactggtggtggtgcaccgcgaggaggccccagcggcgtcgagctgctgttgctgcgggcacagcgacgtcggcgtggtcaggatggtcgcagcccttcaagattctcaatggcggcatctcggcgctgatggcagagtcgacggcgagcatcggcgggtacatggcgtcggggtaccggagggtggctggcgtgcagctctacatcaaccacctcaagcccgcccgcctcggcgaccgcatcgaggccaaggtgaaccccatccggtacctccaccccgacgcgtacttggacaaggaccagctgctggacgcggtgcattggatctggcaggcg

SEQ ID NO: 11569 - DNA, 732 bp, Triticum aestivum
  unsure (1)..(732): unsure at all n locations
  Clone ID: PAT_TA_11569
ataagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctggacctccgataacgcagaggagggtggtgatgagatcaaggaagccgcctcaaagcctgagggagaggggcactgattggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaacnatttcctnattgcagcacaa

SEQ ID NO: 11570 - DNA, 579 bp, Triticum aestivum
  Clone ID: PAT_TA_11570
ccggcgatccccgccgttccccaccgcctagctctcctccccgaggtcacctctccccgctcaccatctccaccgaccggtttctctcctcgcccaggagagccacgcccaggcactagtggtggggcaccgcgaggaggccccagcggcgtcgagctgctgttgctacgggcacagcgatgtcggcgggggggggatggtcgcagcccttcaagattctcaacggcgtcgtctcggcgctgatggcggagtcgacggcgagcatcggcgggtacatggcgtcggggtaccggagggtggccggcgtgcagctctccatcaaccatctcaagctcacccgcctcggcgaccgcatcgaggccaaggcgaaccccatccggtacctcgaccccgacgcgtccttggacaaggaccagctgctggacgcggtgcattggatccggtaggcggtggggctcgcctgcggcctgctctggggcgccgtcctcctcgtcggcgccttctggatcgccctgtcagtccttccctccctccatcctcaaagccccaaccttcttctttcccttcagacataggcat

SEQ ID NO: 11571 - DNA, 650 bp, Triticum aestivum
  Clone ID: PAT_TA_11571
ccgtgatagttcatttgtactatgcacacttgctgaagattgatgaggaagactttggaggccacgccgccctacttcaggaggggctctttgcttcgttcacccttttcctggtataagctatcgtccataatcgtgtctcttccagacttccatcactgcctcctagttgcaccaacgtcgaactcatttctaccacacatgcacatgtcttctgttgacatgttttcagtttgcctccaaactagcaagtgctacaggcacataaactagcactatcacgacatcatgtgattctgctttttcagtaggagctgtcaaacaaacaatacaagcttgtaacattaaatcaactccttaattcttgcgtctttgtattcgcgcattgaataaattgggtgccatggattactaacagattcttctctctcggttgcagctttcgtggactctagtatacagcttggctcacttctgagaagcctgtctgcagaaacatggcgtcggattttcgttgttaattttcattcaccatcttgtaaaattagttatcaaggatgtaatggcatggtcatatagaacaacgtcgtcgtcgagctataactgtaatgtggatagaatccctttaaacttcagtgaggaaaataaaa

SEQ ID NO: 11572 - DNA, 1332 bp, Triticum aestivum
  Clone ID: PAT_TA_11572
cggacgcgtggggcgaggccgccgcgggtggtggagactccgtccgcgtcatcaagacaccgcagcccaactcaagtgttaagtttagcgtggaggtgcctcccttgatatgccaggagtgctaccaaacaactcttctcgagtactcaaagcgttttgagtaatcatgaactgcagatacagagttccgggcgatgtcacagcgggagctcgtcaggaagtgcagaggctcaaggcctctgtgtctcacctgcagacagccctgcaggagctgcagagcagcgggttgcactcggaagacgccgggattggggctgcggaagctaggaaggccgacctcatggataagaaggccaagctggacgagaccctggctgcagcccgccagttcagagcactgcttcggcagtagctccagaaagccttcacgtcacaggttagggatcaaaaggcagcacagaactgactagttatgtggtacaagcaaaacgacattcattagctagctcatcaatcgcttcggattaaggatgcaatgcaagtgtggcgggctagtggacagtaacatagtagtacaaatgtagtgttacttttaggcaaatgttgagcaaattttgaactaatggatgagtttcatgggacgaagcgggctgccacttgcactcctcctactgatgaaacgaacttcaaatgactctacatgcagatacatgctttttatttcagtcttgtttagaggaggccccggtagtgtcgagctgctgttgctgcgggcacagcgacgtcggcgtggtcgggatggtcgcagcccttcaaaattctcaacggcggcgtctcggcgctgatggcagagtcgacggcgagcatcggcgggtacagatggagtaggaggacgagcaacaacagcaaatcagcctgatgatgacggggtgcggaaggcaatggtgatcatgctgatggcatgaagaaggcgaatgaccacaacctggaccttttggcatttagagatggcaaacacaggcggcgcggagacaacaacctggaccacccaccccccttgcctttttaattttggttgtggtggttgcatcaccgtcgcggtcgcaaatcagtatgtagtgtgcttgtggagttgggtctggactgcagtgtccatccagtaggttaggtgttgttgctactagatcccatgatgctcacctaagttttgtgttatgtggaggccaacctttgtgatcttatttgtcgacacttgtgtgatctcgtcttactttgtgatacaagttgtacaatatatatgtttttatggatgatcttgtgatgttctttttt

SEQ ID NO: 11573 - DNA, 529 bp, Triticum aestivum
  unsure (1)..(529): unsure at all n locations
  Clone ID: PAT_TA_11573
actggatccggcaggcggtggggctcgcctgcggcttgctctggggcgccgtccccctcgtcggcgccttctggatcgccctattctttacaatttccaccgtcatagttcatttgtactatgcgcatttgctgaagattgatgaggaagactttggaggccatgccgccctacttcaggaggggctctttgcttcgttcacccttttccttctttcatggactctagtatacagcttggctcacttctgagaagcccgtctgcagaaataccatgttggattttcgttgttcatttcattcactcttttgtacaattagctatcatggatgtaatgtcatagtactgtagaacagcgtcatcgagctataactgtaatttgtatagaatgccttccacttgttgggtccattcggtcaagctcaaagtagtactgtctccatcattgttccatgtaaatggtaaggctcgccaatttgaatccnatagtccacccaacatttgntgctcaaaaaaaaaaaaaaaaaaa

SEQ ID NO: 11574 - DNA, 492 bp, Triticum aestivum
  unsure (1)..(492): unsure at all n locations
  Clone ID: PAT_TA_11574
ccagcctccccccacgaacccacagcgcgcacccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctggctctctgtggcttacaagaatgttatttggtgcccggagggttcctggaggattatctcctccattgagcagaaggaggaganccttgggaacgagcctatttgcttcaatcaaggataccnttcaagatttaaaccgactcaacaaatttgtggatggacctcaactctggatccaacttttccctctgcactgaacaaatccaagtttctatctgaaatgaag

SEQ ID NO: 11575 - DNA, 800 bp, Triticum aestivum
  unsure (1)..(800): unsure at all n locations
  Clone ID: PAT_TA_11575
cgtccggccaaaaggagtccgtcggcgaccggaccgagcaaagctccgtcttttctctctcccacgcccaccagcgatcccatctcgccgcccgcccaccgccgatcccatctgccgccgcccgcgtggaaaaccgccgccgcggaggacccggaggcatgaggaagtccaaggcggctgcggcggcggcgaagctgccgcaccacgcggcgcagaacggccacgccctcccctccaggctcgcccggtacctcgaccccgacgcgtccttggacaaggaccagctgctggacgcggggcactggatccggcaggcggtggggctcgcctgcggcctgctctggggcgccgtccccctcgtcggcgccttctggatcgccctattctttactatttccaccgtgatagttcatttgtactatgcacacttgctgaagattgatgaggaagactttggaggccacgccgccctacttcaggaggggctctttgcttcgttcactcttttcctgctttcgtggactctggtatacagcctggctcacttctgagaggcccgtctgcagaaacatggcgtcggattttcgttgttaattttcattcactatcttgtaaaattagttatcaaggatgtaatggcatggtcatgtagaacaacgtcgtcgtcgagctataactgtaatgtgggatagaatccctttaaactttagtgagaaaataaaagtggctgggtctaaccagtcatgctnaaaanaaaaaaaaaaaaaaaaagggggggcccgtanccaaantcgccctaa

SEQ ID NO: 11576 - DNA, 649 bp, Triticum aestivum
  Clone ID: PAT_TA_11576
gcatgtgcaagttgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaacttgactctctggacctccgataacgcagaggagggtggtgatgagatcaaggaagccgcctcaaagcctgagggagaggggcactgattggccctcgagcgtgcccaagtttatttctgagtccatttacgcagctacctgtatcattcggatcataagatgtactagggtcggttgcactatgtgaatcataagatgtggtaggatggtgctatgcgaagggtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatc

SEQ ID NO: 11577 - DNA, 762 bp, Triticum aestivum
  Clone ID: PAT_TA_11577
aatccacaaaaacaaccgcaatccgcaatcgcgcagggacaccgatggcaggctccggcgaaagcgcgagaacttcggcgccgtcgcctcccgggccgccccccgggttcggcgagggcgccccgccggacaacgctctgcacgccctgggcttcgagtacacccgcatcaccgggaccgaggtcctcggccgcctcgccgtcaccgagacctgctgccagcccttcaagatcctcaacggcggcgtctcggcgctgatggcggagtcaacggcgagcatcggcgggtacatggcgtccgggtaccggagggtggccggcgtgcagctctccatcaaccacctcaagccggcgcgcctcggcgaccgcatcgaggccaaggcgaaccccatccaggttggccgcaacgtccaggtttgggaggtccagatatggctgttggatccttccacatcggagcacaaagatttggtatcatcagcaagggttaccctgctaaccaacttgtcaacgccagaggaaatgaagagctatgagaagggcatcaagaaatatgcaaagctttaggaaccgtaatatgttaagcgcaatatattgcagtccaacaaaaattaagtatataagttgatatccaaatcactagatcaagaatgtatcacttgcaattttttgcaaatgtccaggactaccgtgacaagcatgtatcacttgatcaagaattttagtcgggaagtgatgataatccaagtaagaattcagatgt

SEQ ID NO: 11578 - DNA, 811 bp, Triticum aestivum
  Clone ID: PAT_TA_11578
gccggccgggctgcggagtaaaaaacaaccgcaatccgcaatcgcgcagggatcccgatggcaggctccggcgaaagcgcgagaactacggcggcgtcgcctcccggaccgccccccgggttcggcgagggcgccccgccggacaacgctctgcacgccctgggcttcgagtacacccgcatcaccgggagcgaggtccttggccgcctcgccgtcaccgaaacctgctgccagcccttcaagatcctcaacggcggcgtctcggcgctgatggcagagtcgacggcgagcatcggcgggtacatggcgtccgggtaccggagggtggccggcgtgcagctctccatcaaccacctcaagcccgcccgcctcggcgaccgcatcgaggccaaggcgaaccccatccaggtcggccgcaacgtccaggtttgggaggtccagatatggctgttggatcctgccacatcggagcacaaagatttggtatcatcagcaagggttaccctgctaaccaacttgtcaacaccagaggaaatgaagatctatgagaagggcatcaagaaatatgcaaagctttaggaactgtaatatgttgagcacaatatatagcagtccaacaaaaattaagtatataagttgatatccaaatcacttgatcaagaatgtatcacttgcaattgtttgcaaatgtccgggactaccgtgacaagcatgtatcacttgattaagaattttagtcgagaagtgatgataatccaagtaagaattcagatatagtgctacagattgcaaaaaaaaaaaaaaaaaaaaa

SEQ ID NO: 11579 - DNA, 917 bp, Triticum aestivum
  unsure (1)..(917): unsure at all n locations
  Clone ID: PAT_TA_11579
tagcgtggtcgcggccgaggtacactgcagcaactctcaacaagtatgcatcagcacatctcatgattgaaggatgaactccattacacttctctggcaagggtatttaaacccaaccttatgcaacaaaatacattatcttggtcaaagttacccagaattgcgctgctttgagtccaatcgtcagttgctaagtgataaacaattatatggcaagcataatataaagcaaagtagcatgagagcgggttgaaactttaccaatagaaatctaatgatgtctaccttcccttctaggtatgtgcatagataattttgaaattcagtagtgcggaggagccacctgaggacgggcggcgagcgagagggcggcggccggagataggcggcgaagcggggtcagggcgaagagatggcgttcaccatgcgcgccgtgaaggttccgccgaactcggcgtcgatgggggaggcgcggcaccgcgtgttcgacttcttcagggaggcctgccgcgccatcccctccatcatggagatctacaacctcgacgacgtcgtgacccccgcccagctccgcgccagcatctcccagcagatccggaagaaccagggcgtctcccgaccccaaggtcattgatatgcttctcttcaacgggatggaggagctgaacaacatcaccgagcatgcgaagcagcgccaccacatcatcgggcaatatgtggttggccacaaggggctggtgcaggacctggaaaaggaccaagggagcttcgagttcctgaagaaatttaaccagaactctagatccgaggcgcacaaaatttcagcttctgtagaagtgccttaatgncttgaatagacgtgagaaccatcggccattattattctcatgtttcttgttcacttatttatattgtac

SEQ ID NO: 11580 - DNA, 688 bp, Triticum aestivum
  unsure (1)..(688): unsure at all n locations
  Clone ID: PAT_TA_11580
ggagagcaccgagcggaggagccacctgaggacgggcggcgagcgagagggcggcagccggagataggcagcgaagcggggtccgggcgaagagatggcgttcaccatgcgcgcggtgaaggttccgccgaactcggcgtcgatggcggaggcgcggcaccgcgtgttcgacttcttcagggacgcctgccgcgccatcccctccatcatggagatctacaacctcgacgacgtcgtgacccccgcccagctccgcgccagcatatcccagcagatccggaagaaccagggcgtctccgaccccaaggtcattgatatgcttctcttcaatgggatggaggagctgaacaacatcaccgagcatgcgaagcaacgccaccacatcattgggcaatacgtggttggccacaaggggctgggtgcaagacctgggaaaaggaccaagggactccgattcctgaagaaattctacaccagcaactactagaatccgaggcacacaaaatttcaaccttcctgtaaaatgcccttgacatgtctctgaataagacctgagaaaacatccggccaattatttgtaccgattttgcttgtcaactgatcatancgtactcaccaanaatgttcgcagtaaacgnntactctaacncgctcagctagttangatatgctgaagaaaaaaaaaaaa

SEQ ID NO: 11581 - DNA, 694 bp, Triticum aestivum
  Clone ID: PAT_TA_11581
ctcgtcttctcccccacaaaagcaaacgcgctgctccactccgagccgcggccatggagctcgccaccgcggccgtcgtctccacagcctccatccaccccggccgcagccatttctcaaccgcacgcgtagcctcctggtctagttcctcgtcgccgtcctcctctcggtccctgtccacctccgcctccacctcgcggtcccagaggcgtcgactccccgtcgcctcggccgccgtagagctccgcgaggccgccgcaggtggtggagactccgtccgcgtcatcgagacgccgcagcccaactccagtgttaagttcagcgtggaggtgcctccctcgatatgccaggagtgctaccaaacaactcttctcgagtactcaaagcgtttcaaggttcctggatttcggcctggaaagatagttccagaaaatgtacttttaaattacgttggaccacaacatgtacgggctgctacagttgaagctatcttaagacatacacttcctcaagcactgtcctcggtagaagagagggcattagaagattctgtgcgcattctcactaagtttgatgatatgaacgaggctttctcccttgaccatgtctttagatatgatgttgctgtggatgttattcctgaagtccgttggttatctgaagacaaatataagaacctcaaagtggttattga

SEQ ID NO: 11582 - DNA, 762 bp, Triticum aestivum
  Clone ID: PAT_TA_11582
gaatcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaattcaattgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttaccgaaaaaaaaaaaaaaaaaaaaaaaaaaaaaggccccta

SEQ ID NO: 11583 - DNA, 1335 bp, Triticum aestivum
  Clone ID: PAT_TA_11583
atcaggacacaggcatttcgagtttaaaatccgaatctgatctcgtcaatgagtatgcttcgcatccacattccacaacggtacatgaagcagcagcagcagccacatcaaatgggcataaaaaattccaagcaacacatcaatgacaatggcagtgagaatggcaatggtggtggctctcctgcgaggacgcgcaggggctctgagggtgtagcgccgggaggccacaggctagccggagctcgctgtaccggcggacgtcaaaatcccgggctttcatcagacgcttctgcttcaccacaaaacggctctggaagaagccctcgaacgacggctccctcttggtccggaggaagaaggcgtagccggccatgaagtacgtcgacgtcacgaagaagcagatgggctccatgacgtcccaggagagctcccagaatgtgagcctcatgaagccggccgtttggagggccagggcagccagccctccccacagctcccgccgcacctggagcgtcgccatgcggtcgatgtctaccttctgggcctccatggccttcagctcctcccttgcggggtgattctcagcaacagatagccctcgcggaatgggtatggccttctcaattgctttcacaacctgaaatttgaacaaaaaggacaaaaacatttccaaattttacttggctgctcttcttttcaagggagatccatcaaagaaagagcaatgctggaaggacagaaacatttagctcaaactgtacatgcttggattttcaaaacaagtgcaaaatgtttttctgctatcctccacatagattcaaataccattcaaaagaaaatgttcatttttgttaagttagtattgggtattaaacatattgactgcacgccttaacacccatgttgaagagttgcatgacaaagttgccaggctataacagcagatacagctacaagactaaatcatgcaaaagcttttccacaaatagttttgtcgccgccaacagccacaacttgcaaggggtagtgtcaagttatggtgaccacggagggacctagcaaaaacaaacaataaatcgtaccacttatcttgcctgtgagcgctattacctaatcagaaccagatggcatgtgttgatgttcctaaactttgtttaggtccacccagaacttttttttgggggggaaggtcaccaagataagagaagtagatttgtcattgacttgttagccctgtgttagtctcctatttttcaaatgggaagggatgcagcttatttattcagcaggaaataacaacagcatttttttagtacctcggccgcgaccacgcta

SEQ ID NO: 11584 - DNA, 848 bp, Triticum aestivum
  Clone ID: PAT_TA_11584
attccttcaattgtgctcatcatcatcctcgacaccaaagctcatcttcttctccttgaaatctttttgggttcatcagatttggaggatgtcttgcaactgtggatccggttgcagctgcggctcagactgcaagtgcgggtatggatgtttttttccaattagtttttgacgttaatggatgcttctccttgcaaaatagtaggagtactctcgtgctatttatgtacctcatccggatccggtgatccctttagctgatcaagcatcaattcctattgtggtgatgaacgattgatttgattcgccgaccggttgccttcgcccgtcgcaggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcctaaatcgctacttcggttaaaaaaaaaaaaaaaaaaaaaaaaaaaaaaaaaaaaaaaaacctcggccgcgaccacgct

SEQ ID NO: 11585 - DNA, 961 bp, Triticum aestivum
  Clone ID: PAT_TA_11585
aggcacccacgatgcacacacacccacacccaacccacacacacacacccacgttgaatcccatctctctcgtcttcctcgatcccctttctccacccacgccgccgccagattccggcgatccccgcggttccccaccacctagctctcctccccgaggtcacctctccccgctcaccagctccactgaccggtttctctcctcgcccaggagagccacgcccaggcactggtggtggtgcaccgcgaggaggccccagcggcgtcgagctcctgttgctgcgggcacagcgacgtcggcgtggtcaggatggtcgcagcccttcaagattctcaatggctgcgtcccggcgctgatggcggagtcgacggcgagcatcggcgggtacatggcgtcggggtaccggagggtggctggcgtgcagctctacatcaaccacctcaagcccgcccgcctcggcgaccgcatcgaggccaaggcgaaccccatccggtacctcgaccccgacgcgtacttggacaagacggagtaggaggacgagcagcaacagaaaatcagtctgatgatgatggggtgcgggaggcaatggtgatcatgctgatggcatgaagaaggctgatgaccacaacctggacctgttggcatttcgagtggcaaacataggcggcgtggagacaacaacctggaccacccacctcccttgcctttttaattttggttgtggtggttgcatcactggctcggtcgcaaatcagtatgtagtgtgcttgtggagttgggtctggactgcagtgtccatctagtaggttaggtgttgttgctgctagatcccatgatgctcacctaagttttgtgttatgtggaggccaacctttgtgatcttatttgtcgacacttgtgtgatctcgtcttactttgtgaaacaagttgtacgatatatatgtttttatggatgatctt

SEQ ID NO: 11586 - DNA, 765 bp, Triticum aestivum
  unsure (1)..(765): unsure at all n locations
  Clone ID: PAT_TA_11586
ctactaacagtcgcgcgcccatcaggagtgaaaaattgtttgccgtgatatagatcagctgttgttcacaacgatcttttggtacagcaaatctaaccggtctctgtaacactttaaggatgatggaaatagttcaaaaacggcggcccttttagccgacgaactcgcggaaatgcaggcaaaagtacatccatgtttgtatcaaagctcgctgtcgtcaccctccgcggtggcgccagcagatgtcttcccattgacggcgatgagctccgtgtcgaaaaccagagttgcaccacctggaatctttggtggggagcctcgctcgccgtaacccatgtttgcgggtattcttagcttccgcttttcgccgacacacatacctagtaaaccttggtcccaaccttttatcacctgcccattcccaagagtgaattcgaagggatcacctctgtcatagctagagtcaaatactgatccatcagtgagtgtcccacgataatgcactttaatcttgtcacctttgtgagcctgtagggtacatgattcaggcttgtacttgacgccgatctggagctgtgtaacatccgcggacttcttggccgaagcggtcagaaggacggccgcgatggcaacgacggcgaggcagaggagccacggcttcttcgtccccatcgctcttccctgcaatccctacctggtcagcggcccgaggtacagtttctttggatcgtatacggtttggacctcgtgccgaattncctgcag

SEQ ID NO: 11587 - DNA, 926 bp, Triticum aestivum
  Clone ID: PAT_TA_11587
gagagaactagtctcgagttttttttttttttttttttttttttcacatgatcattcattcattcattctccactgatcaccgcactgcatgctcgacttgtgcacgcagtataacatgctggtgctcactcatcattaacagccgcacagtcgaacaaacagaagatacttgtgttctcactactaagagctgaacagccatcaggagtgaaaagatgtttcccgtgatatagatcaactgttgttcacaacgttcctttggtacagcaatctaaccagtctctgtaacactttaaacatgatggaaaatcgatcgaaaacggcggccctttttgccgacgaactcgcaaaaacacaagtcaaattacatccgagtatgtatcaaagctcgctgtcgttgctctccgtggtggcgccagcagatgtcttcccattcacagcaatgagctccgtgtcgaaaaccagagttgcaccacctggaatctttggtggggagcctcgctcccccgtaacccatctttgcgggtattctcagcttccgcttttcgccgacgcacatacctagtaaaccttggtcccaaccttttatcacctgcccattcccaagagtgaattcgaagggatcacctctgtcatagctagagtcaaatactgatccatcagtgagtgtcccacgataatgcactttaatcttgtcgcctttgtgagcctgtagggtacatgattcaggcttgtacttgacgccgatctggagctgtgtaacatccgcggacttcttggccgaagcagtcagaaggacggccgcgacggcgacggcaacgacggcgaggcagaggagccgcggcttcttcgtccccatcgctcttccctgcgctcgctaccgggtcagcggccgaggtacagtttctttggatcgtatacggtt

SEQ ID NO: 11588 - DNA, 521 bp, Triticum aestivum
  Clone ID: PAT_TA_11588
ttcgagcggccgcccgggcaggtccagcctccccccacgaacccacagcgcgcacccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattgggtgcccggagggcttcctgggaggatcatctccctccattgagcagaaggaggagagcccgtgggaacgaggcctatgttgcttcaatcaaaggagtaccgtaccaaggattgaaaccgagctcaacaaagattctgtgatggcatcctcaaagcttctgggactcccaaccttgtcccctctgcactgcaacaaaatcaaag

SEQ ID NO: 11589 - DNA, 831 bp, Triticum aestivum
  Clone ID: PAT_TA_11589
ctcgaaattaaccctcactaaagggaacaaaagctggagctccaccgcggtggcggccgctctagaactagtggatcccccgggctgcaggaattcggcaccagaccaagcggaggagccacctgaggacgggcggcgagcgagagggcggcggcgagcgagagggcgggggccggacatacgaggcgaagcggggtcagggcgaagagatggcgttcaccatgcgcgcggtgaaggttccgccgaactcggcgtcgatgggggaggcgcggcaccgcgtgttcgacttcttcaggcaggcctgccgcgccatcccctccatcatggagatctacaacctcgacgacgtcgtgacccccgcccagctccgcgccagcatctcccagcagatccggaagaaccagggcgtctccgaccccaaggtcattgatatgcttctcttcaacgggatggaggagctgaacaacatcaccgagcacgcgaagcagcgccaccacatcatcgggcaatacgtggttggccacaaggggctggtgcaggacctggaaaaggaccaggggagctccgagttcctgaagaaattctacaccagcaactactagaatccgaggccgccacaaaaatttccagccttcttgtagaagtgcgcttgacatgtactctgaataagacgctgagaaacacttccggccaatctattttgttactcgaggttttgttttgttcgagcttgattcgattatactcagtcatctctactcaatgagatggtgtctgctagtgaaacggttgtaactcatagactctgcttcccaagactcatgttgaagg

SEQ ID NO: 11590 - DNA, 1476 bp, Triticum aestivum
  Clone ID: PAT_TA_11590
aatccaagtccaatgcaaacatcacttcaaagcatatgtttctgagttttacattctgaacaccacagatatgcaacaacaccttcaaacaagacagactattcatccatttacaacataagctatccacaccaccatgcatgcacattattattgccattatttctctagggttacagcttaccgatgctttgctatgatttacgaatgactggctcgtcatcagcaagcttctaaaatgaggaggcaggtttatttcccgattagcatctaatccaccgatgtcagcatctcacactgtgcaccaaacagcctcccataatctttcagatcaagcgatctcacctcatcccgtcgccaaaaccagtcctcatacctataccaccgcaagataccttcatccagcatcattcgctggcatgcaacgcattgtctgctttggcagtggtggaactcccgcagccgggaagctctctcgagagctttgttatctagctcatgaatcacttgcctacgcccattcgtcgccatctcaaacagcaggcagtgggaaatattcagaacctcaagatgctccagcgagttcagaacacattgcaaggcacccattgtcacctttgagcaacgaaggctcaagactttcagctttggaaggtatgtggtaactgctgaagcaaataggagatcaaatgaacccatgatcttgagctctttaaagttcttgcagctattggctaacccctccatgatatatggaggatgaccaatggtaggcatagtcaaggactccagctctccccacctttcaatagcttggcatattcccgcccttgaaatgcggttccatgctggcataaccaatcgttttagattaggagatctttgtgagatgtaatgcaggtgttcatctttcatgtacagattgtaatggaatatcatacaattaacatttccacggctaattgccattgccacccgtagtatttttgcaagcctcttgtcagacctgtcatcaacccaaatatatggagatgctcttgtttgaatgaagttggattttagaagcccaaagtcaagagtgccccatataagtggatctgaacaggccaaacgccataagcggcaaacttgagatactggtgatagctcaaccaagtttagctccttaaatatcttcacgagaacatcagtatccatctcctcccatctttttcccatccatttgctctcccccattattatcaaatcccgaatggatctccgggggcagggggaggaggaagccggtgcgcgaccggcgcggccccgacgggcgctggctcgggaggaggagatcggggccgggagctggtccggcggcggccaccggtggcgacgagcggcggaggctgggtcggaaactgcggggcgtcgcggtgtcgagcatgggtctcgctctccctctcggcctactcaaccggggctcgtgccgaattc

SEQ ID NO: 11591 - DNA, 505 bp, Triticum aestivum
  Clone ID: PAT_TA_11591
agttaattaggtaaatctttcattcttacatattcaccactccatccatagtggagatagatgaagcaattacagggacacatgcatacacatacacacagggacagttcgaggtggccgccgggcagtccggcgagggctgcagctgcggcgacaactgcaagtgcaacccctgcaactgttaagctgcatgcactcgtacgtagtacgtgtgatggtgtgagagtatacgtgaataacgagcgtctgatctgatggagtcgagcaagtgtgcgtgtgtgtgtggtttacttgctcgctctccgtctatgctctgcccttgctgtccctgtgtgtatgtgtatgcatgtgtccctgtaattgcttcatctatctccactatggatggagtggtgaatatgtaagaatgaaagatttacctaattaactactcctaaatcgctccttcaaaaaaaaaaaaaaaactcgacctcggccgcgaccacgctaatcacttagtgaattc

SEQ ID NO: 11592 - DNA, 593 bp, Triticum aestivum
  Clone ID: PAT_TA_11592
gccggcccggtccggaattcaattgtgcgcatcatcatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgaggtggccgccgggcagtccggcgagggctgcagctgcggcgacaactgcaagtgcaacccctgcaactgttaagctgcatgcactcgtacgtagtacgtgtgatggtgtgagagtatacgtgaataacgagcgtctgatctgatggagtcgagcaagtgtgcgtgtgtgtgtggtttacttgctcgctctccgtctatgctctgcccttgctgtccctgtgtgtatgtgtatgcatgtgtccctgtaattgcttcatctatctccactatggatggagtggtgaatatgtaagaatgaaagatttacctaactaaaaaaaaaaaaaaaaaaggccccta

SEQ ID NO: 11593 - DNA, 818 bp, Triticum aestivum
  Clone ID: PAT_TA_11593
ggccgggcccggggactaggagaacattttgcctgggcggagagcaccgagcctcatcccaccaccaccaccaagcggaggagccacctgaggacgggcggcgagcgagagggcggcggcggcggctggcggcgaagcggggtcagggcgaagagatggcgttcaccatgcgcgccgtgaaggttccgccgaactcggcgtcgatgggggaggcgcggcaccgcgtgttcgacttcttcagggaggcctgccgcgccatcccctccatcatggagatctacaacctcgacgacgtcgtgacccccgcccagctccgcgccagcatctcccagcagatccggaagaaccagggcgtctccgaccccaaggtcattgatatgcttctcttcaacgggatggaggagctgaacaacatcaccgagcacgcgaagcagcgccaccacatcatcgggcaatatgtggttggccacaaggggctggtgcaggacctggaaaaggaccaagggagctccgagttcctgaagaaattctacaccagcaactactaggatccgaggccgccacaaaaatttccagccttcctgtagaagtgcccttgacatgtactctgaataagacgctgagaaacacatccggcccaatttattttattactctatgttttgctttgttcgagcttgatttgattacttggtcatctctactcaatgagatggtgtctgccagtgaaacggttgtaactcatagaccctgcttgcccaagctcatgttgaaggattgatgtcttgcagaggcaagatcgatgtggaaaaaaaaaa

SEQ ID NO: 11594 - DNA, 1053 bp, Triticum aestivum
  unsure (1)..(1053): unsure at all n locations
  Clone ID: PAT_TA_11594
tgtggtcgcggccgaggtacactgcagcaactctcaacaagtatgcatcagcacatctcatgattgaaggatgaactccattacacttctctggcaagggtatttaaacccaaccttatgcaacaaaatacattatcttggtcaaagttacccagaattgcgctgctttgagtccaatcgtcagttgctaagtgataaacaattatatggcaagcataatataaagcaaagtagcatgagagcgggttgaaactttaccaatagaaatctaatgatgtctaccttcccttctaggtatgtgcatagataattttgaaattcagtagtgcggaggagccacctgaggacgggcggcgagcgagagggcggcagccggagataggcagcgaagcggggtccgggcgaagagatggcgttcaccatgcgcgcggtgaaggttccgccgaactcggcgtcgatggcggaggcgcggcaccgcgtgttcgacttcttcagggacgcctgccgcgccatcccctccatcatggagatctacaacctcgacgacgtcgtgacccccgcccagctccgcgccagcatatcccagcagatccggaagaaccagggcgtctccgaccccaaggtcattgatatgcttctcttcaatgggatggaggagctgaacaacatcaccgagcatgcgaagcagcgccaccacatcattgggcaatacgtggttggccacaaggggctggtgcaggacctggaaaaggaccaagggagctccgagttcctgaagaaattctacaccagcaactactagaatccgaggccaccacaaaaatttccagccttcctgtagaagtgcccttgacatgtactctgaataagacgctgagaaacacatccggcccaatttattttgttactcgatgttttgctttgttcgagcttgattcgattactcggtcatctctactcaatgagatggtgtctgccagtgaaacggttgtaactcgtagactctgcttcccaagctcatgttgaaggattgatgtncttgcagaggcaaga

SEQ ID NO: 11595 - DNA, 591 bp, Triticum aestivum
  Clone ID: PAT_TA_11595
attcaattcaattgtgctcatcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctatgctctgcccatggtgtccttgtgtgtatgtgtgtgcgcatgtctccctgtaattgcttcatctatctccactatggatggagtgatgaatatgtaagaatgaaagatttacctaattaactagtcctaaatcgctacttcagttacctg

SEQ ID NO: 11596 - DNA, 633 bp, Triticum aestivum
  Clone ID: PAT_TA_11596
attcaattcaattgtgctcatcatcatcctcgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactaaaaaaaaaaaaaaaaaaaaaaaaaaaaaaaaaaaaaaaaagactagttctagatcgcga

SEQ ID NO: 11597 - DNA, 624 bp, Triticum aestivum
  Clone ID: PAT_TA_11597
gccggccggtactaaattcaattcaattgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggaaaaaaaaaaaaaaaaaaggccccta

SEQ ID NO: 11598 - DNA, 634 bp, Triticum aestivum
  Clone ID: PAT_TA_11598
ggccgcttcgaggcccggcccgttgccgggaattcattgtgcgcatcatcatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgaggtggccgccgggcagtccggcgagggctgcagctgcggcgacaactgcaagtgcaacccctgcaactgttaagctgcatgcactcgtacgtagtacgtgtgatggtgtgagagtatacgtgaataacgagcgtctgatctgatggagtcgagcaagtgtgcgtgtgtgtgtggtttacttgctcgctctccgtctatgctctgcccttgctgtccctgtgtgtatgtgtatgcatgtgtccctgtaattgcttcatctatctccactatggatggagtggtgaatatgtaagaatgaaagatttacctaattaactactcctaaatcgctccttcagttaaaaaaaaaaaaaaaaaaggccccta

SEQ ID NO: 11599 - DNA, 1068 bp, Triticum aestivum
  unsure (1)..(1068): unsure at all n locations
  Clone ID: PAT_TA_11599
aaaatctgaatctgatcacgtcaatgagtatgcttcgcatccacattccacaacggtacatgaagcagcagcagcagccgcatcaaatgggcataaaaaattccaagcaacacatcaatgacaatggcaatggtggttctcctgcgaggacgcacaggggctctgaggatgtagcgccgggaggccacaggcttgccggagctcactgtaccggcggacatcaaattcccgggcctgcataaggcgcttctgcttcaccgcaaaacggctctggaagatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcctaaatcgctaaaaaaaaaggagggtggctggcgtgcagctctacatcaaccacctcaagcccgcccgcctcggcgaccgcatcgangccaaggcgaacccatccggtacctcgaccccgacgcgtacttggacaagacggagtangaggacgagcagcaacagaaaatcatctgatatgatggggtgccggaagcaatggtgatcatctgatggatnaanaagntgatgacacacctgactttgg

SEQ ID NO: 11600 - DNA, 1373 bp, Triticum aestivum
  Clone ID: PAT_TA_11600
cgtccgcccacgcgtccgcccacgcgtccgcctccctatttctatccccccccgccccccacgaacccacagcgcgctcccgagatccgcagccgaagcccgtgagaaaagcgaagcgcgagaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctgagggagaggggcactgattggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttggcgtcaagcacccccaaagcttgcctttcttatgaagcaacaactgagtttttcttgtctacttccctctcaaaataattgacttctaggattcttataattcaaaaagtttgatcattttga

SEQ ID NO: 11601 - DNA, 1854 bp, Triticum aestivum
  Clone ID: PAT_TA_11601
gcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgtcgcatcaatcaaggagtaccgtaccaggattgaaaccgagctcagcaagatctgtgatggcatcctcaagcttctggactcccaccttgtcccctctgccactgcagcagagtccaaggtgttctatctgaaaatgaagggtgactaccacaggtaccttgcggagttcaaggcgggtgctgagaggaaagaagcagctgagaacactcttgtagcatacaagtcggcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctctgataacgcagaggagggtggtgatgagatcaaggaagccgcctcaaagccagagggagaggggcactgattggctggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttgttgatgattgatcatacttggcgtcaagcacccccaaagcttgcctttctaatgaggcaacagctgagtttttcttgtctacttccctctcaaaaaaattgagttttaggattcttttaagtcaataagtttgataaatttgatatgaaattatatcagcatttataaaatcgattttattcccttagttaaattatgaaatgt

SEQ ID NO: 11602 - DNA, 641 bp, Triticum aestivum
  Clone ID: PAT_TA_11602
gccggccgggtcgggaacagtcgtcagccatggcgctctccctctccacctccttcctccctaccccgggcgccgccgccgtcgcgagaaccgcaaaccgcaccctccgctccctcgtcccctcccaggggatgaggtgctcgatgcggaagaaggggctgcacccggagatctttgaggacgcgaaggtgtactgcaacggtgagctggtgctggtgacggggggcacgaagccggagtactcggtggacgtttggtcgggcaaccacccctactacgtcggcgactcctcggcgctggtcgtcatggacagccagatcgagaagttccgcaagaagtgggggcacgtcaaggagtactggaccaaggagcagtggctggagatgcaccctgacggcgacccggagtttgagcctgaggacgacgagacccgcaaatgatggctgcctctcctactcctcgtcttcctgctgcgtttctcttgctgttcactcccgaactcaattatgctagtttgcgtggcttgattctcccgctgtaccgtcttcacgttgattgatttggttcacggggattgcatttgcattgccctcgaggtgttcgggtaatgttcgcaaaaaaaaaaaaaaaaaaggccccta

SEQ ID NO: 11603 - DNA, 728 bp, Triticum aestivum
  Clone ID: PAT_TA_11603
caacattcagaaatcatcagcagcacaagaggataagataggaagaaacaggcaaggaaggcaacaagtcgtcagccatggcgctctccctctccacctccttcctcccgaccccgggcgccgccgccgtcgcgagaaccgcaaaccgcaccctccgctccgtcgtcccctcccagaggatgaggtgctcgatgcggaagaaggggctgcacccggagatctttgaggacgcgaaggtgtactgcaatggtgagctggtgctggtgacggggggcacgaagccggagtactcggtggacgtctggtcggggaaccacccctactacgtcggcgactcctcggcgctggtcgtcatggacagccagatcgagaagttccgcaagaagtgggggcacgtcaaggagtactggaccaaggagcagtggctggagatgcaccctgacggcgacccggagtttgagccggaggacgacgagacccgcaaatgatggctctgcctctcctgctcctcgtcttcctgctgcgtttctcttgctgttaactcccgaactcaattatgctagtttgcgtggcttgattctccagctgtaccgtctgcacgttgattgatttggttcacggggattgcatttgcattgccctcgaggtgttcgggtaatgttcgcaacgactctagcaatactactttccagtatgtgtcaacgttgagcttcatgaaatcggtgctc

SEQ ID NO: 11604 - DNA, 998 bp, Triticum aestivum
  unsure (1)..(998): unsure at all n locations
  Clone ID: PAT_TA_11604
gccggccgggccccagttgtgcacgcatcagcacccctccgggataagataggaagaaacgggcaaggaagccaacaagtcgtcagccatggcgctctccctctccacctccttcctcccgaccccaggcgccgccgccgtcgcgagaaccgcaaaccgcaccctccgctccctcgtcccctcccaggggatgaggtgctcgatgcggaagaaggggctgcacccggagatcttctggaggccgcgaaggtgtactgcaacggggagggctgggtgctggtgacggggggccacgagagccggagtactcggtggacgtctgggtcgggcaaccacccctactacgtcggcgactccttcggcgctggtcgtcatggacagccagatcgagaagttccgcaaggaagtgggggcacgtcaaggagtactggaccaaggagcagtggctggagatgcaccctgacggcgacccggagtttggaagccggaaggacgacgagacccgcaaatgatggtctgcctctcctactcctcgtcttcctgctgcgtttctcttgctgttcactcccgaactcaattatgctagtttgcgtggcttgattcccccgctgtaccgtcttcacgttgattgatttggttcacggggattgcatttgcattgccctcgaggtgttcgggtaatgttcgcaacgactctagtaatactcctactactttgtcagtatgaaaaaacaaaatctactactgcctcccttcctaaatatttgtctttttagagatttcaaataaatatttgtctttttagagatttcatagacccgggcgcggaaccacggacagggttancccaatttncccctattannnagnccnatttancaatttcacttggccgncngntttaacaaccgtcnntgtacttgggaaaaancctgngggttaccncaacttnattcgcctttgtagnacnattccccttttcccngctggngttaant

SEQ ID NO: 11605 - DNA, 764 bp, Triticum aestivum
  Clone ID: PAT_TA_11605
tgcacccacgcgtccgccaatctcgaaccctagccgcatccctgttccagatcgatctctggtgccggcggcgaaccatggcggtggcggcgctacgcaacctggccgccaagatacggatccccgggcctgccgcccttcgggcttcgcctgcgccgggtcctctggccatctcccactccacaactccaaagagtgatctcgaaaaggctcttctcctaagaaacaatattgaatctgctacatatgtggatcttcactctagtgcagaggtgttaggcaaatattgtgagcacactgaagaaatcatcaaacaatattctgatgtacatgtggaggttggaaacaagatgcgtacacttacgttgaagtatttctttacctgtgtcgcaatctgtttcactgattctatgataagcaacaaagatgaagtcgtccttcaggagcgtcaaggtgaaggcgtggtggttcaggagcgtcaagttgaatgagcgcatatctcttaagttattgccagctctactaagttattactgttttaaggggctatgtatctctgtactcctaacttatggatgctcaacgcagcagggctgcaggggcatgcctgcttgccaggctcggtatgtgcctatatgtggttgcttatgtatgtctgtagtaccttctcatgtagtcatgtatactaggcagcagttatatgtactttgccggcttttatggatttggcagttggaagacattattctattgtaaaaaaaaaa

SEQ ID NO: 11606 - DNA, 954 bp, Triticum aestivum
  unsure (1)..(954): unsure at all n locations
  Clone ID: PAT_TA_11606
tcgacccacgcgtccgagctactgtcgtcactaagccacatgttgaggttgataaggccgactcaaagaggagaaagacccctcctgtggaacgcagtaacttgtcaatagaccgtgtcaggccaactgagattgtgaagccaaagatgacaaaagaggagagagaatccttgggcgactgcttatcttctttggcagagggtccagaagaattacctggtcccatcattgatttgctacagcagtgtatgggacaacaatacagagcagcctggggatggagagatagagattgatatccatgcactcagtgatgacgtactattagaactgaagaagcgtgtggacaagtatttgcaagagagagatcaccagcagacaaaatctgagccctctgagaatgaggctgtgaatgtttctggcctcagtcactcgtccacaaatccctgcaaaggtggtgagcctgttgaggaggatgtggacatttgcggcaatgcatcccctatattgatagagaaggatccacagatcagaactaacaaatgtggcagcccaagtagttccagcagtgactcgggatcttcatccagcgattctgactcaggcagtgacactgaaagcgaacctgaaaaagttggtagcccagcaaagcttgtgaagggtactaaaataccagaacaacctgcagagcaagaaaagagtgatgatgttattagccctattgatgctaaccacactactgctgatgtggaactccgtgaacaggacaatgagtccaaggctgcacctgagggcactgctgctgatgtggaactccatgagcaggacaatgagtcgaaggctgcacctgannnnggagagtgcaaaacctgataggcaagtctccccggacaagctcttacgagcagctgttttgaggggccgctatgctgatgtaattgtgaaagctcgtnn

SEQ ID NO: 11607 - DNA, 2447 bp, Triticum aestivum
  Clone ID: PAT_TA_11607
gcgtccggccgcatctggccccgcaaaacctatctcgaccgccttcctccccgatctcgcccctcctcgcctggcgaccagatccgcttcttcgatatccagatcttcggagcacgccccgctcgccccggccaagtcgtgagttgagtaagggaggcagcagcagcagccatggcggcggcggaggagaacagctcgctcttcctgatattcatcctgaccatgatcgcgctgcccctggtgccgtacacgatcacgcggctgtgccacgcggcgacgaagaaggccaagaccatccactgccgctgctccgggtgccaccgctccggaaagtaccggaagtcgatctacaagaagatatccaacttctcgacgtggagcaaccttactattttgcttctctggatcgttgtgatcttcctgatttactacatcaaactcagcagccgcgaggtccaagtatttgagccatacagcattcttggacttgaaccaggggcatcagaaaatgaaatcaagaaatcatacaggagactctctattcagtaccatcctgataaaaatcccgatcctgaggcccatacatactttgttgaatctatctccaaggcgtatcaggcgttaactgatcctatatctcgtgaaaattatgagaagtatggtcatccagatgggcgccaggggttccaaatgggcatcgctttgcccaagttcttgctgaatatggatggtgcatctggcgggataatgcttctaggaattgtggggctttgcatactcttccccttgatgatagcagttatttatttatcaaggtcatcaaagtatactggaaattatgtcatgcatcaaactctgtccacttattattactttatgaagccatctctagctccaagcaaagtcatggatgtcttcatcaaggctgcagagtatatggagatgccagtacgacgcagtgatgatgagcccctgcagaaattgtttgtagcagttagaagtgagttaaatctagatttgaagaatattagaactgagcaagccaagttctggaagcagcatccatcacttgtaaagatggaactcttgattcaggctcatcttactcgagagtcatttgctttgacaccagcgctagtaaaagattacaggcacatgcttgaacttgcgcctcgtcttttggaagaactagttaagattgcacttctaccgaggagtcccaacggttttggatggctcaggcctgcaattggtgtagttgagctgtctcaaagtataattcaggctgtccctctcagtgctcgaaaagctggtggaggtaattcagaaggaatagcacctttcttgcagctgccacattttactgaagcaactgtcaaaaaaattgcccgcaagaaaatcagggcattccaagaactttgcgatatgtcggaggtggaacgtgccacactgctgacacaggtagctggactttcagaagaagaagctcgggatgtagagcttgtactggagatgattcctactgttgaggtggatattaaatgtcgagactacgacagaagggggcatacaagagggtgatgttgtgacaatgtatgcttgggtctcacttcagcgtcgcagcgggctaactgccgcccttccccatgctcctttctatccgttccacagggaagagaacttctggctgcttctagcggacaccgcgtcaaacgaagtttggttatcccagaaaatcagcttcatggacgaggctaccgccataactgcagcgtcaaaagctatacaagatacccaggaagcattgggagcaagcccaaaggaaataggaattgcagttagggaggcggttgacagagtgaagaaaggcagtaggctggtgatgggcaagttccaagccccatcagagggcaatcacaacctgacgtccttctgcttgtgcgacgcatggataggctgtgacagcaagactagctttaagctgaaggttctgaagcgcagccgcgcgggaacaagaacctatgtgcctgaagaagggccagtggcagaggatggcattgaggaggaagaggaggaggaagaagaggagtatgacgattacgagagcgagtacagtgaggacgacgaagaagaaaagaagaagggaaagggtaaggttgcaaacggagcagcacatcaaagggcaagctctgatatagattcaggcagcgatgattgatactataccttgtgatgttcaaccatagatgattaacatccatgttttttgccatttgacttgtgaaacttagagagaaaacatctcccatcaacttatagagcatgcggtaatagatactggattttttgttttgtttattattcttgcgctgtatgaatggaaccaataattgagaataggctgtgaaatcaaaccggcgggatatcttgggtccccaaaaaaacct

SEQ ID NO: 11608 - DNA, 949 bp, Triticum aestivum
  unsure (1)..(949): unsure at all n locations
  Clone ID: PAT_TA_11608
ttttttttttttttttgtttctgccgccccgaacttcttagattgacaccattctagctcaagcatagttgcacatacattgccaggaagacagacagagctagtacattgggtccataactccatttcactaagcaaccttgcaaatgccgctggaattgcttctggaattgaaatgagactccatcctatctcactgagcaaccttgcaaatgtcctcatactcaatagccttgagaactttcccatcatagaggcccttttcaacctgcagtttggcggcgaatctctctgtgtccactgacagcagccgtgcattcgggccccggctccccccctctacactcccctccaagccctcctggctgtgcgtcggcagtcccaagctcaccccggccgaccccgcggagcatccttgctctcctcctcctcctcctccccctcgtgctcttccccatcatagagacccttctcaacctgcagtttggcagagaatctctccgtgtccactgagagcaacctggcatcggtgccccggcacgccccgttgtccttccgctcccgcccccccttcgccggctcctccgcctccagctcatcttcgtcggccctccgcccgggctccctcgcctgccccgcaacctccccctccttcttggccatcaccctcttcaccaatcccttctgcttgtagtacctcccctcgcccccccacggactcatcaccttgacaacgataccagggcacagccagtagtccttccggttgctccgctccttggccttctcctcctccttcatcagatcatcgatcgccgacctcctggtgtccgttgccttccctgcaactttcgccttcttgttgggcaccacctcctcttcctcctcgaagccaaatttcatctttggcttatcatcaaaaggattaatcttangcggcggcgcancc

SEQ ID NO: 11609 - DNA, 432 bp, Triticum aestivum
  Clone ID: PAT_TA_11609
cgtccgcccacgcgtccgcccacgcgtccggttccaagaactggagttgagctgcatcgatcgatctccgtccacggtcgagcctcgggcgtgccatccatggcagccggctcggcgtttcgcgtggcggtgctcgctgccgtcctgctggtccctttcctcggcccgccggcggtggaggcgcagctcgggcaggtgaggaagtactgcggcagccagttcgccctcgccagccaggcgtgcgccatcctcccgcccaccagcccggagcaccgccaccacgacgacgaggatgatgacgacgaggacgaggacgaggacgaggacgaggatgaggacgacgatgaggacgacaaggggggcggcggcggtggaggcgacaaggggggtggcggcggtggaggcgggggaggaggtgggggcggtggatgt

SEQ ID NO: 11610 - DNA, 1617 bp, Triticum aestivum
  Clone ID: PAT_TA_11610
gcatatgatgcggcggtaacaagagatcgcctccggccgctcctccgtctccgatccgggtggtgactctggctcaaaaaggccaaaatttgatcaggatggattgggcgatattgtcattcaaccacatctatctgatgacaaacctatgcatctagaccaagaatcatcatcatcgttatcttaccaccctcatagagatgctgaggcaagcacatctactagtatgaatcctgctaaagctgaagaaacgggtgcagatcttccgaaaggaatgaatgatatgacaataagcgatgataaagttgatggccgtaataatgataaggaggctgaaggggttaccgttgatggaaatggaacaaaagctggccagatcattgtgacaacaataggaggtcaaaatgggaagccaaagcagaaggtctcatacatggcagaccgcgtcgttgggactggttcggtttggtgtaatatcgcaaaccaaatgcttggaaactgcagaaactgtagaagttaaatagttgctgcaggataagagatataagaacagagagctgcaaacaatgcagttacttgacctccgaaatgtagtgcagctaaagcatcacttcttttcgacaactgagaggggtgaagtgtacctaaaccttgtacttgaatatgtctcggagacagtttatcgtgtggccaactattattgtcggctgaaccagcgtgtacccatactatatgttaagttgtatgcatatcagatgtgccgggcccttgcatatatccatcgtgttgttggtgtatgccatcgagatattaagccgcaaaatctgttggtcaatcctcatacgcatcaacttaagctttgtgattttgggagtgctaaaaaactggtccctggagagccaaacatctcatacatctgctcgcggtattatagggctcctgaactaatatttggagctacagagtacaccacagcaattgatatctggtctgttggttgtgtagtagctgagcttctgattggtcagcctctgtttcctggagaaagtggcgttgatcagttggttgaaattataaagattttgggtaccccaacaagagaagaaatcagatgcatgaacccaaactactccgaattcaagttccctcagataaaagctcatccctggcacaagctttttggtaagcgtatgccacctgaagcagttgatcttgtgtcaaggctacttcagtactcaccaaatctgcgcttcacagctgtcgatgcttgtgcccatccgttcttcgatgaactgcgggatcccaagacctgcttgccaaatggacggccattaccaccattattcaacttctcgggagctgagctagaaggcctccctgttgagctactccaccggatcattcctgaacatatgaggaagtgaagagagatggcggctggagaagcggtcgctatttctcggcgccactgtgcgggtggagaccggacaccgcgagcatatccatggctcgtcgtggatttgatctggagtagactccccggctggcctggactggcctggagctagagaagggcaaccgcgggcatgtgcccagggcccagacccacccacactg

SEQ ID NO: 11611 - DNA, 2357 bp, Triticum aestivum
  Clone ID: PAT_TA_11611
ggttggtatggccctccctggctatgtggctcagcagcagctgggaatgggaaataacgaaatggcgtggttgccactattggctggtgcagctggggcttttggaggatcatatccaccttacattacccttgatccaagcttttactctaggtcttcaggacagacatcgtcgtcagttccatccagggaaggtaacgttaaccatggggctaaatctcctcctcaaaacgatattgtgactgaagagcttgatcagcgccagaacaagcataggagatactcagagatgaacttcagtcagtgaagcaccctgtaaggccctgttgtaggccctttgtgatctctggttatgatctgagcactttgggtggcttggtgtcctaaattatattaggtcttatagatgcctgctcgtgctgtagttatctgatgggggtcgcttctcagcaggccggggggggcatcgggggcgtggagtgtggtgttgcttggtcgaaatgtcttatttgttggtggcatctgaacacatgagccgttgttgaggcgacgtctgaattatgatctgtgttgattgctaaccaaaagcgagaagggcttttagtacattttgttagtgactcgaatttacgtcggtctaccgcggtggtaccgggctccctcgcctacaaccaacaagatctcgcgaaccggccgctcattctgcagcggccagagagcctggccaaatttcaaatgcacattcggaagcagttcctgctaaaaagaatgttgtcaattcaagcttaaattctgcgtcaccaccattttatccctctggtgcctcaaaccaagtgggagctcaaagaagggacatacaaccaggaggttcaaataaggttcatccatcttccatgaagatggatgacaacatgaagctacaatctggtccagtagttagagggaaaggaaccacggactatggtggacgagataggtttcatgccgagggtcctgttagaccatctcctgcaagaagtgtaggaggatcatcatactcatcagggtttgcatcatcatcaatcaattctggtcaatcccctaataacagggctcaagggggaaatgcaagcattggtgttccttcacataatcggcccacaccatcatttcagcaaacttccagggtttctacgcaacagcaaaatcatacctcaattatgcaccagaagtcaggccaagcacctagtcaagcttcaatgagaatcccaactcagcagttgagccatcggacaggcaatgcttcaccaagtgctcagcacctacctgctagatcaactgaaagtgacgagaatggttcatatcctagttcaaatcaatccaagacatctgaggtggaaaaaaccaacaaagaaactggacggggctctttcatgtatggtggagcccaggttattggggctgctggtcttgcccagggcgagcaaaattttcctggcactccagctctcctgccagtgatgcaatttggcggccagcatccaggtgggcttggagttcctactgttggtatggccctccctggctatgtggctcagcagcagctgggaaggggaaataacgaaatggcgtggttgccactattggctggtgcagctggggcttttggaggatcatatccaccttacattacccttgatccaagcttttactctaggtcttcaggacagacgtcgtcgtcagttccatccagggaaggtaatgttaaccatggggctaaatctcctcaaaacgatattgtgactgaagagcttgatcagcgccagaacaagcataggagatactcagagatgaacttcagtcagtgaagcaccctgtaaggtgaatttcatctgaataagctgcttacggccctgttgtaggccctttgtgatctctggttatgatctgagcactttgggtggcttggtgtcctaaattatattaggtcttatagatgcctgctcgtgctgtagttatctgatgggggttgcttcacagcagagcagggggtgcatttgttgcttgagttgtgttttggtgttgcttggtcgaaatgtcttatttgttggtggcatctgaagacatgagcggttgttgaggagaggtttgaataatgatctgtgttgattgataaagaaaggcaagaagggcttttagtacattttgttagtgacttgaatttatgtcagtataactctgatgtacctatctatctatcctccaatagtggtattggcaagagcaagtggctttgttgctgcagtttgtatcttttggagtatgtgggaatgggggtgagatttgtcaaaaaaaaaaaaaaaaaaaactcgagacta

SEQ ID NO: 11612 - DNA, 676 bp, Triticum aestivum
  Clone ID: PAT_TA_11612
attggatgtaattactcaatcttgatagtaattttttgcagggtgtgcttgagctcatctgctggtacagtgattagttcacctgctaccttgatatgcatatttgtctcctccgcaacgtgttgacagaaaaagtacacgcaacaaaatagtactccaagagacgctaagagcaatgaaatcagctgttctcatatgtcattgtggcatgtgtggtcgcaggggtaggggcaatcgatggccctcacttcagcgcggccaaagtaccagtcgctcacagatttcgcgatactcttattgtgaatcgtaggagagccatatgcattccaagtagccgggaccttggactggccgtgcgtgaagcacgagtttatgaagaacccattgcccttggagcgggagaaggcgccttgcacaattcccaccatctgttccctgaaagcttgcaagactttcatctgggatgcgttgcaggctagacgattggacttgcaggctcgccaggcgccgccgtggtcggctacgtccggggccaggctttcatggatctgccatgtatcgtaggctgcattcagcaggaagatcggggtttttatgctgccgattatgttctgcgggaagaagcacgaggtggcgtcgagatggccggtgcaactcctcggcagggtctgcgccg

SEQ ID NO: 11613 - DNA, 1361 bp, Triticum aestivum
  Clone ID: PAT_TA_11613
ttgttccttttttttccttccggttcattgttccgacttttgtccctcgcgtccctcttcgtgcttcagttcgaaacgtatacaatggtaggagtatcacgtaatggtgctttgacaagcaatgtaagtcgtcccaattgcttgcccagcccaattagccacacacaagacacaaccttgcacgctgacactacggcgcacaagtaactaaatactgaaattcgtatcctttcatccattccatatgcactgcagctggaacatctaggacacgaacagagtagaagaatgctataggcagacatgatcggaatctgtcgtagcaaaaccatacagatttctccatgcctccaatcaactagtactatctcgtactaacaatctgaacaagaattcccaaacgaatgcacgcaatccatttcccagatcaacaaatagctgagccaggcaattcctctctgatccactgatccccttctggtagtggtagcgtggaaaactactacgcgagatcttaacccagcgtggatgagagagagccaatgcaccgagcagattagccctcggcgaataccggaatttaagcgctggaagagtggaagatttgcaccagcgacgagtaggtgccgaagacggcgagcacgaggccgagcaccaccaggaggacgtcgctgagaaccccgacccagcccttctcggcgccgaacaccttgatgtgcaaggtggccggcagcacgaagccgagcagcacgcagacgctgctccccacgagggagaggaagtcggtgaaattgggcacaagcatggccgcgagccccacggtgaccacgagcacccaccgcatccaccagcagtagcgctttccgtggaacaggcgctcggcgacctcgtacaccgggttcatcatcaccggcatggtgaagaagaggttgatgcacagccccagctgcacggcggccgacagccacccgctgccgaggttggtggtgatgatgtcgcgcgtggcgtcgccgaacgcgacgtaccccatgacgccgaacagcccgtacatgacagctatgaacgccatggacagcccgagcgtggcgccgaacttcttcttgtccgcggcctccgcctccagcggcaggaccatacagacgccctcgaaggcgtacacggacacgcccgcaccgtagaggagcgcggcgggggcgccgaacgcggcgacgggtgggtgcgcggcgagccaagtcgacacgtcctggccaacaacgacccccatggcgccgaggtcgacgacgtcggcgatggtgccgagcggcgcgcggaccgtgagcgtgcttgatggagttgagcccgagctggaacggcagcatggc

SEQ ID NO: 11614 - DNA, 1553 bp, Triticum aestivum
  unsure (1)..(1553): unsure at all n locations
  Clone ID: PAT_TA_11614
ccatctgaggggccttcgttaacatttgcctcttcctcccttcctccgtacccccctccccctctctctctcccaacgcccgtccatctctccggcgaaaccgatggccgcgagctcaggcgacgagtcccggaggcccaatcccctcccctcggggctcgtgtccaatctgcagtccgtcctcgccgcccgccgcccgcgttttcccgaggacggctgctccatctcggccgaggccgaggcctccattggggagacttgagaagataactttccggatagggtgcctgtacttctgtgcggtgccggcgggatccagtcgacgggtctcttggaagtcgtcgacgccctcgtcaagggcggccgatgcgacgtccacgtctgcgcccctaagtaggcctcaacctgctgctcacttcatgggcatgcatcaaagcctcggtattcagctcgcacagcttgggaaggatgcttctgcagcaggagctgcacgcagaggtaatactcagcggaagagaattgaggttgagtctgttgcagctgcagggaagcaacaagctagagaagtagtgaagaaatctttccgtgccgagttccttgttcaagttgcacaaagatttggatgacgatatcgatgtgagagccttggaaaatggatttatatctgtcactcctctgaatgtgcacggccatgtcgagtctgaactcgaagctccagcgtcagactggctgtcagcagctgtgtctgtatccgaagaaaaggaagctccagcgacctaacaaacacgcagaaatgtacactgtgggtgctttcgtccttgcctcaatctccatctactcttcccttgctttcttggcttgattcttgtctgccttttgcattccatggttgttcagggcagtcattatttttgttggtcttctccgacgattgccgattttcttcgtcatgtaaaatgctttgatgctggagcccctacagtttgcgaagtgatcatgtaggcgactgcaatctactagacaaatactgccactccccactatttttttccagtgtggtttgttccccgagcgcgggggggtgtgaaccggcctttccgtgccgagttcatcgagaagctgcacaaagatttggatgacgatatcgatgtgagagccttggaaaatggatttatatctgtcactcctctgaatgtgcacggccatgtcgagcctgaactccgaagctccagcgtcaagactggctgtcagcagctgtggctgtatcccgaagaaaaggaagctccagcgacctaacagacacgcagaaatgtacactgtaggtgctttagtccttgccttggtgtccatctcctctccccttgctttattgggcttgatccttgtctgtcctttgcattccatgcttcctcagtgcagtctttattttggttgggcctctccaaacagttgccgattttcctcgtcatgtaaaatgatttgatgctgggagccctacagtttcgaagtgatcatgtaagcgaccgcatctactnacaatacgcactcccact

SEQ ID NO: 11615 - DNA, 1332 bp, Triticum aestivum
  unsure (1)..(1332): unsure at all n locations
  Clone ID: PAT_TA_11615
gagaagcgcgcgccctttccgatgcccgccacgtcgtcgtctccgctctctcttgtcctcctccggccgctcccatgcagatccctcctcctctccaagcacgggaggccatttcccaccccaagaaccggccgcctggcagcgtcagccgcagcaggagctcagcagcggttgctgcggccgccggagtccggccgctggagcaggagctcgaggagcggcagagacttcgcgtgcttatcctacaacaacccgcccccgccttccagtaaggattcgaacgaagtggcccgtccttcgccggtgggatgtgccatgggagcgtccgcggacgcgtgggcggacgcgtgggcggacgcgtgggtttgctctgacaggattggttgagcagtcgatactgcaatatgtagggttttcagccgcgggggcaactatagatgagaaggcagaaatactgttcctcggacaacttagcgtgactgctgttgtgcttggtgttatatttagcatcaccaataccttccgaccattccctgatgatgtcttccgttacgatgtcaaagaaccattcaagctgcaaaatggctggcttctatgggctggtattggcctctttggtgcagtcatttccattgctttagttggagctgccatgacctatctgaatggtgcacctccagagagagagaaggactcgctggtccctttactgccactaattggctcatcaactctcagcactgcctatttggtggggattactggagttctagcccccattcttggaggagactgtgttccgaggatttctaatggtgccctggactaagtggttccctactccagtctngcgtgattctcagtgctgctgtatttcccttcgcccatttgacacctgatcaattcccaccactgtttgtactttggtgttgcactggggtttacatatgctcaaactcgcaatcttcttagctcctattaccaatacatgcattttggaactcggggagttatactactgctaacctttcttcagttgcaagggtacgatatcaaggagctattgggggcgtcttgaagtctttataaccgtccggattttagctttgtgcatatccttgagtaacttctgcaaaaagatctggaagaacaatgagctttcctttattcgactgcttagtgtatgatcttactgggtaaggcacgcaatgtatggtctacaagatgtcttacaaaatatgattatgtatggttctttccatactactgccaatcttcgtggtggaaaatgtccaatcatacaaatatacaatacggttattgctataagaa

SEQ ID NO: 11616 - DNA, 1164 bp, Triticum aestivum
  Clone ID: PAT_TA_11616
gccacgcccccactgccggccgtcaccgaatccacccttgctcgctaggccaccagcctcgcaaaaaaatcaccatttggactttgaacatgatggatggtaactccaggttcaagtgggagccacatcgtgtgatctacctggatggtcttttgccaaatcctcaccgtcttcccgagttccctatcatcagcgcagatgacccggatgttctgtgctgcctcttaaggaaggaggaatttcatggtgaggcctccatggtcatgattgacatggagcatgcacgtctgcggtcgtctactccatatatcaatcgacagtctgtggatgagaaggctcacaaaaacgagtttcttgatatgcccctacttccaactgtcttctccaaacacattgaaaggccaacagggatgccatgggacaaccacaagcttgcaactcgtccttcaaagaagcttaagtctgcaatgtgaagacctggaatctcgtgactggtgttgaacactttgcggatgctcaaatcgtagttgatgtttgtcaatggtgcggtgcaggcacaaccaagtcaggcaagatatgacattgatgtgatgaagatgacgcactgatgagtatctattacaataaatgatacatgttcttgatcctgtaattgcatgtttaattaagagcctgtctgttttaagtttgaggttgaacatctggtcttgcagtctctctgtatgtttgtgattgaacatctcattctttcagcgtcgacagatctgaaattgagctactaatatcgtgaagccgacgccgtcctgcctcccgactccagtcactaaaaaacgtgaaagatcaactgggtgcccgtgggactatgacccggtcgcttctcggcctgcggtggaacttcggtccgcgccgtctcaagacctggagtctggtgactggtgttgaacatttcgggtatgctcatattgaaaatgatgtttgtcagtggtctggtacagttagaaccaagtcacgcaaaatatggcattgatgtgatgaagatgatgcactgatgttatctatttgagtgaacgatgcatgttcctgtaatcgtatgtctaattaagagccagtatgttttaagatcctatattcctatgattaattaagaatctgtctttatttaca

SEQ ID NO: 11617 - DNA, 583 bp, Triticum aestivum
  Clone ID: PAT_TA_11617
cgtccgcggacgcgtgggcggacgcgtgcgtccggcgaaggaaggaaggaaaggaaagcaaacccagcaatgggtgatgcaacaaccaagtgttctgctggagaagagaatgacagaatcaagtatgctacgtcatctatgaaaggatttcgtgatgaaatggaagatgccctcacagctgtcctagatctagatggttacagttccacatcattctttggtgtttatgatggccatggaggagctgatgtagcattgtattgttcaaggcaatttcatattgagctcaccagggaaccagactatggcaacaatctgcgtaccgcactggagcatgtgtatttcagaattgataagaagttgaaacgatcggatgaatggaaaagggagccagctcatcctcctgttagtagaactttgaaaaacttgctcagggctgctctttgtgaggaacgttatgttccccccctacaggaaggaaccacagcatgtgtggctctcattagaggtaaccagattattgttggaaatattggtgattcccgttgtgcacctctcaaggaatggtcaggcaaatgatcta

SEQ ID NO: 11618 - DNA, 459 bp, Triticum aestivum
  unsure (1)..(459): unsure at all n locations
  Clone ID: PAT_TA_11618
acctgttaagatgcgtcaagcacacaaacaatcgtacaagaaatcggacatgctaccatgtaaaggagatcaatagtgatacatacagatgcaagaatcaatcggaaccaggcaggcctcttgccctctcattctacgtgtgaactaaacaaacaaaccatacaataaattacaaacagatggtgagctgggaaaaagggacgaaaatgggcaaagctctaaaaaaaaaaagggaggtcgtcgccggagggaaatgcacaactatttacacctcttcttcgtcttctgtcacacgagcaaaggtcaccgttcagtgggagtaggagctcggctcgtcgccgccggacgccgggtcgntggagccgaaaacgggcttttcctnctcccacttgacgatntcccggccgtagcggatngccgagcagacanactgttggtccagggcgttnacgtaggaca

SEQ ID NO: 11619 - DNA, 725 bp, Triticum aestivum
  unsure (1)..(725): unsure at all n locations
  Clone ID: PAT_TA_11619
atatncgttaaatctgttnaaacggcccaacatcaaccgtttcacatagtaacagaaaagcagccgatgtgatgtcttaatttcgttttaacagctcctgcttcttttgtgatggtactggagactgcaacagaatgagcaactggaacaaatgttgcttactaagattcttaccttctgaaagactgaaactacataacagaaaataggcgctaagaagtagcacaccattgactcagattcctcacaaaggcacccgcattccacaggctaatatcgcccataggtcctccctaaatcgtcatgtctgtcatgctgaaactcgccataagcaacgtgacgccttggagcagaatagttatcagtaggatatggatatgtgttctttgaatcaataggtggaccagtagcagcataatgtgcagttctctgatcaaaatcgctatacccagtttgggcgtatgaggtctgctgagcttgctgttgccttttaaaactttgttcaagaaattcatcccacttccttgcttgcatactcctcgtgaccgacacactctttatgtggttctccctcatttctctaagtgactcgcgatgcttagagttctcttcatcctcctcctggtcacgggctctagctaattccattgcttctcttttgaactcaatttcaagctcttccaaagtttgtggataggaagggaggtcaaacttaangtctagat

SEQ ID NO: 11620 - DNA, 1105 bp, Triticum aestivum
  unsure (1)..(1105): unsure at all n locations
  Clone ID: PAT_TA_11620
gccccgtcctccgccccgccctgccgcgcctcttcctgcgtccgcctgccgtacaccgcctagccggacgcctcggccgccgccaggagctccaacctgcacgccgcctccccgccgaacctcgccaactgcctgcttcctcagccgccaggagcccggctcctgagctccaccgccgtctccagcaggcagcgagaaggatatagatggaccaggaggtcaaggagtcaaagccctccggcgagccaaacctgttcctgcaatggggcagccggaagcggctccgatgcgtcaagtcccgggaagacggctcgccgtcgccggcccggtcggatgcgctcaggcgcaccataccccgggctgaatcgcccccttctgggaggcgatgtctcacagtttcgttcaccacgccgacccaagcactcttccacccgaggaaatccgaggcacaggcgagtgaggccaggcagtccatatccctctcaccagagaaggaccggtactactccaccaggggttccccatttccctttgaggggaatgggtttgatttcagcggtggggtggaagagaagggcaccgctgctctgccgaggttcttcatctccttgtcgaacaaggagaaagaggaggacttcttggcaatgaagggctgcaagctccctcagaggccgaagaagaggcccaagctgatgcagaagtgcttgcttacggtgtgcccaggagcatggctgtcagatttgtcgcacgagaggtatgaagttagagagaagaagagctccaagaagagggcgaggggactgaaggcgctgtgcatggagagcgattcggagtagaggcagaagcaggatggattcattttttgacttgtgctcgaggcagagaagccgcacctaggtagcaacggcggcggttcttctaactaggcaatgctcagcaagcagctaatttagtgcccgttccccttctcctccttattcatcatcatcccctgtttaatctccatgatcctttcgtctaattgtctgttcatcagaactctgaagagattgttcgtctggaaccatgaagcaaaatagggtagtaatatattagnatcgtcatc

SEQ ID NO: 11621 - DNA, 674 bp, Triticum aestivum
  Clone ID: PAT_TA_11621
tctattttggaaccgagggggtagtccattacagtacgaacatacaatatgtgtcccactcaatgtgccaccgctactgctaacaactaaagagaaaagaaagaaaaatgataaaaataactaaataaggaaatgtctactgtatatgatctgcattcagggatcaggccctagagctcagcaattctctctaacaaacgaaaacgataaacaataacaaaaaataatcatagaacgatactgaggttcctctgcatttcctaatgcttgcagtactgcaaggttctaatctcaactatgccctgtagataaacatttctttccaatggtccacgcaagctgttgccagaagtgagaagtatcaataaccaacttcagcgatgaggcttatgaggaatgctcttcagttgaactgatgtcacgcccatgctgcatctcaagcaacttctgttcctcctcatcattctcttccttcggctcaacatttggtgcattgggctttgtggtggattgctggtacagaacaccaccaggcatgcagatcaacagcccaattgttcccacaagggatgaaggcggggcccggaccagcagcccaatcgcgcctgtgacggccttgggcgcgttacccgcggccgggaatcctggtgccgcgatcgcccggctgcaggaga

SEQ ID NO: 11622 - DNA, 878 bp, Triticum aestivum
  Clone ID: PAT_TA_11622
attcggcacgagggttcgacctccttttcttcctcccggcgtcgacgtcagacgaatcgccccaatttaccaaaccagtactcctcgccgctccgatccgccaaattctccactcgctcaaaccctagaagctatcccctgccggcgaaccacagagctccaatcggagaagcggccgatcagggccatctactgctatttctagcgccggatttgggttcggcgcgatgtcttgggccgggcccgacgagatcctcctctccacctccctggccggcttcttggataaaaaactgattgtcctactacgagatggacgaaagctgcttggcaccctctgctcattcgatcagtttgcaaatgttgttcttcagggtgcttgtgaacgagtaattgtgggcgaattatattgtgatgttcctcttggtttatatgtgatccggggagagaatgttgtattaattggagaactggatcgtgagaaggacgaactccctagtcacatgacttgtgtttcagaggctgaaataagaacggccgagaaagctgaaaaggaagcaagggatctgaaaggcacaatgaggaagaggatggagttcctagacttcgattagcgtccatccattagtcagtcatgttgattgatagttggtgctccctttgtggccgctggtttttaatggcggcatttgctatgtttgtgggcaatggaagctcctgattgcactgtgtcttatacttgttcagccctaatgatgctctggaccgaggggctcttcctcagtagcaatgtaccagccctgtattcttatcttctgttgcagtttgtttctctttaaaaaacctcggccgcgaccacgctaatcactagtgaattc

SEQ ID NO: 11623 - DNA, 610 bp, Triticum aestivum
  unsure (1)..(610): unsure at all n locations
  Clone ID: PAT_TA_11623
gcgctagcgtccattatagcacatatacacactaacacgcatgatgccaacataataagacagctgttttaccgacacgagaaagtttggtatattgcgactacgattggtttgattgctcactggtggctaagttcaccatgtcagtctggttcgtgttctcagaggatagcaggtctgaactcgacagtaacacctcattcagacacttctacacattaccgccatatgaattttgcaaaggtttccttgcttcgatatatttcatgatgggaaggcccaaactgatgatgtcaagaactgccagtgttcttatgccaaaaggatttgaaaggcaactgcgaaagccacgactcggcgcgtggagatctaccggactgagaagcatttgcgccagcagcagcatcttgccagaacttgagaacataaaggctctcctcgtcagtacacctcttcaacagaacacgcgatgcaaaccccttctcgttcatcaaatggcatatgcccaaaggatcattatcttcaagggcaatcatgtagagacatcctttttctgacagcagctcgcgcacagcaagaagaaccggccgntnacttggcgcccatcaac

SEQ ID NO: 11624 - DNA, 1132 bp, Triticum aestivum
  Clone ID: PAT_TA_11624
ccacgaggacgcgtccgcgccgcccggccgggcggtgcgacggcgccggacgcgtcgccggccggcggcgggcggctcggcgcccaggcggggccacccgttcacctggctcgacgtcgccttctcggagccctactaggccctctcggtcatcgactacttctcccacctcaccgccctcatcacggcgcccgcggccgaggacgacgcggacctggacagccgcctcgtccagctggagatccaggcggtccgcgtgttcctcgtggccgtcacagtgatcattgtgaaggacgaactgtgggtagtattcttcgctgattattagcggttgactgtcggctacttgctgggagttatcgttatatttgctattgctcagcagcctccttatgatggcctaggtcttgtaaatcatttgacgccgttgcaactggatagcctgctaactgaagaaccaacaacacgattttggctggttgagttccggacttcctttttaacaccatgtatacaagcaagcagtgtcatgcctgaactctctaacttatactccaacaagaacatttcttttggattagttgatctagggcattttccaaatgctgcagcgaggtttggaatatccatgtgggatcatcttcccacttatatactgtttgacaaggcgactgaagttgctcggctcccagaaatcggaaacggaacaaaagtattcgtgccaaaagttaccaagaagcttctctgccatcactttgatcttgacaggagactgattgaattcctgtcgacctagttgatccatcgtctatcccaggtgtctcgaattgaaggtgacaattcggacgagataaatggaccagacagttgtgtggaaacgattacttcaggggagcatcttcaagaagcttgttttattcgatgggtttggttgcgcccatccaatccaaggccagtatactttgtggcgacaaatatgttttcgcatcttactacgatctgtcacttcttgaattctggaacgttactgccactgtacagatcttgtaatgattcaccgaccatgctttgcactgcagtagtggtcaatccagacaccattcgtttccccagaaaagcaaaaaaaaaaaaa

SEQ ID NO: 11625 - DNA, 2664 bp, Triticum aestivum
  unsure (1)..(2664): unsure at all n locations
  Clone ID: PAT_TA_11625
cctcgcgtccgcccgcgcgggggcacccgggccccatgggcccgcgcccgcgctgcagcctatgcttcccagacaagaacgaagcctttgttgctggtatcagtggaatagaatgggatgccgtagagttaccctctcagttcatggaaaactggtgctaccacaacgaatactcttttaagcattgcaaagcattatgaaaccggtgaacctcttccccgcgccgcccctgctgcccccgcgcccgccccgcccctccgtcctgctccgcctactccaccgccgttacgttcgccaagtgggaagataccagcagcaacccgctactcgccgacttcgacttcccgcccttcgaccgcttcgagcccgcgcacgtccgccccgggatccgtgcgctcctcgcccgcctcgagggcgagctggagtagctggagaagggcgtggagccggcgtgggagaagctcgtccacccgctcgagcgcatcgtcgacaggctcgacgtcgtctggaacggcttcgaccaccacgcggttcgagaaggactccgccgacctccgcgccgccgtggaggacgtgcagcccgagaaagtgaaattctacctgaggctggggcagagcaagcccatctacgaggccttcaacgccctcaggaaggcatccgtctgggacagccctgctgaggcccaaaggcgtgttacctgtggccgcatagggggtgcggtccctccttttgttgcgctcaagtttgccgcaccagctttaaggaatttttatttccatgtgaagtcgatgaaacagtactgttgttgtaattaaattaaaagtagttattttcagtcagtggactattcaatcaccattaattaacaaatcgactggtttacctgcctcagtctcttgggcttagcagcacagagcggctgtttgtcacagggtcatgaaaatgcttcagctgaaaatggaccttggatgatcacactagacgcaccaagcttcatggctgtcatgcaacatgccaagaacagggctctccgtgaagaagtatatcgcgcttatctaacccgtgcatcaagcggcgatcttgataacaccgatatcataagtcagattctgaagttgaggctagagaaggctaaactacttggctacaagaactttgctgaggtaagcatggctcggaaaatggcaactgttgaccgggtgcaagagcttcttgagaaaatccgtgctgcttcctgggatcatgctgtccaagatatggaagacctaaaagcctttgtgaaagattctggttctgcagaagccaatgatctagcacactgggatcttaacttctggagtgaacgactgcgggaatctaaatatgacatcgatgaggaaggactgcgtccttactttgcactgcccaaggttatggatggcctcttcagtcttgcgaataagctctttggaataaccgttgaagctgcagatggattggctcctgtttggaacagtgacgtcaaattttattgtgtcaaagattcttccaatagccccgttgcttatttttacttcgacccatactcaagaccatctgaaaagcgtggtggggcttggatgaatgtcgtcttttctcgtagtagtgtgctagctcgccatgggtcttctgtaaggctgcctgttgcccatatggtgtgtaatcagatgccaccagttggcgataagcccagtcttatgacctttcgtgaggttgaaaccgtgttccatgaatttggtcacgcgctgcagcatatgcttaccagacaagatgaagcctttgttgctggtatcagtggaatagaatgggatgccgtagagttaccctctcagttcatggaaaactggtgctatcacaagaatactcttttgagcattgcaaagcattatgaaaccggtgaacctcttccagaggaaatctatgctaagcttgtggctgcaaagaatttccgtgctggcaccttcagtctccgtcagatacgttttgcaagtggatatggaactgcatacaacttatgatccaagtggaccagtgtccgtgtatgatgttgaccgaagggttgcagaaaaaacccaggttctcgctcctctgccagaggacagattcctgtgtggattcagccacatttttgcaggtggctatgcagctggatactacagttacaagtgggctgaagtactatcagctgatgcattctcagcatttgaagatgttggtctggataatgagaaggcaattgaggagaccggcagacgtttcagagaaacggttcttgcacttggaggtggaaaatctcctctcgaggttttcgttgctttcagaggacgggagccgtcgccggagccactgctcaggcacaacggcctgctacctgtcgccgcatagggtgtcgatcgctcctttttttctttttcattcgccgcaccaacttttaggagtttttatttccatgtgaagtctgaaacaatactgttgttgtaattaaattaaaagtagttattttcaatcaccattagtttgcgtatgagcttgtgggctaaatacaaagagaaaaagttaagctttgtaaaacttggcaaataaagcacgttgggttcattttcccgggcgggggccccggtacccnaatcccccctaataggttg

SEQ ID NO: 11626 - DNA, 1325 bp, Triticum aestivum
  unsure (1)..(1325): unsure at all n locations
  Clone ID: PAT_TA_11626
acacatgggagccctcacttgcacagactacaaatttacactctggagctacagaagctgagatctggcttctggtattgctgaacccctttaaaaatttgtgaacaagcccatagccattaacaacacggattcttgaatctgcagaagtggtcaggacttgccaggagcttccttgagcaaacagttgtatcnnataaatggcagcttcccttgtgagatcccaccaggccaccattgcaacctgtccatcagggggaataacatcgcagtggtaaccaactcatgcagatcattccagtcttcaaccatangcaactattagtagtgttatttaccagtttaccgaccatgatattctgttttgatatccaatttgcaggccctaaccatagttaatcacacaaagacagccacatggactatctttacatctgcagcctgaggatcaactaatagtgctattcagcagtttacaaagtacgaaaatggttacacaatggacatatcaaattgcatgtcgcaacagattcactactaagtactaacacaaatgaagtggatcttacagcagtccaaaaactgaagaacacaacagccaggccttcggttcaatcggcagtatgcagtgtattgttgcatgctgaagcctattgcccagttagtgtagcccaagtgacaccaggtggaatgtaatattttccatatagcacgtggcttaattttagtcgttttgatgatcacaatccttacagccgcactagacaccatcaaaactaaaaattactgcttgctgtgtatggtacagaacatacactggtatgggttttcgctatgggagcccctcctgtatgtacaacaacgggctcagggttcttggctgttcacccgatgatgaagctcgagcatttcctggtggttggggtccacggaaagtgctgcgcggcagtcccggagggcgcctgagatgtcacccacgtgctcgtggaaggccgcacgcagatggagcaggttcaggtccgccttaaaggcaattgccttagtcagctctgagatggcatctttctccttgtggttgtccatcagaacagcggcacggtatctgtaggggtagacccggagggggtcaagtttggtgaccatctgcagatcagctttagttagatcccggtcacaatactcagacctcttctcgtacgctgatgcattgctcctggccttctctatcagcttggtcatttcctcgaatgcaccggtcctgttattcctaaggaaatgaaccctggcaaggccttgatgagctctcgtgtggccaatctttaaag

SEQ ID NO: 11627 - DNA, 1182 bp, Triticum aestivum
  Clone ID: PAT_TA_11627
ggcacgagcctccctccgctcccctcccctcccctgcaagtcacgactcacgcgtctcccacctcgccggcgccggccgcctcactccgccttcgccgccgccgccatgagcgccctccaggcctccctcctcctccgccctctcccctcgcccctgccccctcgtcggcgtccgccaccagcccccgcctccgtctccttccctcgctcctgccaccaccgccgccccccgctccccctccgcgcattggcctccgacggcccccagcctcccccctctccggcccccgagccgcccgcggcggctgcggcggcggtcgctccggaggcggaggtcgacacgggccccgctgcccaggacgggaaggaggagctggaggacctggtggataaggctagggtttgggccgtggctttcgcggccgcggtggtcgaggtggccaagaggtttttcgactgggtggtgtctggcgattggatgagctggtggccgttctggcgccccgaccgccgcttgcagcggttgatcgatgacgccgacgctcaccccaaggaccctgccaagcagagcgcgctgctccacgagctcaacaagtttagcccagaagatgtcatcaaaagaatcgagcaaagaagtcatgcggttgatagcaagggggttgcagagtaccttcgagctcttattctcacaaacgctatagctgattacctaccagatgagcggtctgggcgttcagcaacactaccagccctccgcggacgcgtggggcaacgtgtatctggggaggacaagcctttctcgaatcctgggatatctgacaagcaaccattacatgtagtaatggttgatcctaaagctactggtagatcaactcggtttgctcaagagattttctcgactatcttgttcacagttgctgttggatttatgtgggtaatgggtgctgctgcgcttcaaaagtatattggtagcctaggtggaataggcgcatcaggtgtcggttccagttcatcatattctgcaaaagagttgaataaggatataacgcctgagaagaatgtgaagacatttaaagatgtcaaaggctgtgatgatgcaaagaaagaacttgaggaggttgttgagtatttaaggaatcctatgaagtttacttcgcctcggtgggaaagttaccaaagggg

SEQ ID NO: 11628 - DNA, 715 bp, Triticum aestivum
  unsure (1)..(715): unsure at all n locations
  Clone ID: PAT_TA_11628
gtttgggaacnagcccttnaaaaccaactaagatagtaagatacaccaaagtggtactccctctgcaaagagagggtagtatataagctaagaacgatacagcaggttggagagccaaaaacactcactggactggggtaggcgctaacaagaacatttctttctgttggcaaacatccaacaccactacttgctagcacaattctaattctaacagggaacggccactttggattcagccttctcaccgtgtgccctcaggtttttcttcgactcaactcgagtcaagggaggcaaaataaaggttacggcgcattgtctcacaccggctgatttgaacagccaatcctttcatctgcttctaacatccatcacaagtgccactccataagataagagcaggctggcacagcaagggcttccagctccatcgcacggggcacggcagtcaaggcagccccagcccatgcattctcggaatttcattcatctccagctcttcttacttgggttttcgggcccgcgccattgggcatctcaacaccagggagccgcaacgcatgtgcaaacatccttttagccgctccagtctgttctttctttgagcgtctcggcgctaacagtaggtgtaggacggcttcgagcagatgggttccgacacggaccactaccaggtgagcttgagttgtgtttccctgcttctttactcgtggga

SEQ ID NO: 11629 - DNA, 955 bp, Triticum aestivum
  unsure (1)..(955): unsure at all n locations
  Clone ID: PAT_TA_11629
cgtccgcccacgcgtccgggcgagatcatgctgtcggtgtggctcgggacccaggccgatgaggcgtttccggaggcttggcattccgatgcgcatggggcggctggtccgtcggccgtcgcctccacgcgcgccaaggtatacttctcgcccaagctcgtgtacctccgcgtcgccgccatcggggcgcaggacctcgtgccccacgacacgtcgcgccccatgaacgcctccgtcaagctgcagctcgccgggcaggtgcggcgcacgcgcccgggcgggccgccggggacgcccaacccgatgtggaacgaggagttcatgtttgtcgcgtcggagcccttcgacgagcccttgctcgtcaccgtggaggaccgcgtcgggccaggccgtgacgagccgctcgggcgcattatgctgcccctcaatgccgcaatgccgcgccatgaccacttcggcaagcccgtggagccgcgctggtacagccttgcgcgccccagcgacgacggcgagaagaaggagggcaagttcgcgagcaagatacagcttcggatgtcgctggactttgggtaccatgttcttgacgagtcgacttactacagcagcgatctccagccatcatcaaagcacacccggaagccgagcattgggatccttgaggtgggggttctgggtgctcgcaacttgattcccatgaaggccaaggatggtcgcagcaccgacgcttactgcgttgccaagtatggtccgaaatgggtgcgcacaagaaccatcatgaacacgctgaatccgcaatggaatgagcagtatacctgggaggtgttcgatccttgcaccgtgatcacggtgctggtgtttgacaatagccagattgggagcaagaatggcgatgcccgggatgaaagcattggcanccccagaattcgtctctcgacactggagactgaccgggtgt

SEQ ID NO: 11630 - DNA, 621 bp, Triticum aestivum
  Clone ID: PAT_TA_11630
ttcggattgggctatataatctaacacgcgcgcacacacacctggaaacgccttgaagaaacttgaccaagaacgaccagaaaatagacagagcactatgccaaatccctcaacagaatttataagtgaagacgggtataaagtttatgaaaccatccaccaggcaccaacaagaatagacaccaggactaagatggtcaagatactagcaccagccttgtcgccagtggtgacagtatcgaacttgatgggtgtatcagatgaagtgtcaccggcgtcaggattgctcttggagataccacccttttccgccgtcgcaggaccgctgactgacggatacagcagcgattgtacaacctccagagccgccatctgttcgccaacaccaaagctgccatcgttgacaccgttggtggtccacttgagcccacacgaagtctggttagcacctccggtgcactgcttagcagcagcctgagccgatgtctgaagataaggattgatttggtcactggtccaaggtgcaacgctagctgtgtatgccatggaacgtgcaaggtaagccttgaaagagcgctggtccacatcgcacttgccgttgttttcacaggcgacttcgga

SEQ ID NO: 11631 - DNA, 619 bp, Triticum aestivum
  Clone ID: PAT_TA_11631
tgttggatttcttttgttgatattagcatataggcaaattacatgagtgagacaaaaaaaagacgtacggactatgacctctcttaagaggatccatatatgcataagagcgccactgcaggtctaaggaacatacctacccctatacagagtgttacttgcgctggttcgaagcaagcttggcaatgaactccttcacaacccagggataggtcactgctatatgatcccagccactagttgccattactgtttgcaagcatgagggagactgcacttggataaacttcaagcacgcctccttcaatccacagcagtggtgcttctcagctagagcaagagtggacgtcaccgagctgacacttatgtgctcagacaactgcttttcgcagattaacttgagcatttggagatcgtatctgtctgccgccacaaacaaatcttccaaccattgcagccacatttcaaactctgctgcttcttctcgcccttcgtccataacttctgacatttcatcctccatgctgtccttctccatggcagggagtgaatctgtgtagatgaagcttagcaaagccctgaacacttttgcttccatgtctttgatctgtatgacgct

SEQ ID NO: 11632 - DNA, 733 bp, Triticum aestivum
  unsure (1)..(733): unsure at all n locations
  Clone ID: PAT_TA_11632
tttctttntttttcctttgtgtccgccaatgcactcactgttacatcgtcttacaagaatcaacatataatattataacctgctcttggttacaggaattactgcacctaacatgtccgactaaacaacactcaaaagctcaatgtccacacaagaacaaaatgtttatatatccgataaagattacagactcgggttctcgccggagcaaactcacgtacccaatgaaggttacagattgaggaggggccttcctcatggaaatcggctaattataggaatcacctgtgcatgcctcttggcgtaaatcagcgacacatctcttcactttcacattataggaatgagcttggctgggcagcacagttgattgtgtcggcgaccttcagtgaagcttttatggctttggacacattcttttgttggaattgcctcttcaaagaatatgtagaaaaaatcaacacaccggtgaggggggaaatgatgcacgcaaacttcttttactctgcgtactcgaattcaggatccatatctaatttcctttttagacgcgacttgtcagcactattcaatgttggtcgaggagctggtcgtgtgccaaacacaactccaacatcaactgacattggtattctagaactctgactggacatgccctcgctgcgcctcatgcctgtagtaggatgctcttctgctttctctgctcgatgagcattgattttcatcccatcag

SEQ ID NO: 11633 - DNA, 753 bp, Triticum aestivum
  unsure (1)..(753): unsure at all n locations
  Clone ID: PAT_TA_11633
atctggtttnactactgatttgtttgttgtctttcctttccttcggttttagaggcaaaagtagtatacaaaaagaagaaatacatcatagcaggtccagagatacaacaaagcacatcccctattttccaaaaaggtcatatgaaattgcataggaactctttcatccgatcgatgtagggtggccgggtaggaatgatatgccccatgtcatgctcaacgatggtgcaccggccctcctcaaacatgccagcaagttcagtgcttgccctgcttgcgatctgcctgtcatgaccttcaccgccaccgaagcaatggagcgaggggagcctgattggctctctgtcaaaatcgccaacaggtgctggatatccagagcagaatatcccaaacctgaactttggagatccgcaagtcttctgctgctgcctgcacagtaaggcagccattgctgcaccctgggagaaaccgagaacgccatcaaagttgccgtcctgagcaattatactttcaaggtatgcatatgattccttgaacccgtctgtttgttcctggtactgaagggggtcaaacggtgcatctgcaaccttccaatcttgcatggtgtggcagctcatgttcggagaaactagccatgcggattttgtttttgctgtgccagatggaggtgaggggtttgtcggagcagacatctggatgtggtcggtatacaaatgaaagcttgtgtggagcgtctataaagacaagctccgc

SEQ ID NO: 11634 - DNA, 1227 bp, Triticum aestivum
  unsure (1)..(1227): unsure at all n locations
  Clone ID: PAT_TA_11634
tctccataagcagctgttgggacagggatgagattgtgttcaatagcatcgacgggtctcggctacggccggtgccagcgtttggcaactgggtgccgtgcctcgtcccgcacgcgctcagcgcgcgactgctccggcgtctagccggggtccggccgacatcagatggtactgctagtgtaaccgatgatgttctggagaagatcgtgaagcagtttcgtcgcctcaagttcatgtccctgcgtggatgcatggaggtcactcgtctccttgattcattggctgccatgactcagctggagactttggatgccaggcacacctccatagtcgagctgccacctgctatcatcaccaagctacacaagcttcagtacattcgtgctggcaccaccaaagcaagacgactacaagcagcaacaagagcagcagcagcaatgccaccaccaccaccaccaccaccaccaacaacaacaacaacaatacaagcaggcgacctccatagtggaaggagctcctttgtaggagtcaaagcagcagcagcattaggtgtggtccaacgagcatcatctagaattactggagcattgaagaatagggtgcatgctttggtggaatccagcagcagcagtagctggtgggagtcgaagaaacagcgcaggcgtcgcgttcgtgttgctgcaaatggtgacggtgttgagattgttcgtgccgccgccgaggggattgggaagctgacggagttgcatacactcggtgttgtgaatattgcaggtgggaaagacagtctcctactcctcaaggagctcgagaatcttacccagctgcgcaagctcgggttgaccggcatcaacagtaaaaactggaaggagttgtgcgatgccatctccggtcacctccctcatctcgagtccttgtcactgcaactgctggtgctgcaggagaatgccggcagctatgagtttgcttgttttgaccgcatctccgtgctgcccaagaccctgaagcgccttaaggtactgtacactagtagtcgtacagtgttgcatgcataaggcaaacatggaccaggcttcccgtccgtattttccaacatgagtggagggatcaactgggaggnatagnatttattanccggatatttacaaccngacgcctcattcaancggtagagactccaaattggcagtgcacactgatggtcnagtgagactgtcacacccagtt

SEQ ID NO: 11635 - DNA, 626 bp, Triticum aestivum
  Clone ID: PAT_TA_11635
tgaaccagtgccggaaaagttctcgctggatgatatccaggaggtctcacaggaagaggatgtgatcgaaactcaggaggactatgaggatatttataataagttgggggattataaattccggcatgaggaggtggaagcttcacgtccgcggacgcgtgggcgggtaatgggacatccccgggttgttgaggggtctgtgaggaagaaggagagcagcagaaagaagcagcgcaagagcaaagaggaacggcttgcgcgagccaagcaggagcaggcagaggagctgaagcatctcaagaatttgaagaagaaagagattgctgagaagcttgagaagatccggatgattgctggaattgaaggggaagctgcctgtaagcttggtgcagatgacttggaggaagattttgatccagaggattatgacaggaaaatgcaggagatgtttgatgacagctactatggtgctgatgaggttgatcctgggtttggaagtggagatgatttggatttggtcaaacctgattttgacaaggaagatgaattgcttgggctacccaaagattgggctcttgatggtaaagaagggtctactgccactggtgagaagaagaaaaaaaaaa

SEQ ID NO: 11636 - DNA, 886 bp, Triticum aestivum
  Clone ID: PAT_TA_11636
cccacctcaccccgcgcccttaccgacacaaacctgcggcgaggtccctgcccgcgcttcctcttacacggggggccctacacttctccggccacgccaccgggtccttcttgcctcggcccgccggagatggcgtccgagctcacgtaccgcggcggggcggcgtccccgtccgcgggcgccgccggggccgccggcgagtactcgtccgcgaagcccgcctgctccaagccgctcgcgtggctgccccgcgccgcccgctacgccgcggccgagcaccgcccgctcttcgccctcgacggcatgcttgcgactggttccgcgcttgtagtgtaacgccatccgtctggcgatgtggcaagagggccctacagcaggacaatgaaggaacaagaacaggagcgctcaatgtccaggcggctgcgcggcatgaggttgctgtaggagcatgttcgtcgactgtgtacgtggaatcatgctatgcctgttgccaaagggaggtcactagaaatccggatttcgactggtatgcttgcattcgcagttgccacgactaagatgctctcccaatcaaggagcgagagaacaagaaggccggcgaagtagtcgtttgttgtgagcttatactagctcgtttcctttccaaacaaataatgtgcggtgcagtgaatccgtcacagtccatctgtttgctttagttctgttacctacacctttatttacaatggagttgcagaatgctatacattccgtgctgctacggttcatgcatgtaggtctctcgaggtggctatgaataatgggcaagctctaggctaccatgtgtgcggaaccaagccttgtcattggttgtagtgcttgcactaactgaaagtttttttcttcg

SEQ ID NO: 11637 - DNA, 916 bp, Triticum aestivum
  Clone ID: PAT_TA_11637
agcggttcggcgccaggttcctcctgggggcgggggtgaggtctacggtgatcccctccagcaccctcaggtggagacctactggggcaatgtcaaccccatcggtgtcaggagttgctacgacgagggcaagcgtacagctgaaaccttgaccatggactaccaccgtggtgccaaccttgaggttaggattgctcggatctttaacacctatggcccacgcatgtgcattgacgatggccgtgttgtcagcaactttgttgctcaggcgctaaggaaggagcctttgacggtttacggcgatggcaagcagaccaggagtttccaatacgtttctgatttggttgaggggttgatgaggctgatggaaggtgaccacatagggccattcaacttgggtaaccctggtgagttcaccatgctggagctggccaaggttgtccaggacaccatcgacccgaatgcacggatcgagttccgtgagaacacccaggacgacccgcacaagcgcaagccagacatcaccaaggccaaggagcagctcgggtgggagccgaagatcgccctccgtgacggtcttcccctcatggtcaccgacttccgcaagcggatcttcggcgaccaagatagcgccaccaccgccaccgaaggccagtaaagagtagaccggagtactatactttgaaattttggtggcctgcttctagcttgcttcttggttaatccccccactgacagagctatggccacgtagtcgtcgtcgagagttttactgctaaataccttggttgttgatgtaatgttattcatttttgtctgtcgccttctccgccagtctcagctatacggacagatatcccagttggattgttggatatatataaatcaaatctggatcttctaattttttgttgag

SEQ ID NO: 11638 - DNA, 1764 bp, Triticum aestivum
  Clone ID: PAT_TA_11638
cttgtgagccgtagcacattagttcaacaccaaccagctagccatgggtatgtgttccgacaagaagcgcagcagccctggcgttgctgtgtggtgtgtagtcctgggcatagccctgctcgtggcgtcgacgcggcgggcagtgaaggtcgtgcgagagccgggcaattggctgaagagcatggggatgcagccgactgctcggccttgtgcgacggccgggcgaagtcggtcgacggcccgtgctccgacgacagcttgaacgggagggaccacggacgcgaccaagccttagaggtggttggcgtcggaggcgtcgcgggcctcctcgtcgtggcgacgaaactcgatgatcgggagggcgcagcgaagaccatgcactgcgaataccaccgtgcggtgacaatcaagcccactgttgctgcgacgcttgacgtgaatggcccgagcatgtccatagccgatgcggctttgatcgctaccgtgccaattgaggtgctgaggcatgcccgccagcccgtttacgtactggaccaactggagcaagaggatcccaagcggttctacgattggctaatgggagggcaagagtgcggcacaggcgcccagtaaggccttacatcgtggtgatatcgccgcagttacgattgttaggggctcccacggctatgggccgcgccagtgcatggacgcccgccatcgtgttcgctgcgtagtcgcacgggcgacaagcaagaaggagaagccgatttactgggatgacaagtagtggggaagttcccactacgagtttgttctggctgaggggattgtaacgctgttgcgatctcggcgatgagggcgattgaaggggtgcaacgctggatggacaatcgaaggaacaaagaacaaggtagcgcatcaaagtgtccatcggactggatggcgcgggcatgaggttgatactaggtaacgactcgttcgctccgaactatgtacagtgctgaccaagggctcatccctggttggcctaaagggagcttactcagtgacgcgtgttatttcgaaggtcgtatgcttgcattcgcagatgctacggacaaagaatgctcgtggccaaagcaacaaaggaagcggatgaagaacaatgaatagacggcttaggtctctgccgggcgaatgtagtgtgttcccgtagggtcaatcatcatactaacgcgtttcctgtccaaactaattgagtgggccgtacattgaatacgtcccacgtcgacctgattgcactgatcgtgttccgtgagacctcccaggacgaccggcacaagcgcaagccacgacaccacccaacgtcctagcggagcagctcgggtgggagccgaagatcgccctccgtgacggtcttcccctcatggtcaccgacttccgcaagcggatcttcggcgaccaagataacgctgccaccgccaccgaaggccagtaaagagtagaccggagtactatactttgaaattttggtggcctgcttctagcttgcttcttggttaatcccccccactgacagagctatggccacgtagtcgtcgtcgagagttttactgctaaataccttggttgttgatgtaatgttattcatttttgtcgtcgccttttccgtcagtctcagctatacggacagatatcccagttggattgttggatatataaatcaaatctggatcttctaattcaaaattgacacgatagcaccatccgggttacattacatgttgtttcagaaaaaaaaaa

SEQ ID NO: 11639 - DNA, 1922 bp, Triticum aestivum
  Clone ID: PAT_TA_11639
gaattcggcacgaggtttgaagccctctgtctcttgacttgacaataacaagttatcgacgctgcgagtaagctttatttgtcgaacaaaaataagctagtagtatttgcacgtgattgggcaaattagtcaagacgggcgctctttgctgcgtggccgctaggccacatgggacaaagtccaatcctgctagcagagactgttccatggatcctacagagcctcgttggcggatgaattcgagcttctctcctccatcgcggggatgggactgcatgtactcatcagacggtttgcctcataggactcctgatgctccacacgatcatccaccttatgtgtcatcactatcatcacatagtaaaggaagtagaagtgcatttggcagtgaccagtacctgaatcaccaccactctgtatctgatggagcactttcttattttggtagtcctgttgacagccttcaggctccacgctggacaccctctctgcaaagatttgatcttggcgagttctctacacctggaggaggaccgaaacctgaaagttccgatctccaatccagcgagagacatttaactgctgtgagcagtttcagttctgcatccccattctcagaaacaagtcagctggcatcttctggtaaacgaccagcttcacatctacctcgcaatcatctgggaaggcgatcctttatgtcaacaccagtctacccgctagtcttccgcaatccagtgtcagaagcagaagcctcgggggtggctgaggctagtaatgctgggcgtaccacaccgagtgatgacagcctggcttctcctgtgtggaggcgcagtttggcgagtcctgagctcaagttccatgacacactgagtgaacttcggaagatggaggcttctcctgagccgaacacaagctctaggagggaaggattcagatggagcagtgctagcagctatgattttggatatgatggtgatgccattgacatttcagaccatatcagcattgactcccaaagatccccaacaagttcaacgagtttcctgaaatgtggcttatgcgagagattcctcaggcagaagtcgccatggagctcaaaccggatagttcgaaataccaatatgccagtagcagcagtcctcccatgccgacacgtcttccacgcagactgcctggaggaaagtactccgaagagtgaagcccatgaaccaccttgcccgctttgcacgcgagctcccgatagtgaaggatgtgtatcattctcggagcctcttcacgccgccctcagatccgctcgcaggaatcatggcattcgcttttcttctggtgatgcgggtggtagcagcagcagcgcaaacccttctcgcaacgaccatgtgctgaagagaaatcagtctgcgctcgcgccagcgcgcagcggctcgctgttccggaaccgtttcaagaagcagttccccttcaaggggaggctcgggaaggacctgtttggtggcagggttttcaggaaggtcggctcgtcgtcgtcttcggggggccaaaaggacgacgcgtcagccgccagcagctaataagcctgaccgatccatggagtaagtaagctagagcgaaggcgcgcctctatattgttcgccgccgttactctacccttgtaccgtgtccaaatccgtagtagatgtatccataaactgtgaaatgcagtgccggtgcgctgcgagtactcgtccaggacggagctgtttgttttgtttggacggtgcctgccttggatgtggcaccatgagtgcgtgaactaactgtgctgtgctttcatcatgactcgttttgccgcctgttgttttgtttggagcatgctactgtattgaaaaccggcaggtccggctctggagtattaacagtcgagaacggttatcgttaaaaaaaaa

SEQ ID NO: 11640 - DNA, 974 bp, Triticum aestivum
  Clone ID: PAT_TA_11640
ttttccctcctgggcttgttgaaagcttcaatggaagcatcacgatcatcacccccagtattcccatcaatacggcaatactgataccctctgtacattagataatcttccaaaatgtccaaaagacgggtcatctgagagaatatcagtactctggagtcacgggcctttagcttgggaagtaatttatctaacagaaccatctttcctgcattctcaattagatggtccccagttgtataaggtgggccaggctcagcaccttggaataaatatggatgattgcagcacttccgtagttgcatggctatgttaagaaggcgcttgcgctcaccaccagcattaataacctccagatccttctgaagtagagcacgataatactgtttttgcatctcagacattccaactttaagtatagtctccttctttggaggtaaacctttctcgacatccgatttaagcctccgaaggagaaatggacgcaaaaccttatgaagctgctgaacaacctcgtgttgatcattttcccctgagatttggaaccattcatcaaaagtctctgcagagctaaatatttctggcaacaagaagttgagaagagaccaaagttcatgaagattattctgcagcggggtgcctgtgatgagcagacggtaattggtgctgaaaagcctcattgtcttagaaagaagggagttctcattttttatccgatgagcttcatcgataataatatagcgccagctaaaacgcctcaatgcagttttttcttttattgccatttcaaaactagtaacacagacatcaaacttccctggagctagcaaattttcccgtatatgattcctttcttctgggtttcctaagaacttgacagcacgcagaacagggcaaaaacgttggatttccttcttccaattgccaagagtagactttggtgcaacaaccatgtgaggaccagttattcctct

SEQ ID NO: 11641 - DNA, 778 bp, Triticum aestivum
  unsure (1)..(778): unsure at all n locations
  Clone ID: PAT_TA_11641
aaaacaggaaaagcactctgttgcattttgcattagaaagactgaaccttccaccgtgcaacaaacagtggtctttacatcaccactatataaactggcaagtgaaataaaagatacaatagaatcatcaagtccatttttcaaagccaattaagtagttggtaatctctcatttgcaaacgctcacatgatggttgtataagcaagcgtgttcctcctgcagcaagggcatcttcctccttgaggtattcttcatcttcctcctcctctgtcacctttgatgcatgacgaccctttccgcggttctttttctccgcagcttggcttcctttcgcaaaatgagcaaatatttcagtctgctgcaagaggtatttcagtcgcccctttcccttcttgttcatgtcagcatcaatggaagcgttttggctgtccagtatttcctggatcttctgcttcttgagcttctgcatttccctgagcttggcccgttccctcttgccaatctctgtctttgcagtggcgtcttcagactcgtcggcatcttcctcgccgccctcctccgcggcggcgtcgtcctcggtagattcggcctcctccgccgcgccggcgccgtctcccccgtcgtcgtcgtcgtcatcggcgccggcgccggtggtagcggcgacgatctcctcctcgtcgacttcttcctccgcatcctcgccatcccccgccgcctgctccccctcgggctcctgctcttcctcctcatcctcctcatcctcgccctcanccganc

SEQ ID NO: 11642 - DNA, 801 bp, Triticum aestivum
  unsure (1)..(801): unsure at all n locations
  Clone ID: PAT_TA_11642
ngttttttttttttttttttttaaanggccattcgnttaaaaatggttccttttttttcttttggcaacgccactcactcgcgactttttttttgaaaacttcgccacgtggcgtttcataccgtcgtacggtaacgtaccgcctgaggaattacattgacacgtcttgagtatgtactactacacgtagtatatgtgtaggttatatgtttacgttctgccgctagctagctcatcatgggcagaagacgatctggagccggctgccggcggcggtgcatgagtggtcgttgtacttcacgtacgggaacgcgtcgtggcacccgtcctcccggcaccggagcgcgtcgccggagctgcacgtgagatccatgggcaggttgaaccccttgtccaacgtgatgccgtagtggtagaagccctcggagatggcgacctgggccttggtcgccggcgccgcagggtcggtgctccggcaccgcagcccgctgccgcagtccgccgtctggcaccgccccctgcctgccgcgtcgaaggagcagcccgtgcgcccccatatgtccgcggtgtagtggatcgccgacgcgtccacggtccagttggctcccggatggagctcggtgccgaggcctgcggaggccaccgccggccacaccgtgaaggagcaccggttggtgatgctgagcggcgtcagcgtcgatgtcgcgctggcccccgcggcgagggccgcgaccacgacgacgaggaggaccggagtggcgctcgcgcttccggccccccgattatgtggcctcgtgccga

SEQ ID NO: 11643 - DNA, 933 bp, Triticum aestivum
  unsure (1)..(933): unsure at all n locations
  Clone ID: PAT_TA_11643
tttgaatttgctctttgcttggcaagnattaatgtgaggtgtttaatttatgttcataaactaaaaaaatgatgcttggtgagattttaggtgtatccagcaataatagcttttggaataatgttaatacaatttgctctttgttgcccagtacttatgagtatagattggttactccactgcatgttactccgtgtgaggtgggcttaaatttcttgttcaggtcatgtgtttcaagaacatacatatggataatttgagatttttggtcatttgtatttggctgtttcattcttctataaaactgcaggtatattcccacattgaactcgattattgcaatgattgggttgatttggacatactgtgccttgaatgacttttcccgttgggcaattcaaatgatggaagcctcttcggacccttccacctctccggcctcaccactggagactcggatgcgagaaccgccaccgccgctgccgtgtctgtcggtgacgctcacacaagaatccagaggcagtaccttggtcctctccctgagaacaacagctctctcatgatgcgcagtcgcggcctgagggtggcgggactgacgccaccgtccatgccatgttctggctgatccccaaggctccttgccgatgtccaaccagcgccacacagccaatggtactgccgatatgaggacgctcacccccgtgttgatcgagctttttgacctgagcctgatggacaaggtcatacgggcatctgattttgatttcctatgtgctctcttttcacaagtgtagctttttgtgttataaaactatgctaccgattgttctttgttgatatttccctacttgtgtcctgattaatggatctaaggtagttagaagtcactaataactacttatactattgtgtcagccgtcacgggctacaatt

SEQ ID NO: 11644 - DNA, 1755 bp, Triticum aestivum
  Clone ID: PAT_TA_11644
cggcgcccgaccgcaaccgcccgaaccggcggcccggggcggccgggaggatgttgaggaaccgccgccgggagcggggccccagcgaccgcccccgtgacttgggaggcagcggaggagccgtagccgctcaggagcgccgccgcggggaggaggaggagatggtgagggagctccagcgggagcgtgaacgcagcgaccgccaccgtgactacagagaccgtgatttcaggcgtaagaaagatgatggtacagaaccagaagttgacccagaaagagatcaaaggactgtatttgccttccagctatcgttgaaggcagatgaaagggatgtctatgagttcttctcaagagcagggaaggttcgtgatgtccgccttatcatggaccgaaactcgcggcgttccaaaggagttgggtacatcgagttctatgatgtcatgtctgttccaatggcaattgctctaaccggtcagccgcttctagggcaagcagtaatggttaagccatcagaggccgaaaagaacttagctcagtcaaatgcgacatctggtggagcagcttcaggtggagcaagaaagctgtatgttggcaaccttcattccaatattaccgaggaccaattgagacaggtctttgaaccatttgggcaagtggagcttgtccagctgcctgtagatccactcactgggctatgcaaaggttttggtttcattcagtttgcacggcttgaagatgcaaaagctgctcagagtttaaatggccaacttgatattgctgggagagtaataaaggtctcagctgttactgatcagggtggtgtgcaacttggcacaactactggagatttagatgatgatgaaggtggaggcttggcattaaatgcaagctctagagcccttctgatgcggaaattggaccgcagtggcactgcaaccagcttaactggtggcattggtgctcctggattgaacacttcttgttggatttcctgctgctgcatcagtgcttggtgctcctctgacagctgcttctcttcttgtacagcctgttggagcaattccaggggcacctcttcctatcatctctcaatctgctgatattggtacacctactgaattcctattgctgaagaacatgtttgacccagcagtggagacggatcctgattttgatttggatattagagatgatgtgcaagacgaatgttcgaagtttggtgtagtgaagcatatttttgttgacaagcataccgcgggctttgtgtacctgcattttgatagcgcaacagcagcagcaagtgcgcaacgatcacttcacggccgatggtttgctggaaagatgattacggcaacctttatgacagcacagcagtatgaaatgaagttcccagaccgcgcagctatggaatgaaattcacaaagcagacgagttatatctggtgatggacctagggctgttaaacggttccaattgaagttgtgaagtcttgagtgtagtaaccctgttagttattgtttcttgtaacattatgaagactagaggcctgtttgggcagttgcatcttttgtgataattggagatttcttcattttctttgtagcagtatacgagaatgctggatttttttccatgccatataaaaaaggttaagagatgtataacatggttaaagcatttaactcaaaaaaaaaacccacgcgtccgcccacgcgtccgcccacgcgtccgcccacgcgtccgcccacgagaccg

SEQ ID NO: 11645 - DNA, 869 bp, Triticum aestivum
  Clone ID: PAT_TA_11645
aggattggaccttcagtgatgccaggtttgcaaggcagaatcgcagattcagaaagtctgaagagaagaaggaacagaaaaggagagagcaagatgctaagtacacaaaactgatgaaagagaaggctgcaagagctgaggaggcgagaaaggaggaccggctggagtttatcaaagaaggcgtcttggggttacagaagtctctaggcaaagttggtgagagggtcgatgctggctttaacaaaagccagcaggccattgacactgcttatcaactagagcttgtgaactcccagactcttcttctctccctcggtgtcttggaggatatgtctaaggatttgggttacttgatgttcaaagctgctcaagagacgaagaggctggaatctgaaaagctttgggtatatgttggacttgagaagctcagtcagaagctgcctttcaatcttgctgtgcacgtgaagagcatcgtgaggaacgtcaatgagtcgaaggcgctataccccattgcggggtgtgccattgttctcagcagggcgcatttcacaccgctggagtgggttgagatagccaagatctcaaatgacgattgggtcgagaaatggaccaagaagcttcaggaagttcatgagaggagcaagaacaagactggataaggtcccagtcacagtgaaggcagggaagagtgaggtaatggcggcaatcgggtctaaaggataggataggaggcaggcgagtgagacggtgtctgtcttgtaaactgttaagaggtccagaactttgtgcttgtgtgatgacgttgggcaagtccttttatgttgtgagcctctgcaaactgcaatggacatcttgtcttaaaaaaaaaa

SEQ ID NO: 11646 - DNA, 752 bp, Triticum aestivum
  Clone ID: PAT_TA_11646
ggcccaccgagggtatccttccccagggcatggttttgacgctgaagacgcgaaggagggcctcgcgaaggaagccgcgcttctccacccccccccgaagcccacgggccccctcccctcggcgttcgccctggttcgggggctgcgggtcccccggggcgggcctttccaggacaaggcgaactcagcctcccggcaggtggcagcggcgccggctgccgctctaggtcgtgaggcggttgctgcggccccccccgatggctctgtggggagtgctgatcacttcatgtcctgcgacgaggaggacgcggaggaggaggaggaggaggaggaggccgcgtccgcggtgtctagtcctccgcaggacgtgacggatgatgacgatgaggatcccgactatgcggggtaggcccccgcgacgaggcttcttctggtggagcataggaaggggagaaagccgagaatgcgcccgcggatcttgctccgaccgactgacggaaccagtgcagataactgtaggatcgagttggtaaatccgctgtgtgttgtgcggctgccatgtactgctaggcgttagtgtcactgaatcgtgtggtggtcgccgttaacagtccgccgagccgagccgagcagtgtgcacaaaaggcttgctggctggctggctggctggcatccttcctgtgcaaagttgccgctatgagcattttctgcgggtgctgtttgttggcaagcaaaaaaaaaaaaaaaaaaaa

SEQ ID NO: 11647 - DNA, 605 bp, Triticum aestivum
  unsure (1)..(605): unsure at all n locations
  Clone ID: PAT_TA_11647
ttcggcacgaggagcgaatcaagtggtgattgccaggnaaaggggtgaacagacctcccctccgattttgaatgaaaccttgggggaaaccgcaccgaaaccgaggtgcgccaggcgcgtacgacataagtacagtcttggtttttttgagtatttagtagctatatgtttgttgttattatgttcactagagcgcaggagaaaagagtcgggcatcctttttttcgttgcgtgcgaggaaaagcaacatctggatgccattgtacagataatccgcctctaccccctgattcattgttcgaaggcgcgaaccagttcaccccctcattcttttttggttttggtgagaatagaagatagagataatctgtctgttattctagtagtgtaagaaaggaaagcccgaccacgccgtagaaagtgatgttgctgttgttgttgttgttgttgttgttgttgttgttatacttgtatgtacttgttaccacacaccatggtgtattgtactactgtattattctttggagatgattcgatccttttgcctcaaggttaaatgcataaaaggagctcattgccccctgctgtgattgaaaaaaaaaaaa

SEQ ID NO: 11648 - DNA, 1033 bp, Triticum aestivum
  unsure (1)..(1033): unsure at all n locations
  Clone ID: PAT_TA_11648
ccacgcgtccgacaaaaacctgctgccggtccccatgataagagttaccccgtgggttctgtgcttatcagtgcattgcgcctcgttgacgtcttttctgatgattcaaactttagatcttccttcataactaatactattccctttctgacgcaaattttggcgactcctcatgatgagtttgtctcgagttggtgctctgtcgatctgccagtgatagaagatgatgctaatctggattatgatccatttggtgcagctgacctggcactgttagctgcttcaaatatgctgactgaagctaaagttaactattcatgcaattttcgctctatcagcatgccttcaatacaatatgcgcagacaagnaacatcctgtgtggtgaaaataatagcaaatttgcacgtctttgttccaaacatatgcgaagagcaagaaagagacctctttcttcagaaatttcagaaatacttgttatcagagagtcccaagccatcattggaccatccagcagctgatgagatcactatagtttgtacaaacttgggatctttgtcccattatgctaaatcattaatccctggtaatttgttaaatgaggaagatgtgcaactattaagtgattttgcttataagttgcaacgttggtgtaaatcgcaagttggacagagaatatcgcaggtggcaaaaagtgacgtcacatcagaaatgaaggtagacttgcaaccggtgcagcagccccagccccagccagcaagggctagcgttccagatcccaatatggatggccctcctaaggatgtgcaaaacatcgaagagtctatggcgacgccccccatgaaacaagatggaaatgctagggatgagactccaagaaaccgtgccactacaaatggtggggtcctgcaaaattcagtcggtcagaacctaatccatcttggtgttgcgaggacgactagcgcgggctatccgggtcccagtactgctaccagcatggaggtcccgcgctgcagaagtgtagaccatttcaaa

SEQ ID NO: 11649 - DNA, 972 bp, Triticum aestivum
  unsure (1)..(972): unsure at all n locations
  Clone ID: PAT_TA_11649
agcgaccaagatgacgaccaggagcccgacgacggcggcgccgactacaacctctccgtctccgagatttgccttgcaagatggttagtccaagaggatgtcttcgtactatgccagttcagcttttttgtgtgcccggcgaatcttagctgcagctggcaaaaaagccaatcagccctatccatcaccggagtccctctcttccggatagcagataaatttgccttgcaagatggctcgtcgaagagaacgtcttcatacctgccagttcagcttcttgtgtgtgtggcgcggtgacgagttggggtggggaagcaccaacaccagggacgatttgggcattgctgcatccacctagctccaaccagcgccgggacagaggagaccccgacgctatggacaagcagcggcgatttgatctacttcatcctccacctcgactcgatttcatctgtttcccctgctgcaacgtcgcctacctcaattcaattcaattcaggcagtagcaaacatcactcgagatgcaggacgagctcctagctcgggcaacaacaagtcatctccatggattctgtcactccagttccatcatatctccatggacggcatccacaaacgaccaagatgacgaccaggagcccggcgacggcggcgactacaaccactccgtctccgagatttgccttgcaagatgactaatcgaagaggatgtcttaatatttgacagttcagcttttttgtgtgtgcgacgaatctcagctgcagctggcagaaaagccaaccagccctatccatctctggaacccctctcttccggatagcagatgattttccttgcaagatggctcgtcaaagagaatgccttcatatcctgccagttcagcttcttgtgtgcatggcgaatctcagctncnactggtaaaaataccaatcaaccctatccactgctggagcacctctttccggatagca

SEQ ID NO: 11650 - DNA, 854 bp, Triticum aestivum
  Clone ID: PAT_TA_11650
acgagcaactgttcatcgccattgacgtgggcgacatctgctcacatgatggatcacatgacaactgcatggtgactaggttgaacaacatctctttccatctccccacgacgacatcattgctccaagcacactacaacaacaacatgagcacaagcgcaatcagcatgctaaaggagttcccaagatgtccaccgagctcagagtttggctatagcccgacgtcggtggggacggcggtgaggacggtgcggtacaacaccacggtggaaatcgtgttccaaaacccatactcgtcgggtatgttcagcgcaagtaacccgatgcaccttcatggacacgacttgttcattctcgggcaggggttagggaagttcgacccggtgaaggatgtgcaggcatacaacttggtggatccacccgtgaggaacaccgcccttgccccgatttacgggtggacagccatccgattcgtcgcaagtaggacaggggtgtggttcttgcactgccatatggaaaagcacgtatcgtcgggcatggcattggcactcgtggtggagaacggaccgacacccgagacgactcttcccccacctccggcagattatcgaagctgtgatggcggccaaaacaatagagcactggcagatgaataatgagagacagttagctggaaatatgtttgagttctgtcaaatatgtttgcttattgcacttgcaatttggactcttggttgattggtagttgggtgcattttattgtgtcgttattttaccttttgtaatcctctgtgggacctttgtcaacccacctgttgttaatggaagcaagtatattagtgttaaaaaaaaaa

SEQ ID NO: 11651 - DNA, 956 bp, Triticum aestivum
  unsure (1)..(956): unsure at all n locations
  Clone ID: PAT_TA_11651
gcaggcacgccatggnaggagaggacgccatggnaggggatgacgccatggatgtgaggatgccatggaggacgcagctccatcaccaccccgacgccatctccgagccccctcccgatacatctcatgcgagtttgatggagggtcaaggaccgcacgcacagtggattatccagaacgcccaggccagccacggtgtgagtaggcatcctctgtggatgatgacgacaaccagggcatccaccgccacgacgacgctccgcacatggtccaactcggctacaacctcctctaccacgggacgaagaccgtggccgtgtgcggcatcggctacaacctcctctcatgtgagttcgtctcctagctactagccccctctccttgtgctgctataggagtaccttgctctgtttcatgcgcatgggtgattttgtttgtactttccgtgcttgtgtcatggaaaagaccattcctatttacaagtgatgatgatttggagtagcacacttgttaaattctgctcttgtagtagaccccatttgtagttactgtgatgtgcattgactcggcctcctagtactgtagatcatgcatgttaataatttatagtggccttgttaggttactacagctaggctgtgttaactgttggtgtttaatcctaactagcttgtttgtaccatcaaggattgcaagcaaatgcatccagctagcctgtttgtaccatcaaggattgcattttaactgttttacccaactcgttttcgttgttacttggatacatactacctccgtcccataataaacaatcaaagtacccctggganggataaacacttttttagaacatgggttgaagcagactggtacttgctactgagaatagaaaatggganatcgttnctaatataagatacantgggttaancagtacgagatgtttcatccaanaaatt

SEQ ID NO: 11652 - DNA, 759 bp, Triticum aestivum
  Clone ID: PAT_TA_11652
ccacgcgtccgcgctttgataactacttctggactgttgtacacatttggagatggcacatttggcgccttaggtcatgggaatcgagaaacaatctcgtatccgaaggaggtggaatctttgaagggcttgaggacgatttctgtttcatgtggggtgtggcatagtgctgctgttgttgaggttatcatgacacagtcaaatgcctcatctggaaagctattcacatggggagatggagacaaatatcggcttgggcatggtgacagggcttcaaaactcaaaccaacttgtgtgtcttcactgatagactacaacttccataagtcggcatgtggccatactcttacgattgggttgacaacttcagggcacatgtttaccgtcgggagctctgtgtatggacagcttggcaatcccaacaacgatggaaggtatgcacgcctagttgaagataaggtcggcggcggtggtgttgtggaggttgcttgtggatcttaccatgttgcagtcttgacaaatgccggtgaagtttacacatggggcaagggtgcaaatggaagactgggccacggcgatattgcagaccgcaaggtacctacacttgtggaggctttaagggataggtccgtgaagcgcattgcttgtggatcaggcttcacagctgcaatctgtcagcataaatgggtgtcagggatggagcagtctcagtgctcagcatgcagacagccattcggtttcactcgaaagcgacacaac

SEQ ID NO: 11653 - DNA, 481 bp, Triticum aestivum
  unsure (1)..(481): unsure at all n locations
  Clone ID: PAT_TA_11653
taggccgcagcttccaagtttgatcgttgccccgccgtcctggaagaagcagaagatcgatgtttaagttacttgttctgtaaagacccattggtactgctattaaagacaacggtttgcctgtagagaactgctcgtgttgtgtttttgtggaaagtgaacagtgattaagtatggatgccatgcaaattgcgattgtgagctccagggaggaatagagatgaaagcaagctgtggcagaatgtttgccgccaagttttgtatgctcgaaggcgcttgattgttcgcatcgagaaggaaatagagatgggaaccatggtggatgctgtgtagattgatgtaggcttgaaaaatctgttgtctaatttaagcctaggaagctgagatgtaatccaaagttgttctgtaaatttgatgttgttcatggnggcaaaatctgtttgtctaatttaacctttaggggaanccgggaaaaaaaaaa

SEQ ID NO: 11654 - DNA, 790 bp, Triticum aestivum
  Clone ID: PAT_TA_11654
cggcacgaggtccgcctcctcctcgtcgtcctcctcctcgcacttccgctcgctctcgtggagcgtgtcccgcacgtggtcggcgtcgcggcagctgcaggccatcgggtccggcctggccgcgccgcgggcgcacgaggcgggcctcgccgcgcccgtgtacgcaatgggatgcctgctgcacctcgcctcgtgggcgctcgtcgcggccgtcccgtgcccggaccgcgtcgcggcgctccaagcgcaccacctccccgcggcaccgccgcgtggggcattcgcgtgggcgccgccgctcctgacgctccaggaccgcctcaccgaggagggaaagcgcaaggacaggcgcaattcctgcggcctcctcaaggaaatccacgcgctcgagaagggcgcacagaggctcgccgaggcgatcgacgcagcgcccatcccgctcaccggagagagggaggccgcggtgcgggaggccgccgcggagcttgccgccgtatgcagcgccatgaaggacggcctggagccgctggaaaggcaggtccgggaggtgttccaccgcattgtgcgcagccgcatggagggcctcgactcgccgatgcccaacgccgccgactgaaccatcaagaatccgcattttggccgcgcgctgcggcggcgataggtagcctcctgtccgtggtttttgatcacccgtgatctgtctcgcagtcagtagtagcaagtttaaaatgtgtatccttctgtaaaggaaaggggaaagggaaggaaccatctttctgcaaaaaaaaaa

SEQ ID NO: 11655 - DNA, 468 bp, Triticum aestivum
  Clone ID: PAT_TA_11655
ggtgatcatgaaggtgactttgccgcttctggacagcagagtcaagctatgcatgccgaagcattcacggtcaaaaaggcgctgtttttagccgagcagagggggattggaaggatcgttttggaaactgattgcaggaacctgattgcggctgtgaaattcaatgcctgcaacagttcaagccttggtacccatttgctagcagcaaacgatgcaggggaaagccacggtttccatgctacttgggaattgggacgtgagctaccatgatgatgtaaaccatttggtggcctgttatttaactgggccttaatggaatacgagtgttccattcaaaagaaaggatgtggttcgacgccaaattgcattttagtatttcacgagtgttccatgatgatgtaaaccatttggtggcctgttatttaactgggccttaatggaatacgagtgttccattcaaaaaaaaaa

SEQ ID NO: 11656 - DNA, 1447 bp, Triticum aestivum
  Clone ID: PAT_TA_11656
cgaggcccactctcccacgcgccagatcgagcccgacccgcgccggagcagaggtccccgtagcacgcgcgcggcgggagcgggggggatcggcttcgccggaggcgcgcgatggggctggaggccggcgagcccagctccttcctcagcttatcttcggccttttcatatggagttgcatccatggcgatggttttcgtcaacaaagcggttattatgcagtatgttcactccatgaccctcctcactttacagcaattagctaccgcacttttcatacatttcgggcaagttctgggaatgtctaaaaggaaagatctcagcatggcaacagcaaagaagcttctcccagtgtcaattttctataatgcaaatgtcgcatttgctctggcaagcttgaaaggggttaacatccctatgtatattgcaattaagaggctcacaccccttgccgttttggtgtctgggttcttaagggggaaggggaaaccatcaacacaggtgtcgctttcagttgtctgcactgccttaggtgtccttgttgcagcacttggagatttttcttttgacttgtatggatacagtatggctctaatatcggtcttcttccagacgatgtatttgattctggtggagaaatcaggcgcagatgatggtctttcctcaatggagttgatgttctataacagcatattatcgattccatttctgtttttcatcattgttgcaaccggagaattcccccattctctttcagttctgtcagaaaagacagcctctgcatcattcagtgttattcttctgatttcactggtgatgggtatcgttctcaattacaccatgttctggtgcacaatcgtaaactctgccctgacaaccacgatagtaggagttctcaagggcgtcgggtccacgaccctgggtttcatggtgctgggaggcgtcaaggtgcacgctctcaacgtcaccgggctggtgatcaacacgttcggtggcgtgtggtattcctacgcaaagtacacgcagaagaagaaactgccacgaagggtcgcacccgacgaagagtcgcatccgcacaagtagcagcagcgccgggtcagcgctcgatataacttatgtagtcacaccacattcttaaaaggagacaataaatctatttttttttcgacgccatccatcagcagcgctatttggcgcagaggaaggtacaaagttgttccttttcttttctccttttaacttttataaatagcaccgtgtgtttatcagcagcatcatagtccataggggagtgatctcagggaatcaagtaactgtaatgttgggatgaatcattaccacactgtactgtactttttcccttgtcccggcgtgcttgccagattatcagtgggttttaccccgaaaggttcactcatttgaagagaaaaaaaaaaaaaaaaaaaaa

SEQ ID NO: 11657 - DNA, 339 bp, Triticum aestivum
  Clone ID: PAT_TA_11657
gggcgctgcgccccgggaggagcgtcaggtttgggtatgtgcagcccggccctccggccaatgtgtgggtcactggatacaagctggtgtgagtgaaactcttcttgtttccatgtttgaggtcctaggattgacaatccagagtttttggtgggtttgttgtgtgcgtgctaggcgcgagttagtgatgggaaggagtgaagagattaaaaatgtgattgtgctcatcctcttccttccgagagcttttggttaggccagagaggaatttggattttagagagatgagatgtaatgttcatccttcttacatttcaagggtttttttcaaaaaaaaaa

SEQ ID NO: 11658 - DNA, 967 bp, Triticum aestivum
  Clone ID: PAT_TA_11658
cctctttccttcctgagaaatagaacacccaaatcccctcggcggcgcaaccctagcagcacgccgccagcggcgggccatgacgaccgacggcgacatcgacatggccgacctcgcctccctcgacgccccggcctctcccgccgccgccgccgccccctccgtccgcttccaacccaacgtcaagggcaagcccaagcccaaacccaagccgaagccgaaggccaagccggcgcccaagcccaagcacaaaccagagccggagccggagccaacaccggaggagggtgacccccacgccgcggcggcggcggcggcggccacgctgccggagggcggcgtggacgcgatggagaccgacgcggacaggggtcgtccgcggacgcgtgggggatgacatggatgtcgaggacgaggactttgtggtgcgggagatcgacgtctacttcacgcccaagcccttcgacaaggacagcaagctgtacatcatgcagtatccgctgaggccatgctggcgtccgtacgagctcggtgaggtgtgcaaggaggtgcgcggaagccagggagctcaaaggttgaggtggacttggaggtcgatacgcagagcgacaattacgacccggaggtttctgcgtctctgaggctgacgacgcatacgctgtcatcatcggaggcggccgatgtgtctgactatgccgttggagttctccgaggcaacatggttcatctgaatcatcttgatgcggtgatgcagctgcggccgtcaatgccgcatctgatttctggtgcttcgcgtactaggcagcctttgcaacaggtggaaacaaatggtggtggtgctggtcgccaggctgttccatcggttaagggaaggcaacacccagatggttccaaggtctcccctgaagaacctgagccatggatttctctcacttacgaaccagctgggagtgatgttgcacgcaag

SEQ ID NO: 11659 - DNA, 787 bp, Triticum aestivum
  unsure (1)..(787): unsure at all n locations
  Clone ID: PAT_TA_11659
attcggcacgaggctaatgacggagtaaattccagtgctgaatccactctgctgtggaagaaacatgagcctccaactaattccacacgatacaatttgtcatcatttgctataaccctaaacgagctgactccaaatctcaaggagaaacttcctccgacagattcaaggctcagaccggatcagcgacacctggagaatggggagtacgataaagccaattccgagaagctacggttggagacaaggcaacggatggcacggaaaatgcaggacaatggatggaaaccgagatggtttgacagggacactgaggacggaccgttccgctacaccggaggttattgggaggcgagagagcagaggaaatgggatggctgccgcgacatattcggcgaattgcccggcaaaaaaacttccccggttcctgctagcgtgggtatataactcaattatgtagcagctattgcatttccaccaaataggtgttagcgtgaaaagtattactgaaaatatatactgcaactactagctggctttccccaatcctcattatgcagagatgagctcactcatctcccctgtatgtaaacaaatactatggcatacgactatggacactataaactgtgtctgtgtccataggcttgcaagatgtagtaggtgctatagcttgtggttgttaaccctgatttgtcaataataatattaatccttaacctgtanaanttttcaacacaaaccgatgtggtgtcctggtatcaaagtgctcaagtnttaaatctta

SEQ ID NO: 11660 - DNA, 607 bp, Triticum aestivum
  Clone ID: PAT_TA_11660
ggtcccaggcctcgtcgtcggcggcggcggcggcgcggctgagctcctccctctcccgacggcgcagattagcgaggtttcatcgatctgcgggctgattgaaggtttctaattgtctcgccgtctcgttgaaacaatgaaggtgggcagcatggtgttcacagttgctcttgtgttcatcgggtgcctactcatggttggacaatgtcgtcctgagcccaagagcacctatgaagatggccatagcaacacgactatggtgttccagagcaaacttgccttgaaatggtgtgtcgcaagggattgtaagaccaagcatgaaccgtcgctattcgcccctcgatgcttttgctgtttcaatgcgcagggaacaccttgctttaaatccataggggattgccagaatcactgcccaactcttccacccggaaaataagggtgtgctttactagattacaatgtgatttttcacatttgaatgagagaatgtgatgatacttgcacactgcatgttttcactagtctctgtcgatgcaaactaagtcacgggccagtatttgaatattaagttaccttgagaattaaaccttttgtctgaaaaaaaaaa

SEQ ID NO: 11661 - DNA, 793 bp, Triticum aestivum
  unsure (1)..(793): unsure at all n locations
  Clone ID: PAT_TA_11661
aggtctcaccgccgccagcacccttgccgtcgccccggnacaccgcgatattcccgtgacctcgttgcgatggccactcccggcaagcccgacccggccgctgtgccgccgaaagcgccgcagccgcagccgcagccaccggtgaagggggctatcatgcgccgcgtcttccccttcctcctcgccaccaacctcttcatcggagtttatgtatttgcaaagacctacaaacgagaccaggacaagaaaaatgctgagaccgcagcagcagcagcagctgcagcagcattgtcagccccacctgctgcagttgctaagcatgcagagcctgctcctccgccgaaaagagtactcccacctttatccgaagatgagcagcgcaaggtctacaagtggatgctggaagagaagcggaagagcaaaccacgtgacgctgctgagaagagcaaaatcaatgaggagaaggctcttctcaaggagatcatcagggcagagtctctccctcgtttgtggtgatttcatcagttctcctgctggccttggatgtcttttctccccctgcaattccagcaagggtatattttattgtcaatctagcgctgttagctggcacaaatagtatggcttggcgtgatgatacgtcgacatttcgtagccaaattttttgagtaactccagtctctaggaaacggttgccttttagatgcaaaattatgatggtggagtctattctggagatattctcgcgcacactaaatgattgctccaaaaccaaggggctgttttgttcgcg

SEQ ID NO: 11662 - DNA, 904 bp, Triticum aestivum
  unsure (1)..(904): unsure at all n locations
  Clone ID: PAT_TA_11662
gtttttctacccttganaagcctcttctccacctctagcccacaggccacgtcgctccgtctccgacttcctgctccgttcttggtcatcttcctttcgggaggaggagggaggaagcatcatgggcaacgagttcgactacctgttcaagctcctcttgatcggcgactcctcggtcggcaagtcctgcttcctcctccgtttctccgacgattcgtatgtggacagctacattagcaccatcggcgttgactttaaaatccgcactctcgagatggatgggaagaccatcaaattgcagatttgggacacagcaggacaggagcggttcagaaccatcacaagcagctactaccgaggagctcacgggatcatcattgtctatgacatcacggacatggagagcttcaacaatgtcaagcaatggctgagcgagatcgacaagtacgccaacgacagcgtgcgcaagctacttgtcggtaacaagtgtgatctggctgagagcagggtcgtcgatactgcggtggcacaggcctgtgctgatgagatgggtattcctttcctagaaacaagtgctaaagagtccatcaatgtggaagaggcctttttggcaatgtctgcagcaatcaagaagagcaaagctggaggccttgagaggaaggcatccaatctggtccagatgaaaggccagccaattcagcagcagcagcacaagcagaagagcagctgctgttcaacatgactcgagggagggtaaagcatcccagcggcgcagctaccttccaggaatcaggatgaaaatgacatctgccaaatgtgaacctctttcttccttgccttttggaacacttttttagctagctgcaaactgtatcagtaagtgaattcgcatgttcgtatcgat

SEQ ID NO: 11663 - DNA, 923 bp, Triticum aestivum
  Clone ID: PAT_TA_11663
gcaccggcgtcatcctcggctgcgagcgacatacctccttcaccccagcgcctcaaactcgcccccttcctgcaagttgcgaaggccgctgacagggcgttcatccaccttcgacctcacaaccgatctgaccgccccggatgtcgttgccgcccggccagatcgccatggcactcgacgccaccaacacctgcacacttcagtaggacctgacggctgacgccacacggatctggctgtcacgaacaccgccaccgccacaccgtctttctcgccagtccagatccacttttcccttatctcagtcgtggtacgggtgccagtcgcagcacagaactatgaggcattgacgatccagccgctgtcttgtttttttgtctcttcaggatgaacaataatgcggcactccctccatcgggatccaacaacacacgatagttgcgactccgtcttcctcctcaaccatgttgttccaaaattttggattgttacaatccacaccgtacacgattttgtatttttgcgtgtgtgccaaagtgctacataggcgacaagtttgttccctgtgtgattacccctcatcagccaatcgatgattgttttgcaggtggagtagcgctcatgccagaatcgagcattatctgaaacagttgtcattctctctagatgctaataggataatatgcaagtcacctttgaagaaaatcgcgatggacaaagaagcgttacaacaactttagtcgccttcaacaaattaggagaagagacgaccaaaaaatgttccttcctttgatgaagacggaagctatacaaatatgtttgggggccaagacaactcatttgttaatttagtccttaatgccgatgatacttgtttcatcaagtttctatgtaactcgtgttatttcggcctatgtagtatg

SEQ ID NO: 11664 - DNA, 862 bp, Triticum aestivum
  Clone ID: PAT_TA_11664
tgcaatattggctgcgctgtttggttcaattattgggttcttagccaggcatttctaccctttccatgcaggaagtctccatcaaccgctttttcagcaggatacagaggcaatacaggagaacccagaggaaggccgcactgatcagcttctccgacatcagaaacgcaattgctaactccatgctttctaccgtcctgctgaaactagttagagttagtgttggctatcttactgttgtgttacctagtattaggctagagcgaggagttgcctgtaagccttctccttcttctccttctcctccttctcttcttgatctagacatggctagtactactactcctgccattggtcttggcaacgaagcactgccttctactgagcttttgggggatttcgtcggcttcgatgatagcgacagcgctacggatgagggcaatgaatccgcctttgatggtagtgctcctcaggatgagaataaagagacgtcgcttgacagggatttgtgggcgcttcttgatatcccacaaggcagttctaagaaaatagacaatatgatcgaggccaacttatcggacttttcaggccaagacaagtattgcagcccagctgttaactattctggagtaagcaggaggttccatggaggtagcaaggttctctgagctcgctgtaagtgaatattagttgtattagtgtctagtgtttgcctgcctaaatgtctaaataacaactgtgttagtatttgcacgtatgaaaaccgtgctcgtcgtatctactgtggcagtggcatggaagtatgtaactaatgtacctcggtcatggtgaactacggttgttttatgtgaatataattagc

SEQ ID NO: 11665 - DNA, 512 bp, Triticum aestivum
  Clone ID: PAT_TA_11665
gccgaccgccagcgttgcaagagccgcaccgctgatcctccacgccgacctgatccaccccacaccaacgaccccccggtgagagcagctcctctgactgggctcctggcgcgcggttcacggagcgtggatgttcaattcgccggcactaccacagcagaggcacattgtgagtggccaccacctcgctgggatcgcggagacgaagccaccgacattgacaaccctcttccaccttcccttctccctcgctggggcagcacgagcgtggcggcgcagtgcactgccactccgcgtgcacgtgtgatcttcggaccgggcatcacccgtggttgcagtttgtagtggcggctacattccatgatgaattattatttttgaatcattttgtagttccgtttggcgggcacgtttcacgcagtgcgtgggcatgttctttgcagtgcggcatgtgtgttcgtgcagtgcgttggcgaaggaaacaacatctgtttgtttgaccaaaaaaaaaa

SEQ ID NO: 11666 - DNA, 800 bp, Triticum aestivum
  unsure (1)..(800): unsure at all n locations
  Clone ID: PAT_TA_11666
attcggcacgaggacccgtcgtgcgtgctacaatggcggcagcaacctgtgctacatgggccatggaaaagctgcaatcggccggcgaaaaagccacaaccggctcacataagctacaatggggtgtgttgtaatgttggaaccgacgtcaagatttgttggaatcggcttctcgatttgctggaaccggcaatcacacttgctggaatctatgtcacgagcgtatcattttgctgcaaccagccgcagagattgctggaaccggcatctagaattgctggaacgggcttcttcttcttcaacgacgcctatggtgaccacgaagacggcgagtgcgggaagccaacgcgagcgcgggcgggtgcttcaatctccgacgaagggattacgacgagggtcgcgggcgttcgccgcagcctctctctctctccggcgcgcggcggctgctcccgatgcgggagaagaaagaatcaaggaggaagaaggagggaacgacgcgcttgaggggctgaatcatgaggggcggaatgcacgcatcgtgtggctgccgtgcgtctggtccaaatttgggccagcgcgccggcgcctatcagtgttcgtaccggaaggtcaatggagatgctcggtatatgttcaaagcgcctgtgtggaggaggtgcacactgccatggggcattttgatttcactgtcaccgtttcagtccatgtagttcctccccattccccagtgcctccttttcctaaagacatatacgatgtggtaatgctggcctacgtcaagtataaannattgtatactt

SEQ ID NO: 11667 - DNA, 624 bp, Triticum aestivum
  Clone ID: PAT_TA_11667
ggcggactctcctgcaatacatactccgccgccgccgccgccgccgccgcgatgcttctcttccacaagcaactgttctcgctccgtctcccagcttcacccgtgatcttctctctccgtcgggccctcttgtccacctcggcggccaccgacgccccgccggccccattcgccgtcgacgactacctcgtcaccacctgcggcctcacgccggagcaagccctcaaggccgccaagcacgtctcccactgcaagtccacctccaacgccgagtccgtcctcgcctacctcgccggccccaccctccgcttctccaaggccgacatcgcccacgtcgtcgcccgcgacccgcggatcctcaactgcagcgtcgacgacaccctcaaggcccgcgtcgccacctttcgcggctatggcctctccgagagaccacgtccggtccttcctccgcatggcccccggcgtcttccgctccgtcagcatccaggagaagctcgggttctggttgcacttcctggggtcgccggagaagttcccccgcctccgcgggcgctactgctaccccctctcgtcgggccgccggcctgtggtcaagcccaacatcgcggtgctactggagagtgg

SEQ ID NO: 11668 - DNA, 634 bp, Triticum aestivum
  unsure (1)..(634): unsure at all n locations
  Clone ID: PAT_TA_11668
ggatacaagaaggacaagattggggagctacgcttcttattttcaagctaaatcgtgctttatgtgtccaagtggagcccaaaagaaaataagtttgctgtgggaagtggtgctaagtctgcatgcatttgctactacgaacaagagaacaactgcaggattcaattcggtacaacagcatcaccgatgcagacgacatggggttcatcgtgccaggcacctcggtgttgcttccatgcgacggcggcagcagctacagaaacaaccacgatgaacccctctccttgcctccagtgcttgctctcagctcgtcgtggccatcctgccaaggctatgtctgcaaacccagaggctgggatgcacacacccgaaggtcaccctcatcacctccttcccttgccctgctccccaattcgacggcaagatattgaatgagtatctggtatgaggaaatggaggtgacgttgatccctagaggcctaatgtatttttcatttcctgcttcgtactttggagatgtacccgcttaaggccaaggacctcttcatgacataagtagaccatgtcgatgcactatgagtaaaacaatgaatcgtcagagttatgagatgtaatnctgtgaagccccttttta

SEQ ID NO: 11669 - DNA, 956 bp, Triticum aestivum
  Clone ID: PAT_TA_11669
gctccatcccctcgcgctagggttttaaggctttgagtcgggaggcgccgccggcgacgacgacgactacgacggggagctgagatggcggacgcggcggtgaggtgcctccgggacggccgcctcgacggcgagcacgcgccggcgctggccgtggagggctccctccagtgctgccccctcgcggcgcgcgccatgctccacgtcgccgccgccgtcgcctccaacgcggccgcggggaaggcgcaggccaggggacttgtggtcgtggcgtttgatcggagcccggaagtttacctggatatcatgcttcggcacggccttgattcaaaatgcactgagtcgatgtgttcggatattggattgctactcagacccactggggtggaagcaaaatattcgaagtcagcagcaccaagaggacagtggaacaccatgctcaacaaacaaagacaccatcacaattttcagaagtgtgaaggatgttgataagttgtcgtgctccataattgatcttggaagagggtttgaaggagaaggcaagacctatttttctgttgctgttgattcaatcagctctatgttaaggcatgcttcagtgcaatcaatttcaggccttcttagtaatcttcgaagccatggtctcccttcgtcgtccttctgccttgcgcatcctggtctccgtgtaaccttgtgctcccgagcctgtgtttctcgctctgccatggttgcttctggggtgccagtcgttgttgtctctgtgtgtggggatggacctggggcggtcttctcgctccttgcgcactccggtcctctagctgccttccaggtgcgcctgaagcgcaggaatggacgggtgaagcatctgtatgaggagttatgtgtcgagggatatgatgtaaaatttatttctgctacttctgtaagtatcgaagtgaaccaaagtctactaccta

SEQ ID NO: 11670 - DNA, 801 bp, Triticum aestivum
  Clone ID: PAT_TA_11670
cctccgttcccggggacacccgttccgttccgatcccaaacacccaccgccaccggtggcagatctggatcggagccccgctccggcgacccccgatccccccgacgccgggatggaggtcatcccagccgctgcggcagcgcacgacgggcagaagcagaggttcgacctcggggtcttcgtcggcgacctccccctcgacgacgacgacgcggccagtgacaacgagtcgctggaggggctgcagcaggagctcgaggactgcaagaacgaccaggaagtagcaaacatcctggctaatggcatcaagatgcgtgattacacaaaaggtgtcgagaacagcatacgccaagttgagctggattctattcaggattacattacagaaagtgaaaacctagtgttgctgcatgatcagatctctgactgcgataatattctttcacaaatggaaaccgttctaactggattccagacagaaattggttctataagttcagagataaaggtacttcaggagaaatctatggacatgggattaaagttgagaaaccgtaaggctgcagaatcgaaactgtcaaaatttgttgaggatataatagtacctccaagaatgatcgatataattgttgatggagaggttaatgatgaatacatgaaaacacttgagattctaagcaaaaagatcaaattcattgaagctgattcgatggttaaaacatcaaaggctctcaaagatgttcagcctgaggttgagagacttcggcagaaagcagtatcaaagattttcgagtttatcat

SEQ ID NO: 11671 - DNA, 706 bp, Triticum aestivum
  Clone ID: PAT_TA_11671
acacaacacggggaaacttaccaggtccagacatagcaaggattgacagactgagagctctttcttgattctatgggtggtggtgcatggccctgccccgtgccgcgtccggcggcgcgggggcagtccgtgggcccgcgggccccctccccgcggacgccctggccgccgccgccccgcccccccgcgcctccttccgcgacctccccccctcgggcaatgatgtgtgcaaggacggaaagaggcagacgatcaacgccgaggacgtcttcaaggcgctcgatgagatcgagttccccgagtttgtggagcccctgaggactgcactggaagagttcagaagcagaaatgcagcccggaaaccagcatcaggcaagaaacaatctgaaaagaagaggaaactggataaagaggcagtgcccgaagagcaaaacggtgcagccgatgaagccaacgcggacgaggattagtttttctgaccttattataggctgaatccgaatcacattagcgggtgtgctttcttagcagcaggccccttgtgctctgtttcgcggtctctctagatgcagaactgctgtgtacttggtatcatgatgtatgcagtgactcatgtttccgttccaaacatcatcagctatgctagctcaaattagaaacctcgtcttggtgctatttaaattaccacctttggtgaaaaaaaaaa

SEQ ID NO: 11672 - DNA, 1072 bp, Triticum aestivum
  unsure (1)..(1072): unsure at all n locations
  Clone ID: PAT_TA_11672
gnntgtacnccncntttggaaattcccctactaatgggaacaaaagctggagctccaccgcggtggcggccgctctagaactagtggatccntngggctgcaggaattcggcacgagccctaagcgaaccggggttccaaaggatttcgcgatccccatctccatctctctcccatggcagagccgccgccgcccccgtcacagtcgccggcgcagacgccgccgcctacgcagcagcagacgcccgcggcaaacgcgcgggatggcatgatggcgtgcgtggctgcgctggaggcggcgctgttgccgtgcctccccgcgcgcgagctgcaggccgtcgaccgctccctccagtcctcccaccagattgatgtcgagaggcacgccagggatttcatggaggccgccaagaagcttcagtcttacttcatcggcatgcagcgcgaggaccaaccaacaaccgaagaactgcttcgtaaggagattactacaatggaggaagaactgaagaccaagtctgagctcattgccaagcacaagagtctcattgaagggtggcagaaagaacttaaggaccagctgggcaagcacaacaccgagctcgaaagagtttgattccaccatgtacattccctatttcgaccagaatgaccatgaaattctgtgtggctgaatgttacagtcgtccctggaaaaattgtgtcagccaggagacaagccagcataactaatgtttaggatctaaccagtcaaattgttcatcgatgtcttgtttcgttgtggaacatgtaatttttttctatctgtttggttaccaaatgtcttgattcggacgtttggggcaaatttgccatgcaaaacatgtagttaaaagttgaaaacaatctacacttcagcccttcagcataattgtcccngnctttgcnanaagccattaanctttaaaaaaatataatatnaaaaaacnttngnggngggncccgngncncccaattntnccttatangggngnnnttttacaaantnnttgggccgnnttttnaaaacnnnnnanttgngaaaancnttgcct

SEQ ID NO: 11673 - DNA, 808 bp, Triticum aestivum
  unsure (1)..(808): unsure at all n locations
  Clone ID: PAT_TA_11673
gaaaaacgcgaaccccaccctgccctccgcagcaagcctccgccgccgccggtccccttctgcgctgctcctcgccgcggctctctccggcgaatctgcatggccggcgggtagtccccatctaccgccctgctcctccctatcgcgccgcccgctccctgtctccagcagcagccgacgccccactctggcggccgactgcctactccggccgagaccccactccggcggaaggccccccgtttcccctccccacctcccaggccgtggccatgagctcgtccgtttcttgcccggtgcatcagccaatcctggctccgccactgtgtcaaggtgatgacggacgagcagatggaggtgctccggaagcagatctccatctacgccaccatctgcgagcagctcgtcgagatgcaccgcgccctcacggcgcaccaggattccattgcaggtatgcacacccgtacaccaactacacacacttgacggctcggtttactctttctgtgtaaagagagtaaaaggctttctctctctgtctctctccctccttttctttcaaggacgcagcgttgtttctatctgagtaaagttcaaggctttgtcggatctgtaaaagtactagtagtactttcttatgagctgatggaataggtagtatgatgattaggatctgtttatccattttaccaatttcttggtgagaatgctgcttttagctgtttgccaattcatgcatgagcaagccccacacattgctattcatgctagtagatgcttagttgtggctatgtaccanccttgagat

SEQ ID NO: 11674 - DNA, 1435 bp, Triticum aestivum
  unsure (1)..(1435): unsure at all n locations
  Clone ID: PAT_TA_11674
cctcgcctccggcgcgcgccgcacgcccgccgcgccccccgcgcccgcgccgatctgcgctcgattggctccggccggctgccggcagtggatgagcatggggcgctacgcgggcgccacggatccggaggcgggcagggacggggccggccaggccgtcctgctccgctcgcccagcggggccaccgcgcgggtgagcctgcacggcgggcaggtcgtctcctggcacgaacgaccgcggcgacgaactcctcttcaccaggcagcaaggcagtcatgaacccaccaaaggcgatgcgtggcgggattccgctatgctttccacagtttcggaaactgccggacctgggagcgacatggtttgcccagcaacagaatctggccccttgacgaggagcctccgcgggcaggtcgcctccggcaagagcgaccggggtgccgagctcctcttcaccagcagcaaggcaatcatgaagccaccaaaggcgatgcgtggcgggattccggtatgctttccgcagtttggggactgcgggaccttcgcgcgacatgcgtttccgaaacgttgaatgtgggccctccaggagctccttcccccaccaagcagaagtctcagtcgcagcagaccgcgtggtgaccatagacggccgccagacccaggggtcacgaagagctggccacatagtttcgcgttccgccggacaatctctctcactaaggacggtgacctctcactagtatcgcgcatcagaaacgttaatggcaagccattcagtttctcatttgcctaccacacatacctctcagtttcagacatcagcgaggtgaggatagaaggcttggagacccttgattatctggacaatctcagccagcgggaacgccataccgaacaaggagacgccataacgttcgaatcagaggtcgaccgagtgtacgtcagctcgccgaacgtgatagcggtgctcgaccacgagaagaagcgcaccttcgtcatcaggaaggatggcctccccgacaccgtggtgtggaacccgtgggagaagaaggcgaagacgatggcggacttcggggacgaggagtaccagcagaccctgcgcgcggacgcggcggcggcggagcggcccatcacgctgaggcccggggaggagtggacggggaggctggagctctccgccgtgccgtcgaccaactgcagcgaccacctcgatcagcccggcatcatgtgaggatgcactagcgtgtagcgtggttggttggtgattggttgcagtgctgtctgtatgtgtagccgcctgtccgtctgtcagggagtcgctttcgttgtactagcatcttgtacatgtacatggatgggatcagtaggttggttggatnccgtggtggtcagccggcggcgctgggttcgccggttnctgagacctggnttntggaa

SEQ ID NO: 11675 - DNA, 677 bp, Triticum aestivum
  Clone ID: PAT_TA_11675
tcaatggttgagaaggttcagtacaagaatgtagtgttcactgtgtgggatgtgggcggccaggagaaattgaggcccttgtggaggcactacttcaacaacacggatgctctgatctatgtggtcgattccctcgacagggatagaattggaagagccagggctgaatttcaggccataatcaatgacccatttatgctcaacagtgtattattggtgtttgctaacaagcaagacatgaggggagcaatgaccccgatggaagtatgtgagggtcttggtctgtatgacctgaacaaccgcatctggcacatccaaggcacatgtgctcttaaaggcgatggcctgtacgaaggcttggactggctagcgacgactctggatgaaatgcgagctacagggcggttagcttcgacatcggcgtaaagagtaacagggatggctcgtctgtgtttcttggcacctcatttttcctttttgtgtctgccctgtggctgccctttgatgtggtcgacagatttgttgtagtatgaatgattcgcaagaggagatgcatttctgaagagggggtgctcctcctggttagaagcgcatatctattctgttctactctaggattgtgggatgtaaatactgatgtttctactgatggcatgacacgctcatatttgtggttc

SEQ ID NO: 11676 - DNA, 1190 bp, Triticum aestivum
  Clone ID: PAT_TA_11676
gtgagctcggcctctccacctcctcgtcctccccccccgtcgtctccggctccgacttcgacaagaggaaggaaggcaggcaggggcggcggggccgatcgatccttccccgaacctcacacgcgccgcagaaacttccagaagccggtccaatcccatcctcttcggcggccgaccaagccagccagattctcctgatccaaggagggagggagatgggccaggcctttcgcaagctcttcgatgccttcttcggcaacaaggagatgcgggtggtgatgcttgggttggatgcagccggtaaaaccaccatactctacaagctacacattggcgaagtactctccaccgtccccaccattggtttcaatgttgagaaggttcagtacaagaatgtagtgttcactgtgtgggatgtgggcggccaggagaaattgaggcccttgtggaggcactacttcaacaacacggatgctctgatctatgtggttgattccctcgacagggatagaattggaagagccagggcagaatttcaggccataatcaatgacccatttatgctcaacagtgtattattggttgtttgctaacaagcaagacatgaggggagcaatgaccccgatgggaagtatgctgagggtgtttgtctgtaatgaccgtgaacaaccgcatcatggcacatccaatcgcacatgtgctcgttagaggcgatggcctgtacggctggctatggctctggatgaaacgggagcaatcgggcattaaactgcgagctacagggcggttagcttcgacatcaggcgttaaagagtaacagtgatggatcgtctgtgtttcttggacacctcatttttacttttttgtgtctgccctgttggccgccttttgatgtggtcgacagatttgttgtagtatgaatgattcgcaagaggggatgcgtttctgaaaagggggtgctcctcctagttggaagcgcatatctattctgttctactctaggattgtgggatgtaaatactgatgtttctactgatggcatgacacgctcaatatttgtggtttagtctgaagaaatcacagtatttactctaccttgttcatttgttgggaatgactagctagaatgccaaggctaaaaatggaaaatattgggatgctttaaaaaaaaggagcgaaaagaagaaaag

SEQ ID NO: 11677 - DNA, 697 bp, Triticum aestivum
  Clone ID: PAT_TA_11677
cctcccccgacgacgtgcggggcgtccggctcgagatcgaggtcatggcgcgcctctcgggccaccccaacgttgtcgacctcaaggcggtgtacgaggaccaggactcggtgcacctcgtcatggagctctgcgccggcggggagctcttccaccgcctccaggagcgcggctgcttcccggagcacgaggccgccacgctcttcaggtacctcatggaggtcgtcgcgcactgccacagcaaggggatcgtgcaccgggacctcaagcccgagaacatcctcctcgtcagcaagtcgccgtcctcgcccatcaagctcgccgactttggcctcgccacctacacccagcctggtcaaagactgagcggcacggtggggagcccgttttacattgcgccggaggtgctcgccggcgggtacaacgaggctgccgacgtgtggagcgccggggttatactctacatccttctcagtggcatcccgccgttctgggggaagaccaagtcgaagatcttcgagtgtatcacgtcgacggagctgcggttcccttccgacccctgggacagggtttcggattcggccaaggagctcatcaccggcatgctgcggcgcgatcccgcacagaggctcacggccgagcaagttctagagcattcctggatacgggaacacgccgatgattcgcgcgattcctg

SEQ ID NO: 11678 - DNA, 931 bp, Triticum aestivum
  Clone ID: PAT_TA_11678
gaataaatccccatctcctgagcccctttgtgccggcgccatgaggcgcttggatgggtcggggttctccgtctccgtggccggcaagcgcaagcgttcgccggagtacccctgcgtgtcgcgcttccggcagcggcgactcctctccttcctccggcgccagaagctgttcgacgcctacgacgtgcttaccggcgagtcgggtgcgcgcatcgacctgtaccatctgaccgaccttgtcaaggcgggccggtgggacgaggccatcgaccatctctcctgcttcctgccgtgcgaccttgctctgggcgcccacggccgcgtcctcctccacttcctccgcgtgcacaaggccgtccacgacatcgtctccggggcgcccgagagccgtgccgtctctgccgctctcaggatgtgcttcaccaagaattttaccatcaaccacgccatcaccaagctccgcaccatcctctggtccctccactcctccagcggattcagggactccctggactttgggcgcgtgagagacaaggctgcatccactgtcgtttacttggcttatcaaactacagagttgagagaacatatgaaagaggcgcgtggcccagcggaaccccacaatgtactccccattggcttcggcttccgtccaaggcgccatgtgaagcgaggccccatcccgggctctgttcttgtcaggcactatcttcgtaagaggaggatgcttgcttcttcgatatcaagtcactgtgaagggtcaagttctgaatcgttaattaaggcaaaagaatggatggtggatcttgttgattcatgtttggaagctggtaagcggcatcaagggtatccacttcaatatgtttgtactccaatggtacacaaaggtgctcctgttgatccattctcgcggagtaatcttggtacattc

SEQ ID NO: 11679 - DNA, 892 bp, Triticum aestivum
  Clone ID: PAT_TA_11679
ccggtccggaaacccgggtcgacccacgcgtccggcctttttaccgccgtgctgcaggtctctatctacccagtgtccacctgcggctctccttcgccccgctccctccctccccgcgctccactctctctcgactcgtcgtcgctccctttctcgccaggtgaggcagccgcagatctgctgctgttgatccccggctcggatcttgatgatttgggggctcttcttcaagtgattgctgtcacttctctggcctacctctacctggatattggattcaatcaggtggtaatttctcctgttgctcatacacgagactgaaaaggcgtgcatgttatgttaaaccgtcacaaagatggcgacaaaaggacagcttgttagagaaaggaatgtgaagatcacatcaagccgtgaaggtcgtcaaaggggtaattcacagtcagaacaattagtgcaagttccaaagcaaaaggactcggcagccagtggaaacattgatggaaaatttgaagatagaatcagagttgtgaagaatgacaagattcgtaggcagcgagaacctcgaaatgcagaaggggatgtaggcttgaagagctcaaaaccatggcctgcacgaaaagcaactactgttgatgaacttgtcaagcatatgtccaaagttccttcgtatttacagcgcaaagagacggctgaccatcttcaggacaaggcgctgaatgttggggttcttgagtggggccttctcgcaaggtggtctcatgagcaaaaacatgagccctgtagcagccatggagcctcttcatctgataccagcagatctgttctattctcttctccatctcattcttctgcaagccccagcagcaaatctcttgatagcaatcagtctcca

SEQ ID NO: 11680 - DNA, 350 bp, Triticum aestivum
  Clone ID: PAT_TA_11680
gaaggccggtgattatggtagcaaagctgatgaggattgcagaaagaaagaagattaccaagccactgactcctgcccgatcgtagtctaccaccttcatctggaaggcattgatgtgtcatacaaaatcgatgaaaattcgaacattgttgttgacaatgcagcccttctccccagtgctgcaaaccaaaacaggtgtagctacctaacatggagggataagcttagcactttgtaggagagtagtatacagaacttttggtaagtcgcaggagcacaagctgcacaaggctgtgcaatatcatgaggctgatgaattcagtggcaatcagtactccataaaaaaaaaa

SEQ ID NO: 11681 - DNA, 764 bp, Triticum aestivum
  Clone ID: PAT_TA_11681
gccgcaagcatcgccggaacccctatgggaacgaggggagcaggaacatgcagatgagtgcgctagaggagcacaacaatagcttgctgcatagggaggcgctccggctgcagtcagcctccaaggagaaggtgcaaactcctgagaaagagaggctggtttatgtcaaagctttgtcgaaaacagcagcttcaatacttgaatctctcttcaagaaggaccctcatgaagctgaatttatacagtctatacaggaggtggttcattctatagaaccagttttggtgaagaactcacaatatgttcacgatattggagcgtttattagaacctgagagatgttttatcttcagagtgccatgggttgatgacagaggtgaagctcatgtcaatcgaggtttccgtgtgcagttcagtcaggctttaggtccatgcagaggtggtctccgtttccacccgtccatgaacttaagtgtggcaaagtttctagcttttgagcagactctgaagaatgctctgtcactatataaacttggaggtgctgctggagggagcgattttgatccaaagggtaatgcgcttttgtcaaagtttcatggatgagctgtatagatacttgggccctgatcaggattttcctgctgaagatgttggtgttggtccaagggaaatgggtttcctttttgggcagtacagacgcctttctggtcattttcagggaaattttacagggcctaagatcttctggtctggttctagtttta

SEQ ID NO: 11682 - DNA, 730 bp, Triticum aestivum
  Clone ID: PAT_TA_11682
gcacatctagcaggtctaatagagatcagaaatgcaaatgaagcactctgttcttcgaagtctgaaacagttgttgaggaagctgtcagggagaacacttcagagccagtggacagtatggtgagatcaatagcacctatttttgtcggtgttgtgaaggatagtgagagctttgacttctgtatgtgcaatccacctttctttgagagtatggaggaagctggccttaacccaaaaacttcttgtgctggaactgctgaagagatggcttgccctggtggcgagcaagcctttataacacatataattgaagacagtgtttcctttaagaactctttcaggtggtttacatcgatggttggcagaaaagcaaatctaaaactattagtatccaaagtccgtgaagctgggggcctcagttgtgaaaactaccgagttccggcaagggcaaacagcgagatggggcccttgcatggccgtccatggctccgagaaaaaatgttataagatccagttcaacccggaaaagtccaccattctttcatgcttcagggtctccgacgtggaaatggtgcatttcaggtgttgaagtcagctgagacctttttctgtacatctaatctatcatgtaaaaccgattctctgtcattttctattgatgttacattgccagatgagcagactcaggctgcaacattggattgtgatgaccttcctggttctgttgaag

SEQ ID NO: 11683 - DNA, 500 bp, Triticum aestivum
  Clone ID: PAT_TA_11683
gcagttccccgtgcggccgcatcgggcggttcctcaagaagggccgctacgcgcagcgcgtcggcatgggcgcccccgtctacctcgcctccgtcctcgagtacctcgccgccgagctgctggagctcgccgggaacgccgccaaggacaacaagaagtcccgcatcatcccgcgccacctgctgctcgccatccggaacgaccaggagctcggcaggctgctcgccggcgtcaccatcgcccacggcggcgtgctgcccaacatcaaccccgtgctgctccccaagaaggcggccgacaaggagcccaagtcgcccaagaaggccgccaagtcccccaagaaagcctagtcgattacttactgtctagtaggagtacttcgtaatagaattagtgttcgctgtttgggtaatggtgtcgatgtagtgatgttctgctctgctttgaaaaaaagaacgtcagagatctctctgacttgctgtaaaaaaaaaaaaaaaaaa

SEQ ID NO: 11684 - DNA, 1516 bp, Triticum aestivum
  Clone ID: PAT_TA_11684
cctgcctcaacttcgccacgcccgggccgcgccctcccgcgcgtggagacccaggcctcgtcctccgcgcggccgatcgactgcggcccggccaccctcgtcggaccgtcctcctccggcctggtctccctcggccagcccgccagctccgcccccgtcctcggcccccgcgccccctgcgccgccgccccccacgggctcgccggcggcgcctggcggccctgctccgccgccccggggcccgcctccggccctctcccggcggccccccggggccagtccgccgccgcgtgcccccgcttcctcgcccggtccacccggtggtctgcggccccctcccgcgcccgccccaacccccggcgctcattccattatggtgatattaccgtgaccgatgtgtacttgttgcagagtcggccgcccgagctcatagacgggcaactgcgctctactatcaatgggatttcttacattgctccttccactccattgatacttgcacagctattcaatgtcccgggagtgttcaaactggatttcccaaatcatccgatgaatagactgccaaaagtcgacacctcggttataaatggcacctacaaaggctttatggagattatattccaaaacaacgccacgaccgtgcagagctatcacttggatggatatgcattctttgtcgttgggatggactatggattgtggaccgacaacagtcgaggtacctacaacaaatgggatggtgttgcacggtcaaccatccaggtgctgaaattcatgttttgtttctctttatggatttctatatattatatggtctggagaaacctaagaaaaattataccaaatctgcttaacaagacaatcccacagtattccccggtgcttggactgctgtgctcgtgttcctggacaatgcagggatatggaatttgcgcgtggagaacctggacagctggtacatgggccaagaactgtacataagcgtggtgaacccggaggaagaccacagcgacaagactccgcttcctcttccggataacacaattttctgcggcgcgctctcgagcctacagaaagaacagtctcataggttccagtactcgggagcttcgcgggttgggaagacggtgtctgcggcgatgatctcgacgacatggttggctgctacctggttgctgtatagatagacgaagacattgaatggacttgctttgtggaaaaggagtacagaaggagaagagatcatacagtggcagtgcagagacaggagtattacatatggtggaggaagggctcctgggagggatgcttgatttttttgttaggttcaagtgatgaatgcccccaattgtagagtacatggagcaggagaaaattaattattccattcaagatgtgcagtactagtttttgtgcgtatgtgtttaccgcttcaaattcgccgcagtggttatcagcttggatttggaccggaagtcggtcccgggcacgggcaggcatatggataccaatt

SEQ ID NO: 11685 - DNA, 272 bp, Triticum aestivum
  Clone ID: PAT_TA_11685
ggaaaccccgaagaagcggagtgattaacgttcagatttgtcctatgcttcggagaaagcagaataattgggtatatgatttagtagtagttagcttcatcgcctgttttttactctgactgtgttgaacaatggttacgatgatttagtagtacttgagcttcttctgtctgttttctattttcttatatatgtagcctcagagcatctccaacagatgatgcaaaatatcaaaatataacacccaaaaacagtttcactcaaaaaaaaaa

SEQ ID NO: 11686 - DNA, 1122 bp, Triticum aestivum
  unsure (1)..(1122): unsure at all n locations
  Clone ID: PAT_TA_11686
gcgtgctgctccggttcgtgcggcccgcgtgcgccgtgggcgccgacgaggccgccgccgccgcgcgccggatcggcgccgtcagccacccgaacctcgtgccgctccgcgccgtgtacgtcgggcccaggggcgagaatttgctcgtgcacccttctacgtgggcggctcgctccaccgattcttgcaagaggggatcgccgactcgcagagatggagcctgatctgcaagctctccgtcggcccccccgtccggctcgaccacctgcacacggggatggagaagccgatcatccacggcaacctcaagacgagcaacgtcctcctcgacgccagctacgagtgcagggtctcggactacggcctctacctcctgctcaacaccggcggcgcccacgagatgctggaggcgtcggcggcgcaggggtacaaggcgccggagctggtcaagatgagggacgccaccagggagaccgacgtgtacagcctgggcgtggtgctgctggagatgctcgcgcagaaggagccggccggcggcgacgaccgcgcgccgagctcccgcgacatcttcttgccggcgtcgttcaagaacctggtgcgcgagaggaagatctccgacgccttcagctccgacctcgtcaggcagagcaggaagtcgggcaacgagaggaagctcaacgcgttcttcgagctggccacggcgtgctgcagcccttcgccgtcgctccggcccaacaccaaggagatactcagaaggcttgaggagatagcaaaataattaactaaatgtgggtaggttcaccattcagacgtagcacgaggcaaggctcaaggaacgactgaacctctgctggacggaaaattggagaatggaggcacacggttcagatatcatggaatgtgtatagtcagagtgtaagcgcggtggaggccatcgtctcaagaatatactcattgtacgtaatttattttcttgtgctttgcttgaaaccgaccatgtacaaagtgttgaaagagtggggacggcgtatgctgcatgttcatgcatcaaaatcgccatgtcgatgtaaccttggtctgatctgagtgttatatcagatatgattggtnggaaaaaaaaaa

SEQ ID NO: 11687 - DNA, 997 bp, Triticum aestivum
  unsure (1)..(997): unsure at all n locations
  Clone ID: PAT_TA_11687
gtgacacatggnagtgcaccgcccactatgcccccagnagagacattgatgtcatcccaccactcccaagagcccagtaccacggtcaaaaaattttcaatacaatcctctccaaagaagaaggcggtgtcttgtcctacctgtatatgttggccgaatttttcagcaagccaaaaattttcagggtgcgcgtgtatatgttgcaagggggcgtctggtgcatgcatgcctcggccacgacacagctccctcgtctgctgacgtcactggaagtcgtgcttgttgacgagaaaatctatatggctgacaccttcagtgatgaaattattgtcttggatatgacaacctcgggtttctccacaattccgctcccacaaggagtgaattttcactgtgttcgcaccatcatgtcacgcgccggtgatgcttctggtgtatatctcacccatatccatgtcaaggagctacaactttgcatctggctccacaaaggggacaactggttgttggttcatacaatttgtttgcatcagatgtgggataatttgaggatgctagatcagacccttgaggatgagcatattagttttacttgtataagcaatgtgggggataatgctgaatttgtgttcttggaaatgtgtggctgcattttctatctggatgtcacaagcaagacactgcgtaaagtgcatggggtgacagtaaaggatcgaccgttcaatgatgtctatccttttatgatgatttggccgcccaaattccccgcgcccaaggatgatcctgcaagaaatgccatgtgaaggaggatgatatcaggaagtttttggatggtgagcgacaagggtgagcagagaactgcatttccttggctgcagtttcactgtaactcatagtgtattagttgagatgatgtataactggagcaggtagtcctatccctatggtaccatgcctacttgtgaccaacatattggttttggacgaaaactccctg

SEQ ID NO: 11688 - DNA, 741 bp, Triticum aestivum
  Clone ID: PAT_TA_11688
gcccctctcctctccctgacctagccgccacctctgtctcccgcgaactccatggcgactgcggcctgatctgcatccccgccgcccctgctgaccccgtctaccacgccctggtcttcaaatcgcggctgccgcacttcaacctcgccgccgccaggtccggcacaccgtcgccgccggccgggagagatggatgatgaggcgcaggagactccacctcgccgccgccgtcccaagagggcccccgaggtacgtgtcttcagacaacaaattctccaacttgctgggattgcttgtcatgaacaggagggaaaatcacggacagagctactggagaagctcaaaacatgtaacaaggttatgctagttgaactgtgccgttcatttgatgtccctggttcaacaagcactaagaaggatgaattagtgacaatagtgatggagttcttgatggaacactgttctggtattatttacacagatcctgataaggctcaacttcttagctgccagaaatttaacaaaagaaagcgcaagaagaatggagcggatctatctggtggtgaaccttccaagaaaaggaaaccagatggaactctactggaattttgtagtcaagaggaagcagatgggagaaaagctgtagaagatagaacaaaccattccgagttcagcttgagggatagcagagatgagctggtaaatgactccgcgttggggaaattagctgtagttccactg

SEQ ID NO: 11689 - DNA, 750 bp, Triticum aestivum
  unsure (1)..(750): unsure at all n locations
  Clone ID: PAT_TA_11689
gcgccccgtcaccggcgtccagcgccgtcatggnattcgcgccaagggaacctcgctgcgcccctccgtcgtttcttcctcgccgccgcacttctgttccagcgccgctcctctgtttccgttcgagcagagacgagcgctcgcccgccttcgttgaccacgcgaggactcagcccgcggtaggcccagcctgtttcccctctagagccggcctgccttggcctctccccccgatctgggcttggcccatgggtgaggccaccccaagcgccctcttctttttttcgtactgctgggccagttcagtttcggcccagtggatgttttttttggttctgtgaatttagctattttccagggatttgcagatttacagaaaaccccctagccttcatgcatttaatatctcacaaactaagcatcacatgtaaaaactttgtatatgaaacttgcttagtttttcatctagtttcataatatgtcttcttcatccatgtttataattcttaatatgttgtttgtttaaatttgctttaataacttgctacaatggtttaattcataactaaataaccgtaactccgaatttaacaaacgttatatgtaaatggggtagaattttgcatagtttaacatggtggcatctctttgcatgtttaacaactctaaaattgtgtttagggcagatcagtaacaaacattaaaatatgcatatggggtttcaccaaaattgttgtttgttgttccggc

SEQ ID NO: 11690 - DNA, 913 bp, Triticum aestivum
  unsure (1)..(913): unsure at all n locations
  Clone ID: PAT_TA_11690
gggcgccaggnaaggcggcggagggggagaagcagccggaccccgtggtgaacgtgtactcggccgcggcgtacggggatctggagcgactgcggcggttcgtggagcttgacggcggcggcgcgtcgctcgccgtgcccgacggcaacggctatcacgctctccagtgggccgcgctcaataactacccccacgtggcgctctacatcatcgagcatgggggggacgtgaacgcagaaggccacgcgcagcagacagcgctgcactgggcggcggtgcgcggggccacggccacggccgatgtgctgctggagaacggcgcgaggctagaggcagccgatgtgaacggctaccgggcagtccatgttgcagctcagtatggccaaacaacattcttgcatcacatcgtctcaaagtatggtgcggactttgaagctttggacaatgacgggaggagctctttgcactgggctgcctacaaggggaatgcagatacaattaggttactactgtttatggatgctaatcaagtaaggcaggacaaaaatggttgcactcccttacactgggctgttataagaggaagtttagaagtttgcacccttcttgtacatgcaggcaccaagcaggaactaacattgagggatagaggtgggtttactcctttgcaacttgcagcagacaaaggtcaacagcatctttccaatatactttctaatgctacaaaagtaagctttggagacaagtactgctcagggaggctgggcaaggttggatacgcacctatcctgttttcttatcttgttatcctcatgatccttttcctgaaatcaattgtttttgcatctgatttttctagaatcactgctgctgttggtctttggtcatgggctgctatttctcttgccttggc

SEQ ID NO: 11691 - DNA, 1312 bp, Triticum aestivum
  unsure (1)..(1312): unsure at all n locations
  Clone ID: PAT_TA_11691
gccggcggtaccgggtggactgaaaactaatcccttcgccgaaaaaattactcctaactctaactacggtcatgtctgcatcacggtcggaaggcgatgaggccctcgtcaacgaggtgctcaccgacgatgagctccgtgcggtgctcacccgcctggggcccgagtcggagcgcgacgcgttcgggctcgtgtgcaggcgctggctccggatccagagctccgagcgccgccgcctgcgcgcgcgcgccggtccgtccatgttgcgccgcctggcagcacgcttcccgggcattctcgagctcgatctctcccagtcgccgtcccgctcgttctaccccggtgttatcgacgacgatctgcacgtcattgcaggggggttctgcaatctacgagttctcgccctgcagaactgcaaaggtatcactgatgttggaatggtcaaattaggagaagggctgcaatgtctgcaaaccctagatgtctctcactgcaaaaaacttagtgataaaggattaaaggtggttgcgtcaggctgccagaagttgagacagttgcacatcgcaggttgcagattaataactgataatttgttgcatgctgtatcaaaaaactgtttgaacttggaagagcttggggctgcaggatgtaacagcataacagatgctggaatctcagctctagccgatggttgtcataaagtgaagtcactagacataagcaaatgcaataaagttggtgatcctggaatttgcaaaattgctgaggtctcttcgtcatctctggtgtcattgaaactgttggattgcagcaaagtgggcaataagtccatctattcactagctaagttctgctgcaacctagagactctcatcatcggtggatgtcgggatattagcgatgagtccatagaagcactagctcttgcctgttgtagcagcctccggattttaagaatggactggtgcttgaaaataacagacgcctcgttgagaagtctgttgtgcaactgtagacttcttgccgctattgatgtcgggtgctgcgaccaaataactgatgcggcatttcagggcatggaagctacttggttcagtcggaattgagagttctgaagatcaacaattgtgttgactcaaattntggaatancacntataaatctcaaggactcaatactcanntcggtaagtcccaggtaaaggaaactcaagaactggtncacnacgtgntgaagtaactttagnactnccgatcgtacgtaaggtncaggcacntaccctaactttggagcaancnaggtnaagtaattc

SEQ ID NO: 11692 - DNA, 573 bp, Triticum aestivum
  Clone ID: PAT_TA_11692
cgtcgttagccgtgctccggtgtgttgccgagcgatggggtgtgccgagcctagtgtgaggtgcctagaagatgtagtctccgtcggaaccgtgatgtgtgtccggtcgatgtgagagttcttccgggttgtgcggagtgggtgcgtgtctacctcatgtgtgtgttcgagtcgtagagagaaataaagccaagatataggcattggtgcaccgcggcattcgtccggaaaaatcatggtctctccttcgtctacctttgtccggcgtttgtggcaccgaaaggctgtccgacgtgtatcgccgtggaggattggttcggggtttgtcccaacatttggtatcatgagcttggttagcttgggcgtggttcgccatgtcggaggcgtcccagcgtttgttggtggttgcgtgaagctccgagccgtgtgtcggcctatggaggtgcgcggcgcggcgactgtcatggccgatgccgaggcgacacacgatgagttcacgacgagtgcgacggacatggaggcagaggcagcagggctgcgctgcacggggagagcatggcgaccacgatgcac

SEQ ID NO: 11693 - DNA, 974 bp, Triticum aestivum
  unsure (1)..(974): unsure at all n locations
  Clone ID: PAT_TA_11693
gcggcagccgagcccaaccgccttgccgcggctatacaagccagccccgaccccacccgagctcaccacttgacctcacgcactcctggctacctccccgaccacccaaacgagctcaaaaagctctctagtttcccccatggctgccgtgcccgcatcggcctcggcctaaattcgctcgaagccggccccctccctcctcctcttctccacgagagcctctacccatctctaggaagccaccccgtagcccttctcctcctcccctcgcctgcagccgcgagtccaccggcggccgaaaccatcctccgccgcggctgatggttcgctcgtctcggtgctccccggtggccgcttcacgtccaagtgcatgcggctcaacgccctgatctctccagtgtgtagcacgtcccaggaggtcgcctacatcgccggcaatcgccgtcggggtgcgcccctgcctcgaccgtgcgcgagctggaggttgaaggcgacgacccagctggtggtccccacctgcccgtgggccccgcgagtcagcctctccacgcgttgaccccgcctgcccagctggataagtgacgggccccacagcccgtgggacccgcccgtcagcgaagcgcccggccccgcctctgatgacgtggcaagtggagacgttttttgggcgaaaaagtccctgatcttctttacctcataactccgcaaccgtaactccgatcgagcctcctccgagagagtaccctttccggtgattccttctgcggtcatccgcacttcttcccggagtatccttcatccccaggataagcgttccagccagagtccctgcggagtggagttcaccaccgtcgtcgcttttccgctgccagtagtcattccgctgcatcgtgttgttctgctgcttgcatggagcaaccgtggcaggcgtagtgtcgccgtgcnnatgaatatcctgaccccaatagatncaa

SEQ ID NO: 11694 - DNA, 967 bp, Triticum aestivum
  Clone ID: PAT_TA_11694
ggatagcacgacagtttgctattagaaaaggaagtctataactattattcagtcatttgtcaaagcataccatgtgaggaaagcttcaaagcaagaagttgttgacataaggtctagaattcagaaggcttctgcacaagttgatgatgacatgcgcctgatcaatagactaattgctgcgctgtcacaaatcactggatgtagaagcatcagcagcattcgacaaacttgcacgacactaagtattgctacagagctttctgagaagtgttgtgcgacacttgttgatgccggtgctgtagacattcttctgaagcaaatccctcaacttaaccgtgggatccctgaccaggaagtcttgaagcaagtactctatacactgcggaacattgcacgattcccaaatgttcgaccggtgttagctaacaatccacaattggttaacactattttccaggagctgctgcggaacaaaacggacatgtttttcatcgcatgtgaaattctgaagaagctgtgcgagtcggaagaagggcgcggattcgccggggccctggggcaccacataagaaggctggacagtatggtgcgaggccttgagaagaaggtggagctcgacaagagaaatggtcacactgaagctcgtaaggaggacaatttgcggcggctcggggaggcggcggccctctaccatcttctcaccaataaataatggcatacggtgtggtttgtagcccttggtttctggaaccggaagtgattgtagtccaaaggtagatcctgtggacagaagtgtgcgcgtcagtcgtggtagtatgtggtaaacagtcggggttgtggaacggagcatcagcttgatgtatgtgacaatggttctattttcttgacattttcttcgttgtgttgcgtttatcctgttacgactattgatccgaggcagaagcgagaaaccgacttgcgatttcaa

SEQ ID NO: 11695 - DNA, 1252 bp, Triticum aestivum
  unsure (1)..(1252): unsure at all n locations
  Clone ID: PAT_TA_11695
ttcggcacgagggaaaagacctttacttgtgctcctagtgatgatgattggatattttgtggagaagtctgtgataggcttaagttgtttgctgacattactgaaatattttctgggactcagtatgtgactgctaatatttactttcctaagatctgtgaaattaaaatgaatataaggaagtggtcgaagtgtgggaatgaaattatagaatctatgtcagatgctatgagtgcaaaatttgacaagtactggtctgatatccaaggcctcatgggtattgctacactccttgatccacggtttaagattgatatgctgcatgtgtgcttggaaatgctccttggtgacgagtccattattgattgtgagagtaaagttcatgagatccgtgagttagtgtctagcctgatgcttgaatatcaaatggagagggagcaagagaatacagaagcccaagtctgggtccatttctgcaatggaagctaacgaagtgatgtccatcttcagtgcacgagtagctagaaagaggcctgcaaccagtttatccagaacagagttagaccgctacttggatgatgagtatgtgccagctaatcaagagaattttgatgtgttgggatggtggaatgttgctggttcacgctacccaactttgagggcntattggcggcgtggcatatttggccatccccagtcaactacaggagcgtcccccgcggccttcagtagaagtggaagagtacttagtgagcaccgcagtcgtctgacccctgatttgctagaggctttaatgtgttctcctgtctgggtgggcatctcacctgtagatgatgagaagaccgaggctgctagtttctggagttgccttgatgatatacaagaaggtttagagcgcatcacactatagagggggttccttctgtacttcctacaagtcagctcaacttcaacaaacaatgatgccgaacacataccaaggctgtagctgttagcttgctacctctgcaatacttttgcgcacgatcatgtttaccttaagttagttatggtcacatggaaccttatgttggagtcaataaattatgtcaagcgagtcagacaaattttgtagtcaataaattatgtcaagcgagtcagacaaatttcgtccttattaaatgtggtgtttgcatggatactctcttcaagcgtgtgctcacgctattcaatatttctatgatatttgtgtgcctccgccgcgaccacgcta

SEQ ID NO: 11696 - DNA, 1245 bp, Triticum aestivum
  Clone ID: PAT_TA_11696
tcggccggccccccgcccaggtacatgatcggcgcactaataatcaaaggagctcccaggccgatactgcagatgttgattctaaacaatttggtggagcaaaagggaaccatgttagcatcggaactaatggcatcgaggaagctggacaacctattccacgtaggcggcaaagtaaaggcaatagaaagacacatacctcacataagcagaggttctttgctggtaattttgcgaatagtcccaatagtcgatctcactatggtggtgtatcagaaagccccccaagcaattcaattggatatttctatggttctactccggaaaatcacagtagctataagagttcaaagctgagctcatctcctcatggaattcctactgggagctcacctattggatcagtacctaaatctttcccaccgtttcagcaccctagccatcaacttttagagaaaaataaattccagcaacaaaggtacaataagttcaagaataaatgcgttgctgaacgtaagaagttaggaatcggtttgagcgaggaaatgaattcgctctatcgtttttggtcatattatctgagagataatttcaatgaagatatgtacaagcattttaagaattttgcagtagatgatgcagcagcaaattacagatatggacttgagtgtctcttcagattttatagttatggtttggaaaaaaacttccaatggaatgtatatgaggattttgagcaactgacgcttgagttctaccacaagggcgatctttatggacttgaaaaatactgggcatttcatcatttccgaaaacaggatagcagccccgttaataagcatgcagagttggagaggctcctcagggaggagttccgaacaatcgaggacttcaaggcacggcgtgcggcagataaagaaaccggcggtagtggcagcaagagtgcggtggcggcaagccatagcaaggctgtggctaagtaggtcctacctgggcatgaaattttggtggtgatcctacaaaggagaaagtagcaacgtttttgtttggtgtaaactaaggatttgagtagactcgtccctgtgcagattttgctctcccctgccgatacttgttgctgtccaggaaatttttctcttcttttttttacatcagcttcatggtgccattgtgggatttgtacatagagataaaataattgcctttattaaatagccaaactatagagttaaaaacacgtgatga

SEQ ID NO: 11697 - DNA, 544 bp, Triticum aestivum
  Clone ID: PAT_TA_11697
tgcatagccattggattttgtcctgtctttgagattcgcgcgtacaactttgttcgtcccgcttcgtgcgcgctcgcgtcgctggtgccgttgcctgtctcgcggcccgttctttcccgtggattttgcgtagcgggccgttgttggttgggctggcgggccgttttttgtctctgtgggagcaggttcgtgaattaatgggcggcgattcagttttgtcctcttcacatgcttctggtgacggcgacttctggagagctacaagaagagagagacgcattggagtggcggtgattgtttgggagcgagaaggggagggggaggggaggaccagccaagttaaagtggtgtgcaccggcggtattaaattagtgtgttagtcactgaatggttttccgagcaaacaattttctacttgtcatgtttttgaggaagagagatatgacccacccctggttttgtatttttgaatgttggggttgatgctatgtacatatatgtatgcattttttttattgaatcatgggctgcattaaaaaaaaaa

SEQ ID NO: 11698 - DNA, 311 bp, Triticum aestivum
  Clone ID: PAT_TA_11698
ggtttccttcatacttatgttgttcaaattggggaagagcatcacaaattcacaggcacaagtgcaccaaacaagaagtaggcctgcagattcattttcgttgatagccgccgtgtgttgcttctctgattagctaggctctgtgcatagacgaagaagccattgtctcccacatttgtttccaactagatcattgaaagcgcgcgttgctgcgcccgtctattttggcactacaatgttagtgatagaatgaattatattagaggttttactctagcaaaattaatacatgaattatgataaaaaaaaaa

SEQ ID NO: 11699 - DNA, 616 bp, Triticum aestivum
  Clone ID: PAT_TA_11699
gcgccccccgcccccggcgcactgaccccatccaaatctctgctcccagtcccaggaggaaggggcggacacagaaagatctcccagtctgcgggaaccaccgggcacggtacggttccgcgctagcccggggcacggggatcctcgctgcccgtccgcgccatccgccggggatcctatcctcccgtcggggtcatccgcggatcaatacatcctgcgtgtaggaaccgtgggtcttgattcgcaggatgccagatgtaagaaccaaagccatttacgagcactggatcagctcacagcaatccgatttcgcatgatcaactggtggaaatggctcaaacaaatgctttgccaagtattggtggaaatagctcacacatcagctttgtcaccggacaccggttactgtaggacagatgagctgcatggatggttttcttgatgctgtaacactgacttcgtgggccggtcagggcttctccattgggaattctcagaacaatgggtgttcaagggttgaccatttatcatgtcaaaagtcatctgcagaaatatcggcttgcaaagtacatcccagaccccacagctagcggtgacaagttggagccccgggaat

SEQ ID NO: 11700 - DNA, 935 bp, Triticum aestivum
  Clone ID: PAT_TA_11700
cccacgcgtccggcaagaagacgtttgctcctccaaaggaggtccatgtccaggttacacattcaatgccacctcagaagatggaaatattccaatctcttgatggttgggctagagataatctgttgctgcatctgaagccagttgagaagtgttggcagccacaggatttcctccctgatccagcatctgatggatttcacgatgaagttaaggaactcagagaacgtgccaaggaaattcctgatgattatcttgtttgtttggttggagacatgattaccgaggaagcccttcctacataccagactatgcttaacaccctcgatggtgtccgagatgaaacaggtgcaagccccactgcttgggctgtttggacgagggcatggactgctgaggagaataggcatggtgacctcctgaacaagtatctgtacctcactgggagagtggacatgaggcaaattgagaagacaattcagtatcttattggctctggaatggaccctaggacagagaacaacccatatctgggcttcatctacacctccttccaagagcgtgcaaccttcatctcccatggaaacaccgctcgccatgccaaggacttcggtgacctgaagctcgcacagatctgcggcatcatcgcctcggatgagaagcggcacgagactgcatacaccaagattgtggagaagctgtttgagattgatcctgatggcaccgtgcttgctctggccgacatgatgaggaagaagatcgcaatgccagcccacctgatgtttgatgggcaggacgagaagctgttcgaccatttctccatggtggcgcagaggctcggcgtttacaccgccagggactacgccgacatcctcgagttcctcgttggcaggtggaaggtccctgaactgaccggcctttccggcgaggggcac

SEQ ID NO: 11701 - DNA, 1832 bp, Triticum aestivum
  Clone ID: PAT_TA_11701
gcaacactgactcccccgcgcccgcggggcgagaaaacctgaggctgagatcccgcgaggcgaggccggcccacacccccgcacagcaccgcacggcgacggcatctctcctcatgcccgctcgcaaccccgcacccccgctcctcgtcgccgggtgcccaccagggccccaaccgcccccgtccccgcccccgccggcgtaccaaggataccgcgccgctcccaccccgccacgccctcgctcccaggatggcgctgagcccgcacgagcccccacccccagtgccctcggccaggcgcgctggtcctgtgcgtagcatagtcaaggtgagcgcttttaccttcgtctgcaccttaatgtgggcgtgtaaaatgggcatttaccacagaaaatggaattccttcagcgtgctgattgttttgctaggaatcctcaggtgctgtgacttaattccattgagatgtgttggcggccacaggattacctcgctgatccagcatctaacgatttccacgctgatggcagggaacacatttcagctcccgaagaaattcctgattggtttccaccatgtagtgaaaggagtcaggaaaactgccaaagaccttccttagtagaaaattgtgtttagagatcgatcctgtgggcaccgtgcaagctctgcccgccatgctgattaagcagatcgcactgccagcccacctggttgatgatggtcaggacgagaagctgttcgaccaatttctccatggtggcgcgggagcggagagtaggcaccgtgagggactaagccagtatcttcgagtccctggaagggaggctaggagacagagcaatcaccggcttggcttgatcaacggctcctggcccgagcctgcgaccgtcatctcgcctggaaacaccgcaagctataccaaggacctcggtcgcgtgacgctcacgcagatctgcagcaccatcggctcagacgagaagcggcaggagcctgcatacaccaaaaacgtcgagaagctgtttgagattgatcccgctggcaccgtgcttgctctggccgacatgatgaggaagaagatcgcgatgcctgcccacctgatgttcgatgggcaggacgagaagctgttcgaccatttctccatggtggcgcagaggctcggcgtgtacaccgccagggactacgccgacatcctcgagttcctcgttggcaggtggaaggtcccggaactgaccggcctctctggtgagggacacaaggcccaggactacctctgcaccctcgctggcaggatccggaagctggacgagagggcccagtcgagggccaagcaagccggtaagatgcccttcagctgggtgtatggcagggaggtgcagatgtgagcacgaagcgcctccatcacggcgttccaagcttcccgcgtacctacctgtcgttcatgcatgtggagagtctgtctttgatataacgaggttcggactcgcctcgttacatagttcttcagttcaggttcgtcgttgccgttccttgtagcgatagggagatgtcgtctgtccgcgtgtgtgttgttagttttgtgtacaacttatgctggctgtgtggagtgtggactgaacatgaactgaagcatgcagcgtgctgtttgtgttgttcagatgccttaagtatcgtgaacaggacaggaagtgagccatccaggcagtgtgctattagtctgagctccatcccttgagtattcattaccgataaacgtttgtcgtcctgtgatctgccgtgttagataataataatgcggagctccaactgaaaaaaacacaaaaaccacaaggggggggg

SEQ ID NO: 11702 - DNA, 1232 bp, Triticum aestivum
  unsure (1)..(1232): unsure at all n locations
  Clone ID: PAT_TA_11702
ccacctctcactcgtcgcaactcccaagccgcagcacgagnagcccacaggcagcttcttggtcgggtaccccgtgactcgatccgcctcctccgggcgctcctccaccttccttcctctccttcttctttgtcccattcctggacacgcgaagatctaccacccctcaaggtcccgacgacgacgccattccgatttggaatgcacttcagtggtccatccaagctcaaacccttgattgaccagtagtgttgcaatctgggcttcaggtttcagttgtcagagcaatgacttccaagacaatgccccaaaccatcccaacaacccccaacactgaagaaaagaagcagtgttctccgaatgattcccctctggatctcaccagttcgagtaaacccagtacagccttgccaagaaaattgcccgaatcggctatcccaagcagtccaaacaaagaagtccagtccaatgaccagaaaccatctcacaagctacatgagtccgttgatgttacatccagcaaggttcctgcagatgatgagaaggatactgtggaaaatggaaacacagatggaaccgtgaaatcagactcgacggtagataaggatcatggtgcagcgagtgcaagtggaagtgccaggttgacgggaaggtctgagactggagaaagaggtattagcagccgatgcaggccgagcacaggcagtgatgtaagtgaggaaagcgcgtgcagcagttttagtagcaccagcaagcctcacaaggcaaatgattcacggtgggaggcaatccagatgatcaggagtagagacgggatccttggcctcagccactttaagctattgaagaagctaggatgtggtgacattggcagtgtgtatctttcagaattgactggaaccaagagctattttgcaatgaaggttatggacaaggcatcacttacaggccgtaagaagttgcttcgagcccagactgagaaggaaatcttacagtgcctggatcatccttttcttccaacattgtacacacacttcgagactgataagttctcatgcctcgttatggagttctgccctgagggagacttgcatacacttcgacagaaacagcgtggcaagtattttccagaacaagctgttaaattctatgtagcagaaatcctccttgctatggagtacttgcatatgctaggcatcatatatcgtgatctgaaccctgaaacattcttg

SEQ ID NO: 11703 - DNA, 287 bp, Triticum aestivum
  unsure (1)..(287): unsure at all n locations
  Clone ID: PAT_TA_11703
ggaaagtaaaaacgcagcaagnaggaggaggcagggnaaccgaaaacagaacttggaaaagaagaaaggaaaaacacagcagagcagcaccggacggacggaggaagacgacgacgtcctagatatagtaatagtaagatgattaacgaaacgaggtgcattgctcatgtctccgatcggtccaatcccgaagtagtaagagccaggtgtgaagtgacgggaacggtggcgccgtccaagaaccttctgctgcagcgacgatcatcagtactcccacaggagtggct

SEQ ID NO: 11704 - DNA, 867 bp, Triticum aestivum
  Clone ID: PAT_TA_11704
ccctccgcccacaaatattttcttgattctccctccacccacaccttgatcgcctccgatccctaaatttccccgccggcttcgaccgcctccgtcccgtcccggagtcggcgcgcgggatggggaagaggaaggccaagaaacccgccgcgaggccccgcagcggcgcgggcgggagcgtgccgcggccggtgagcgaggacgacaccgagaccgagcccgagcccgacggggaggagggcgacttctgcttcgtctgcaaggacggcggccacctccgcctctgcgactacaggaactgcaacaaggcttaccatcctaagtgcgtcgtccgggatgaggatttcctcaattcagatgaggacttcatctgcggttggcacacatgctgtatctgcaaagggcattcatactatcggtgcctctgctgtccagttaaatcggtttgttatggttgcctgagagaagcagactttgtccaagtcggaagaaggcaaacaaagggattatgcgctaactgtctaaggctgggaatcatgattgagaataatattcaaaccgactctgatggggagagggttgatttcagtgacaggtcaactgttgaatttttgtttaaggaatactgggagataattataaagaaagagggcttaacattggataacctttaagaagcttatgctagtttaaatgatggcccggatcagatgtcagattctgagaattttcctaaagtacaggacagctcagatgatgatttcttgggcaatagtgatggtggtgatgctgagccaatttgcccatctaatttaaatggaacatcaaataaagtgaaaccctttctgaagcaggcaaaatcaaaga

SEQ ID NO: 11705 - DNA, 468 bp, Triticum aestivum
  Clone ID: PAT_TA_11705
ggagaaagccagctgcttcactgagtgagcaaggatagagtgtgagtgagtgtgggagtgagcgagtgacacctctccccctatgtagagctgtagagcgtgagcttgagggcatcctgttcttccaccaccatttcgtcgcccagccactacagtcggtcggcgtgctggtggagttgaagaggaggagacgccatggcattgcaggagcaggaagaagacgaagatgaaggagaagacggcgaggaagatgggatcatgacgaggagggtgctgtggtgggggaggagctgctgctgatttcctcccctgtctgacccgaggcgcgctgcctgctccggagtagtagtaagatattggcacaataggctcaatcactttttctttccccttgttttgctgtttttgcgctcctttccccgttcagtccattgatgattccatactcttccccctgtaaaaaaaaaa

SEQ ID NO: 11706 - DNA, 388 bp, Triticum aestivum
  Clone ID: PAT_TA_11706
ttttagcaagaacaaaatcagggttgatcaggtataacggatacaattgaaccacacggtagtatagtaccactagtaaataagcatgaaacagtcacaacttacagcttatagatgcaaattccaatgagtagcaagcaccataaaataccatcacgctgcggctactatttttctttgttctcccaacaatcaccttccgtgcgatggcaagtagaagtgtcggaacgcattgagattgcaaagcggaagttccattacagttaccataaccttttgcctccgagagagaatcatacgacgcctgacttacatcaacagcgatgattcgactctagcgaaagagtctaggaacggatcgctttgggatcttcccttcaagcttcaa

SEQ ID NO: 11707 - DNA, 1027 bp, Triticum aestivum
  unsure (1)..(1027): unsure at all n locations
  Clone ID: PAT_TA_11707
ggtncgcgtcatcaatagcagggctgatccggggtagcccatactcttggtccgcacggtcggtttgcaccactcctttgtgcgctggagtcggtcccggcgttcagcccggggccgcacgttcccatgccttgcacccgccgtgatcttccgacccccattcgctccgaagttgcttggatctcccagcatgctccgtaaatgccttggctcctccccccgtcggaacgcactgaaggtccaaaccggggttcccattacagttaccataaccttttctctccgcgcgagaatcatacgacgcctgacttacatcaacagcgatgattcgactcctagcggaagagtctaggaacggatcgctttgggatcttcccttcaagcttcaatcttctgtatgcttctcctggatgtggcaaggccttgatgggcccagaatctttcctttcactgcataactattctttgctgtttcaatgacctcgccgacaaacatctttgctattcctgatactacgatggtggttggcatagatatcttttgactgccagtgatactcgccaatagctttttcatgttagatttcttggaatcccagatctccggaaatgactcataccggttcatctggtcttcttgtaaattgggataacaaagcattcatcttggcgagcttgtcgggatcgctggtgccggagggcagcttgtcgaggtcgacctccatggggtcttcctcgtcgtcgtcgtcatcctgctccttatgggcccgaaccttggccttcgccgccgccggggctacggaggtcgagggcgcggctagcgccgaaggccgcggccgcggcggcggggcgcgcgaaccaccggcgccggcgctgccgtcatagtcctcggcggctgtgtgggggaccgctgtggcagggtcctcctcgggcggcgccggcgaatccggcggggactcctgctcctcaacggccgcctcgaaggggtccttcatgggtcgccgaggaaagggaagacgattctgca

SEQ ID NO: 11708 - DNA, 1022 bp, Triticum aestivum
  unsure (1)..(1022): unsure at all n locations
  Clone ID: PAT_TA_11708
gggaagacatctggnagagctagtttccgactgggaggatttggatgacaatgattttcagaaccagtttggtgcagatgaggccagtcaacattcctcgtacaaaagtgttgctgacggaatggagcttatgcagtgcaatcaatcggttgccaatcctgtgaatggagaacggcattcttctaatggagacatgcttgtgaactcacacaatggaataggcaatggggttcaaaatgaatcagatggtgttggggtacagcttgaaagatcgtctatccggtccggactgcccgggtcggcccacgcgtcccagcaggcagcactatcatcccatgattttgtttattctagtccagatgtgtatgtacctgaagaagcacaggttaatgcgaacctttctggtcaggatgagtatgtactctgaaaaaacacagatcagtgcagacctttctagccaagatgagtatgtgcctgaagaaacacgggtcaacacaagccttcctagtcaagatgaatatgttgctgaagaaatacaggtcaatgcaaaccttcctagtcaagatgaatatgtacctgaagaaacacaggtcaatggaagctttccttgccaagatcaaaaggttgctgaagaaacacatgtgaatgtagaccttcctattcaagatcaatatgtacctgaagaagcacaggccaatgcaagcctttctactcccagccatcatgtacctgaagaaacacaggccaattcaagcctttccaacaagccattatgttctaccgtggaagataattcatcttttgagcaacatcaagcaaaggctgagcttctacgaatcatcactgacttggccaagaaggctgatgcactggagaagaatcagattaaatcagatcaagaaatcatttcgttgaaggaagtagttaaagactctggaagaaaagtcagcaactggaatatcgcatagatgagttacaattcaaatttgactcctccttgtctcttcaaggaagcatgtgcg

SEQ ID NO: 11709 - DNA, 770 bp, Triticum aestivum
  Clone ID: PAT_TA_11709
cgctattacagcgtccgagaagttctccttggctatccatatactactgcgattgatatgtggtcatttggttgcatagttgccgaactgtttataggactacccttatttcctggggcatcagaatatgatgtgcttaagcgtatgctaaagattctcggggggcaaccaccagatgacttgctaagggaagctaagaatactgctaaattttttaaacatgttggaagtggttatctgggtattggggcacatgatggccctggcactgcatacagaatgttaagtgaagacgaggtcgaggggagggagaccaaaaggccgaaattagaaaaatggtacttcccacagcaaaggttggaccaactaatatatacctatccttgggacaatacaaagttgccagagacagaaaaagcagaccgcgtgctgttagttgatttcttgaggggacttcttgaatttgatccaaataagcgatggtcgccatttcaggcgtcaggccatccattcattacaggcgaaccttttactggtccatatgagcctgtctctgagactccaagaattcctgttgctcatgctgcagcagttgatcacaatccaggaggaggtcactggttagttgcaggtctttcccctcaggttggaagtgcgaacagatgtctacctcctaacccctatcctccaaaagtgcctttttcttatgggagtagttatggaagccttggtagccatggtagctatgctggcaatgctggtcttgctag

SEQ ID NO: 11710 - DNA, 737 bp, Triticum aestivum
  Clone ID: PAT_TA_11710
gaattcggcaccaggacatctcgtctctactgtacgcggcagcccggcggcgggccggagctcgccccctcgccggagacacgggcggagacgatgctggaggcccagcctccgccgcccccgagggcgatgatgctcgccgacctcaacgtcgacccgccggagagcgacggcgaggatcacccaccaacccccaagcccaaccccgccatcgccgccgctgctccggtggtcgccgtcgattcctccactaggagttgcaacgatgagggtagtttggcaaaaagcatgaccacgacgaaggagcctgatactgttgaatgcgaagatgtcgagcaacattgtccaggggcttccgtttcacgcgaggagaaagttagcaacttgaaagctgctctggtaaatgttgcccggaagatgcctaagaatgctcatgcccattttatgttgggtttgatgtaccaaaggcttggtcagccacagaaggcaataatagcatatgataagtcgtctgaaatattgctacaagatgaacaagaagtgcggaggcctgatttactctcgtcagtgaggattcaccatgctcagtgtattttgcaagcaagcatggggtgatagttttgacgaagaacttgatgctagtgaattgagtgaaatccttgttaagctgaagagttcagttgaattggaccccaggcaggccgctgtttggaacattctcggtttagtcttcttcg

SEQ ID NO: 11711 - DNA, 677 bp, Triticum aestivum
  unsure (1)..(677): unsure at all n locations
  Clone ID: PAT_TA_11711
gcagcaatgcagctaacacctaaccaatccattcactgcaagcagcagttgatagttgctgaagatggaaataggaggggtaggttggagaattccatctaaccaaagatagataaaattccaattttgttgccgtccccaatgccccatgagacatcttgttttagaacatgaaggtgggtgacgacgcattccaagaatcacagagaaccaggtgccgatgcattccaagaatctccttgagaacaaatccaactccgagacccctttttttttgttcgtttgtttttgtctggttttttaattcggttggtacgtgcataaaagcggtggacaccgcagcccagtggagcagaggtcacggcgagctgggttagtgaaaggccacggcgagcactgcattctagcatcgcagcagctagcatgcggttgtgcattctcgcacgtatgcaccattgtccccggtgggcagcccgtgccgtgccggagaagaccaaaagccggcgggttgtgttcgtgatttccatcgtaagaagatagacttgtagaagtctaaaaattgggagcaaaggaagaggcaggctgagctgactcttttcaaaatcattctcgtgatgtgtggttcaaagagaatattncttgtggtagctnatcaatttctgtaagaacgaagctag

SEQ ID NO: 11712 - DNA, 711 bp, Triticum aestivum
  Clone ID: PAT_TA_11712
gaaggagctgggcgagtttgcggcagaaaagataatggagcttgagccagataacactggtgttcacgtatcccctttctgggatctatgcatcattaggccaatgggaggatgtgaaggcaatcaggaagctgatgagggatagcaggattaagaagcttcctggttttagctgggtcgatgctaataacaaaactcatgttttttcatccgaagattggtcacatccacagcagaagaagatatatcaaaaacttgaggaactctatgagaggataaaggaggaaggttacgtcccagacacacgttccttaccatctaatttggaagatactgcaaaggagaggattctgcgttatcacagtgagcggattgccgtagcttttgctttgataagcatgcctgctacaaaaccaatcattgtgaagaagaatttgcgtatctgtgtagactgtcattctgcactgaagttcatttctaaggttgaaagcagggatattattgttagagataactccaggttccaccattttgcggaagggaggtgttcctgtgaagattactggtgatcaactcatctgtcttcttttgcatcagcatgagcattcttgaatcgctgccatctgtccatttcacgatgcttccgttttatgtcactatatttgaatgcatgctgtcaaaacaatattgattctgggtgaaatatggaac

SEQ ID NO: 11713 - DNA, 846 bp, Triticum aestivum
  unsure (1)..(846): unsure at all n locations
  Clone ID: PAT_TA_11713
gaatgaatggacttttctccccaactggatggagggcgcctccttcgatgagccatatgcgtcaaccgctatctgcccgggtttctggtagagctaaagcaatggaccaagacggtgctaaaataaaaaaggtgcttttcgattcagcagtccatacaacagctgaaaacacgccaagacgagatgaagtaaagacaactaagaaagaggtacccccttcgttaactccttggaaagaggacaaatctgaatctcctctcaggaaagcactgtctcccattccttcaaacatgatgactccttgtaatgtcaattgccctccttcattggagcccaaaactccaataggagttgagaagaatccggatggtacacctcttgataagtttaatgcactgggatctaacctaaaggaatctcttatccaacaatatctcgagttcttaaatgttgcaaacaaggaagagctacagcaactaaaaggaattggtgaaaagagagcagagtacattctcgagctccgggaggattcgcccagaccattccaatctctttcggacttggggaatatanggtctatcaacaaaacaaatccaagacatcatacagaaaacagccacaggaatcttcaaatgatcactggaatggactattgcctgaaaatcacagaatggactgccgtaatctaccaccatccgtgacccagtggatggtgttgtaactgtactgtgaactgtcagcctgttgttgacatagttgtagttgtcctgttaacagtcggcctgctgctgatgctattcctagggcagtgggtcttgttgcaatttttctcttgtattgtattca

SEQ ID NO: 11714 - DNA, 839 bp, Triticum aestivum
  Clone ID: PAT_TA_11714
ccacgcgtccgcctagctagcccccgcctctccgcctccgcggcgctcggaaccgcgccgggatccaggaatggcgtcggcggacatgttccccaacgtctccttctccgacgtcaacgccgccgcctcgcaggaggccgccgggaaggccgtgttcggcctggaccccgcctccggggcggcgcgcctcagcctcgtcaggcccggcgcggagcaggcgttccagatcgacctctccgacgcgcagatattcaagctggggccgatggagtggctctgcgtgagcggcgagaccgaggccaaggctggcgtggaagagaaattgttttcaagagcaattaaggttgttcttaggacagaagccgagagcaaagccttctctctagcttttcaacgatggaaacaacaaactattagtggaaaagctggtgaatcattggagaatggatcaatagtggcttgcaaaagtaaatttgatacaaaaattgaggcatcatcagcacagatgtatttccactactatggccagctattacatcagcaaaacatgttgcaagattttgtgaggacaggaacatactatgctgctgtaatggaaaaccgggccgacttcgagggtaaagttgtggttgacgttggagctggtagcggtattctttcgttatttgctgtacaggctggtgccaaacatgtctatgcagtgaggcattgaaatggttgtacatgcccaaccggtttatttttgggaacccatcttttgggcaacgaatcacgttcattaaatgcatagtctaggaatgttgcacttccatgaaatagtctgttatactgattttttg

SEQ ID NO: 11715 - DNA, 394 bp, Triticum aestivum
  Clone ID: PAT_TA_11715
gaaaaggaagcaggaagagcgtgaagctgaaagacgacaggacgctgaacttgtaaggatgcaagagattggtgccttaaaaagagaacaagctaggcgtgccacagaacagaagattttagagcaagagctacagactctgaaagaaagggctaaaaatgatcgcgagacaaacaaagagaatgctatttctaatgctaaagctaaagctcatgaagcaaagctgacagaagattacgaaagaagaatgcttgtggaactcatgaatggcgaaagagaaaagtggcttgctgcaataaataccacctttcaacatatagaaggtgggttaagaacattattgactgataggagtaagcttgtaatgggtattggaggagtcactgcactagct

SEQ ID NO: 11716 - DNA, 599 bp, Triticum aestivum
  Clone ID: PAT_TA_11716
cgtccgctccccctcccacccaatccccacttctccggcaatgtctacttctccggtgatgtaagactggcccgtgactcccaaactccctctgtctcacctgctggaggccgaatctgttccccgcccccgcaacctcttcaacgaggcgaccaggaggagctcaagtactcaacagtaagctacttacatgatggaggctgcacgatcccccccttggtcagatctccacccggaactccttggccttgtcctcaagcgcctcccctccttagctgaccgtgttcgtgtaagagctgtctgccacccatggcgctctaatagtatgttgcaaccccttcctctcccattcccatggctcacgctccctgacggtaccttcctcagcatttcaagtggtgaaattcaccacatatctttaccagaaggtgcgtgttgccagggctctatcggaaactggctattcctcatgcacaatgatgatgtgtgctacttgatgaaccctttctccaagaccaggttggagcttcctaagctagccaaagtgtgtgatcctgaaatattggatcccgactctatatacaatccaattttctaca

SEQ ID NO: 11717 - DNA, 369 bp, Triticum aestivum
  Clone ID: PAT_TA_11717
gaagcctcatccttggaactccaagatgaagaaggtggcactgaaatgtaacagttgtgatgagcatttgcaagattagggtggcgcatgcctgagattaagaagctattttgctgagacagtgagatggcccctaattattttcttcttcttcttgagatgatggctcctaattagcagctagctacagatatgcgcaaaggagacagggaaagaaaggtacatgttgatgaagatgctgctgaaatttgacagttgtgatgagcatttgctacatattaagaatctttgtcgctgtgacggcatgtttgttgatggacggatggataccatttctatatatcgtgtgtgacattcccaaaaaaaaaa

SEQ ID NO: 11718 - DNA, 487 bp, Triticum aestivum
  Clone ID: PAT_TA_11718
gagagaactagtcggccatcgagctgaggaagtcggagatcgaagacgggtacacggggctgctggccacccgccgccaggctctgctgctggacgtgagagacaagcttctcttcgaacagggagtatgcaggaagcaccagggccaaggttccgcccagatcctctcttcatataccctggggctggttgcctgctgccttgtgtgtcctgcaggaggttggggaagagaagctggttttggacattggtcaggcagctcttcggcgcgctgattctaagccatatgttcatgatgtactccttgcaatggcactagctgaatgctccattgcaaaagcctgctgtgaaataagtacccttgctcttggcctcgcggccctacctcgggcgcaacaccttttgagggccttcccacctttagagccgttgccccctcttcccccgggtgacccccctcccgaagtgcttccgccggcttgcactc

SEQ ID NO: 11719 - DNA, 471 bp, Triticum aestivum
  Clone ID: PAT_TA_11719
gggaatcctatacaaaaacctattgcgagtagtcgatatggtagcacatagtagccacaaagaaactgtaagcatgagaggcatggggagcatagcaatcaccctacttagatttattttcagtgaaaggccttcacgctgctagataaggcctcgtaatcagcacagaaagcgctacaaggccacacattgatttttttcagcagttgattttataccttagacaccgagcaatcatcttttcctaaccagtgggtctactgcaacggcatagaaaccttccatcctctgtgtgctcattatcgtttgaggcgatcctatttcttttgaggggattctttgggagcacgtgaatggtgatcaagcctgcgttgtgtgtcaagtctcattagccgtgagctagctaatgggagtatgttgtgaaggacatttggcccgtgtatcggtgactgagctcgctaatgtttgtgc

SEQ ID NO: 11720 - DNA, 600 bp, Triticum aestivum
  Clone ID: PAT_TA_11720
atggtgcgtatattgctgcgtcatgcatggatcacaggatctatctgtatagtactctccacatggacaagggtccaataaagacttacactggcagcaaaattgagtctttctttgtcaagcgtccgcggacgcgtggggggactcatattttaggcggttcgagcaatggcaatgtttacttgtggcaggtggatcagcctgaaaatgggcctatagttctgaaaggccatgagggtgaagtcacttcagttgactggtgctctttggaggttggaaagatagtatcatcatctgatgattccacggttcgtgtatggaacaccaagaaaatagactgcaccaacattagttcccctacagtcatccgtaagagggtaactgctccaaacatcgactgcccaagatcggctagccatgagcgagcgactagttcaagagatgtagcagcctgcaccagtgctgacaatgaattgccagccagttcacactcacccctccggccagagtactggagtttggcacgcctgagtctgtgaaaaagagagccttttcggtatttcgggaggaggccttggatactaggagcagcccaggggc

SEQ ID NO: 11721 - DNA, 1123 bp, Triticum aestivum
  Clone ID: PAT_TA_11721
gccggccgggctcgccgagaagaggacacaggaactcaccagctccacgagcagaggagccgacacccaacccagcaccaacgcgctccgagcacaccaaggcaccatgcgtccatctcgggacctccggctggccgtgctcctcctcctcttctcggcctccgtcctcctcccggcagccagagcccagcaggagaccgacgaggaggaggagttcagctactcgctggacgcggagaacgggccggcgcactggggcgagatcaaggaggagtggtctgcatgcggcaagggcaacatgcagtcgcccatcgacctcgccagcccgcgcgtctccctcgtgcgcggcctcggctacctcaaccactcctacgcccccgccaacgccaccatcgtcaaccgcggccacgacatcatgctcaagttcgagggcgacgccgggagcgtctccatcggcggcacgccctacttcctccggcagctgcactggcactcgcccaccgagcacagcgtcaacggccgccggtacgacatggagctccacatgttccacgagagcgcccagggcaaggccgccgtcatcggcgtcttctacgagatcggcgcccacgacgccttcctccacaagctggagccatacctggagatgatagcggatcggaaggacagggaggagaaaatggggatgatggacccgaggggcgcaaggggaaaggccagcgtgtactaccgctacgtgggctctctcaccaccccgccctgctcggaaggtgtcatctggaccatcgtcaagagggtccgcaccgtgtcgaggcaccagctggagcttctccgggaggccgtccatgacgacatggagaagaacgcgaggccccgtcaggaggtgaacagcagagatatcagcatgttccggccttttcagcaaaatagacattgattattagctagggtcgattctccgcttaattagtttgctgttacagctataatgtatgtacatggttataccaatttttgtaattctttctacccatattagatgccttgcatccagtcactgaataaaaaaaaaaaaaaaatctcgaacctgcccgggcggccgctcgaaatcactagtgaattc

SEQ ID NO: 11722 - DNA, 1440 bp, Triticum aestivum
  Clone ID: PAT_TA_11722
ccccgccctcccgtccgggcccccgctccgccagctatgtcggcgggccccgcgcctcccccctcctttccccctcccccgctgctctgctccgctctgctcctccccagcccacgcccccgcctccatctcctcgcgtcgcacgcacgcacgcacgcacgcactcacctgcgctgctcagattccttattacatcaccgccggccagtgcgcaaccaccgctccaccgcgcctcctgctgctagctgccgccccgccgccggcgcctaatgcgggccggtggctaagcctaagccctccagttccgggcgtgtaagagacaaagagacatgggggagggcgcggtggtggtgctggaggcgcccaagcccaggtcgccgccgaggtacccggacatgtgcggtcgccggcgcctgcagctggaggtgcagatccttgaccgcgagctcacgttcctcaaggacgagctacatttacttgaaggggctcaaccagtctcacgttctggttgcttgaaagaggtaaacgagtttgttggtacaaaacaagacccgctaataccaattaacaaaaggaagcaccggtcctgccgtctttattggtggatcagatcgaaactgtgcatatgtgcttcatggctgtgctgctcctgccaatgcctaccaacctgcaaaagaccaaggtgcttcgactgttcatgctgcgagccaaactgctcgtgctgcagcctgaactgctgcagctgcttcagtatcccttcgtgctgcaaaccaagctgtggctgctttgagtgctgcagctgcagcaaaccacaagtgctgcagcagcggctgtaacccttgcggcgagtgcaagccggagtgcggctcgtgttccggcggcggctgctgcggcgagcagtgctgctcctgccctcgatgcacaggctgcttcagctgcttcaaggtccccaaatgctcgtgcgcgcagtgcttcaactgccagtcgtcgtgctgcaaggggcagccgtcgtgcttcaggtgccagtcgtcgtgctgcgacaagggaggctgctgcagcggcgggtcgtgcctgagctgcccgaagccgtcgtgcccggagtgctcctgcgggtgcgtgtggtcgtgcaaaaactgtacagacggatgccgatgcgcccggtgctgtgctggcgggtgcctgtgttaagttaggccacatggtgtcaagcctttctctcttttggtagtagttgtctttgtgcttgctgtttaagcctctgtttgggttcgttcggggccttgacgtatggtggtgtttcacatgtaaagaaataacttgacctccggatcacaaggcggagtgaagtagctctagtatcagtagccaagttatatatattggtgatgcacattgtcaagcattttacagtgtcttttttttaaaaaaaaaaaaaaaaaa

SEQ ID NO: 11723 - DNA, 622 bp, Triticum aestivum
  Clone ID: PAT_TA_11723
gcacgaggcccaagctcactctcactctcccacccacttcaaacccctccatcccaaaccccagccagccaccatggccgccaacccccggagcgggaccaagaggctgaccggcggcggccatgggggcgccgcggccctcctcctcctcctctgctgcaccgcgtccatggcgctcaccccggacggggaggcgctgctggagctgaagctggccttcaacgccacggcggggcagcggctgggcagctggcgggccgccgaccccaacccctgcggctgggagggcgtctcctgctccttcccggacctcagggtccaggccataaatctgccctacatgcagctcgggggcatcatctcgcccagcatcggcaggctcaccaagctgcagagactagctctgcaccagaacagcctgcacggccccatccccgccgagatcaggagctgcaccgagctcagagccatttacctgagagccaactacctgcaaggcggcatccctccggggatcggcgacctcactcacctcaccatcctggacctgtccagcaatctgctgcggggtgcaataccggcgacgatcgggagcctaactcatttgcggttcctgaacctc

SEQ ID NO: 11724 - DNA, 660 bp, Triticum aestivum
  Clone ID: PAT_TA_11724
aattcggcacgagggctaaatagcagattattccccaactttcctgccagtcagcctggcccctacggcagtcaacacacacagaacttccatacctaataatttcctgccctttagtgtgccatttgtaagatattctgtaaaaaggaccacaaaaagggcttagccattccacctaaagacagtacaatcagatctttagcttaagcttaataaccgcattgcaagtgtaaacacgacactgatgataacagatgatcatttcaacctacttgcctagaaccaagacagaattgttacggtgtaccatgtacaccaaaagccagagctggcgagtgaagaaaaccctgcgggtagctatgatcagtttcacgaaattaagtagtacacatatttgtcacaggtcaaagtagtgttcgaagctttgagaatatacaacggcaagacacaggtgcatgatacaaccaggaagaattcgccttcagagtggcacccaggaactcaaaataaaagctacacatatgtggaaaatatgactatattaggagaataaagatgtaaacactgaactatggagaaaaacaatcatgagtaaatatcaagaactatttgtgtggataaatacggtggaatcctgtacaacaaaccatgtttgactca

SEQ ID NO: 11725 - DNA, 422 bp, Triticum aestivum
  Clone ID: PAT_TA_11725
tcggcacgaggcaccaaaggagagccccctacatgccgccctgacagcgataatgaaacggtagaaaaaaaattccatgagcgggtttcttgtgagagaagctccaagcagcagcatcacgactcggggaaatctcttccctgaagacatggaagctggttggaatatcgctgatgacgctcgggtacggaattagttggaggatacctgtctaggaagaattctcttggtgtagacttgaattttgtatgcgagtatcacatgtcgtcagtgtctctctctcattgcttgccggcctggcatagggttgtccccaagcctataattccattctcaagggaggcttttaaagtagtgttttgagctattcttccggccaactgctacctactcttcttgagtttgctgctcaggcccaaaac

SEQ ID NO: 11726 - DNA, 2016 bp, Triticum aestivum
  Clone ID: PAT_TA_11726
tcggctccgcttggcctactcatcccacgtgctctctagaaccctaggaatcgccattgccaccgcgaggatccctgccggggcctcacagggccggagggtggagcttcagatctcgactgcaacggcgctgctcccccctcccgtcggccgtggtgcagtaagccacctcgccgggggaagatgcagagcgcgacgcggttgactctgctgctgtgcgcggcgtgggtagcggcgctgctctacggcgagatgggcgcctactgggccgcccacctctcctgctcctggccatccgcatcctcttcctccccatcgccgagtaaccatgtcaaggttgccgtcattgctgatccacagcttatggacagcacctcccttggtctaccagcaagctcagttgcactgcaagctgcagagttcttcacagatttgaacatgagaagatccttccagtctgtgatattgccgttcaagcctgatgtcgtcttatttctcggtgactattttgatgggggcgcacatatattggatgaagagtaaggtggcaggattctctattccgatttaagcatatattcagcatgagcgaacagaggacaagtccacatgtcccaatctactatctttcaggaaatcatgatattggttactcagcatttcactcagttcatcctgaggttatcagtcgatacgaaaaagaatttggaccaagaaacttccattttttgtctgggaaggtggactttgttgttgttgatgctcaaactcttgatggaggagccaaacagagcaaagaaagatcctcttcttgggagttcatcaaaacactatcatctggtaatgaatcaaatccaaaaattctactaacgcacattcccctgtaccgacctgacaatactccgtgtggcccacatcgttcttcacctgctattaatcagaggatatatagcgctgctatggaccaaggaatcaagtatcagaattatctaagtaaacagacttccgatcttttgctagggctgctgaagccgactcttgtgctctcagggcatgaccacgaccagtgcacagttgtccactccactccttttgggccagtaacggagcacacccttgggacaattagctggcagcagggaaatctgtatccatcttttatgctgctatctgccgggccccgaaattctactgattctagtcaggaggttctgacgaatctttgcttcctgcctaaacaaactcatatctatatctggtatatctttcagtttgtggttaccgtccttctgctgatgttttggccaacaaatggtctaagctctcttccctacgtgaacacatttgtgagcttcatgagttcggcgggtgctgacctgtttccaagaagcaaagaaaaagatgacgcggaagatggcgaatatgaaatggtttgggatgcagagggatccatgcacctggttaaaaaagcagtggcaaggccccccatcacaaactcagactccaaaactacaggacgaggaaatgttgtgccaaggccaactgcgagaaagcaccaacctgaacctgattcatcatctgttcatgttgagatgggatctgaaacgccgcctgaagatggagggaaggcgcctcgcccgagcaaatggaaaataaggacggtcctccagaggctgttccgtgtcgttcagtcggttgccattatcgccgtgctgaatgttcctctatacatgatgcttctgtttaaggattgggttgaccgttgagagtagcttctcaaagcctagctctatgtgggcgtcaccatcgcgctgcctgttggtcgccgaacccccccttgcagggccgttttgttgctccgaacgattgtaaggccctggttgattaaatgatatcccgtcccccgcaaaaaaaaaagagcctagctctataattgctacgtatttagtagactgttatacgccggatctgctcttgcaaagcctatatgaagcaccgaaatgtgcatcagataat

SEQ ID NO: 11727 - DNA, 1179 bp, Triticum aestivum
  Clone ID: PAT_TA_11727
tgttttgagaagagatttttttttccctctgacaatcgcttgtatttctagattagattgcaccaaaagatgccagtgatgtacattctcgtgctactttgctatttgaatggcccttttgctatgtaatcctaccattctattcgtcgtcaatatcctttacagcatccttagcgagccgtgttacataagtagcagcaacggctgtaactaatagccctatgcccagtgtcaatagctggttgtttcctcccagaccgatttccgtctcatcttgaattatagctcgcccaaatgcaccagcactgacataagcccatgttcctggaagcatacccaaccaactgcccaacacgtagggtaggaacttgactgaagtcaagccgtacaagtagttcccaagggagaaaggtaataggggactcaaacgaagcagagtcacaaccttgaatccattttcacctattgctttatcaattgccagaaacttcttgtttccttcaaccatcttaagaatacgctctctagcaaagtatctagcgatgagaaaggccacagcggcagctagtgtcccactgattgaaaccataatagtaccagtaacactaccaaataatagacctgcagacatggtcaacggtactgctggaattgcaagaacctccaatcctgcataggcaagtataaacaacgcgtacccagcagtgccatagccctcaatgaacccggagaagtgcgtgaggaaggtattgatctggtccttgtacacgtacccggcggccccgaacccccctacgaccccgacaagcaccgccccggcaagcagcgtcccggtgagggcccccgagaccccgccgccctcttcctccttctcgtccttctccttcttccccttcttctcctggccggcggcagagcgacggtcgtcggggctgcggccgcccccgccgccgagccggaaggggaggttgggcgaggccttgcgcagcgtgcccttgtcggactcccgcagcgaggagagcgagaggaggtgcgcccggctcatggggtcgggctgtcaggcttgcttagcgcgcggtgtgtgcggccatgagagctcggaagcgataagaggcgtgggagacagctagttctagatcggagcggccgctcgcgatctagaactagcggacgcgtggg

SEQ ID NO: 11728 - DNA, 984 bp, Triticum aestivum
  unsure (1)..(984): unsure at all n locations
  Clone ID: PAT_TA_11728
gtcagacagacattgacttccgcgcaagggggaaatgtcagggacgacggcgacgttggtcatcatcgatggattcaccgtgactgtggcgtcagtcggagactccaggtgcatccttgacactcaaggtggtgtggtctctctgctaaccgttgaccacaggctagaggagaatgtagaggagcgggaacgtgtcacggcgagtggaggggaggtcagccggctgaacctctgcggtggacagcaggttggccctctccgatgctggccaggtggactgtgcctttcaagatcaattggggacaccgatgttggggagttcatcgtgccaattccacatgtcaagcaagtgaagctatccaatgctggagggaggctaataattgcatcagatggaatatgggatgcagtgtcctcagagattgcagcgcaggcgtgcagaggcttgcctgcggaattggccgcaaagcttgttgttaagcaagctctaaagacaactggattgaaagatgatacaacttgtgtagttgttgatatcatcccatctgatcattgttcaacaccgccgccgtcgtctccaaagcaaaatcagaacaagttgaggtttcttctttttggtaggaggtcccatagctctgttggaaagcttggtgacaaaaagaatctgcttcatttgggatttgtggaggaattatttgaagaaggtctgcattgttgggaagaaaggtggggtaggaatccctgtcaaaagcaaattgcccccattcgctgtgcgatctgtcaagtgggaccgaatgccatccgaagatttaataacaagataatgggggaagtttactggtccgccccgtcaaacacancgaagcgncctaactttgttccngtgtagaaaaagaaggatcatggaaggaaaagtcaatcgccgacgcatgcacttgaaagtacantacacgacggggctgtcatgagaacatatcggntatt

SEQ ID NO: 11729 - DNA, 389 bp, Triticum aestivum
  unsure (1)..(389): unsure at all n locations
  Clone ID: PAT_TA_11729
tgcaggnaattcggcacgaggggacgcgggaggcggtggatgccgtggaggcgatgatcgcggagcacatctcgtacgccatggatcgccacaggcggaagcagggtggcgaggggaggaggacttttgtggagtagcctcagcaggagcaatgcagcagagcagagcatggtaatggtagtagtagaagagcaggaaggagatgttgcaagtgttttttggtgggttgctggagtagttaactagcagcaaaaattaccttttgggaggggtttgatgaaacccaagatgagaggatttttgaactgaaacaatttgttgcactagtgctcaactgatgcgtgtgcgtgcatgagaatttattttggttggtgtgatgaaaaaaaaaa

SEQ ID NO: 11730 - DNA, 472 bp, Triticum aestivum
  Clone ID: PAT_TA_11730
tcggcacgaggatcgctcggcctcctccctcctatcctcttgccatcgccggcaaagcccgagcgggtgccagtgaaggtggcgatggggcgtttctcgtttttatagctcgtggagaggcttggctggtgaagcgggggtggcggcggtgtgtgacgctcagtgaagtggcgcaagtgggtgttgggcacggaggtgcggcggcgtggtactgtgccgagatgttggacggctgcaacagggtatgttcgttgtgacagtgactacacggtgagggcatggcccagatcttgtggtgctgtgacggcggggcggcgcggcggccacctctcgctggcgtgcttctcagggccgttgcgactgcggggatcaggactgattcagagtttggcggcgttgctccgaggtgcgatctatggatgcctgcttgagctagatggcatgtatgtgcagcggcggcggtggattttct

SEQ ID NO: 11731 - DNA, 663 bp, Triticum aestivum
  Clone ID: PAT_TA_11731
cgttcgcgaacacggccgaccgagagccgagacccctcaaaaccttcaaaataatttcaattgctcccctcccacagttccactccatccctcgccccggcccctcctcgctccggagcctcctcccgggccaccgccatgctgcccgcgcgcttcctcaagctctcgctgctacgccgcctcggcgccgcccgtgcggccggagtgcccccgccgtggcagaccaggcaatttccggtgcggggtttccaatctcgaggttattctgccggaggaagctccaagtatgatagaccgatgagacagtttgctgaagagaacgagtcaaattctcggccactaatatattacattgtcccatctgccattctagcctttgctggactagccacttatgttcactataatgatgagaagcgtgcagttcccttaggtaaacaagcacaacagaacagtattcccaaaaggtgcactaccaacagacctgcaatcggaggaccatttaagctctatgatacagaaaacaatgtggtgactgaatcaaagcttcgagggaattggacgctgatgtattttggctatacatcttccccagatgtggggccgaaagaagttgagaagatcgctgatgttgttaagctgttagagtcaaagtatgatatc

SEQ ID NO: 11732 - DNA, 801 bp, Triticum aestivum
  Clone ID: PAT_TA_11732
ccacgcgtccggcccctgcgtcgcccgtacctctcctactccctccgacgaccggcgccatccccgccaccccgcaggagccggcgagcgcggccccacgctcccatctcgccggcacaagcattcatccgtcccgccccctccccctcccgacggccccgacgcgcccatcccgccggccacccccttcctccgccgtccccaacgagccgatcccgccggtcgcagctcttcttgcaccgcttcctgatggcgtcatgcgaaaccttgagggcaagacctcagagatatttcccccagatttgtctgacatatgaccatatggagcatatggtgaagtttcatggccggactgctggtctcaagaggtctgaagaagtggaggactattttgatattcagtttctaactgctgaagacgccaaccgtgcctttaaccatctcaagggcaaggtaccaaacatggagttcagttgggcgccgaggaacattatcaaagacaagccaccaactggagtggtggatacttcattcgtcccaccaaaatgtgatctcgattgctttagtgagctgccttccctgcccattcctgccaatcagccattccccacattttggaagttgccgcctccacagcataaacggaagagaggtcgacagtctccagagcctccacgttccgcagagcggtatcccccaagtagtgttcagatggatgaagtcgacccacgccctccattcacagcgcgttactgggcgcaacttcgtccgatatacagtacctcggtatgagtgagtggc

SEQ ID NO: 11733 - DNA, 705 bp, Triticum aestivum
  unsure (1)..(705): unsure at all n locations
  Clone ID: PAT_TA_11733
gagnantttgatacnttaagctcgaaattaaccctactaaagggaacaaaagctggagctccaccgcggtggcggccgctctagaactagtggatcccccgggctgcaggaattcggcccccgggaccaccgcccctatggccgccaccagctcgccgtcgacggcggcggcggcgatgtgggccttcgccgccgctacttgcgtcaagcttctgctcgtccccacctaccgctccaccgatttcgacgtccaccggtactggctcgccctcacccacgccctccccgcccggcagtggtacaccgatgcctcctcccagtggacgctcgactacccgcccttcttcgcctacttctcccgcctcctctctctccccgcgcccttcgtcgacgcctccctcgtcgccatccctgtgcctgccgcgccgtcctcctcggtctacatcctctacctccgcctcacaagtcgccttctcggacctcctcctcctcgcttcggtcctcctcctggcgagggacgctcgccggaggcaagcgtccgttcctcgctctcttgctcgtcctgtggtcaccggcgctgctcatcgtggaccacattcactttcagtacaaacgggttcctgatggggctgctggtgctttcgctgcattttctagagcaaggggaggatcttgcccgggggaggtgtgtttgcaagcattgct

SEQ ID NO: 11734 - DNA, 764 bp, Triticum aestivum
  unsure (1)..(764): unsure at all n locations
  Clone ID: PAT_TA_11734
tagcgtggtcgcggccgaggttgcaacatgaacaaaccaccttacagatacttnnggagaaactaggagacgatgaccttcgaactcaggatgctgctgcttggctagagtatttcgattcaaaagcattagaacaacaagaggccgctcgcagaggaatcccaaaacctgattcttctattgcaagtaaagggcatcttagtgtatcagatctacttgactacataagcccggatcaggaaagaaaagagagggatatgcaaaagaagtgcaggcgtgcaaagaataataccagagcacaccaaggtgaaccagttgaagagaaggagaactttcagcatgactcaggatctcttcttgaagcagacaaaaaggattttcaagaagcaaaactggaagcaaaccctcgtgtagtagcagcagtagcagaagaaacttatgctgtccatgatgagctgaagcaggtagatactttgtcacctgaagagtattctgatgaaggttggcaagcagctacattgaaagggagatctgcaaatgtgcggaagaaaagcatccgcagaaggtcatctctcaccaaattagtggttgatcgtacctgcccgggcggccgctcgactactcataggagtggtgtacaaccacaagcaaaagagcacaaagaggaagctgtaaactcccctagccaactgtcatttggcaactttatcagaagtgataagttgaatggggaccccatcattaccgaagagaagtcttctaag

SEQ ID NO: 11735 - DNA, 749 bp, Triticum aestivum
  Clone ID: PAT_TA_11735
ccgggtctgctgtttatataacccctacaggaccaagtccaatcatggttcagccgtctttccagagcgcccctcattttggagtttctagcataccgccagtttttggtgtctctggtccatttggtattgttgatccttctcgagcaaatggtgtcaatattcatgctggtgcttctgcaacaagtggtccatctggtggttcaaccactgcttctgcaaccactgccaacggggaaagccaaaatgcagaaagacctcaaggaggcaacccgccggctacacgtggattgccaccacgaacagttgttacaggacttgcagctattccggcctttccagggaggtcctcagttggtgttatccttcctgttcaaatgagaagccaagtggcagcacctaaccagtcaactggtcctcaaggtcctcagactgccgtgggcaacgggtctcagccgaattcggcatatgttgttccacaagcttcttcaggcagtgctgtttctgctatgatagcacagatatctgcacaggtagccaatgcactggctgcaaacccgcaggcattggcttcacttacatcagctgtgctgaacccagcagcccaggggcctcaccccccaaccacaaacaatggagctggcaccgtgagctctgtgacatcaggaaatacacaatcacaaaatgagctgccgggttctcatcatgggcaaacttcagtgaacatgcagtctgatgcaactggtgca

SEQ ID NO: 11736 - DNA, 748 bp, Triticum aestivum
  Clone ID: PAT_TA_11736
tccccatgagccaatagcaggacagcaaggacagtcactcaagcctgatattatgaccacattagccaaacttatgccaaatgtgcagtcatcagttccagcaaatagtcaggtgggtaatcttcagcaatccggtcagcagttcggcaggcaagctccagcaagctatgggggcatggttggtgctcaggagcagcacccaatacatactgcttacaaccctgaggttaccttaagcttgcctccaccacctcctctccctacacaaggacccttgtctgctctccctacacagcagcagtatcaaccagcgcacgattacgctcctcaaaacaattacagttccttatgatcagttagccagtctaacttccagtccagcaataccaacctaccagtccctcccgcacaccaaatgaatgatggaccattggcagcaaataaccagatggggaatttggcacagctccatcagtcaacgtcattccccactgatagggtaaacccggatttctcctcttaggtacaacagcaacaaaatgttgcttttggttctgctcaagctactgaagaggcggattataacaagaagtaccagtctaaccctccagtttgctcacaatttactgctgcagctactacgtggatttggaaaccaatcttgatattttaatactggtttatgtactttctcgacggcttgctcgatctcctctcctgcagtggaacatatatttggcccatggtg

SEQ ID NO: 11737 - DNA, 881 bp, Triticum aestivum
  Clone ID: PAT_TA_11737
ttcggcacgagggtggttatgagaggtactggctgcgccgcttcgttgagaaactgaacgtcttgctgggtatgggcattgttctgaccgtatcgttgatcacagtcgcagctctgaactggctcgcgccgcttgccttcataccactgctggtttcagtcatggcgggtgtatttgtcattctgaacgacgatggctccggctacctgccgctttttgtaccgcggcaggttaaaccagcgtccatggagctgaccaaggtcacatttacgggcttcttggctgtctcggtgcaaagctttggtagcaagtctctcagcagctacagccacgcgttcattctcctcaccgccgcagctgtcatcaccggcatcttctggaggctcttgactcacatcacgccatcaacgattggcatgcataaggccgtgaagaggactgtcaatgttgcttctgttggtgcccatgtctgcatcgccgccgctgttatccccttcaccgtgatggccttccatgcactgaagtaattgtaactgctgctgcctgttatcctgttcatgatgctggtcttcacaacgcactgaagtaattgtaaccgctgctgcctgttatcctgtttatgatgctggtcttcacaacgcactgaagtaactgtaaccgctgctgcctgttatcctgttcatgatgctggtcttcacaacgcactgaagtaactgtaactgctgctgcctgttatcctgttcatgatgctggtcttcaacgctctgaagtaattgtaatcgctgttcacggtggtggccttgaacgctctgaagtaattgtaatcgcagctgctgcttgttatcttgtactcagattttctctaactttgtgttgtaatt

SEQ ID NO: 11738 - DNA, 1207 bp, Triticum aestivum
  unsure (1)..(1207): unsure at all n locations
  Clone ID: PAT_TA_11738
tgcaggnaattcggcacgaggattttctgttcctctttcgcgcgacggcgcgaggcaaatctcccccaggcgttcccggagcccgcgccgcggcgagaagcgcgcgtccccaggccttcgctctccacgccggcgagacaaatagagagcagtgacgaaggggcaggacccggcgggcgcctcgtctcccggcgatcggcgcggccggccgccacgatggattcggctcgcccccggagggttcccaacaaatcccgccgcccagactggagagaggagcttagggcaaattgcatgacaagagttaaaaatgagagagttcacttgctctggaagatgaggaaccaagggcagccgcctgctaatgacatgaaaacggtcgaatctgcagtcaggaacattatctcagatgaggtacagaaactcaaaaggaatgtgaatggaaaagaggaccaagaagttgatatgatatgggaatatgaagggccgcaagaagctatgcctgctgaatttgaaagtgaagatatgttgcttgaaatggaaagagttctttatgaagatctgcgggaagaaatgattcgaaaagaaatagaggctcttgatgaggaagatgcatacttagctcaggctgttttcgaacatatgcaattaaaggacgagggtgtggaaaatgctaagctctggtgtccagtatgcaaacaaggagagctacgagaaactcataatctcatacactgtactttgtgtaagatacggattgaccttgaagaagataaggtaaacctagatttcttgcgggaacggttggctaatgtccatatggagcacttggacagaggatgcacattgtcacccaagttctgcttgcatgacatgtttgggttgaatgcgctttacatccgttgcgatgaatgcagcactttcgaagttgtggtgtaagtattgcaataaggctgatgatgaccatatgatcaacatatgaaggttttggcagttttcctgaagttacttgtcagaaacttgttggaaaaaggcccacatgtacccattgtaatatgctgaggtggccaaacagtaaaggttccatacaaatgtaatcgcacgtctgcctacctttctagaatttctgctgtgtacagtgcagtgtaattagccagttaatcttgctcaacatttcgttgccagcttacacgacactatcagtgca

SEQ ID NO: 11739 - DNA, 461 bp, Triticum aestivum
  Clone ID: PAT_TA_11739
gcggacttctccctaagcaactgcatttccattgcaacggcgattcctgagctgtcaccagttgagaaggcaaacagttgtgatatattcagagatgatgtcaataggcagatatttgtttgcgctgatcaagaaacccgccttgcatggttaagaaagcagatggcgccaatacttgattgagtctaaaaggattaactgtgggcaagatatgcaggagacagtgaagaggtgcacgagaactgcaggttacatcttcaatgttcggacaacagttccatcgacaaatgtggaggatcactatgacatttctctgtctattatgtagcatgattctgtcacactattctgctattgatcaacatgattttcaatgagctttaagcttcatcagtcttataacgctctgttctgatggtgattagatgaaattacttctttatggatgagcaaaaaaaaaa

SEQ ID NO: 11740 - DNA, 904 bp, Triticum aestivum
  unsure (1)..(904): unsure at all n locations
  Clone ID: PAT_TA_11740
aggcgacatctccgcatccccacactcttttctccgtcctcctcttccaggctcggcggctggaccctcgccgtggcctcctccgtcgcggcctcgatcgaaaccgaaaaagatcgcccagtaccaacgaagtggaaggacaaagccgtcgtcagtgtcgtgttttgcggctcgtcgtcgttcacggattcgaggtcttatgcttcgatttgatttcttgcattaggaagtgaagattgttatgcaagtgtctgaacttttccaagtggattggtcttatgcttcgatttggtttgttacatgaggaagcgaagaaccgtgattgccgcatgtgtctgaacatttcaagtggattggtaaatatggagctgtattggcatctccaccagcaaacaatgggagagactacgcgagctaccaaaatgcacgccaacatacagctgaaaacaatttcgattcttcccggggcgctagtgcttgcctgacaatcagaagatgcagagttgcagacagattgtgtcacacattcttaatctgcataaagttctgcttcaagtacatagtcaggcatcagtgcaagagctactcagctggtttgaagcaaacggatgcctacattagagtgacatccgttgtgtaggcggtgggacagaggccggctaagcagcatgctggatggtctagaggtggtcggctggcagatcgtagggcctgtttggtttgcttcctcaaaagaacgttagatttctcaagcctaacattgaaattactgcctggctaagtagcattttcgcttgtgtgggagtagggcattttggagaccgagctccatggagccctttactttgaaaaattcaaaattcataaatttcagttcaaaaaattcnaaaaaaaattacacatg

SEQ ID NO: 11741 - DNA, 365 bp, Triticum aestivum
  Clone ID: PAT_TA_11741
gggtctgggcaactcagcattgggttctcaacggctcatgaatataacaaatgtattacatgttgaaaacaatttatcgcggcgcaaactgagcccagggcgcatacaagattactctcgaattacttgctaatcctgctgtgttccccacaaccatgtctcgttccatcaagtgatgaagcagctcaagatacacaaggatgttgtttctccgtggactcgtctaggtcccgtatgtttgcggtcttgtagcttcatcaggcactgtgggtagtctgggtacaaacaacatcagctaggtactggaaggaatcaatctggcatgcgcgcctacttatgtgttattagaaatgagttcctgaccc

SEQ ID NO: 11742 - DNA, 491 bp, Triticum aestivum
  Clone ID: PAT_TA_11742
ccacgagcagatcgacaggaccgggaagagcaagtttaggagcgaccaacgaacgatgaagagtagcacgctggtggcggtcctacttctccagaccgtcatggtcatggggatcctcgcacactcacagcccgcggacgcgcacgacgatttccccaagtgctgcgaccactgcaactcctggtcgggggcccaattctgcgacgacgtgggccccaagtgccgcgacggctgcgtcaactgccgcgtggtgcagacgcgccccgtgaagacgttccggtgtggagatggacgctccgccttcccgtacattccctgcccgccgccgtgcaaaaagaactgatcgctccacctcatcacacagtgacatcgatgtccggccggaaaatataaaataaacagcaacaactgtcgtcgttctctctactttgagagaaatatacagtatatagttgatgttgctccgtaataaataaataaataagctttgt

SEQ ID NO: 11743 - DNA, 767 bp, Triticum aestivum
  Clone ID: PAT_TA_11743
ggagaaaaatcactgtttgaacaagactgtacgataagctgagttcgccttaacccaataaaactctgaaccttctgaagaaaaatcactctcccacggtcccacacaacacaaacacagaaagcacacccagttcgccatctcacctggcatgcggcaaaaaatgtattacatgttgaaaacaatttatcgcggcgcaaactgagcccagggcgcatacaagattactctcgaaattacttgctaatcctgctgtgttcccgacaaccatatctcgttccatcaagtgatgcagcagctcaagatacacaaggatgttggttctccgtgggctcgtctatttgcggtcttgtagcttcatcaggcactgtgggtagtctgggtacaaacaacatcagctaggtagtgggaaggaaccaatctggcatgcgcgcctacttatgtgctatagaagatgagtccatgacgctgcatgatttgtccatgaacttcttcatggagtgtaattcccggccaaatggttccaagaacttcatctctatatctaggggccaaaccttgagtcccatcagccgcagaggcgcctgctggccgggcacgaggcactccgggccagcagcctcagctacggcctccatggccagccccatccctatcggatccggattcctcatgatggcgagggcgtaggcggaggagtcgtcctgggcgacgcggaggacgggggcgtggtggatgcgcgggacgggacggattccggcggagcc

SEQ ID NO: 11744 - DNA, 614 bp, Triticum aestivum
  Clone ID: PAT_TA_11744
aaacaaccacaacaaaaccatcactccacgagcagacaggactgggaagagctttgctcgacaagttcaggagttaggaccaaccaacgatgaagagcagcacgctggtggcgatcctagtcctccaggccgtcatggtcatgggaatcctctcacactcactggccgccgacgacaatttcccgaagtgctgcgacaactgcaactcctggtcgggggcccaattctgtgacgacgtgggccccaagtgccgcgacggctgcgtgaactgccacgtggtgcagacgaggcccgtgaagacgttccggtgtggcgatggacgcgccgccctcccagagaatccctgcccgccgccgtgcaaaaagaactgatcgctcgctcgagctcaccacacagggagatcgacgttgcgccgaaaataaataagaaagctccgacgagatgagcagaaacggccggtgtggtgtacatgcacgtggcccacgcccagcaacacttgagagatagttgatgttgctccgtaaataaacacgtgtatcagtgtatacatatgcgtcacagctcaatcaaataaaaagtcagtttgtttgtgcgataaagtttgggtttggtgc

SEQ ID NO: 11745 - DNA, 585 bp, Triticum aestivum
  unsure (1)..(585): unsure at all n locations
  Clone ID: PAT_TA_11745
nnnnnnnnnnnnnnnnnnnnnnnnnnnnnntccgcaagagcttcgctcgacaagtttaggaccaaccaaccaacgatgaagagcagcacgctggtggcgatcctagtcctccagaccgtcatggtcatgggaatcctctcacaggccgccgccaaagataatttccccaagtgctgcgacaactgcaactcctggtcggggtaccagttctgtgacgacgtcggccccaggtgccgccgcggctgcgccaactgccaggtggtgcagacgagccccgtgaagacgttccggtgcggagatggacttatgagctaacgggcgcgacacgcccacgccctgcccgccgccgtgcaaaaagcactgatcgctccagctcccgcagacactgatgagatcgatgttgcgcccaaaacataaaataaaaaggctccgatgagatgagatgagcagagccatgcccagccttctctttcctttgagagataataataatatagttgatgttgctttttaaataaataaataaacacgggtatcagtttacaaaaaaaaaaaaaaaaaaaaaaaaaaanaaaaaaaaaaagg

SEQ ID NO: 11746 - DNA, 922 bp, Triticum aestivum
  Clone ID: PAT_TA_11746
gaagtcacgagcactgcatgatacacaagttattgaaaaggacggcgcaacagtacacgtctcgggtgtttatcaaataacaaaacagaagagtaccaagtctaaggctatagaagtcttacagggcaaaaacaacacacgctcctaaacgcactccatcaaagttaacaaatccatcacctagcacgacgaaaaatgcaaggcaagggacaaactagtagggccgataacgccgctggcttccttcgccacctcggccaccgccatcccgccggtcaccacgtcgcggagggggtggaggcggcattccaccaggttgttgcagaacatagccaaggcgaccatcagggagcaccatcggcaccatcctcattccagctggtgctggtcctctaccatagatcataggctggttgaatccagggccgccaccataggcaccatatgggtctcccatgtagccaccataaggtggaagaggatagctgggagctccaccaggcttgaacgagtggtcaggtttcttatcactcaaaggtttggccatggaaacttcaagcacttgcccatcgatttcgtatttttcacttcctttaactgccttcagtgcacttgatctttcagcaaagtgaacaaacccaaaatccctcttatgcccggccttagcaggcggtaaaacaatttttgtgacctctccatgaacttcaaagagatccttaactttctctttagaaacattctccggcaggttcttcacatatatagtcttcacctgagcagcagatgaagaagaatctgatgatgacgatgatgaacccttaggttcagcccagctaacagtcaactggcttccatcaaccttaaagtctggtgatgacaatttctgcctggcataatctgcgcaagcatggttatagtactc

SEQ ID NO: 11747 - DNA, 912 bp, Triticum aestivum
  Clone ID: PAT_TA_11747
cggcggacgaaacccacacccatacaaggccaaggggcaggcaaccctcctcaagcctcaagcaaccaacgcggcgccaaggaagaacccctcccttcttccacccaccgatccttccctccgttcctcgtcctcgccggcgacgacctgcagccatggcaatggcttacaagatggcgacggaggggatgaacatcaaggaggagtgcaagcggtggttcacggagatgaagtggaagaaggtgcaccgcttcgtggtgtacaagatcgacgagcggacgcgcgccgtgctggtggacaaggtgggcggccccggggaggggtacgacgagctcgtcgccgcgctgcccggcgacgactgccgctacgccgtcttcgacttcgacttcgtctccgtcgacaactgccagaagagcaagatcttcttcatcgcatggtcgccggcggcgtcgaggataagggccaagatcctgtacgcgacgtcgaagcaaggcctgcggcgggtgctggagggggtccactacgaggtgcaggccaccgagcgctccgagatgggcttcgacgtcatcagagagcgcgcgcaatgagcgagccgccgcccagagcgagctttactatgttggtgtgcctgtcgccgacgatcgccggtgtactataatcgaacggacgctgattggggctggctggttggttggctcgtgtgctctgccagcagcctcgctcgacgcgatctgacgagggtttgggctttgattcagtagaaattaccgatccgtggcttgagattgtgccgtacgtgcgtgtgatgtatagggggagctgagagagcggcagcggattaatgaaacgtcccatctctgcgtgcgacgtggaaattccactgatgctggggatgccccgacttggtttgct

SEQ ID NO: 11748 - DNA, 734 bp, Triticum aestivum
  Clone ID: PAT_TA_11748
cggccgctcgagccggcgggcgggaaccaagacaccagcctcctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgagccggcgcacaggaggccggccggcagaggcgagcacgaggatgaggaggagaagcaagcaatcatcatcaccaccaccaccacccagcgtatcagtaccactagccgccgcatgcgctcgcgcgcgcgctaaataaaataaaaccgtcatgtgttccttagttctgtacgaccagtgtccctcctcatgcctccacttctaatgaatatatggcgcctcaactttgaacgatccaaaaaaaaaaaaaaaaaaaatgttgttgttgtcctcagtctttatcttttcttcttcttaagaaaaacctgttgttgctccgtgaataagctcttgtatcagtttatgcatttctgctcaatcaaataaaatatttgtcatagc

SEQ ID NO: 11749 - DNA, 636 bp, Triticum aestivum
  Clone ID: PAT_TA_11749
gcgatctagaactaggaccatcattccacgagcagatcgcagggccgggaagagcaagtttaggagcaaccaaccaaggatgaagagtagcacgctggtggcgatcctggtcctccaggccgtcatggtcatggggatcctcgcacactcacaggcagcggacacggacgacgatttccccaagtgctgcgaccactgcaactcctggtcgggggcccagttctgcgacgacgtcggccccaagtgccgcgacggctgcgtcaactgccgcgtggtgcagacccgccccgtgaagacattccggtgtggagatggacgctccgcctacccatacattccctgcccgccgccgtgcaaaaagaactgatcgctccacctcatcacacagtgagatcgatgtcgggccggaaagtagtagtacgtataaaataaaaaaggctccgatgagatgcgcagagccgttgtggttgtacatgcatgtctgtcgcctacgcccagcaacaactgtcgtcgttctctctactttgagagatacaacatatagttgatgttgctccgtaataaataaataaataaataaataagctttgtaaaacctggttccatgtcccgctggtaggcattacagtgatgcaa

SEQ ID NO: 11750 - DNA, 668 bp, Triticum aestivum
  Clone ID: PAT_TA_11750
tcgcccacgcgtccgaatcatccttccacgagacacggcagtgcagagcctccatatagagtttaggagcaacgatgaagagtagcacactcgtggtcatcctggtcctccaggccgtcctggtcatgggaatcctctcacaggcgaacgccgagttccccaagtgctgcgacaactgcaggttcttctcgggggccgtagtctgcgacgacgccggccccaagtgccgcgacggctgcgtgaactgccgcgtcgtgcagacgagccctaagaagacgttccgatgcgccgatgcacgcgtcgacgacggcacgccctgcaagccctgcaagaagcactgatagcacatgctcagaacataagatgttgcaccgagaataaaagctcggatgggttgagcagagccgttgtggttgtacgtacacgtgttccatgcccaacaacaattgttgttgtcatcgtcgtcgttatgcttttatctctctccaacaaaagctgtggtcgttgctccctgaataaacacatattcccttcgtttcataatgtaagacattttttggcactagtgtagtatcaaaaaacgtcttatattatgggacggatggagtacttgtgtgtcagtgtattgcgtctctgctcaatcaaataaaaatcagtttatttgtgtc

SEQ ID NO: 11751 - DNA, 594 bp, Triticum aestivum
  Clone ID: PAT_TA_11751
gcacaaccacagcaaaaaccatcattccacgagcagacgcgggacagtgcagagcttcccagagaagcttaggagcaacgatgaagagtagcacactcctggtcatcctgatccttcaggccgtcctggtcatgggaatcctctcacaggcgaacgccgagttccccaagtgctgcgacaactgcaggttcttctcgggggccgtggtctgcgatgacgccggccccaagtgccgggacggctgcgtgaactgccgcgtcgtgcagacgagccctaagaagacgttccgatgcgccgatgctcgcgccgacgacggcacgccctgcaagccctgcaagaagcactgatcgcacatgctcaggacataagatgttggaccgaaaataaaagctcgcatgggttgagcagagcagtggtggctgtacgtgcccgcggtccacgcccaacaacaattgtagttgtcatcgtcgtcgttatgcttttttctctctccagaaaaagctgttgtcattgctccgtgaataaacacatacatatgtatcagtgtatgcgtctctgctcaattaaataaaaatcagtttatttgtgtcgatg

SEQ ID NO: 11752 - DNA, 689 bp, Triticum aestivum
  Clone ID: PAT_TA_11752
gtgcggcgctcgagccggccggtcctggaaaactacagcataaaccatcattagacaggacaagccaattgctttgctcgacaagtgtagaagcaacgatgaagagtagcacgctcgtggcgatcctgattctccaggccgtcctggtcatgggaatcctctcacaggcgaacgccgagttcccaaaatgctgcgacaactgcaggttcttctcgggggccgtggtctgcgacgacgccggccccaagtgccgcgacggctgcgtgaactgccgcgtcgtggagacgagccccaagatgacgttccggtgcgccgatgcgcgcggcgacgacggcacgccctgcccgccctgcaagaagtactgatcgcgcatgctcggaacataagatgttgcgccgaaaaaactcggatgggttgagcagagccgttgtggttgtacgtgcacgtggtccacgcccaacaacaattgttgttgttgtcctcgtcgttatcttttcttcttcttcagaaaaaacctgtttttttttgcgaatagaaaaacctgttgttgctccgtgaataagcacttgtatcaatttatgcctctctgctcaatcaaataaaatatttgtttatttgtgtcaaaaaaaaaaaaaaaaaaaaaaaaaaaaaaaggcccctaggaaaaaaaaaaaaaaaaaaggccccta

SEQ ID NO: 11753 - DNA, 627 bp, Triticum aestivum
  Clone ID: PAT_TA_11753
cccacgcgtccgcccacgcgtccggcataaaccatcattctacgggtagacaggacaaggtgagagctttgctagagaagtgtagaagcgacgatgaagagtagcacgctcgtggcgatcctgattctccaggccgtcctggtcatgggaatcctctcacaggcgaacgccgagttcccgaaatgctgcgacaactgcaggttcttctcgggggccgtggtctgcgacgacgccggccccaagtgccgcgacggctgcgcgaactgccgcgtcgtggagacgagccccaagaagacgttccggtgcgccgatgcgcgaggcgacgacggcacgccctgcccgccctgtaagaagtactgatcgcacatgctcagaaattaagatgttgcgccgaaaataaaaactcggatgggttgagcagagccgttgtggttgtagtacgtgcacgtggtccacgcccaacaacaattgttgtttttgctgttgtcctcgtcgttatcttttcttcttcttaagaaaaacctgttgctgctccgtgaataagcgcttgtatcagtttatgcgttgctgctcaatcaaataaaacatttgtttatttgtgtcaatatatttataatgttcatttcc

SEQ ID NO: 11754 - DNA, 601 bp, Triticum aestivum
  Clone ID: PAT_TA_11754
ggcccgctccgagccgcccacgcgtccacatctacagtataaaccatcattctacgggtagacaggacaaggcgagaactttgctagagaagtgtagaagcaacaatgaagagtagcacgctcgtggcgatcctgattctccaggccgtcctggtcatgggaatcctctcacaagcgaacgccgagttcccgaagtgctgcgacaactgtaggttcttctcgggggccgtggtctgtgacgacgccggccccaagtgccgcgacggctgcgtgaactgccgcgtcgtgcagacgagccccacgaagacgttccggtgcgccgatgcacgcggcgacgacggcacgccctgcccgccctgcaagaagtactgatcgctcatgttcaataagatggtgtgccgataataaaagctcagatgggttgagcggagctgttgtggttgtacgtgcacgtggtccacgcccaacaacaattgttgttgttgtcctcagtctttatcttttcttcttcttaagaaaaacctgttgttgctccgtgaataagctcttgtatcagtttatgcatttctgctcaatcaaataaaatatttgtcatacctgc

SEQ ID NO: 11755 - DNA, 1075 bp, Triticum aestivum
  Clone ID: PAT_TA_11755
gccggccgggtccgcggacgcgtgggggaggactgccaaacccacacccatacaaggggcaggcaaggccgcaaggggcaccctcctcaagcctcaagcaaccaacgcagcgccaaggaagaacccctcccttcttccaccgatccttccctcctttcctcgtcctcaccggcgacgacccgcagccatggcaatggcttacaagatggcgacggaggggatgaacatcaaggaggagtgcaagcggtggttcacggagatgaagtggaagaaggtgcaccgcttcgtggtctacaagatcgacgagcggacgcgcgccgtgctggtggacaaggtgggcggccccggggaggggtacgaggagctcgtcgccgcgctgcccggcgacgactgccgctacgccgtcttcgacttcgacttcgtctccgtcgacaactgccagaagagcaagatcttcttcatcgcatggtcgccggcggcgtcgaggataagagccaagattctgtacgcgacgtcgaagcaaggcctgcggcgggtgctggagggggtccactacgaggtgcaggccaccgagcgctccgagatgggcttcgacgtcatcagagagcgcgcgcaatgagcgagccgccgcccagagcgagctttactatgttggtgtgcctgtcgccgacgatcgccggtgtactataatcgaacggacgctgattggggctggctggctggttggtgtgctctgccagcagtctcgctcgatgcgatctgacgagggtttgggctttgatttagaaaaattatcgatccgtggcttgagattgtgccgtacgtgcgtgtgatgtataggaggagctgagagagtggcagcggattaatgaaacgtcccatctctgcgtgcgacgtggaaattccactgatgctgatgatgccccgacttcgtttgctattgtgcttcaaccgctcttcaagatggtactactactacggttgattgctctgggttgtctctttgtctggtgaaattgttccaggcgtttcttcacctctgttacgcccagcccatagcaaaatttgtaaggac

SEQ ID NO: 11756 - DNA, 697 bp, Triticum aestivum
  unsure (1)..(697): unsure at all n locations
  Clone ID: PAT_TA_11756
atattatgtggtgtgaaaaaaaaagccggaaaaaaaaaggacaaccacaacataaaccatcattccacgagcagacgggacagtgcagagcttccctgtagagaagtttaggagcaacgatgaagagtagcacactcgtggtcatcctggttctccaggccgtcctggtcatggggatcctctcacaggccaacgccgagttcccaaagtgctgcgacagctgcaggttcttctcgggggccgtggtctgcgacgacgccggccccaagtgccgcgacggctgcgtgaactgccgcgtcgtgcagacgagccctaagaagacgttccgatgcgccgatgcacgcgtcgacgatggcacgccctgcaagccctgcaagaagtactgatcgctcatgctcagaacatcagatgttgcgccgaaaataaaagctgggatgagttgagcagagccgttatggctgtacgtgcacgtgttccacgcccaacaacaattgttgttatcatcgtcgtcgttatgcttttctctctctctccagaaaaagctgttgtcgctgctccgtgaataaatcacataaatatgtatcacagtatcagtgtatgcgtctctgctcaatcaaataaaaatcagtttatttgtgtcaaaaaaaaaaaaaaaaaaggcccctaaaaaaaaaanaanggnnnnnnnnnnnnnnng

SEQ ID NO: 11757 - DNA, 2177 bp, Triticum aestivum
  unsure (1)..(2177): unsure at all n locations
  Clone ID: PAT_TA_11757
gcgggggccagccaaaacgactgcccaaccaacacccatgcaaggggaaagcaaggggcaacagcaacaggcgttaggcaaccgcaaaaatgatgacgaagataatgccgcccgtcgccggccccccggtctacatggtcctgggccatcgtcttacacgcaagccccgcagcggatgaacgccaagatggcagtgccaactgcaattcgtggggggggggctggaagcagtggccacgggccccgggcggccagaccgccgggcggacgcgcgccgccgtggcagacgaggccagagacggcggccaggggggcgaccggctgggcggcgccgcccgccgcggaccgctccccgccggccaggcaccgcgtgcacctacatctccgtcaacaacagcgaggccagcacgacccatgatcaaaagacgggatgccggtcggccatagaggatgaagggcgtaggtgccgacgacgaggtcgaaacaagcctgctcttggtttccagcacggcgtccagttcttgctccaagcaacatattgctcaaggttggccttctacatcaccagagaatgcgcgcaatcaactatactgcagaatgagtagaaaggttgcaattcgcagtaacaggaacgatcttttgttgtgctataattatcagcagaatgatgattgccgctgtactttgatgggcactgccctcagcctcgatgcatccttacgtgggtttgggcgctcgatttagaaaaattatcccgtggtttgagattgtgccctgtgatgtataggcggggctgagcgagtgccagcggattaatgaaacgtcccatctctgcgatggaccgtggaagttccgctgacgctggggatgccacagactcctcctgctattgctgctccaacactgtcatcccttcagcagcaggagaagcacggtctgttgattgcgattgtgattccttctgttctgatcatctaacagtcaattgtattccattaacgtttaacactggtgatgacaatttctcacaggcatactctgcttacgcatggttatactactcaattcagaggaacccgcggtaaccccatcgcgtatgaaaaacctacaacatctcaaaagatacgctatctcgttggttctccttgggtccgtttgtttgccgttctttagtttacccagggcatggtgggcaatcaggtaacaactacttggactaggttattggaaggaaccaatctggcatgcgcgcctacttatgtgttatagaagatgagtccatgacgctgcatgatttgtccatgaacttcttcatggagtgtaattcccggccaaatggttccaagaacttcatctctatatctaggggccaaaccttgagtcccatcagccgcagaggcgcttgcttgccgggcacgcccccgaccaatacctccgagccctgcgggggtagtgcgaggagctcctcccacttcatcttctcttcttcgtcctcaggcccatcacccttctccatctcgtcaccacttcctgcggcaggttcatcactcgcaacggccataccggcgtcctcctcccggccatctccatcgccatcgccctccacctcgatttgaggctcctcgggctcctcctccggttcatcagagtcctcgccaccgtggcggcggcggcggtacccttcctcgtcgtccatgacgtcgtcgtctccctccaggtccacctgctcctccggctcctccgacggctgccgatccgacatcccaaaaccctaacctgcggtggggagctcgctcgctacgggacggtgagtagccggcgggggagggcacggagccgcaggcgcggcccgttccagatgcgagtcggacacccggcgtacggatctgacggcgggggatcgaaaatcggtacctttgacccggaaaaaactggggagtggagttgtgtgggtaggggaatttggctggctggctttgggggggaagctgctgctgctgccgggaggacgagaggattcgattcgatttgatttcgatatatgtgagtagaaggaattattggagcagaggaggaggcgaagcttactggggagtggagttgtgtgggtaggggaatttggctggctggntttggggggggggaagctgctgctgccgctgcctccctcgtgccga

SEQ ID NO: 11758 - DNA, 714 bp, Triticum aestivum
  Clone ID: PAT_TA_11758
tctccctcacccctccttcttcacctccggccgccgccatggccaggccgacgtggtggtgcgcctccgcgccatccatcaccagcaccaccgcaccccagcgcgccaccaacacctccaccatcaccctgcgcctccatccaccaccatccacagcgccgcctcatcacctcgcgccgccgcccatccatatccctgctgctgctcaacctttcttcttctcctaaccttcttcccgcatccccgctgcccttcttctttcctgaacctgctgctgctacctcctcttctttcttctccttcacctcgctgctccttaccacgctgctgctcttccctctcatctctgctgctgctcttccttgcgcctccctgctgctgcttttccttccctccgctgcttgttgcttcttctttgatccctttgctgctgctcttcttctccagcgtcccctgccgctcctcacttgctgaagctctgctctgaacctctcccttgtccctactgctactgcactcctcttgccgctctctgtttcaagaacaggaacacctgaatctctctctaatatattctgttgtgtatcagtactattcgtgtctgtatgtcagttagtttactttaataattcagatcacttgtgatctttgtgttgaatgtgctttcggtgttcttgagatgtgtaaaactgttcaatatttagtttacaattt

SEQ ID NO: 11759 - DNA, 969 bp, Triticum aestivum
  unsure (1)..(969): unsure at all n locations
  Clone ID: PAT_TA_11759
gctcctttgggaaaacccagtataactcgacgggagctggatttgggaggacggagcgggagatcgatcgacggagcatccatccatccatccaccatggccaagaaggctggtgcggagagggacgcggcggcggagagctgtgcccaaaagaaggctaggatcgagtacgaggccaaggctgcggcgtcgaagatcaccgtcaacttagaccacaagttgctggagtgctccgcttgctgcagcccgttggctccaccccttttccagtgcacaaatggccacatcgcatgctcagagtgccgcaccaatgcggagtacagttgcagcttctgtgccgagccggccaacacccngctgcgacatcatggagcgcgtacttggcggcatgacagcgccgtgctcgttccgggagtttggctgctccgcgacgatcccgttcacgaagaagctgacccaggaagagtcctgccttcatgccccgtgccactgccccatcccctactgccgcctctacgccaaccgtggccagtgcctgcgcgagcacatcgagacgaagcactgcttggtcccatacggggatgccacagccggcagcctttcccctgtgagggtgtgcgacagtgagccggcgcgcctggtgttcctggacgccagggcggtgttcctgctggtggttgagcggagcgggccgtcggggcgtgccgtgtcggtggtccagctcgtcagcgagccagtgaaggaggaggaggagaaggatttcaagtacaagatccaggtgcatacgcgagcaggcgtcctctctctgtccggcgagacgcagagcgtcgggcgactgatgaggccttaccaggcagccgcgtcgctgttcgtctcggatgacgtgtggtctccccaggattctccggtgtacctcgagtttaaatgaatctggataagctgtatgccgttcagtggcaaacctatccc

SEQ ID NO: 11760 - DNA, 614 bp, Triticum aestivum
  unsure (1)..(614): unsure at all n locations
  Clone ID: PAT_TA_11760
tgcaggnaattcggcacgaggcacattatcatgttctgtgggacgagtaacaatttcacggcggacgaaatgcagacattgacaaacaacctttgctacacgtatgcgcgttgcacacggtctgtttctgtcggtaatttcttcttccttctcgcgcccctgctgaatacattttcctctttcgacgtaacaatggtgacaaatctgaagtttggcctttggtctgttgtgttgtttgagcagtgccgcctgtttactatgctcatctagccgcattccgggcacgtttctacatggaccaagatagcctctcggtgaagaatgccaaccggacgaatggaagtgccatgaagactatgccagcggtgaaagagagggtgaagagggtgatgttctactgctgacaggcactcggacatgctatatagctaacactaggaattagaggtttatattagattttagatatgtaggacgggaagagtgaagaactaggtatcttgtcctatataaacttggactatgttttgttaagattgggcacaacatcctccgtaatatagctaatagattggcaatgtcagtccggaaaatgtgcacacataaaaaaaaaa

SEQ ID NO: 11761 - DNA, 672 bp, Triticum aestivum
  unsure (1)..(672): unsure at all n locations
  Clone ID: PAT_TA_11761
cacgagggggggaactagnaagtaaagtacacctcccaagnacgcagccgataagggcgagcctctaccagaggcagagcctgcaaaagaagatgatatggatgaggacagctctatgcccagcagcggggcggcagatgatacattgagcaagggaaagaagtcaaaaagagctactaggagttcaggaaagacaaagaagaacgacacctccaaggacgcagataagacagagtctgtaactgagcctgcaaaggaagtggccgagaacgaggacagctctatgcccagtgcagaggcgacagatgacacagtgagcaagggaagaaagtcgaagaaaagtaagggttcagcaaagaccaagaagaaagatgcagataagaatgagtctctaccagagcctgcaaaggaagttgccgaggatgaggacagctctatgcccagtgcagaggcgatagatggtgcattgagcaaggaaacgaattccaagagcagtacaaggtcggcaaagaagaagaagaaagacgcaggtaaaaaagagtctctaccagatcctgcaaaggaaggtgctgagaatgaggacagctctatgcccagtggaggggcgtacagatggtgcgttgagcaaggaaacaaattccaagnatcagtacgaggtcggcaaaaaaaaaa

SEQ ID NO: 11762 - DNA, 631 bp, Triticum aestivum
  unsure (1)..(631): unsure at all n locations
  Clone ID: PAT_TA_11762
agccttcggcccgcggctctcctagacgagctacggtggccgcccacaaggtgtttgacggaattcccatcaaggatggcatcacttgggcgaccatagacttcgatggaggtttccacgacgaagcagtaagtcttttgacctgcatgtgtcacgaatgacagggactcattggtgctatgctcgtccatgccattgtggctgtgtttggctgagcaaaccaaggaacttcagtgagctgttgcacgcgcataaagagagcctgcaatgatgtaggtagttcggcctgctacgccggacgtgaggtttccatcaagatgtcagcaagccatttaaagctggaaggagtgatatgattcatgcctcttcacactgtatacaatctgatgaagagggaatcaaggttctcttcttctgtcctgtgaatattttgttttctatttgtagaaaaacaaagcagcaagcctcctcgcagcttccattaaaaacccatgtgccagaaagttcttagcatgaaaccaagtactaccacatttctgaactgtgtattttagtgaaatctcttggagtttatggatctggtggaacaaatatggttaaaaaatgattgnttttctccataaaaaaaaaa

SEQ ID NO: 11763 - DNA, 2211 bp, Triticum aestivum
  Clone ID: PAT_TA_11763
gcgaacgcccagttgaaattaaagggggaaaataaacccaaaccactcgccgaacactacaccaccccccaccccccatccccgccgcccctgaccggcgccatggccgccgccggagagcggcgcctcctcgtcggcctcctcctcctggccctgatggtctcggcgcactgcctggacggcgcgggggccaccacggcccgcgcgtgaagcggcgccgcaagaagcgcgagatccactcccccgtcaagacggtggtggtggtggtcatggagaaccgcagcttcgaccacgtcctcggctggcctccgcgacctcccgccccgacatcgacggggctcaccggcacggagtccaaccgcctcaacgcgtccgacccctcctccccggagatcttcgtcaccgacaaggcccggccacgtcgacgcgggaccacgggcagcggcttcgaggacatccgcgaggcagatcttcggctccgccctacacctccgccgtgccgcccccaactcccgcggctccgcgcagcaaccgcgagcgggccaggggcctggccccacggctcgcaacgtcctcaccgagccgccgcccgcttgcgtccccgcccacccacgccgctccgaccagttcctccgcgggttccgccagctggtccccgtacgcccccacaaccgctcctcacggcctcctcatccactccgccgcctccccccgccgccccgccctcaaccgccagaacctcatcatccactgcctgcagaagaccaccttcgtcggcccctaggaggacggccgctcctccgccttcttctaccagccaaaccccccggacgctctcttccacgagcgtgcccggtctcctctaccccctcctgtagtaccagtacaacatccggctccacatcgacgccgccacgggcaacctgctcaataactacgtcgtcatgcagcgctacttcgtttgcagcaagttcctccccgacgacgaccacccgccgccggacgatgccgcgggacagagagttgtcaaggaggtctgcgggacgctgcgcgcgggccggccccggaacgagacggctctcatcttatcatatgctaagcttagtggcttctatgaccatgtccccacgcccgtcgtcaaagtgcctcagcctgatgggagtattgggcctgacccttactacttcaagtttgatcggctcggggtgcgcgtgcccagcttcctcatctcaccctgggttgagaagggcaccgtgatccatgaaccaaatggtcctgagggaacctcacaatatgagcattcatccatccctgcgacagtaaagaagctatttaatttacgtgctaactacctgacaaagagggattcatgggctgggacctttgagagctacctcaaagtccgaaagacaccaagaactgattgtccagagaaactcccagaggttacaaagtccctgcgaccatttggtgctaagtgaagataaatctctatcggagtttcaagtggcagttgattcaacttgcctctcagctctactggtgaacacgttcccaatcagcctatacagggatattggctaagacgatgagtgtaggcggaagcaaaccggctacgcagcaggatgctgtctcccagactgcctcgcaggctgggaaggttcgcacgtttccgggctggttggcaaagagaaccttgctgctcgggttgaccactagaggccccgggctgacatatgcagcagccgctaatctcccaccggactttgtccatacctggaatgcattgatggactcgttacgtcggcatagcttgcccaacagattctgcatcacgattaccggtagctaacatgggctgcaagagtacggtagaatttatgtattgggttttagatcttgcacatggattttttgtacacatacgccatgatacttcgtatatcggagcttacttcagccggccctcgtggtttacgctcaggagaatcacccaaccacgcaccagatgcatgccaaagtccccttccggatacgctgtagcgggtgttcttccttttcagctctcctactgtgcctgcattgtatagcagttgaactgcattgtaaaggaagtattgtactatgaatgattgttggatttggccgcctgtaacaactagcagcagccaaaaaaaaaaaaaaaacttctaaatctttgtttcacttcaa

SEQ ID NO: 11764 - DNA, 1038 bp, Triticum aestivum
  unsure (1)..(1038): unsure at all n locations
  Clone ID: PAT_TA_11764
ctgantcgccaagctcgaaattaaccctcactaaagggaacaaaagctggagctccaccgcggtggcggccgctctagaactagtggatcccccgggctgcaggaattcggcaccagaatctctctcgccagaatcccccagtcctcccttacgcggcagccaaacaaaaatatatagtgtagatcggttcttccttcctgtcgcccaaatcggaactcccaaattcttctcgccagaatcctccagcctcttccttcgataaaccatccatcagaccaaccgatggcgccggatgaggctgtggccggcgtcgagtgtgtctgccctgccaaaagaaaggcggaggctttcgccggagaggagtgttcgcgcgccgccaagaggctcgactgctccgagggagacaaggatgcaccggcagggacggtccaacgaaaaaagatgtggcggctgccactggaggagatcaagtggatccttgcacagccgaacgaacctgtttgggctgagatccgggagctcaagcgcgccaacccgtcgctgctgccatcgcctgaggaggagaaggatgaggcaatggtgctgctgtacgcatgtgctcgcgactgctatgaggatgaagagaagttcgcgcgattccaggcctgggtccgcagcgagtacgcctccatgggattcgtggaggtcgactacgactacttcggtgagagggccgaggcgacgaggctgagcaaggaggcacgggaggaggtgttcagagacacggatctttcttcagacagcgaggacgacgacgagttgaagcatctcaagagaacagttaggagctgggtctgaaatccatagttctatctatttcaggtttctgatgctggtggcctgtcacggcatcggagctactacctcctcttgtcttatcttgtaaccctgctggtgcagcaattctttgtactgatgcccgtgtgcgcccatgtcgcaagaggctagtacgagcaagtattgtttgttcagtaaaaattgatataccggattgcaag

SEQ ID NO: 11765 - DNA, 749 bp, Triticum aestivum
  Clone ID: PAT_TA_11765
ggggcatatctaatgattttatcgacgaggggaggaaggcgggaaacgtgctcgtgcattgcttcgcgggggtctcccggagtgctaccatcatcacggcatatctaatgaggacagagcagaaatctctggaagaagcactagagtccttgaaggaaattaacgagtccgtttgcccaaacgacggtttccttgaccagttaaaattgtttgaagaaatgggtttcaaggttgatacttcaagttctttataccggcgcttccgcttaaagttgttaggtcagtcctacaaagttggagagaaaataggaaaccatgtatttgaagacgatcctggagttgctcgacagcctaatcctacccaggaattgtcaggcaaggagaaggcccttaaaacagcataccgctgcaagaaatgcaggaggatcgctgctgcacaggacaatgttatcggccacacacctggtgagggcaacgctgccggtgcgcccctcccctccaggtttccccgcgcacacttcatggaaccaccttcttcttctccgcccatgggttagcagattcgaggagttcgtcaggggggtggtgtagataccatatcgtctgaaccgtcatgcattggatcacaaggagcaaaagctggagcctgcttcatgcattcaccctattgtactctgaaatactgtacctcacaactgcccacgggcgaagttgatctcagcaccgtctagctctccccgatcctaaac

SEQ ID NO: 11766 - DNA, 876 bp, Triticum aestivum
  unsure (1)..(876): unsure at all n locations
  Clone ID: PAT_TA_11766
gaggcgttgctattttctcagcagcaacagcagcagcagaggttgtcactagttcagccgcctcatcacaattacctaaacatgcagcctcacttgtatcaccatcattccccagagataataggcaggtttgatcatattcctagtgtgccttcaccaagggacaagagatcaaggtcaggaagaggaaaacacagtatgcgcttttctcaacaacaatctgatacagctggccagaatgttgacactggaggaacaaaattcagatcaaagtatatgtcatctgaagagattgatactattttaagaatgcagcactctggcagtcacagcagtgatccttacgtcgatgactactaccaccaagcttgtatagccaaaagatctgtcaactctcagcagaaggtgaatttctcccccgcgtcaataaaagactcccactcaaagtctaggtctggtggtgatcagcattcatacctgaaggttgattctcttggaagagtgtcattctcttccatacgtaggcctcgccctcttcttgaagttgatattcctgcatctggtgatggccacaagtcatctacgaggccactggagaaagagccaatgctggcagccagaattaccgttgaggatggtatatgtcttcttctagatgtaaatgatattgaccgtgtgttacagtctagccaggcacaggacagcagcttccaactgaggcgaaggcggcaggtcctccttgaaggcttagctacatcacttgagcttgtcgacccttttggccccaacaaacctggcaattcatctggattggccccgacggatgaccttatttttctccgcattgtttctctccctaaggcggaagcncttgga

SEQ ID NO: 11767 - DNA, 408 bp, Triticum aestivum
  unsure (1)..(408): unsure at all n locations
  Clone ID: PAT_TA_11767
gcacggtcgcgcgcacaacnggccatcgcttcatgcgcgatcacagctctcgcattggtcgacgccgtgtgggccttctcgatggtggccaatggggagctgatgctgctaaagaggcttggagttcgggcatggtggaggcttccatgggcgattctactgacctttctgtcgcagttttggccttacattgtgatcgccggcgtgctaatattttacaaggttgatagagttcattgacttgtaatgacattgtgggactgctcgtaacgcatttaaattgctcaagtactttgttttgtgtgacgaagaggagggagaaggagattaacatgtgaattcaaatncttggtgattgcgctatgtgaaatatgaaagagaaaaatattctttattccaaaaaaaaaa

SEQ ID NO: 11768 - DNA, 1141 bp, Triticum aestivum
  Clone ID: PAT_TA_11768
gacacagttcttgaagcagcaaaatttcgagggattgaacttaatattgttgcgtacaactcgggcatcggaagctatttaagttttggagattatgagaaagctttggagttctacgccgcaatgatggcgagcaatgtgaatccagatgctgtaacttacaatatactcatcagtggattgtgtaaattgggaaaatatgcagaatctctgaaattttttgaagacatggtggacttgcaaattcctttaaccaaggaggtttactcgtccttgatttgttcatatgtcaaacaggacaaactagctgaagcggaatctacttttagttatatgaaaacatctggctgcttccctgatgttctgacatatactgctatgattcaagcctatattgatcatgggagttggacgagtgtgtgggacctattcaaagagatggaaggaaatgccatactgccagatgccattatatgctcatccctcatggaagcattgaataaaggaaatcaacatgaaagggtccttcagttgatgaaattcatgcacgatcgatccatccaattgaaccaaaaagcttattttgaaataatagcttcatgcagcatgctacgggactggagaactgcaagtgaaataattgaacatttggattcctctctcccatccatttctgttgggaagctaaaccatcttctgaattttcttggaaaatgtgggaagacagagagtatgatgaagctgttttacaagatggtgagttcatgctctactgtaggcccgtcgtcgcggccggggctccggtcctgccccctcgcacgtggaaaatggagaaagtatgtcgaggttttgcagtggatggaggatgctggagtccgtccaacactatatatgtatcaaaatgttcttccatatatttggagggacaatagcatggattgtgtcactcttatgcaggaaaaaataagtgccgtcagagtgtgcatcgcttgcgcttcaggcgtctttttgcgcgtctttggtgggcaacaatgcgtccgcgtatcttgggggtgttcactctgcggtgtgtgtgctctgaagttgtggagccatggctacttcccctaatccagatattcagaaaacataaaactgggca

SEQ ID NO: 11769 - DNA, 604 bp, Triticum aestivum
  Clone ID: PAT_TA_11769
ggtcctccggaaacccggactcctcacccttaccactcgccgcttctcccacctcctccgccgccgcaatggcaggggaaagcacggcaagccaccccatcgcgcgcatgcgcaccctccccggcgccggcagacgcactcctacccaccctgccatccgcccagcgtcccgagcaacgcgaccttgggactgggagggtcatatgggcggtgataagatggactggagggtgcgcggcgaggcggagcccggagtcgccgtgcctggcggtatggcggcgagtttcctctgcagttccgcttgtggatggccctcctcctagctggatggcagggacaatggatgatcatctactgccctcttttttaccatcttggtagaccgggcataatatttggttattgtttaggttcaggcatcgactgaacttggtgaatccgaactagctgacgagaggataagtactactcgtaggcctgaatactttcatctgaactttcaggtggcctgtcacctgtcaggtggtgaaatcaatcaattatacccatgagcaatggtctgcatgataatatttcatatttggttttggcaccaaaaaaaaaa

SEQ ID NO: 11770 - DNA, 695 bp, Triticum aestivum
  unsure (1)..(695): unsure at all n locations
  Clone ID: PAT_TA_11770
naagaanaanatcaaaggtttaaantttcanggggtgaanttcttataccgggattacccccggggtgccttccctggggagaccatggcagatttcattcttgatcctgacaacgcagacgtattgaaggcgaaaattcttgtgatggagagtacttttcttgatgactctgtctcgattgagcatgcaagggaatatgggcacatacacttgtttgagattgcgaatcactctgagaagtttgaaaacagagccattctactaattcacttttcggctcgttatacaacagaggaaattgatgcagggataagtagattgcccccgtcgttccgaagcagagtttatgcgttgaaagagggcatctgaaattaggttgagatagtgatcaacttttcttgtcttccgtctaaactagacgaacaaaatgtctgtatttttcacccaaaaccttgcttgtatggtatgccatcgtaacaaggttcttgacatgtccctagtactaaattcatctggaattctgtgaaatggtgactcgtttagttgagtgttcattttgtctatgtgagatgggagaagattgaaatgctaaaaaaaacagacagacagaacaactcggagcctgttagagctgcccccttgcacggcacaacccccccggcctccctggccccccaccctgcctggttcctca

SEQ ID NO: 11771 - DNA, 673 bp, Triticum aestivum
  unsure (1)..(673): unsure at all n locations
  Clone ID: PAT_TA_11771
ggacgcggggagccatgggcgtcgtcaaggnaaatgacgccttgtggccctctgcgtgctaggtgtcatgttcctcgttccggatggcggacatgagcggtctccccggctgcggaagaccgacgaggatggatctccaggagctcgcggcccaggtgcgcaccacccctcgtgggcaccgcctcctcggccgccgggatactcatctgggtcggcaaggtggccgacgacctgagcgccgctgggtgggactgggagatgcgcgcgatgttcatcgtcggcgtcaacctctccctcgcctcgtcgttcctcgccctctccgccctcgtcttggagctctcctgcgaccccgtcgtcaactactgcatcgccgcggggctcatcggcgtgcatctcgtagccgcgtgggcggtccgtggtcgtctccgagcactgaggcttcgtcgagcaacctaggtagccaacaacgagccggtgggactgggattgtctctctcaattgattagggttatggtggtgttccatctccaaatgatgtgtctggcgcgcctggacaaagacatgaatcaactttctattncttgttncttaattaatncttagggnagtgcgtttagtttattttaggtaaggaagtaaaaactgtaccaccggtgtgngcttatcttaatc

SEQ ID NO: 11772 - DNA, 985 bp, Triticum aestivum
  unsure (1)..(985): unsure at all n locations
  Clone ID: PAT_TA_11772
attcggcacgaggtaggaagcaggccagcgctgtagcatacatcaaatgcagcttggagacacatcagaatgccatggttgtcttcggcactgccttcaaaggggtccttcagcctccaaggagaagggaactgatggctgccagggaaactaggtgaaactctggatgctcgagacagatcagatggttaatttttttatggtggccacggctacttccagtgtctgctaaagagcagggccagcaataggcctttagaatacatgcaagcaaattatctccagagttcagggcttctggatggaagagttttctacaacctcaaaaatcttagtactctctacctagacttcataattatgcctcacttcttctgaagattttttgaagtatgccttttatttgggttgttcgtgcatttgcagtgttggaggtgttagtacaagattgtagagttggaaagtatagcaaaacgtcaggttggtgcagggacttggtgaagccatcaggctcgactgtgtctgcttccctgatggttttgacttctgattagtgattttgatgcatattacttgatgatttggtctttgtggcagctttcagtttgaactggcattcagtggcttcatcctctttggtgcaacttggagttagtgtgtacatctgaatcttttgattttcctgaagcatattacttggtttatggtgtctgctaacttgcatgcaatttgatggaatctgatctcagttttgctcccagtgaatatacaaaaggctagaagtaaatggtggaagatcctttggtctcaaacgaggttcctactttcgtactcaaagtttgtacagtaggtaatcaaattttggcctttagcttgcaaatttatcaccttacaggagaagtaaaggttgcatgtacatgagctctaattatctccatatatacttaattgcttgggttcatgnctggatttgtcggactaccat

SEQ ID NO: 11773 - DNA, 641 bp, Triticum aestivum
  Clone ID: PAT_TA_11773
ggagcactgtaaaccagtaacaatggaggatggctgctctgctctgctcgattgatctctccccctggtgaggaggggtagcggtggccggtaggcagctgggtagcgttggctcggctgtgtgagcgtccgtcaccccgccgacgggccattactcgcgcgcaggtggaggtccgtcgccggctctcgactcgctttctgggggaggcgggtgagagatcccatgtgcattggggccctgaagcaagcagcagccagcgtctctcgcgccgcgggcagccgcgcgtctcacctgccccgcctctccctcccttaattctttgcccgccgccgctcctgaccttggtgggtgggcaaggaggagggaagctcccgtgacctgtggtggtggttctcggggaacccccggcggccggcattcaggaagctgtactgtgagatcaataaaagcaaagttctttcaacgaacaatttttgctgctgctgcggtttttcatccctgccttcagtatcaaagtcctggctgaaactctgaaactcctggttgagaaattggaaagcgtacaacttgccaagatacacaggccggcgcttgttataggatacagtcttgggcacaaagctgggctccaatggcttgg

SEQ ID NO: 11774 - DNA, 1146 bp, Triticum aestivum
  unsure (1)..(1146): unsure at all n locations
  Clone ID: PAT_TA_11774
gggagattgcataagtgtgacagccagnatctgttggtgtcaaggggcgtcgtgccgtcagccacggctggtgccgaattctcctgcacggttgtggttggacacctcggcggcgctgctgagtgcggtggcaagaagaaagagtcgccaacccagtccatgaaatcgaccgggaaggtgaacccagaggcgccggggtggaccagaaggttgagagttggccgtgcacctccgcatagggcaccctgccctggtagagtcactctactggaagaagcaatccggaggtatgctgataaaccatcggacaatgttgtgaaaccaaagattgggatgagttttgactccctggggaagcctacgaatttctctaacctgtattcctggagcttggatttggtatgagatatggcaagagacgcctgaacgtcgagagcggacaaagtgtctggatactcgataaatttcatttgcagggaaagcctgagcagcagaatagctggtcttgctggtgcgagtgccctccaatgatcagacttctttagagctgctcacaattgatggttcatcactgagcaccggtgaagccacaactattcatgtcccttacttgcggtgaaaaaggcacaaaagatttggtgaagcggcttaggggaaataatgtgaagctcaacaaggtgtacaacatagttggcagcttcttcggttcatctcagagactcagaatgtgcctttcacaaagcggtcttctccggaatctgtgtggccggataagtcgagaccaggctgatcacgctgatgtgaacaagacccttgctgtgtttaaagagatacagcgcaacgacccagagttcacctactgagtataaggggatgaggaaagcagaatcaagaaccttatgtggacaaatggaaacaacaagctgcagcacaaattctttgggatgtcatcacattcgacacaatgtatcggactaatctgtatgacacgtcctttgggttgttcgttggtgtgaacaatcacttccagagcgtaatcctagctagcgtcttgatgtgttatgagcaagtcgagagcttccagtgggtgttctctgaacttctgaagtgtgaattgcctatgtagtgtcagttttcagaaaacaa

SEQ ID NO: 11775 - DNA, 404 bp, Triticum aestivum
  Clone ID: PAT_TA_11775
gctcgctggacgtgaatgccatagtgtcattccgtgtctttgttgcactccccgctgaaccaacggttcgagtcttctggattgccatagttgagtaatcttgttgctcaccacccattggcgtgggcttgtgtagactccattatttgcaggtcgatggggatatgaccaagcaaggagcacgcgcaactcgagaggcaattcggtctggatgactcaagcaatactactctccgctgcagcgcacattcgatgtgattattattacatgtataaatgtaaatagctcgttaattagttagagaatcaaatacttccatgagtgcatatatgttactggaagaacgtttggcggtgagacagtaaaatgtggtctgctcacgaaccttctcacaaaaaaaaaa

SEQ ID NO: 11776 - DNA, 715 bp, Triticum aestivum
  unsure (1)..(715): unsure at all n locations
  Clone ID: PAT_TA_11776
aganccagaccttcgggaaccagaccaagaagctcctctacctctgcctgggtgccgtgttagcggtcgtcacggcgcgtcaccagccatgctcgtccatgagcggccgcggcggagtactttgcttgcggcgtagacgatggcgcgcatgccgtgcttgctgctggagccgtggggcacctcctcgcccaccccgacaacaagaagagctggtgggaggaaatgggtggctacccagcaactgcttgctggttgcgccaatttggggcttgctagcaattgtgcttgtccctgaactatagaccaaaaagagacaatgctaacttaatgaatgttttgtgtgggaattagtctgtacattagccacaaccggatccagattgaggttggcggtcgataccaacgccgtcctggatggcgtgctcgagatcgaaggcggggaactccagaaggcagacggcagcattgcctcagttgtagctgcatggggaagaggaggggtggaggagtagacgctgcatctccatccgccgtgatgggagtgatggcgtcggtgctcgccgtgtccgccgtcagctccatcttaacgatgttatcctcgattggaagttcgagcgccctcacaacaggacttactccaccccttctccctccccgttcccttcccctgggggttaattgaagtatttatatttccgtattagtgggttcaact

SEQ ID NO: 11777 - DNA, 1211 bp, Triticum aestivum
  unsure (1)..(1211): unsure at all n locations
  Clone ID: PAT_TA_11777
acggccgagggtcggcacggggccgtggtgtcggacggcggcgacggcggggtggtggccaggagggtgtgggatgggaagggcatgtcagggtacggggcggcgagatgggcctcgtcggcggagttcgccaccggcggcgccggctgcggcgtgcagtggtgggaccgcaggaaaggggacgccgtggtggcgcagtgcaagggcgtctggggtcatggtgtcgccaccggcatggtgcactccattgatatacatccatcaagaaagcatgtctgtgtggtgggaggctcctcaggaacaatatttgcttgggacctccgctgggcacagcagccaataccactctctggtgtaggccttgacgaaacggcacaacccctgtgcgagagtgaggtctgggaggttctttttgacaactacacacagtcttctgatattatctcgtctgtctcaacaagaatattacctgtgatgctgtgctcagaggatggaatccttgcaatcgtcgaacaagatgagtggcctcttgcattgcttgccgagccctgtgctatcaactcctttgatatcgatcctcagaacccttctgatgtcgtctgtgccctggaatgggaatcgattggtgtgcttacacgtggaagggatgcaatggcagaggaatgaatacattcgctctccgacaattctattgaatttccatgcacaacttcctgtgatggcccgtggcgtgactagtcgagaaatcagggtaagcatcttccgaggacaccggcatgctgtccttttgttgctcatcagctatcaattgatggaataggcgtgctccggcgtgtatttcatttgttgttttggtgggcaaacttttgtttgtcattggtacccccgattcgtgttaaacttcacactggtttatgcgtacctggtgatttggggttcaacatcaggtgaattgggaacataacttgtgattacngggtttaaancaaaaaaaaaccccaaggggggggcccngtaccaattcncctaaaatgatcgtattaccncgccaatggcgttcntttaaaacccttnccgggnaaacctggnttccaactaacccttgnanaanccctttccaantgggtaaanaaaagccnaacgttccttcaaaattccacctaaggaanggacccctttgggatnaaccggngtggntncccncttcccnn

SEQ ID NO: 11778 - DNA, 1115 bp, Triticum aestivum
  unsure (1)..(1115): unsure at all n locations
  Clone ID: PAT_TA_11778
gcacgaggcaggggcagagagagaggtggcctgggcgtgctccgctcgcgcggcgaggcaggggggcgatgcggggcgccccgagcgcaaacacgcggcgccgccgcctcggcgagtcgggatcggatcgcctcgccttcaccaccgcccagacccgccacctcccccccgccccctaccctgatccaccgcttgcccacccccgtctacgccccaagcacaagagccacagtagcgacagagtcctactccacaaagttcaacccaagcagcgccgtgtctgagagccacccagtatatgagccgccgttgctgcggagccctgctgatgaaaccctcaacaagaggacttatgattatggagcagcaactgtgcagcctaagagggacatggaaatgagacccagtgtgactgcctcccagggccacgggggctgtggctacgagggccatggaagtgcgcccaagctacccgcacccaagcgaccccaacccagcataccactcaactcggtctctggtagttcattagcaacccgtggatatcacccaggccaactccgccacagagctcacccgctgcttagcatcccttcgcttagccttcattgtggttgctttctaactgggggtctggacgttgggtgggcaccatcaccacgagtattggatttgcacgaggccgctcctgttcctcatcataacgaacgtaaccatcgtcatgtccttgctgatggagaacagggaccccaatgcgaggggcagacaggccggcatcagccttggcttctgatggcttgatggctgatgctggagctcggggatgctgctacagaaggcgtctgaagctatgctgatggacttcggaatttgcgctttcatcatgatctatgttctttgattctggataccctacacatgttttcttggatcctggatgcggatttgaatattgcacagaagcgcgtatcgcatttcgttttctttttttcttatatcgtaatctcatgctcatatatctgatcatctgaccttgtaccctgggttgattctggtttatgatttacttgggaaacacgattacggctcactgggacaattnatccaaggcaann

SEQ ID NO: 11779 - DNA, 788 bp, Triticum aestivum
  unsure (1)..(788): unsure at all n locations
  Clone ID: PAT_TA_11779
cgaggcaccagttcatctccgggctgcccgacggctacaacaccgtcgtcggcgagaggggaatccagctgtccggcgggcagaagcagcgggtagccatcgcgagggccgtcgtcaaggaccccaaggtgctcctgctggacgaggcaacgagcgctctagacgcggagtcagagcgtgtggtgcaggaggcactggaccaggtgatggtcgggaggacgactgtggtggtggcgcatcgcctgtcgactgtgagaggcgccgacattatcagcgtggtgaagaacgggacgatagtggagaaaggaaggcatgaagaactgctgcggatcaaggatggagcctacgcttcccttgtcgagcttagctccacttcaagataagatactcatctttctctaccagaaaattccatggaatgaaaggccagcaattcagtgtatttgagtttataggccagttaatgtgggtgtaggatctttcctttcattttagtagatgggtatctgcagacaagcagatgcaatcagacaaactgtatgcaaataattactgattgtcgttcaagcgaggatgccgatgaagcttttccaaaacacggcaataagaagaaattatttgcctgatcgcagtataagaacatgagttagaactctgggcaacctattcccttggaaatgtaagcttgtggctattttaatatgttcagtttcntgggctgccaaaaaaaaancangccccanncaggccaanaanaaaatccanggggggcccggtaccaattcccc

SEQ ID NO: 11780 - DNA, 925 bp, Triticum aestivum
  Clone ID: PAT_TA_11780
gtctcccgagcccctgcagatctttaccagtgtggatcgaacaaagcataagcattctttgtttgttgtttcccaggtgttttgtccatcccctttctgcggaaagacggttgttaactgtaagcaaaaggctgggtttgtgagctggtctgtatgggctgtgtatcatcgaagcagttcagacgagctccaccgcatgaggatgcggctcttctggccaaagagaccacattttctttgaatgaagtggaggccctctacgagttgttcaaaaagattagctattctatattcaaggatgggcttattcacaaggaggagttccaacttgctctcttcaggaacagcaaccggaagaaccttttcgctgatcggatatttgatctgtttgatctgaagcgaaacggtgtgattgaattcgaggagtttgttcggtccctccacatttttcacccggatacacccatggcagacaagattgcatttgcattcaggttatatgacctgcgaggcaccggcagcattgaacgtgaagagttgaaggaaatggtacttgcaatcctgaatgaatcggacctccttctttctgatgatgccgtcgaacagattgtagatcagacattcaagcaggcagacctgaacagcgacgggaggatagatcccgacgaatggaaggagtttgcaagtaagaatccagccttgctgaagaacatgactctcccatacctaaaggacataaccatgtcattccccagctttgttgtctactctggagccggcgacgaagagttgtagcagtagcagccatcggcacaagcatctgtgactctgacctctcaagtctcaggcatacaacatcatgttcacagtacaaatttttggattatgaaacaccgctttgtagcggaaactgcaatagcagaat

SEQ ID NO: 11781 - DNA, 780 bp, Triticum aestivum
  Clone ID: PAT_TA_11781
ggggaacggccccccccttgaggcccagcgtcgcagaaagctttgcagcggataccgccgcctgaccaggtgccgggagcaactgcccagaaggcgcgggcggaagccaaggcggctcgcatcccagctgaagggatcaacattgttgacgaccaagatggtccgacgcatgaccaaggtgcaaccgtggttgttgttgttatggatgccgatgcgtctgggaatattcatgtggcgcaacgcaagacaaggcggtcgggcatgtggcattacagggatccttttggtgacgagcaaggcccgttctctctagagctgttggatggttggaacaaacaaggctacttcgacgacgacttcagggtctggagagccggtcagtctagcgactctgccattttgctcaaggatgctctgcgcctgaagcgctgagaaggatggcagctacttggggttcccatgctagcaagttaatagtgaaagagggggcttctcctgtaatatattcctgcccagattctcctactttgttcctaatattatggtgggaggaccagtcagagacttatacattacctggtcctacgaaactttggcctctgctgtgaattgtgggatggacataagttggtttcagaggtttatgcaagtttatgtctaaccatgttcagttaaaaaaaaaaagaatgctgctggtgataaactgggagcaagtgtccagaagcagggggctgaagccaatgcagctggcatcccagctgaagtaatcaacattgatga

SEQ ID NO: 11782 - DNA, 1237 bp, Triticum aestivum
  Clone ID: PAT_TA_11782
ggcacgagcgccaagctcaccttccctatctcgctcaagcagcctggcccaaaggatggcactctcaaatgtttcataagaagaaaccggactactcagacgtattatctgtatattggactcacagaagcactggctgatgatgggaagttcttgcttgctgcacgcaaatgcagaaagcctacatacacagactacctaatttatcttgatatgggtgatatgtcaaagggaagcagcacctatattggcaagctaaggtcgaactttctgggaacaaagtttaccgtctatgatgctcatccaccgtatgatggagctatcgtctcaaaaagccggtctgctcgtgtgattggtttgaaccaggtctccccaagagttcctgctggcaattatccagtttcacacatttcttatgagttgaatgttttgggctccagaggtccaagaaggatgaactgtgttatgagttctatccctgcatcagcagttgaagagggaggcaaagctccaacacaaactgaatttcctcttggtaacctcgactccttcccgtcgattccattcttcagatcaaaatccgctcggatagacagtgcacccgctcaggctcaggacgaagagaagctggtgctgaagaacaagtctcctcggtggcatgagcagctgcaatgttggtgcctcaatttccgtgggcgggtgacggttgcgtcagtgaagaactttcagctggtggcttcagatgagaatggagcagccggccaggagcatgacatggtgattctgcagtttgggaaagattaggcaaagacttgttcaacatggactaaccgctacccgatatcagcatttcaatcatttgcaatatgtccgagcagttttggtaccaaaattgcttgtgaatgagacaaggtgctggggaaaatcttggcagctggaaggggggaggaaaactgaagcaaagtattgggtggaccgtcgcctgaagtttgtccagtggtgtatataaaaatatagctatctctctatctagtttatttttccaaaatttagagtctgtatatctatccccacttcccagtgatgcagaattgtttgtgtggcattgccaaacctgatgagtttatttgtgtactccatccacaggaaggagcaacgttgcaactccgcagctccggggggtgggatacccgtcggtgttttcccaaaaaaaaaaaaaaaaaaaaaaaaaaaaaaa

SEQ ID NO: 11783 - DNA, 784 bp, Triticum aestivum
  Clone ID: PAT_TA_11783
cgtccggagaactccagcagcaccggggcgtcgatagcattgcacacggtacagccagaactacctgtatttgtaccgtcggagctacctgtatttgtaccgtcagaagcaagtcacctgaacggagtggctgctgctgaactgcggcggccatcctcctctggctctccatcggaacgacgcctctcatgtgtcgctccttcgcctacacaccctttattggaagacggcaaagcattggaagcttccaggtcgacccagatcgacattgccatatcccagccagaggaagcttggcatccaagtcaaggtggtaacaagctagagcgagcagtctcctgctgaccatgcatgagtcctctagcttaaatctcacaacagagtggcagcacacccgtcgtcattcccccggggctgacttcccgaacagtgggtgtgatgcaggctggcaatgtttgttctgcgccggttgcaagttgctcgtgttttcttagagcacctgctgactgacaatgaaaaggattctgacccaaacagggtcgtttaacataaggattgatgggcttgagcttgtggcattggacgccgccaagcgttaactggaaatggagtcaagtatctgaagaatttgtatttgttatttatcacatcatgttaagttgatgcttgcagacctgcagtcatatggtatgagctgcggtgcagtgtgataccgcaacgaataattgccgcttattcttaatcggatgggaaggaagtggtctttcaaaaaaaaaaaaaaaaa

SEQ ID NO: 11784 - DNA, 676 bp, Triticum aestivum
  Clone ID: PAT_TA_11784
taccggtccggaatgcccccgcccgcccacgcgcccgcccgcgcggccggaccgggtgatgctgacaacggatactgatcttgctggcgccgtgctccatgccaaatcatccggtttgaaggttctcaagttgcatatcgtggacgagtctaatccaaacacagaggtggtaaaaccattacaggagctagcacctcgcagcaggaatggtgtgtcttctgttaaaattgggctcatggctggtgctgttgctctcagtggcgcggcagtcatggtgtacttgaaacgatccagggtgtgattatcagatgaatcaatactttcctaaacccgcctctcaacagctgacatccatccactttagaatctattgttatcttggtatcattgcatactaagaaaagaaagaatgaggcacatgaggtcacatgtttccagtctgtcaggtaattgaaaggtcgaacagcaggcggtaggagctgcctaatatttgtccctccacattttgcacaaacatcagtgatttcatggctacaacgaaacgtataaacataagcgtttatgctagttcatacttttgcactttttttgtagataaacagaggatgtaaaatgattttggagcataacattaagtggattattctctgccagtgtcctacaaaaatcaaatgta

SEQ ID NO: 11785 - DNA, 695 bp, Triticum aestivum
  Clone ID: PAT_TA_11785
ccacgcgtccgcagcaatagtcagctgctgctcaataacatgcgctggaatgtacagtcccatgcctttaggcactaagagaagcgcattgacgaagtttaaagaggatccaacatgcatggctttactgatggatggcactgcagcactgggccttgatttgagttttgtgaatcatgtttttctgatggaacccatatgggacaggagtatggaggaacaagttattagtcgcgcgcatagaatgggtgcaacccgtccaataaatgttgagaccctggctatgcgcggtaccatcgaggagcaaatgctccaacttctgcaggactctagcgcctgcagaaatatggttaataaaggtgcaggcggcaccgagaacgaaggggctcggcctcaccgcagcctgcacgatttcgccgagagtagttatctggcgaaactcaccttcgtgaaaggatctaacacggcatgcatggatgcctagtatgaattgagctgtcaccataagttctttgtctgtttcttttgttttgagattatagcgaggcccttcaagtcattcttttgcagcagaaataaacagaactctgacggtggaatctatgtgccttcccttttaagcaactgcgagttgctcttgcttttcccgtccgactgcagtcttacgatataattttgatttcttaaaaaaaaaa

SEQ ID NO: 11786 - DNA, 867 bp, Triticum aestivum
  unsure (1)..(867): unsure at all n locations
  Clone ID: PAT_TA_11786
attagtgttaccaaaagtcggcatgcggcacgtggggtgctagaaaatggtcaatggaggagtagttaacacctgggcatgcattaactttgcttgggaagtcacagatgctcatgctctgaatttttgtgatgagttggtgctgatgtgcaatgtatccgggatggacttcaggcctgaacctgtgctccctgtagcagcttatgaccctaaatccgtagcacggtcactcanagaaacaccataaacgtgtcatgaacatacttggaccacggcgccaaaaactcgacctgctgattctaatattgcctgacaataatggcactctttatggtgacatcaaaagaatattggagacagatattggagtggtctctcaatgttgtcttgcaaaacatgtttttatgccaaaaaaacagtattttgcgaatgttgcccttaaaattaatgttaaggccggagggagaaatacggtacttgttagtgctttggagaggaaactcccccgtattggtaaaataccgactatcatatttggcgctgatgttagtcatccacatcctggagaaggatgttctagtccttccattgcagctgttgttgcttctcaagactggcctgagattaccaagtatgctggattagtcagtccacaaacccatcgggaagaagtcataaataacctttttaatgaagaaactggtggaatgatcaaagagcacctcatttctttcaggagggcaactggatgcatacctgggagaatcatattttacagggatggtgtcagcaatggacagcttaatcaggttttggatgttgaacttcctgccataaaaaaggcctgtgcatccctggacccttgct

SEQ ID NO: 11787 - DNA, 629 bp, Triticum aestivum
  unsure (1)..(629): unsure at all n locations
  Clone ID: PAT_TA_11787
ggtcgagttcctctcgatgaagctctcggcggtcagccccgagctgaactgcgatctcgatctccaagacatcctttgcccgcaggacgcccgctccacgtttccgggatacggccagcgattgggcaacgttcatcccaacaacaatatgtacagggcgtcgcagccgggcctctcgcgtccagaactatacgggaacgggatcatcatcccaaaccacccagcaagtgttcatatggcgaggacggctcagcagctgtctgcgtttccccataggagcatcgtctgggacgaggaacttggcaatgttggtccgtctgctttcccgtcggacgtcgtcggcgccagcagcttggagaactccgagtcgatgaaggtggagtagctaggcaggctgcagctgacggttaaccatgtgcaaaggctgcacagatctcctcgggctttagcgagtttaactgctgtcgttgagaggacgattctctatgtgtgtgtgtgcgtgtgtgacttttgtacagtttgactaagcagacggatgaaaagcttgtggtccgctgtgatgtgcctgccggactagaattattagtggtaataatgattgggtttgatgagttgatctaannaaaaaa

SEQ ID NO: 11788 - DNA, 832 bp, Triticum aestivum
  Clone ID: PAT_TA_11788
ttgcaacatctgagacctgggatggttttattgaaaagcttcttaaagccggatgatcaggttgaaattatcaagctttgtcgggaacttggtgttggcacaggaggattttatcaacctgcctacagagatggtggtaagctaagtctgcggatgatgtgcttagggaagaactgggatccagattcaagatcatatggagatatacgaccctatgatggggctcaaccaccacagatgccacaagaattgactaagtttgttgaagaagccattaaagcttcccatgatttcttgaaacaaagaggcaagggagctaccgatcccgctgtagaacttcctctgatgtcacctgacatctgcattgtgaacttctacaccactggcgggaagttaggtcttcatcaggacaaagatgaagataaatctagccttgacaagggactgcctgttgtttccttttcattgggtgacactgcagaattcttgtatggcgatgacagagatgttgataaggcttcaaagattaaacttgaatctggtgatgttctgatatttggtggtcaatcaaggcgcatattccatggggtctccagcattgcgccgaaaagtgcaccactctgggtgaccgacaaggcaaatcttcgacccgggcgtctgaacctcacattcaggcagcataagtatgagccctagggggctagggcaggctgcattcagcacctccctttaggcatagtgcaagcagagggtagggctctcatgttctatttatgtgccctgttagaaaatgtttgcaagaacacctatctatttaaaaccttattatgtg

SEQ ID NO: 11789 - DNA, 1072 bp, Triticum aestivum
  Clone ID: PAT_TA_11789
ccgctcgctcgtctcccccctctctctctaaagaaaataaaaaaaaaagctgggtctcgccgtcgtcgtcggtaggtcgcccaatccggagagtcggtcaggtgaggtgaggtggtgatggcgtccagcctcgccgccccttcttcggccccggccccggcgtgctgctcgctccagctccacctcctccgccgccccgccctagtcctctttccctcctactcacgcgcacgcccccacctccgcctcagagcccaaccctcccccgagcccgaagccggcgactccttcgccggctggtcggacaagcaggaagacaataaggatgctgctgctgattctgattctgattcaggaggaggagcattgggagggcttgttggacctgcccttgctggcctcctcttcctcgccggaatcacattcgccgcaatctccatcagaggatcaaaggcacccttgcccacacacactgagacgacggccgatactactcctgaccaacaacaacaagacgacaatgacgctgctgctgctcaggctctgtcaccagccgatgataccctggatgccactagtgatgcaacgccattgcctaataatctacaaacagacgacaaaatacccgaggaagcagctcaacatgacgacatggacaaccaccaattggatctggatcgcggcagcagtcacctagatccgaccaccgataaatacattgcttcacaagatgacactcctgtgactgattcacctcaatctttggtccctgcttatgatccaacctctgaggacgcattattattattggactctgaacccactttgccagaaaaccaggatactactttcacttcagatattatggtgctggagtccggtgatgttgtgcaaatatctgacgctgtggctgaggttaaacatttacaagatacagagcggaatcctcaactttcttctactcaagatggaatttcttctgcatccacttttcctgattatgtggcatatggaagcactgaccggatgcttccatcgggctcgaatgacttacccactcaagacgctgacc

SEQ ID NO: 11790 - DNA, 426 bp, Triticum aestivum
  Clone ID: PAT_TA_11790
cgtccgtgaacattaaaataatggcttttcttgtaagaagttcaaagattgtcgtggagcaaggtcaagagattagtttggtgaaaataatgtgatcttttggtcaggattttggatgatccatagccatcagacaagcagttcaaggcctactacgcaagtcatccatcgtcttctacgcatgagcttcttgtctctacacatctagcaccggagtatcccctccccttgccgtacacacatgcccgcggtcgagctagtgttgtttgtgattgctggtcgtgactattacgttgtcattggacaaataatttgttctgtaactctgtattgatgggaccttcagattatatggtctgtagaatttgtctgacactgtactccacatatatgtagcatagaattttttctcagtattttaatctg

SEQ ID NO: 11791 - DNA, 825 bp, Triticum aestivum
  Clone ID: PAT_TA_11791
ttctgtttcgacccacgcgttctactacatgcttctattatgagtcttagaaccagttagtgctattactggtgtacgccaagatcagggagggtcccatgctcgagcatccactggctcctaccttcacccgttaccgcacgaggggaattcgcaacaagcacacgtggaccccggctggcttctctgtcccgagtgtcgctgccggcctccctgcagcatggcttcggttccctcctacggatgcgtctgcgccaaccatctgatgcatcaaaaagcccgattcacaaattcatcttctatatgcttttcagttcatcgacttcccattgtttggcatcaaaattcacatcagtttaggggtgcccgcatcacggtctcactgtgctaccgcaatctctccttgatacgccaccggacgagcccctcctcacactttggcaagttgtcacttcttgctcctgtgcctggatcccatgtgagcgctgatggtagtcctctgtgaggtttgaagattatcgtggagcaagttcaagagatcagtttcgtgaaaataaatgtgatcttttggtcaggattttgcatgatccatagccatcggtggcaacagggagtagttcgaggcctcctgcgtgagtcgtccatcgtcttctatgcgtgagcttgttgcctctacacacctagcattggagtatctcctccccttgccgcacacacatgccgggcggtcgtgctagtgtgtcattggacatatattttgttttgtaactctatactgatgggaccttcaatatatagggtgtttagaattggttgcccgcgcaa

SEQ ID NO: 11792 - DNA, 1027 bp, Triticum aestivum
  unsure (1)..(1027): unsure at all n locations
  Clone ID: PAT_TA_11792
ttcggcacgaggcaaanaaggcgcggaaccagnacggctcgggagcgaattccggcatcagctcacagtttgcgttccggaccagtgtccggaacaaggactccctcctggcagagcttgccaccgactccagatacgtctatcaggaaaacgatgatctcatggggagccctctcgtgctgtcgaaggtgatgtacgtggcgaacgtcggcggcgacatgtctgttgctgcggtgcccgtaggggcaaggtgtgatgatttttcgaccgatccaagcatccaggaggggcaatgggttcccagctcccattcctcgctgaggccgcctctgctgctcaagcgtcacaggcgcgccgctggcctgatactgaggtcgcagaatttcgcagcatctctcgccgagttgatctcaacagccgcgaaaagcaatggtgaagccagcagcagtgtcttcaccggattcgggcagatttcgtgcaagatgtgtgacgacatcaagctgaccatgtctacggcttggcacggaccgtctgcgatacctcggaagagcaaaccgaccgccggagggtgcgtcgacttcgagctgaagttcgacgaggactcgagatttggggcctgggtcgaggtgaagaggtcgaacccgaggcagctgaagtgggcggtcacgctgtcggacacgccggagaacgatctaggctggggcgtgagcctgcagcgaggctccgagggggcgccggagcggatgcagctggaagggtttctgaacttgcatctaggccagaatgctaccctgcagcctggtgtcatgttcaacctggacgggaggcgatgcgccccggcgctcgtgttccggtcgagttggttcctgtgaggcctgagtgagtggttttggtgtcacccctcctgaggatgtagagaagccatggtagatcagagaaagtagaaacaatcatttgtgaagtctgaaagaatgacagtaattatcactttgtatgatgctatgataggttttgctatcattaccat

SEQ ID NO: 11793 - DNA, 803 bp, Triticum aestivum
  unsure (1)..(803): unsure at all n locations
  Clone ID: PAT_TA_11793
attcggcacgaggctcccgcgtcctgcctcacctctctctctctctctctccctccaaaccctaacccgccgctgtccaggtccagccccacgccgccgtcgtcttctttgcccagccggccgctgccgcaccgcatgctcgtgtgcaggggcgagaaggggaaccaccgcccgcctccggagcgcgagaggtgaggcagcgcccggatccacggcggcatcgacgcgccgtcgtcgacctgagccgccatggtctcaccctgctgtgctccttcccctccacggctcctagctcgggcaacaacaagccatctcaagagagtggattctcaagtcaccccatctcaaggggcaaggtggcgtcggttgaggtcccatcaaattcggtcactacgccgaatctgctgcagtggtcgtcgatctgctgttatggtcgttgatttacagattcgtccagtgttgttggtgcctcctttaatctgacccggttgcgtcttcattcatggatttgcagattaatccctcttctcctcctccttttcggtactcttctgttagagtgctaggcatacagcggcatggccaagggctcttttaggcctgaccatgtgtttggccggcaagggccttttgttgtttgtcttgcctctggttcaggccgaaggtgcccttgctggttcttcgtgcggtatagatttatgtcttttcttctttgtanggtcctggtagggcctgtaattgctgctcctttgttggggagtgttggggttttgcagctttcggtcnagctaggttccaaggaa

SEQ ID NO: 11794 - DNA, 611 bp, Triticum aestivum
  Clone ID: PAT_TA_11794
gcttgaatcttcatcaccatcactcactcactcgtcgatattataaatatatatcgagaaaaaccatggtcgttcgtacaaaactgtttgtatgtatgtacagagtaacagaatctcagacaccatgaggaactgtcaacctaccacgaatatgtatgtacattttttttgggtctgctgctgctgctgctgcttgctgtcgacgcctcgccacggcgtcttattgtccgagtctagcactcgtataaaaaataactccacgcacccagcccacgctggatcatgataatgatgatcggctgctgctcttgttaaacccggggggatcatcattattcagtcgtcggtcagaagaaattgacctgccggatgggcgccggcgccagcgaccgcttctccatgaggttaggctgcagagggaacagcccgaacggagaagagcccgggaatcctcctcctcctcctccggcagctggcagcgtggcggcttggctgagtaaagcaagaaacaatggaggcaatgatgagtggagtggccatggaatctggtcagttcctagtacgcatttgtggatttagatatgtgagctgcttacctgtcaaaaaaaaaa

SEQ ID NO: 11795 - DNA, 695 bp, Triticum aestivum
  Clone ID: PAT_TA_11795
acggggcgcatggtcgggtgaggggtagcgcccttcccgacggcggaggacgagaaggtggccgccgtgcttgccgcggccgccgatgcgtagaggaggggcggtcagcgcagaagcccagctccaagaatgaagagatcccctcctcacctcgtccccgtcctcttccctacccagcggacagccggaggaggaggatatgccgtctctctccttcccgtacatcgaaggcagatcttgagtggattatgtcctttaactcagatttgctcattgctgtcggtggatacttgctctgagggtgtgatctgcatcatcgtcatgtattgtgtcggtcataaggattgtggttgtggcagtgcttcagcgctaagggcatgtttccatcagaatgttggagcagctggctcagccaacatggtgagggtgtctcccaagacctctggatgggattggcattccacaaattgttcaataccttatctactttgcaacaatgggatgatgagctgatttctcgtctagcgtaaagagagagaatgatatatccgatgttcttaattactagagtcagggtcctgctcaaatcgtggtccttctgttctatgtaattttattttcttgatgatgtgatgttctgccattcattctatgttatgcctgatgcgtgtgtcttaagcctaccaataactttt

SEQ ID NO: 11796 - DNA, 559 bp, Triticum aestivum
  Clone ID: PAT_TA_11796
gggaaaggatgcagatcctgtgcctagccgggtactaaaacaaactcgaattgacgtgatattcaaaaaggagacggagacaagatcaaagcttagcaaagcctgggcaaaatggtttcggagcaatggtgttcctgcatttaaagcagactgcccacacttccgtagtgccttgaagctaacacagcagctaggtacccgcctcgttgctcctacaggcaacgaaatagacggtgcaaatctggacgccagtgatgaagaacttccataagtatgtaaggcgaactgcttgaggatatgggagggctaactactttacatcatgtttggacaaaaggcttgtgactttgaaccgatgatccatgcttttgtttctgtaagttgggtgtagggctagttgagtagtgcctcatgaagtgtaccgagtccttttgacccttgttcctcacgaagatgtgacctcgtttctgttattttctttgctaagttgactagatttgtaataatatccttgtccattatgctatgagtgtcctctcctcttcctctaaaaaaaaaa

SEQ ID NO: 11797 - DNA, 1106 bp, Triticum aestivum
  Clone ID: PAT_TA_11797
aagaggtgcttcttttttggtgatgttgctgcacacaagaacccaaaacttctcttgagctacatttttgggctttatgattattttcttaaagaactctatcacttcaatgaggctgataaccctcacaaatcagctataccgattgttatcaacacttcagggtgggtgaaaggtattggacttcatgttctgtcagagatattgagatacgtatccccaactgacgttattcggctaaacaccacagcagagggtaaaaacttaccaggaggtgcattttggctggatgcacacgagggaaattcacaagttaatcttgttgaaattcgcgcagtgcagaactctcctcggcatctgttagtgaagaaagaggcgcgaattattcgtgatctcaggctgattgcttacttcaggcagtgcttgccgagggacttcccaattttctcttctgaagatttagttcaaggaattgctgctatagacccttttcagctccctctttcaaaaatacaggttattgatctacacagccagatttccggtgattcggtatatgacttcttggccggtactatcgtcggtattggatcaagttcatctgtccctttgtcaactgaatgctcctctccttggtgcatgggacttggttttatcaaggccattgatattccaggagactgcattcatctgataacacctgtttctcatcagcttttagaaaatgttgacatcatttttccaagttgtattgcagtgcctgacggcctctttcaggtgccagacacagtggatgatataactgccaggctgagagatctgtagagatctgcagatgtctacaaacaattacgaccgtccagtataggcaacttcacagctctcagttgccatgaacaaccaacctactatgaaaaaccatcactatacctttgacatgtacggaatgagaacttcatagcagtgtcatttctgccaaactggccttaaacaacctgattaggttacacaaattgatggctagggcaaagacatgtactgtattttaagctcgccccgtttctgaacttgtaatttcgtttcagtatgtacaatatagtgccgta

SEQ ID NO: 11798 - DNA, 1057 bp, Triticum aestivum
  Clone ID: PAT_TA_11798
attcggcacgagggaaggtcaaaaaatggcggcggcgagcagtatgggggatggttctggcctgcctcgcctgcccgacaacggactcgagtttctgccggatccagttgacagggaggtggccgcggacgtggagcagccagatccgtcggtgatgaggggcgtcgtgccgtcggacacgaccgaagcccactcctcatgcgcggttgtggttggacacctcgacggcgctgctgagcgccggaattccggtggagtcgacaacccagtccgtggaatcgaccgggaaggtgaaccccagaggcgtcgatgtggaccagaaggtttagagttggccgtgcacatctggatagagcagttttccctggtagagtcactccgccggaagaaacgatcagagggaagcccgagcagtaacaaccagtattgccgacgcgaagtgccctgcaatgatccgatttcttagagttgcggacaatggattatgtcggcgaaggaaataatcatggaggcatcatcgctggctgaatcaagggatgggctaggctttgagggcaggcaagctgctgactcaaatcgcaataacattggattggcgggtgcaatcatcaacggcgagggagaaatgtttgacaatgagaacagcgtgaccctttctggcaattgggatgcattcgctggattgtcggcttcgagcaagaaacatggtgccgggtgacctgctcaagcagagaaaaggtgccatacaaggggtcgatcaagtggacgaggttctgcagtatctccaaactaacaggtcataagaagactacctgcccagtgatgtgccaaagcagccttgcaagcctgcaacctccaagaattgtagcattgtaggccgctgtcgcacctcgtgcaccaggtcgctggcgccaatgtatcttaaagacttcggacaagcatgttttcgaggattttctagtacgtgatttattgtttgacaccatgctttgttcctcttgagtgtaaactagttgtatttcaaacgatgttgagccattttcatgtggtagttggt

SEQ ID NO: 11799 - DNA, 1140 bp, Triticum aestivum
  Clone ID: PAT_TA_11799
gtcgcctcgtcgggcacgcggtggcggggcatggatgggccggcgattgtgacgctgctggggatccggcgccaacaggccgcgtcgcggctcgacgttcctgatggctgcccacggcacacaggctcgccacgcccccgtcgggctcctagactgccacaacgtcgggaatggccccgcctccgtcaactgctgtaatttggacaggagcaagtgcgcggtgagatgcacagggatgcctgcatcggcatggctagcaggaggccatgctcaggagggaccagaggtctgcgccacgacgctgaatcttcaccaaggatttcggaggcgatgcagcagtggtgaaggcgatggttgtgccgggtgcaggcaggtgcagacgggtacattccttgacagtcaatttctttcctcccagccgactatcatgcagtccctcgggcggggactgatgtacttgccttttccttcttcgcctgtttctgtttaaactgcccctgtttctgttgatgaggccctggtaccgtcacctggcgcggccgcggcgaggccgcgggggtcaagccgttcggtgtggagggggcaggcaggtaaaaccagtgtggagtgtgctccggtccttggacaaatgattgtgattttgtagctgcagtggtgctattctttattattccttgacttgtatgcttctgcgctcactatgcctgcaaacagaagcacacgattttggatgtcctgaagcgcataccattttggatgtcctgaggcgcatacacacggttttgtttgacttgggtgttgaaactgcccttttgtcataacattgatacagtgtgatgcctatgggaagaagtggtgctttgagagaataggttactgaagtgcagtcacgtgcattggctttctcatgtgggttgggcctcatacttttctgtgaaagcaatcacattaggagtaaactgttcatgcgatggctgtatgagatgtgatgcctgtatgagatgcgatgatgtatgagatgcgatggctgtatcaaataatacctatatctcgtcggcgtctcctcgccaggatcagccccggatcctggacgtgttcagcgccggatcctgtacctgtccgatggagggcggcaagtga

SEQ ID NO: 11800 - DNA, 567 bp, Triticum aestivum
  unsure (1)..(567): unsure at all n locations
  Clone ID: PAT_TA_11800
gcccgcctttcctccctcgctctctccccaatccctctcgaatccccacccaatctcggtcgtttgtgaggattccttccgcatgcagggatggtgtggactttcggcgctggacaaggaaacggcggccgcctaggcggtggaaccgctggtttcggcgccggcgctggcccgttcgccggcaacttcggcagcggcagggataatgccggccagatcgtgtttggtgacgggagcggattcggtggccgtggcggtggcggtggccccaggttcagccagcaagccggctcccctgctcacctggcggccgcactttcttctggtatcgtggccggcggcggatctcaaggcggacaaattactgtcgagaaggtcccgggctttcgtatgcgcgttgattcagatgatgatgaaatgtccgaccacgattggccagcctcttggtttcgggtggtagagcggcccatcaagaagcaaaaacatgaagaaaaaccatctctcttcagctttcagaagcagcgggattgcccggactcttggtccaaacttccctcanaaaaaaaa

SEQ ID NO: 11801 - DNA, 1090 bp, Triticum aestivum
  unsure (1)..(1090): unsure at all n locations
  Clone ID: PAT_TA_11801
cgcaccgcgcagcagcagcagcagcagcgctcgnanaatctcatcggcggagaaggagcgaccgataatggtgatggcggcggcggaggggcggcggggggacgcggaggcggagctgaacctgccgccggggttccagttccacccgacggacgaggagctggtggcggactacctctgcgcgcgcgcggccgggcgcgcgccgccggtgcccatcatcgccgagctcgacctctaccggttcgacccgtgggagctcccggagcgggcgctcttcggggcgcgggagtggtacttcttcacgccgcgggaccgcaagtaccccaacggctcccgccccagccgggccgccgggggcggctactggaaggccaccggcgccgacaggcccgtggcgcgcgcgggcaggaccctcgggatcaagaaggcgctcgtcttctaccacggcaggccggcggcgggggtcaagacggactggatcatgcacgagtaccgcctcgccggcgccgccgccaagagggacggcgcctcgctcaggctcgacgactgggtgctctgccgcctctacaacaagaagaaccagtgggagaagatgcagcggcagcggcaggaggaggaggaggcggcggccaaggctgcggcgtcacagtcgacctcgtggggtgagacgcggacgccggagtccgatgtcgacaacggtccgttcccggagctggactcgctgccggagttccagggaatggggacgacaaacgcggcgatactgccaaaggaggaggtgcgggagctgggcaacgacgactggctcatggggatcagcctggacgatcttcagggccccggctccctgatgctgccctgggacgactcctacgccgcctcgttcctgtcgccggtggccgcgatgaagatggagcaggacgtcagcccattcttcttctgagccatcaactctctcacagtagcattgttgtctgcggcgtaactgtagtctgtagatagttcacatttgctcaggatttagttttattctggatttatttgtattatatattgctttttaatgatacattgccagccggtactgaat

SEQ ID NO: 11802 - DNA, 1117 bp, Triticum aestivum
  Clone ID: PAT_TA_11802
actcgaggccggccaacacagtccaccacgcaactgccaacacagtccaccacgcacgtgcagcagcagcagcgcccgagaatcccattcccatcgacggagaagaagaagtgaagaaacaatggtgatggcagcggcggagcggcgggacgcggaggcggagctgaacctgccgccggggttccggttccacccgacggacgaggagctggtggcggactacctctgcgcgcgcgcggccggccgcgcgccgccggtgcccatcatcgccgagctcgacctctaccggttcgacccgtgggagctcccggagcgggcgctcttcggggcgcgggagtggtacttcttcacgccgcgggaccgcaagtaccccaacggctcccgccccaaccgggccgccgggggcggctactggaagggcaccggcgccgacaggcccgtggcgcgcgcgggcaggaccgtcgggatcaagaaggcgctcgtcttctaccacggcaggccgtcggcgggggtcaagacggactggatcatgcacgagtaccgcctcgccggcgccgacggacgcgccgccaagaacggcggcacgctcaggcttgacgagtgggtgctctgccgcctatagaacgagaaggcggcgaaggcagaggcggcagcgtcagcggcatggggagaagccggcgcgccgggctgcgacgtcgccgtcgatacgttcctagagctggactcgctgccggcgttccagacgacaaacgcgatactcaaagctggactcgctgcgggagttgcagacggcaaccgcgtaatggggatcagcctcgacgacctgcagggccccggctccctgatgctgccctgggaggactcctatgccgcctcgttcctgtcccccgtggccacgatgaagatggagcaggacgtcagcccattcttcttctgacctctcaatagtcaatactctcacggccgcactgttatgtgcgcgcggcgtaactgtagatagttcacatttgttcaggatttatttgtaatgttgctttttttttgtgatatacattgccaaccggtattgttcatgttcggtcaggatttagagaaaaaaaaaaaaaaaaaaaaaaaa

SEQ ID NO: 11803 - DNA, 958 bp, Triticum aestivum
  Clone ID: PAT_TA_11803
gggtctgccgacttggcaaactcgatgcacaccgtgaagattttggctcttaggtgttgtggatatgaattgccgtggagttcttagtattcttaggaggttcccctgtctcgagaagctctatatcatttttcacaaacactacgagacggatgcgaaaatcgagcctcagtatgaccgactatatccagttgaatgccttcaagcccgtccccctgtctcggggtgcgctacatctgtgggccctgacactccgcgtgggttgcccaagtcctgcctctggatggccgacgtccttatccatttggatgccgtcggacccttcgctgcccggggctgtgtgaaacattcgtgggccatgataaacagcttgagtttgccaagttctttgttttgaatgcaaaggcgctaaaagaaattgaatttgaaggaatatatggtgccaaaaacgatgtatcgctggcttaccaacacacgctgctacgagtggaaaacagagcttctcgagatgcccaatttgaattcaggagcagatatcgcaatactgcgattcatctcctcaggcatatccatgatttgtcagtggccgaccccttcctcctgttatagacccggttgatgcctgaagatcgcgctgttcttagtgtcttgtgctcgttttgcaggcgatgttgatgtcaaatgattgcactgtcttccgcatagacctgctcttttttctagtctaaggttcctctgtaattccagtaccttatgaagttgcccctgttaaagctgcaagagatgcttttagatgcaaaaagaatgcactgtggaaaatttctgatggggagggatgcaaaaaatatgactttggatttgtacctggagacagctggtaagcacaattgtttatggctttgttctgcctaagctgtgctaggaacacatccctgtgtcggaaaaaaaaaaaaaaaaa

SEQ ID NO: 11804 - DNA, 901 bp, Triticum aestivum
  Clone ID: PAT_TA_11804
gcgcgccgtcacccgggccggcccccggcgttcgcggcgtgccgggaggaggccaggggcgaggaggagctgccttgcgccagccacgtaggggaggtgtttgtggatatcgataagagagggctggaggctgaggaaccgcgtatagctagcggctgtgacaaagagatggctctaagcacagcaaacagcatcttctctacgctgaaccgctatagcaaactaactggtttggtggtttgtgagaggagatgtgattctgttggtatcccagcactcagctcttccttaaatctctccctcggtagaatcaaacagagctttgtattaactgaccgccatttgcctgacatgccgatagtctatgctagtgatgcctttctatcattaacaggttactcaagagaagaaatattgggctgtaactgcagattcttaaacggtccaggtactagtgcggaggttttagaggagataaatcggcatatctgtcgtgaggaggcttgcacagtgcatttgcttaattacaggaaagacggaagtacattccgtgatctgctacatgtgtctcccatccgaaattcatcgggcaaggttgcgtttcatgtgtgggttcaccttgacgagagcgcgaagcatgattttagtgggttgacccctgaggtatggcagctcggtgctgttggtgctgtaagagttgcagttagaagcctgtctgcgtcaggtagcctgttgagaccgtcccaatagcgttttcaggtttctttctgattttgtgttacgttgacttgccaacgtttgtatgtaaagtaactgcttagtgaaagagattatagtgcatatgacgggaaaatggctggtaaaaaaaaaaagttgttgtgaattttgtaagtacgcaaaa

SEQ ID NO: 11805 - DNA, 442 bp, Triticum aestivum
  unsure (1)..(442): unsure at all n locations
  Clone ID: PAT_TA_11805
gcacaattccttccatcctagtccaaactattcgcaggatcagaggggcagcgagcaacatcagtctcacagccagagccagagccagagccagagggtaactttccaactgaacgcggtggctgctgcggctgcaaagcgtcctctggtgacagttgatcagttgaacatgggctaactgattgtagatcgctggcaggctcctagtgcttgttcccgccgagcctgcttgctgatgcttgtgtggctgctatgatcgccctttctggccagcgcgctcctgtttcaccatgaaaaatgctgattgttgaggtcttgnaggaaagggagcagccttgcaagtagtgtattctataggtgcacacctcgggttaattaattcctgtccattattgtcgacttatcgattttgtagatctcgtcaaacataactgtcccgttg

SEQ ID NO: 11806 - DNA, 1124 bp, Triticum aestivum
  unsure (1)..(1124): unsure at all n locations
  Clone ID: PAT_TA_11806
aactgtccgggcgctcaagaggaagcccgatgagcccgccgcccgcgcgctcctcgaccgcatcgccaagcatgtccagcccatcatgcgccgccgcaagtggcgcgtcgaagtcctctccgagttctcgccgaagaacccgaggctgctggggctcaacgntcgaccggggtcggaggtgaagctgcggctccggcgcgacggccgggnacctcgacttcatcccctacgaggaggtgctcgacaccatgctccacgagctcgctcacaacgcgcgcgggccccacgatgcgcagttctacaagctctgggacgagctccgcaaggaatgtgaagaacttgttgcaaagggtatcacggggccaggacaagggtttgatggtacaggcaggcgattaggtggattttcaatacatccaccaccaccatctctccgacaagctgcactaactgcagcacagaaacgggcaaggaatggagctctattgccgtccggcccaagaaagttgggtggaaacaatgctatcatgagtgctcttagtccagtacaagctgctgccatggctgctgaaaggaggatgcaggatgacttgtggtgcggatcacataatgattctggcatcgatgattcagaagatgttgttattcttgagcaaccacctaagttgacaacaagggatggaaaaaacacaaagcgtgcaaaaaacacaaggtgtgattcttctagcagttctgcagaacccagcacttcatctggatctcaagttccagcacgagctgattcctcttctggtagaacgactgatgcggactttagttctatgtgggagtgtagtgcttgcactcttcttaatcagcctctcgctcctgcgggtggcggctgcggcactgcgtaaccttgcctcgccagcgccgggtgcccctcttgcccccgtccatgctccactccgggccaccccacgccgctggagtcgcgggcggcttgcgctccctggtcgggcctccgccccgcccgcccttggctcccaattcctctctgggagcactgaatcctgtatgctttggtgacttccgctcgtggttgtcgatttaaagaaacgggtcggtttggttttgtgcaagga

SEQ ID NO: 11807 - DNA, 746 bp, Triticum aestivum
  Clone ID: PAT_TA_11807
tttggtttgaaggaggagaacaagtaccaacgtaccaacttcttgttggattgcatcgtcgagtcgctggactcgaagttctgcgacttcgggaaatgcgggtacaaggctttgttgcgaatgcctctcaccctgagcaaggacgtgctgaagagggagatatccgaagagatcggcagctggagtgagatttcgtcggaccgggccgcggagaaggagctggaccaggtggcggcggcgaggtgcgacgggtgccggaccgaggcgttcgacatcagcatcgccattgaggacgacatactcgaggacctcgtcggcgagttcgccttcgaccaatgctgctgaaagtgtggaagtttactggttgacatggcattggtcacgcatgagtaacactttgcagatatatgtactctatttctcctccgaagatgttgtacagcgtcatgtagtaatatggacgccaccaccccctggttattttcccttttgtgtactactactggctaactgaaacgtgctaaaagtgtatgcactgctcttttttttaaccttcagaggcatttccagctgtttcactgaataatgccaaggacttgcaagcctttatggtacggttgtagttcatcgtatttcctcttcagcaatttttgctggagctcctgtgtacgttgtccaaggccattttgccttttgtgtagcgatgatggaagaaatcaaggtggatgcattaagattttcttttc

SEQ ID NO: 11808 - DNA, 692 bp, Triticum aestivum
  unsure (1)..(692): unsure at all n locations
  Clone ID: PAT_TA_11808
attccaagcatgagaagtatgaagatggcagtgccaggnaagaatggctccaagactagtagaggggaggatgagggttactcatacaagagacacgtagagatcaatgatactccagctaaagagagacacagtaaccccgatagggatagggatagggagactgataaacacagccgacgaaaagacgactcggaagacaaagataagtggccaattgacaatagagacagtgatgacaggaagactctgtccaggtatgatcatgggaaggttaggagctctaaggaacaaaggtttgatgatgagaagtataaacagaagtacaaggatgattatgaaagggataagagacagcaagatgacaagtgtctggatgagcgcatgatccgagatcatggaagtgacagggttgattacaagagcacaaaagatgggcaccgaatttcagagggccattacagaaaagatatagttcaagacggtgatcgttatgatgagtatggcagtaggtacaaggaaaatagaggtagaaaaagacttcctgaggaaaatgatgaccattatgatctgaaaactccaagcgcacgggagcaacgtggaaatttggaaaaatcttcaggcagtgggcgactcgattctctgattgagagagcaaggtctgaacatagacatcaagaaaatgttgattc

SEQ ID NO: 11809 - DNA, 669 bp, Triticum aestivum
  Clone ID: PAT_TA_11809
ttgacgaggacgagactgatcaggcggcagctccgaatcaagaggacgaacaagatcttgcgccaccgacaaaaagagcgatcaggcctgtggcagcaccgactgaagatgagagagcagccaatctagagccgctgaaactcgctgcggctgtcaatctccgggcgatgaacccagagcccatgacccctccattgaagaagaaaccgaccccggtggtaattcacaggacggacccagagccagcaagaacttctccagagaagaaggcttcgccggtaatccgccgacatttccccaagcaagagcctgtggacgatactccccctgaggaggaagagtatgaggagatccagggcaggccgtcagctcttagcacaagcaatcgaagaatgcagaacattgtggatttggtaatgtggagagatgtgtcaaagtctgcatttgtgtttggatttgggaccttttcgctcatctcctgctcctatgccaaagacctaaacttcaacacaataacagcagcttcgtatctaggcctggtctaccttggtctaagattcctttccaagtccttactcaacagaggtgagagtgtggagtgtgatgatgagacgaataatgagaggtcccactacctggtaggtgaggaggatgccgtctggctgctga

SEQ ID NO: 11810 - DNA, 791 bp, Triticum aestivum
  unsure (1)..(791): unsure at all n locations
  Clone ID: PAT_TA_11810
ggtnatatagcctcagtttgccttccatttacgtcatcgtgacactcgtttcgtaacaaggtataaggagtagcggtcatcgtcggctcgaaagctctcggatgtcttaatcgggacgtgaaggaagctcgttaacgtttatttaaaggggctattgttcttctgatccggcgaggtgggactaaatgtacggtttggacgtgacggcgcggtcgctcacaagaacaggtgctacttggatgtccacgggagtctttgtgatcgccttgttggacggattgtggacaaaccggcgaggtgggactaaatggatggattcgggatcaactgccgctcacactctgcctcgcgtgggccggcccatcaccgcgcacaggtggccagctctcggtagcgtcggtttacctctttgtttcccaagttgttggttaacttgaccaggctgccgttaacttgatgtgttgacctttaacctgacccattgacccgagatatccgttgactttttgaaaaacgtttgcacgctcgaaaaagttcatagatttttaaatggttaacgaatttaaagagttcgttgtaaaaaaatcattgatttgtagaaaagttcatgaatttttaaaaatcatcgatttgaagaaaagtactaaatttcagtaagttcatgtattttaaaaaaatgttcacaaatgtgaacaaagttcatccatttcgggaaaaaattcatcaattttaaaaaaagttcatcgaatttgaaagaaagttcaatgtttttgaaaaaactttgtgcattt

SEQ ID NO: 11811 - DNA, 598 bp, Triticum aestivum
  Clone ID: PAT_TA_11811
ctccaccgctctccagcttcccccatcacccagaccagacggctaaaaacaccatggcctcgcaccaccgcggccgcatcccctcccacctcgcccccgccgctgccctcctttttgccttcataatcgcgcttccagcatccggcgatcccctcggacagttgtgcggcaacagtggcaacttcaccgccaacagcacctaccaggccaacatccggcgcctctccgccaccctccccaagaacgcctcctcctcgccgacgctcttcgccaccgacaccttcggaaccctcccggacatcgtctacgcgctcgcgctctgccgcggggacaccagcgccgccaactgcagccaatgcgtcgccacggctttccaagacgctcagcagcgctgcccgtacaaccaaggatgctaccatcttctacgacccctgcgcactccgcttctccaaccagaacttcctgtcctccaccaatggcgacggcaccctcctcctcctcatgaacactcagaacgtgtccgcaccggtgaaggtgttcaacgccgccgtgggcgtcctcctgaacgccaccgccaattacgcggccgcgaattcct

SEQ ID NO: 11812 - DNA, 801 bp, Triticum aestivum
  Clone ID: PAT_TA_11812
gaagtttcccctctcctactccttccctcctttctcgatctagatcggaccccttacaattggtatcagaggtcagcagtagacctggagacggcatacccgcgcccgcgctacaccaccaagcaggcgctcaagacggcggcgatggaggagcagctagcggcgttgctccagtcggtccaagaggggcgcgccgccaacgacgctaagttggaggcgatccagcagtccctggagctttggcgcccggtggttctaaatcttcaaggccaactcgacgaactccgcacacaagtgggcaggatcgcgatccaccccgcgctcgcggatccagcaccgcccacggtggtgcagcaagtgccgccaccgccgtcggccgttgaatcggggcaccacgggccaagtggccacggcgggatcgacaactccgggggtttggtacacggggtggtcaccaccctggcaccgcctccggtcaaggaactatccatgcgggttaaaagcataaatatgggggaggatctctcttcctatagaagcatatcgcgatgacatgctaaagaacgatttgtgctggaggcccgatcccccgtcttcaaggcggatctcaagaacaacacggtcggcgagcaacatgttgacgacatggacatggaggtgctctgtattaatggtcaaacaatttgcttgatggatgcacttcattgtaaattaggtgttatacttatcaaataaaaataaaattccaaatataaattgggaactactgggggtaagggaagactgcagttcatcccctca

SEQ ID NO: 11813 - DNA, 1522 bp, Triticum aestivum
  Clone ID: PAT_TA_11813
ggccagaaattgtggacctaacaattgaggaaggtgagatcaaggcagatgatagtccgcgttgtagtgggcgtgtgcgtgggagacagtcaagtgaagccactcatgaatcaacaccttcatgtgctcctatcgatatcaattcttctgagagcacagggagtatggagaacagagagcacagtaatcaagtgagtgtgcatggcaacggagccatggcctcttcaactgagcagcctgtgggagcacacctggaaatcagctccagtctgcacaatgttgaagttattgagccgagcaaggcgtctgaaatgatttgcattcaggtatccagcagggaacatgctcccgagagtggtgcacccatcagcgctggaaatttaaccaccccggttttcttacctggagtcatccagtcgagcaaggtgtatgaagggatttgcaccaaggaatccagtgtggaaggaccttcgcaacaagcacccttgagtgcacacatgaaggctggaaatttgaccctctctgtttgctttacctggggaacactgtagtaaggtatccagtattgaaggaccttcaaaacatgcacctgagagtgcacacgtgaaagctggaaattcggctccctctctttgcttacctggagaaagtggcagcaaggaaaatgtcgcccatttcccggacatggccggtgtttcctgtatcaggcctgcatttactttgagttatcagcaaagcgtgccaacagatctgctcccagcaaagccaaaatcacaggtcacccctcttactccaaaggatttgatgcctgttcagtttagttctgaccttcctgatcctacctcaattcgttttgagggcatagcctccataacttcaccaaattttggtgatcatgccaacagagtcagcaatactccagggcccaaggatatgagcaaattcccagtatttaatgaacaatctcggagccagcatgatgttctgttccgcaatattgatggatacttgcagcacagacggaatcatcatctggcagttgatatacctgctttttctgatagcactgtaagtggcagtgtgggaatttctcatccggatcagttcacaataaccaaataccagaatggcaggtcgggcagctcaggtctctcaagcacatctgctgggtttctgatgaatgggagcagcaaagaattacgggaaggtcagttgaagccctgttcccacaaggcaagcactgagagttgtgatcaggtgaagcgccctggtgatgtcaagttatttgggaaaattctgagccatcaatcatccttgcaaagttctggctcatcatcgaatgtaactagaagcaagcctcccccgccaacgacagcagcaggattgttgggcagtggaatggatcgcatggtttattcatctaggcccacaaatactgcccactttgggcaggacgagcgagtggtgaggagctacactcacctggatgggagcacagcactgcccgagtcgtctttgttca

SEQ ID NO: 11814 - DNA, 537 bp, Triticum aestivum
  Clone ID: PAT_TA_11814
gaggaggaggaggctgatgaggcctcggcggaggagcagccggaggaccagcggtcgccgcccaagctggcggagggatactacgagatcgagaccatccgccgccgccgccgccgccagaaccagatacagtacctcgtcaaatggcgtgggtggccggagagcgccaacacatgggagcctgaagaaaacctcaaggcctgctctgattttgttgaagcctttgagaagcggcagcaaccaaggtcctatggcaagcgcaagcgcaagcgcaagatctccactactcccgtggtaagtcccaacccttcttctcagggtagaaggggccgcccacggcgttcagatcctcggtctctgtcccaacgtcctgtcccagagcgcaagatattgcctcccagagcaagcagcaggagaggtactgataacaccaacaggaacttggttgcgggctctgatgcatcagtgaacgtggctcctcagcaaatgcttggacaaggtgctacacaggagggcagctcaaatgtgctttcggtt

SEQ ID NO: 11815 - DNA, 1149 bp, Triticum aestivum
  unsure (1)..(1149): unsure at all n locations
  Clone ID: PAT_TA_11815
gnctacttncctncttncacggnatcgcttcctcccgttccgtgtgggtgcttacgccattcgttatctgcctcaagcttgcagctagcaccgaggcaaaacttcgcagcccgggtaataaatcatctctgtatacgtacaattgtgtttactcgttccttgttcttggatttacctttgccatagaattgtgaccgatttatgcttggattggaaacatttctggccccttctgccggccatttacttgagctcctatcccatcgcttcattcaacgctgttcccagagtagcaaagaaagaaataacttttctatagctgcctggtaggattaataaaaatggttttatgtgatgttctgtaaatctgaaagtatttgagaagatgttcgtaactattcatttatctgtttttattcttcctctcaacatgactaagtttgattttgaggctcgtacatgtgatttacaccagataaattcggttaaaaaaaagagtactatgctatgcttgaggttcttctttctgtctgctctgggtgcgtctgctacagccccaatggcctgcctgattctttgtcttggtgcttcccactgcgcttgtgtcgggcgatgcgattgcgagctgcacctgtccgacgaatttctcgcaaggccacccatttactgcaccgagcaaatgctcaaatcctctgacagggtcatgttcatcttgagggtgctcttgatttgggcatgtcaaggtaaagccgctcctggtttactccaacgtgttcagtactcgagggaatacagtaccaggctctcttcctgatggggttgagtagtagagtgaccttttccaccacaaattgaagcatgtggtatgttttgttacccagtaattttcaacttccaattcaaaattattgaaaaagaaaaaaaatgtaaatcaaaccatttgtttgcttttgtttttaatttatgatctgtcgtattttatcatatttttatccttgcaattcatgaattagaattagaattttatctaccatttttttccagcttattttttgctgaaaccaggatgatttcatgactgtgccacaaaaggatctaacattttagctaaccatgcccttttattttctataaacatttaattttact

SEQ ID NO: 11816 - DNA, 577 bp, Triticum aestivum
  Clone ID: PAT_TA_11816
atctcgtgagtcgtctcgccatggccgcgtcctccctgctccgctcgctctcccgcgtctcgcgccgcggctgcgcgcccgcgttctacggccgcggcccgctctcgccgctctcgaccgccgcggctgcagcggcgtccgacgcgggggatgctgcggtgctgcggagggggctggcggggctggggccgacggccaagggggagaagccgcgggtggtggtgctcgggacggggtgggcggggtcgcgcctcatgaaggacctcgacaccaccggctacgacgtcgtctgcgtctccccgcgcaaccacatggtcttcacgccgctgctcgcctccacctgcgtcggcacgctcgagttccgctccgtcgccgagccgctcgcgcgcatccagcccgccgtctccacctcccccggctcctacttcctcctcgcccgctgcaccgccgtcgaccccgacgcgcacacgattgattgcgagacagtcactgaaggtgagaaagataccttgaagccgtcgaaattcaaggtttcgtatgacaagttggtctttggatgtggagctgaggcatcgac

SEQ ID NO: 11817 - DNA, 702 bp, Triticum aestivum
  Clone ID: PAT_TA_11817
ggccatgtggggcgttcaaggttggcagagaagtgaccgtgcactcggtgaacgtcttctcgcatcttgttgcctgcgagagggtggcgagggaggcgtaccgcgtttaccccaaaaaggggtcagtctgggcgctccatgccggagagtacgccggacaccgggaggcccaggtatgactttgtggtgttcctcagcgggtacagtgaggtccacggcatcagcttcggctacctggagaagattgagggtttcaggagcatcttcacccgcagcgacattggtgttcgtgcagttcagtacctccgggagggtgatgtggggatgctttcacatcagactccggcgaggaaagtctccaagggtgaggcctcgactctgcctcctggggattgctgggagcttgaccctgcatccttgcctgctgaattgctgcatgcctagaggcagaagaggtggctttggattgataatgttgacaggctgttagcagtgttcagattccaagtagtgtagaagtatgggaagaacgtcatttcgttggtgtcagatgctgtgatgttgcttctgtttgcaaattctagatggatattggccttcttcaagtagagacttagatatcatggatacttgtggctgtttcattgttcagagctcagtgctcagtgttgagttctactaccccacaacattgcaatgtgt

SEQ ID NO: 11818 - DNA, 865 bp, Triticum aestivum
  unsure (1)..(865): unsure at all n locations
  Clone ID: PAT_TA_11818
cgtccgctcgagacgaggtcctcccgtcgccggcgaggtgagagatgagatgagcctctcggccaccttccgggtcgccaaaattccccgcgccaccctccctccgaagtcttgcaaggtcaccccctcctcggtatcggcctcccccgcctccacgtccggagatccaccgcccaaggcggtgaagaagaaaaaggaggcggcgccgtggtgcgtctacctcatcgcctccgccgggtcccccgcacatacgtcggcgtcacgactgacttccctcgccgcttgagacaacataatggcgagttaaaaggtggtgccaaagcctcttctgctggaaggccatggaatctcgcatgccttgtccaaggcttcaccaacagaagtgaagcatgtgagtttgaatcgaaatggaagaacatctccaagaagatgacacggaagaggagtgagcctggcttgaacgcagtgttgcagcaccgggaagtggcattgagcagagtaaaaacctttctggattgcaaccacctcaacatcaaatggcactcaagctgaggccgtttctccaatttttgtatgtacacatgttttactatgcaagaaatcatccattaacttacgaattggcgaggttttttgtanaggctttccgcntccatggttttgtacaaaaaaggtcccatgtcntgcaactcaaatgaacatgcatgacacatcatctgctaaccaaatgatatgccnggcaantgtcttgctaagaaggnactgaatcgantgaactggtgaatgcaanttttttgtantgctcttaatgacaacatcaagcaatgttaacctgggttggtaaaaatggngtaaatgtattttg

SEQ ID NO: 11819 - DNA, 1152 bp, Triticum aestivum
  Clone ID: PAT_TA_11819
attcggcacgaggagctgctctaagtaccgaggtaaactcacgaatccctaaacctgggactcctggaaatgagttgaagcacaccagtgaagtgagtaagaatacgcctgttctggatactgggaaagaacaacaatcagggaacaaagtggttgaaagtgttggggtgctctctagcagctcgcatattggtcatagtactgaaactaaaagtgcaccgctagagcagccacaacagcatccaactcccgagagcagtgctctagcgcaccaacctttcacagatttacaacatgtgcagctacgtgcacagatatttgtttatggtgctcttattcaaggaataccaccaagcagaggcttacatggtgtcagcttttggagaacctgtaggtggcggcaaacctgcctgggaggcagtctggcgagttgctgttaagatatttcagaatcagaagtcacccgtagctggcttggaaactcctacaagctcacgtataggcagcaatgtggctgaaaaagccagtaagggtacagcaggtaaaacttcaccagctagcaaaaaaggtggcaaagctgtgttgccagcacatactgctgtaactctgcactcaccaactttcaacatgtcaccgcttggtagttctacattgaacctgcaacgaggttcccatctggattttagtcaggctgtatcaccagtattcgcatataattcacagacaaggcagcctacttctgctgttgcatcctggtttcctcagagccatggtacacgtgctgcaccttggctggctccaccacaaaacttaatatttgattcatcaatgcaaccaactgtgccttcaagtgaatctgcaaaaggatctagtaaaactatatccatttcacaagctattacgcctggtctatttcttcccagtcaggcatcttctactgttgcttctccattagcagttgtacaggaggagaaacagaagacaccggcttctaagcgtaatagagctggagctgcatcaccaaagccaagaaaaagaaagaaagcttcagcaagtcaagaacagcaacctgacattgcttcctctcagctcaaaacggacattgcatcatcccagctcaaaacagacattgcatctgttattcctgccact

SEQ ID NO: 11820 - DNA, 647 bp, Triticum aestivum
  Clone ID: PAT_TA_11820
tcggcaccgcgccgccccctcccgctcaccctgcggccgagtggccatccggccccccgccgcggcgccaagcggtccaagccgcgcccgttggccgggcgcagtgagtgctggccgccgcgcgcgcgcgcgtggtgccgcccggccctgccctcccgccggcccctccgccggctgggagcctagggggcgcgcttgcgggccttgcgctctgggccaggtcctccggccagcagtcgcatcagggtcctgcggcggctactggggttctgttcctggtgcggcattggggggcggatgccagcccgccatagggggggcatggctgtggggctggtggttgtcgagcgtccggcgtcgggtcaggagcgtctcctgggaccttccccccaaacctcccggtggggggtgggcctagtgggggtgggtgggaaaggaagggggcaggggactgcattgcgttgctaaacccatcagccagtagcaagaatgtgggtgatcaacaagcagaggtttcgtctcagccggaaaggaactcggtggagagggacaacaggaagatctcgcccaaaacgcaaagcaaggaagattcttcggatggtgatggcactaaagaaaattatgttcatttccgggcaaagcgaggc

SEQ ID NO: 11821 - DNA, 676 bp, Triticum aestivum
  Clone ID: PAT_TA_11821
gccggagacagtagaccttgatgtcaacctgttctttaaggccatggagtcggtgttaggaagagcttcacaagaggaagctggccatgatactgaaagctggtagaaaatcctcctcgtctgacatggactttgacgattctgatttcgataatgattctactgaagaagctggtgaaaaggatatggatgattctttcatggaatcatattcagatgctttgaatgacgagctaagtaagactaccattgaggaaaccttttctcgagcacaacgccctagcaccaacagtgagggtccctcgaatgatgccgatagtgatgatggggagatggccccagttgatgtgaacttgaaccttgtggagagcttccttaactcgtactcgtctcagcagggccttcctggcccggcctcgaacctgcttggacttatgggtgtgaaggtaccacctccggacggtagtaaaaagccgtgattttgtgtttctggtgtacactagagatttcaggagcataggaagaagcagcaacgtttagtgttacatatactgggggtttgtgccctgcttctcactttgctgtgaaactgttatcttacgttctctgtgtgtaatctcactgctgtacactaccgggctgtactacactactactacctccgttccaaaataga

SEQ ID NO: 11822 - DNA, 490 bp, Triticum aestivum
  Clone ID: PAT_TA_11822
attcggcacgaggtgatggccaagcccctaccttatttagtcgtagaacacacaacactataagcagcaaggcaccctatggatcctgcgtggcagattgcaaagatatagattgatggataaatgagtgatattgtagtgtgattactgtttttaaacgcaaattacaaatcgttcttcccatgcgtatgcaagagcttggggataagaagaaaatccctagtgcaatcccatcactaattccctctctaaactcccatgccctcttccatggaatgagtgtctgaaggaagacgaaaaaaggctgagtaccctatcacgaagcatctgccagtttccgtcaaaaagtcagatagttctttttatgcaagcacatggcacaaggtacatgcatgcaagcaatcctgcatatgatgtgctcgtgtcgatattaacagtcatgtccttatttcgaaaagcagaagtaaaaccttttatctgaaaaaaaaaa

SEQ ID NO: 11823 - DNA, 516 bp, Triticum aestivum
  Clone ID: PAT_TA_11823
gcacgcatgagccgggggaggcttcagttcggcagcgctcatccagcctgtgaagttcagccggtgagcatgtgcagtccgacggcgtgtgtgtgcttgtgtccggttcacgggcgtaccgtgtgtggtgcttgcgtgcacacggcagccaaatgtggtgtgaggagaagccaagctaaaaagaagagcacactaccttcacacgcgtgcacgcatgacaggtacagagaggttcagggcttcaggcaatgtgatggtgcagccgctgcagcgtcaactacaacagcgcgggtgctcctctccctttgctgctttgcatgctgcgatgccaccgcctcctcactgcaaaaaaggtttgagtgaggaaaaattccagctcatgaacgaacctggagaagttctattgcgatggtgctattctctgtagttatttgtttctcgtgaatggctgatggatctctatcttcatatattgcgtgcgtgcttttcgcggcacctggttgtttctcgtgaatg

SEQ ID NO: 11824 - DNA, 683 bp, Triticum aestivum
  unsure (1)..(683): unsure at all n locations
  Clone ID: PAT_TA_11824
cgtccggtcatgagcggggacaaaagagagggacagagtgctctctttttcctcctctcgcatctccttgtttccgccccgactggcggctagggttcccgtcggcgccgccacagccgccgctaccatccttgctccgccatctatggccaccagagaaggcgcccttctgagacccgctcttgttcaaaccttctcgtcttggcgtcaaggcgtgctattctgcctggctgccttggtggttgcagatgagggggaggaagggatggcatcgaggtgtcgatggaggccctagctcgaggcggcgagatgcagagatgcggggtggtgcggatggagaggcagcttcagatccgcgcgcagccgcccgcactctccttcctccgccgccttccctgtggtcagctccgtcttctccccgccctccatcctcatgtgttcagcagcaaccctaggaggagctcgagccacatcggtgaatgttctctgctaggtttggtgctactactccgtcttcgatcccaaccatctcgcacgttcccgagatcgtcgtcttcctggccgggacccctggtttgtaattcatggnnnttggcgcatctgcgcttaaattcttgctggaatggtaaacaacgattccatttggttacnnncgncaaaatgaanaaaaccnncaatttatt

SEQ ID NO: 11825 - DNA, 503 bp, Triticum aestivum
  Clone ID: PAT_TA_11825
cgtccgaaacttcttgagtgcctcgcaccgattaataaaccacttgatatgctgtctatagcagataatcatcttgggagttctgtggcagctacattagtgaaattcctgggttcacatgtaagggagctaaatgttgaagacatcggcctaggaccaataggcttccaaatacttgaggaagcattgccaaggaaagtaaatctctcccacatcaacatcagtaagaaccgcggtgggatgggtactgcgcacttcgtttccaggctgatactgcaagcgccgaaccttatatcagtcaatgcaggatctaaccttctacctcctgaatcggtggaagtgatttgtaatgcattgaagcaaacaacatgtaacttgacgcgactagacctgatgggcaacctgcaattgtcgagcactatctttcctgcagtctttgagttcaagaagcgtggaaagccaatcctgcttgttccggcgcagcaaggtagctgtgctcccta

SEQ ID NO: 11826 - DNA, 1958 bp, Triticum aestivum
  Clone ID: PAT_TA_11826
cgtccggctcgctcctgtctcccctgttaggttttcccccaccccacccaagcgcgccgccggctgtctccctcctcctccgcccgccgccggctgtctccgccacctgcgccccccccctagccgctcgaccccgacccctccacgtccctcccccccgtcccccgactccgccccgccctcaccgccagacgccgtttcaatcatggcacgccgaggattgatggagcaggacctaaccaagcttgatgtcaccaagctccacccgctgtcacccgaagtcatctcgcgccaagcgaccatcaacattggtacaattggtcacgtggcccatggaaagtctactgttgtgaaagctatatctggagttcagactgttcgcttcaagaatgagcttgaacgtaacatcactatcaagctgggctatgctaatgcaaaaatctacaaatgcgaggatgacagatgtccacgaccaatgtgttacaaggcttatggaagcggaaaagaagatactcctgcctgtgatgttcctgggtttgaaaacactaggatgaagctcctgagacatgtttcctttgttgattgcccgggccacgacattctcatggctacaatgcttaatggagcagctatcatggatggagccttgcttttgatagcagcaaatgaaagctgcccacaaccccagacatctgagcatcttgcagctgttgagatcatgcgtctccaacatctcataattttgcagaataagattgatcttatccaggaaagtgcagcaatgaaccagcatgaagcaatccaaaaatttatccagggcacgataccctgaagttgtcccggtggtgccaatatctgcccagcctgaagtacaacattgatgtgatctgtgaatatatttttaagaaaacccccactccagaaggaatccactcctcatcccccaacgtgatttttattcgcctcttagatgtaaacaagtctgtttcagaggtttcaaaaatccgggttgggagagcaggtgagcagcatcctcaggggagtcctcagggtgaaccagaacattgaagttcgccctggcattgtcatgaagggatgagagtggcaacatcaagtgcaccccaatctattcgaggatcgtctcgctctacgcagagcagaatgaactccaatttgctgtgccaggagggcttattggtgtgggaacaaccatggatccaactttgactcgtgctgacaggctggttggccaggttctaggagaaatcgggtcacgtccctgacgtattcgtggagcttgagatcaacttcttccttctccgaaggctgctcgggtgtgagaacaaagggtacagagaaggcagggaaggtctccaagctcaccaagggcgagatcctgatgcttaacatcggatccatgtccaccggcgcccgtgtggtggccgtgaagaacgatctcgccaagctccagctcaccgcgcccgtctgcacaagcaaaggcgagaaggtggccctgagccgccgtgtcgagaagcactggcgcctcattggatggggccagatccaagctggcgcgacgctcgaagtcccaccgtgcccgctctgaagcacccccccatccgagtgaaaaaccgcagcttgtgaaacaagagaggcgaaatgtgggagggcagagagctcctaggtacaatttttgtgagatggaggagaaaaacataacgagtctgaaagtctcatctttgctggatttatctacgctactagtttgcttctttctgtttgtcggaatttagggtttgttatactcgccatgttagggtggtggttagtaggcgaggaacctgctagtttggttcagatttacctaattatctcgtctatcacattgactccattatgtcttgcgttgagaagattattgcccctgtttttcccctaattttcctcaactcgacctg

SEQ ID NO: 11827 - DNA, 736 bp, Triticum aestivum
  Clone ID: PAT_TA_11827
caactgtcgggcttaaaaggtgtatattaagcaataattccagagtgtttgccgcctcctccgcccgcacgcgcgacctccaagggcttccgagacccggtgggccgccacctccggccgccgctttcaccagcccagaatcagagtcagacccagcagcagcagcaatctccacaggcaccgcagcaatccccaacatcaactggtttctttccaacaccaggcattggtttcttccctccggttcagatgcagcaatcaccgtcggtccagcggcaatgattacatagcaactgtcaggctaaaaaggtgtcagtttgggcctaattttgtatattaagcaataattccagagtgttagttggcaggtctgcaggcaagcaggatcatcaatgcttatgagtcggaaaggtttgtagaataggtcggtggtttgtgtgatgtataaccggtaacttttccgttttggttgaggaggttcatcatatgaagtggttaagagtggttaagactcttcttcgttgatctgtggctccttaattagtcctgagtcaaacaaatgttgctgcttgaagagctgtgaacattgggctcctcaacttgagaacttaccagtggctttggaacacatgttatagacctatagtctcatagatcatgttgtttgtttaatttaaatcatttagactaacatttatttacatttatttatttattcaaatatagtgtttcgttt

SEQ ID NO: 11828 - DNA, 1122 bp, Triticum aestivum
  unsure (1)..(1122): unsure at all n locations
  Clone ID: PAT_TA_11828
tcgtcccacccgtcacgacgatgactgatgtctttggaaattatagttgttcagaagttttttgagcatgggagcacggctcagataaaggagttggctgatcagctaatcgggcgagtcttggcactcagccttcaaatgtacggttgccgaggtcctgttctgccctcttacgcctgttgcatctggtagcccacttaggcacggtgaacgcagcatgcgctttgcatcaggcatgagaaattttgggggttcttttggttcgtggaatccagacctggttggaaagatggaagggaatctgatgccctcgcttctggaggaattcgagagcaacaaaagcagaacttatgacctctctgaaatagctgggcatgtcgttgagttcagtgctgatcaatatgggagccgattcatacagcgatggctggggtccgccagtccggttgcgtgcgtcctgctgtcctctgtggttacgccgctggcccgcacgttgtggactgcggcatttccaaattatgttgttcagaagttttttgagcatggaagcactactcagataaaggaactctctgatcagcttattgggcgtgtccttgctcttagtcttcagatgtatggatgtcgggttatacaaaaggctatagaggtcgtggatttagctcagcagactaaaatggttgctgagctggatggacatatcatgcgctgtgtacgtgatcaaaatggtaaccatgtaatccagaaatgcatagagtgcatccctcagggacgttatccagttcattgtctcaactttctatggtcaagttgtgctgctatccactcatccatatgggttgtcggggttatacagagggtgctggagcactggtgatgatcccacgacacagcagataatgatggatgagattctccagtctgtttgcttgctggctcaagatcaatatggtaactatgttgttcagcatgttctggaacatggcaagccacatgagagaactgctatcattgacaagttaattgggcagattgtncaaattagccagcaaaagtttgcttcaaatgtcattgagaagtncttngttttngtaaccctntagagcggcagatcttgatttg

SEQ ID NO: 11829 - DNA, 1555 bp, Triticum aestivum
  Clone ID: PAT_TA_11829
cctcgcctccggactgcgccgccgcctgcgtctcctcccacctctcgtccctccggccggatcggcgaaacctccacccccgcctcccgccgcctgcccgcgccgcccgcccgctcccaccgccccgcacccgagcagcagcatcagcggtctgcgtcctcgcgcctggctagccccagcctagggcttccgctcaggaacgtaaatttcactacagacttgaagatgtactccgctccaggcaacaattctttggctcttgcagccccacggccaggaatggagttgggcaacgtgcagcaacatcctaaccaggcttttggtcttgggcctggtgggaaacaacgctcatccagtctggagtcgcgctgatcacggctcacaggccaccagagcgctgtctactgcatgaagttcaaccctgctggaactgtgatagcatcgggctcccatgacaaggatatcttcctgtggtatgtccatggtgagtgtaagaactacatggtactgagagggcacaagaatgctatccttgatcttcactggaccactgatgggagccagataatctctgcaagccctgacaagactttgagggtttgggatgttgacactcgcaagcaggtgatggcggaggacgaatactttgtcaactcatgttgcccgtcacgtaagtggccgccgcctcctctgggtgggtcgggcgccggcgccgctacgccctgggacctgcgcctgagtcggggtgtcgataccctaccactcccggaccagttcccggtcatggccttctccttgtctgcggctgaggttttcgctggcgccctgggccacgatatcgacggcagggggcggcgccttagcgaggttacagacactgacactctacaacggcacctggtaacggggacgcggctgcggcctggtccggctggccccctccccctcgccatggccatggacctcgagctctgggttcggcgcccgcgcccgcccgcgccccgcaaccgcaacaccttgaccggccctcggcaccacctcgactttgagaagaccctgttgaagtgcagctggtcacccgacaatcgcaaggtcactgctgggagtgctgatcgcatggtctacatctgggacacgacatcgagccggttcctgctcccgcggcccgggcacttccgtcccggtgaccgcaccccttcccaccccgcccagcccctcatcggatcctgcagcagcgacaagctgtcccggcgcgccgtgcgtcgcggtcccgtcccctcctcggattgcctgtcctgtttgggttgggtatggaactgaaggccgcagcccaggtaccgtgttgctctgtcctagacattgaatgctggattgctgatcgaattttcaaactgctacttgttcagtaaaagctcttgttaaacttgtgtcctttctgccttttatgcactgccggggtgtggctctctctgggaacccgatccgcgtgcctggcccctgctggagacgctgtcctgctgttcccagggcgggacctgcccgggcggccgctcga

SEQ ID NO: 11830 - DNA, 924 bp, Triticum aestivum
  Clone ID: PAT_TA_11830
gcgcgatcggtcctgaccttgccttccagttctcattcgagaaccacctccgcgaaagcgtggcagcaatggcaaggcagtatgtgagggctgtaatggcatcggttcagagggtggccatggcgatagctccttctcgcctcggcggctcgcagatccaactgaagcaccctccaggctctcccgaggcgcttacacttgctagctggataggaaggagctacagggctcacacgggggaagagatccgctggtcggacactgaagaagccgactctcccctgaagctcctgtggaaccacagcgacgctatactctgctgctctctgaagcctgctccgatgttcacgtttggtaacaacgcggccctggatatgctggagacgacgctggtgaacctgcaggacatctcgctggaggcgatcctggacgatgaggggcgcaaggcgctgtgcgccgagttctccaaggtcatgcagcagggtttcgcgtacctccctggcggcgtgtgcaaatcgagcatggggcggcaggtgtcgtacgagcaggcggtggcgtggaaggtggtgggcgacgacgtggcgggcgccccacactgcctcgccttcatgttcgtcaactggaccttcctgtgaccgccatctacccatctgctgcttgagcaaaagaccttcctgtcgtctgtccgttttgtatggttcagttatctatctatgtacccatcctagctatggtatgtatggtttgcatctttgttgagaacctgatctgaggtttgttgccgtgaaccgaaacatagttggcattccttcccgtgttgatcgggaacaagacctatgtatgtgtgtgtaactgtcagtgtcatgaaccgaacagtggcttgcggttcctgtaattttgctttgcgtgcccaaaaaaaaaaaa

SEQ ID NO: 11831 - DNA, 644 bp, Triticum aestivum
  unsure (1)..(644): unsure at all n locations
  Clone ID: PAT_TA_11831
gcagaagattagtagcagagtgggcatggcaagttcttccaacgtgcttgtgcacgaggacacaaagcagaatgctatgggtgttgggcgcaagctgaatcccaagtcagcaacacacagtcaacaacaaagaaacctgcatccaccaagcgctgcttccagaaaggctggggtcacaagcgcacgctctgaaaacactatgaaaggcaacagaaagggggaattgcagccaaccaactatgcaaacagaagaccaaactctacagccaaaacaatccccaagccgagaagattaccagatgagggcatgcgttcaaagaaaaaccagccaagtgataaagttctcactgaaagaagcccaaggcgtgttcggcacaatattgtgatagaggagcaatcatctttcaccacgaacaaaaagaaaatcagcactgagattgtttcgttcacatttacctcaccagttgacaaatcattacatggttctcagtttccccattcagtggaaaaacggtcgatagagaactggaactccgtgtcaacttcaagcaacacatcaaacactgaatcagataccatagatggtgattatttgagacttcttcttgagcagaagttgagagnattgacttnnnnggntgagn

SEQ ID NO: 11832 - DNA, 1626 bp, Triticum aestivum
  Clone ID: PAT_TA_11832
cgtccgcggacgcgtggggtaaaattggattctgaaattgcaaattgtggtggattacccggccgagagaagcaggtgaacgccatagatatttctttcctgtggtcgccgccccacgctgcccgtgggtagctcccgtagttcgccgccccgtgcgccatgagttgcgcggcggtgtgtgctcccccctccggtctcggccgtcaccacggcttcccctcctccccctcgactgtatgcaggcgacgggggagagcctcctacactatccgggcctgtgccaactccggcgacgcggatgacagcggcggaggtctcctacctcggatggtgctgcacgactcgctcgaggccgcgggggtcgtcactgatcacgctagggcggcgagggagaggttcgcgaggccgcgcgggagactcacgaggctcaacgcggagtcctccatcactatcaggtgccgctccccgtcgacgccttcattgctcgccttgacgacctttccagccgggcttcctcgccgcgggatccctcccgccccccggcgcgccgtccgtgctcttcttcgaccacctcgaccgctacctctacgtccacaaggcctcttccacgaacaagcgtcgccccaggtctccggcgacccccgcccccgcttccccggccgccccacgcgcccgcgaagaacaaacgtagcatcagatgctcgggctatgtatcttcactcgactttgacatgccgatcaggatcagctctaatgctttcgttgatatattcggagatgctaaagacactacggttatatggcttactagacttcgatgaggagatctcctttccacatgatcttgatggctgccctaggggctatgacaaacgaagaagcaagttttgtgatgaaccaaatgtggtgacagcaaagtcacttttggttgagattttacaaactctgaagggtatgttttggccgttccagtctaatcagtcaagtagcttatttttgaatgctgttgctgcaaaccaccatggccctggtaatgtaggcggcagtcaagcaaggtcatgtggcaatataagtgccatagagatggctgctgctaaatctgctcaacataggttgatgcgtggagtatggactaatgtgcgctttggtgatatgcgtcgtgctttggcagcttgcgagagactgatcctactgaatcacaatccctgtgagcttagggactatgctgcccttctgtaccactgtggctactacaaagattgcctgcagtacttaacatcgtaccaaattgccatggttggacagccccggaccaatccactggagatgttggaggacgacacagtgaacactctcacggcacgagtaaacctaattttagcagaggatggctgggacagccacagacctgctgcaagttactggaccaaaaactctgagccatggtagacactcttgaccgatcagtgtatatatttcactaactgagacatggatgtgcaacaacttgtacatatagtaccctggacgttttcaagcatttatgaaatgggactaaattctggtgccgcgctccaatgtttcaggcgctacttcccaacggctacctcggccgcgaccacgcta

SEQ ID NO: 11833 - DNA, 577 bp, Triticum aestivum
  Clone ID: PAT_TA_11833
ggacaacaccaccgctcgctcaagtccccagctccgatggcccgcaccaagcagacggcccgcaagtccaccggcggcaaggcgccgaggaagcagctggcgaccaaggcggcgcgcaagtccgcgccggccaccggcggcgtcaagaagccacaccgcttccgcccgggaaccgtcgccctccgggagatccgcaagtaccagaagagcacggagctgctcatccgcaagctccccttccagcgcctcgtccgggagatcgcgcaggacttcaagaccgacctgcggttccagagctccgccgtctccgcgctgcaggaggccgccgaggcgtacctggtggggatgttcgaggacaccaacctgtgcgccatccacgccaagcgcgtcaccatcatgcccaaggacatccagctcgcccgccgcatccgcggggagcgcgcctaggttcgtcgtggtcgccggtaatgctggccagtagctgttcttgtcctgtgattcgaatgtgtgttgagtgcctctgtttgttggtgttgatatgatgtgtcgtctgttcctatgtatggtggtgctcgaa

SEQ ID NO: 11834 - DNA, 842 bp, Triticum aestivum
  unsure (1)..(842): unsure at all n locations
  Clone ID: PAT_TA_11834
ccaggtttcnntcggntttaaagcgcnttggngggtatgttccacccggccccccgtgccggcccccccctgtggcctcggcccatgtgccccgtttacggcctcccgcattttcgtgggtgcacgtccttccagatcctgtccctgacatggccttcggccgttttcggcctgcattggctgctagaggttttgtgtcgcacggctcagtccaccccgcggccttccggggagttacaacgggggcccctagaggatgggtgtggtcgggaggcttccctttgccaagaattctcaagaggtggggaaattctcaccacattcttgacataaagagatggtaatacttccgaggtaaggaagatcaattgctggacagcaaggaactcaaggtataacaccaaacatgaacaagcttgtgttggtgggaaggcaataaagtggtcgatgataacacaaatcatcgagggcaaggatggtatttctcatcatgaattcaattgatatcctgaaggagctcaaaatgttgacgatgatcacgacaacttctgtcgcgagggttcatggagatgtaatcggtcggcgacgacatcaagtcaagcgaatgatgaagcgaaaggttattggaaccatgggtacgtcacaaactcgaaaccaagcttgttgtttgaggtgagacgataagacaaggaagatcgacgtaagcttagcccatcatcgaaattgtgctccggaaagaaggaccaggtagcacagttaaaatttggcacgataatgatatagtcgagtaggctcggaatgacgtgatttgagttcaaactcgtacttaaagaagattacta

SEQ ID NO: 11835 - DNA, 1059 bp, Triticum aestivum
  unsure (1)..(1059): unsure at all n locations
  Clone ID: PAT_TA_11835
gatatgatgtcagttccaaaacctgtaaacaacagtcttccaagaaacttgggtgatgccaaatttacttcatgggaactgtggcagaaacaggagtactcgttcaagaaaattgcacattttcgcagagcagtgccgataaaagagcagacggttatttcatacatacttgatgctgctcgggatggatgtgagatgaactggaataggtttttcgaggagacaggactgacccctgagatagcctcacagatccgtcttgccattgcaaaggttggatcacgtgagaggttgaagccaataaaagaagagcttccagaaaatataacatacgaaatgatcaagatattcttcgcagctgacgatcttggggtgttagagaagacttttggcaacgctcctactgacgggtctcctgcccaaacagcccgagtcggcaaaaccctgttcccatggcagcgaagctctggagaagggcgatccaggagaccccgtcatcatatcaggcgcctgtgattcaagcgctgcgacaaagagatcccagacggacggaactctgctctctgccgacgagccagtaaagaagctgcaaaagatagaggagcaagggaccgaacctaccaccgcaaatgttgcgaccgaggacgctatacttgagctggccgcaagccgcaacggggtttcgctggaggacgccgtcaagcacttcagcgggtcgaagcgggaatccgtcgtcgagatgctggagagcctccggtgcagcttcgcggtgtacatgaagaacggctgctacttggttctgtgaccagcgggagggaagggaaggaaggatgacgccatttgctgctcttcgcttgttcgtggcgtgagtgggtgttggttatggcttttgggctctgggacctttgacggcgctctgcatcccagttcccatattttgagggcttgccttaccttgccatgggaatgctcgttggttgtgtatatacgtgggtacttgcttctgagtagtatggctcgatcgaaggtactcaaggaagtgagcttagctnagtagta

SEQ ID NO: 11836 - DNA, 625 bp, Triticum aestivum
  unsure (1)..(625): unsure at all n locations
  Clone ID: PAT_TA_11836
gcgtccgcaaccttccctgaaccgggtttttttctgttttgttgcttttctggtttatccgcctttctattattttttcctttattttttcctttttcttcttcgtttattatgcttccttttctttttctctttctttttttcaagtttattttccttttccaaaaagtgtccagaaattgcaaaatgattttattttccaaaatgtatgaaaatgttcccgttttcaaattgtgttaaaaatgtacaaaattaaaaaaaaagattcgaattgcaaaaaaattcagattttcaaaatttgtttcagaattcaaaatttattctggaattttagaaaatgttgtaatttcttaattttttttgtgttttcaaaaactgtttgtgttttcaaaatttgttcggaatcttattttttgttctgaaaatttgtttggaatgtaaatttttgttctcatttttcaaattttgttcatgttgntcgtgttttcaaaagtttggagttcaaaaattgttcggaatgtaatttttgttttcattgtctcaaaatttgtttcgaacttcagaatgtgttccaatatttcaaagaatgttcatatttgccaaaaaatattatcattttagaaga

SEQ ID NO: 11837 - DNA, 652 bp, Triticum aestivum
  unsure (1)..(652): unsure at all n locations
  Clone ID: PAT_TA_11837
acacaactcgcgcgccgtatccaatcctggcccaatcccatgcccagcctctttcccttccaatctccagtggccacaccctctctcctcccgcacgaaccctagaaaatgccagccgccgccctcactcctcccagccgcctccatgctctcttccccctcctcctccatcctcccgcatctcatccatctcgccggatcccaggcgtgggagcacagaggcgagcttctacggcagcggcgggagactgcaggcaaagggcgaccccatggatccgtgtccagccctcctcatcccggttcccatggatccgaggcttgcaggcacggaggcgaactgccccggcggcggcggcaactgcaggcaaggggcaatggtggtgccgctccatctgatctgcacgagagggacaagatgagagggagagagagatggaagacgaggaggaagacagggagaggaagagaagagggatgtgcggcgtcggccgtgcgagggtctctggcgcggtttgtggtggcaaaaatggcatcgaagtccaccactctgagctgctcgaaccgtatgcccccgctggcttcctttccccttctggtggaccctccctgtctgagccccctccgccaatctcttgngtttcttctcttcctg

SEQ ID NO: 11838 - DNA, 976 bp, Triticum aestivum
  unsure (1)..(976): unsure at all n locations
  Clone ID: PAT_TA_11838
tagcgtnnncgcggccgaggtaccgtngnctggagatcgnncttgatggtgtatacaaaaggatgttgcttctcaaaaagaagaaatatgctgccattaaagtggcactagatggtagtttacgagagaacattgagcgcaagggactcgatatggtcaggcgtgattggagtatgctgtcaaaagaaattggtgatttttgcctgaatcaaatcttgtctggagggacatgtgatgatgttattgagtcaatacataactctctcgtccaggtccaagcacagatgaaaagtggtcaaatagagcttgaaaaatatatcatcacaaagagtctaacgaaagcgccagaagattatccagatgctaaaaaccagcctcatgtccaggttgctttaagactgaagcaaaatggtttctctggatgctctgcaggtgatactgttccatatattatctgctcgcaacaggattcagataatacacattctgggggaattgctcaaagagctagacatccggatgagttaaaacgagaccctaacaagtggatgattgacatcgagtactatttgtcacagcagattcatcctgtcgtttctcgtctgtgtgcttccattgagggtactagccctgcccgactggctgaatgtcttggactcgactcatcaaagttccaatcaagatcaattgggtctagcaatgaggatacgtctaccatgctcttatctgtaattgatgatgaagatgagagatatcgtggctgtgagccactgcgtttatcatgcccaagctgtaccaataccttcgagtgcccccctgtgtccagtctgattgctagtttatcagatccaaatgaaggaaaagatgctactgtgaatttctggcgtcggatgcggtgcccaagatgtccagatgataactgatgagtgcagagttttcctccccttngggggccccttttgggggggnttttttn

SEQ ID NO: 11839 - DNA, 817 bp, Triticum aestivum
  Clone ID: PAT_TA_11839
ttcggcacgagggccgctgccgcccgtcgccgcgcccctcctcggcgtcctccggaggacgccatagtattgcggcatcccctccacacccgcttccatcaagcggtgttcaccagcaggggggaggggggctcgattcggctgctgggagcggaggtaggagcggccaagatgtcggatttccagacctccacgcaccgggagcggtggatcttccagccgcaggacctggtgaataagtggacgacggcgaaccggcgttcagcggagatcctcgcccagtatgggacgacgcggttgaaggtggaccctgttgatggctcgatatcgaaccctgaacctctgcctgatcatgttgttgggagctcgagcgtgaagcctctatcctgcgaagaggagcaagtgatgcggatattttacgagcaaaagattcaagaagtgtgcagagcattcaaattcccccacaaaattcaggctacagcgataatatatttcaagagattctatctacagtggtctgtaatggagcaccacccaaagcatattatgttaacttgtgtatatgcttcttgcaaagtggaagaaaatcatgtttctgctgaggaacttggcaaagggattcagcaggaccaccagatcattctaaataatgagatgattgttctgaaatctttagattttgatttgatcggtttatgctccatatcgttctatcgaaggatttattgatgacctggatgatttatgtagggcacgtaatggtgcacaccaacggttgaaggatttgcatcaaactgcgaattctgaggttgacaca

SEQ ID NO: 11840 - DNA, 764 bp, Triticum aestivum
  unsure (1)..(764): unsure at all n locations
  Clone ID: PAT_TA_11840
cgtccgcggacgcgtgggcggcggcgagccgggcgcgaccgatgcgtgttatgggtgcgcactggacgcgtcgtgcgcgtcgggaccgcgggagtggaccgcgtcaaggcgctggacctggttgcgcagattgcgtacgtgcacggcgggagcgcgggccgggagcgcggggacatggggagtgcgcgcgaagggcacgacggtcgcagagacgaggaggtcacgaaggacctgcgtggtggcgcagaggtcgcgacggctcggggcgacaaccgtggaaggtgcatggcacgtaggcgcggcgtggcggctgccatggcggacgcggaggcggcacgcgaagagcgtctggtgctgtcgggctcgtcgggcgcgtcagatgcgtgcgggacgtgcgggacgcactggtgcggtcgggctcgtcgggcgcgtcgggtgcgcgtgggacgtgcgggacaccaaaaggacgccgggcntgtgtccccgcggagatgaaactcggcgccnggtcntgacgnncacgtncgaacggcgtctatcgtcaatccggtccgcnggctgggtcacggcataacgacacaatgacggagctacaacaactcccgtgatggcnaagtctgatttaggangagttntttggagtaacaccctcaaacatatggttcatcncggtntcntcaagtccgatataaggnaccgccnttggaaaacganggcaatccttggtcttaccnaccncatgccggtcnctgttaccatcactt

SEQ ID NO: 11841 - DNA, 1016 bp, Triticum aestivum
  Clone ID: PAT_TA_11841
gaattttccccggaagaccctccaccaggagtcaccgctcgtcgggtctccgccccctctttctccgctcccccgaatcagaactccgacctccgacctccggagtcgcgctcggcgacggcgctgccctgccacctcgagcaagcaagagagatgtctctaatccgaatagctttttctttggtcctcctcctcgccgcggcggagtccgcggcggcgacgcgctcaccgtcggccttcgtgcagaacgctatctactccaaccgcatcaccatcttctccaaatcctactgcccgtactgtatgcgtgctaagcgaatatttaaagacctcaatgaagatccttacgttgttgaacttgatctccgagaggatggccgagaaattcaaggtgttcttctagacctagttgggcgcaatactgtgccacaggtgtttgtgtatggccaccacgttggtggctcagatgatacaaaaactgctctttcagacggacaacttcagaagcttcttggtaagagtcagtcgcagtgatgatcactgccgaagcttggtattgtccaaaacttgtgaaatgtctaacatgcggtgttccttatggaggaatggaaccttacactctttaggaatatgaacagagtgttgcaactcatgctaggtttttttttttagttgaagtgttgtgacaaaaatccatgtgctggattgtatgattttctcaagtgcatttacatttatctcttgggactgttttaatcagcgtgtgattatcaactgactcaagcttggcatttgtcctaaagcttgttgaaatgtcgaatcaagtcggtattccttagggggatggaatgggaaccttacactcctttaggaatatgaacagagtgttgcagctcatgccaggatttttttttgagtgcaagtgttgtgacaaaaatccatgtgctggattgtatgatattctcaagtacatatacttttaaccgccgtgcccgatttcataacggttggggttc

SEQ ID NO: 11842 - DNA, 632 bp, Triticum aestivum
  Clone ID: PAT_TA_11842
tcaagctagatgcgaggcaagcccagggtttcatctccttcttcaagaagttgcccaaggatcctcgggccattcgtttctttgatcgccgggattattacactgctcatggtgagaatgcaacctttattgcaaaggcatactatcacacaatgactgccttaaggcaactgggcggtaactctgatggaatctcaagtgtcagtgttagcagggctatgtttgagaccattgcacgcaaccttttgttagataggacggaccatacactggagctctatgagggaagtgggtcaagttggaggttaacaaaatctggaacacctggaaacataggcagttttgaagatattctgtttgctaacaatgacatgcaattttctccggttactgttgcattgtttcctgtcttccgtgatggtcagctatatgtagcgcttagttttgtggatatgacgaaccggaagcttgggttggctgagttccctgaagatagtcgattcacaaatgtggaatcagcccttgttgcattaggttgcaaggagtgtcttcttccagcagattttgagaaatcaatagatttgcagcctcttcaggatgctattagcaattgcagtattctactgactgaa

SEQ ID NO: 11843 - DNA, 919 bp, Triticum aestivum
  unsure (1)..(919): unsure at all n locations
  Clone ID: PAT_TA_11843
cgtccgcccacgcgtccgggagagtcccatcccaccccaccccaccccactctcctcgcgcgccccccgctccggagggcgatctcgggaggaacggctggcgttccgcggcgagttgtattatacggttgcccgcgacgcttttgctgttagttctggcaagttggtgagtatctggaagctgcgatgtctgaaaacacccagggcagtgtccggcgggcctttggagacctgacaaatgtccttggcaagcggccagcctcatgcgatctggaaaagaatgcaggtggagtcaagatgagtcgggttgaaaaggtcgttgaccctaggaaagagtctgatgaaaaggcaaaggccaatgctggggcatcaggaaacctttttgaagttttggttgatggtattggcaaagaggacttcgcaaggacttcaattttccgtggagccaaggttcagcacatggctgctcaggcagctgggctactatccaaggatgatgatgatgtgaggaatcgttgtgtatcattggattcttctggcctcaacgacaaggcggagtcttccttggaatcagagggtggctgtgaaggggaagatgacgaagacactgatagtgagttgctgccatatgccagtgaggctagtaagattgtaattaatgataagactaatgagggtgaatgtctgactcaagaggagatggttgtatcaccaggaaatcagaattcgcagtcttcatttgacgctacagctcgtgatgacatgacatgtacaaatgtccagcatcctccaatggnnnttggtggcttggaaaaatcatgtgctacaaagtcttgcacttgctctttctgtcttaaggctgcttttatgtggactaatctcnantatcnnnntgcnngaagccggcttggtgcattga

SEQ ID NO: 11844 - DNA, 949 bp, Triticum aestivum
  Clone ID: PAT_TA_11844
cttacctggatatactccttgggaacctgcaatatcagtgcaaaacttttgacataaatcttccctctgagatggtgaaatgtgtagaggtttttaaggagttctacgcaacaagaacaaagcacaggaagcttacctggatatactccttgggaacctgcaatatcagtgcaaaatttgatgctaaaactatagagctcattgttacaacatatcaggctgcgttgctgttgttattcaatggatctactaagcttagttactctgagattgtaacacagctgaatctgtcagatgatgatgtcgtccgtttgctccattctctctcttgcgcgaaatacaagattcttagcaaagaaccagctggtagaactatttcgcctaatgattcttttgagttcaattcaaaatttactgacaggatgagaaggatcaagatacccctacctcctgttgatgagaagaaaaaggttgttgaggacgttgacaaggaccggaggtatgcaattgatgcatcaattgtgcgtatcatgaagagtcgcaaagttatggcccatacacagctagttgcggagtgtgtggagcagctcagccgcatgttcaagcctgacttcaaagcaatcaagaagaggattgaagatctcatcacgagggattacctggagcgggacaaggacaacgccaacacatacagatatctggcttgattagtattggtggtaggttgcaagcttgctgatggtggatacgctccaacgacttgctgcgatgttgcagcttattttggggatttcggttgctatcttcccgggctggtctcattttgtacatggttcgtcagaaacactattaggcaactcaggattagaggaggcacctcggtaccactgaattatccttctcatgcagtgcattttaagtatgacttagataataccttgcctttcgt

SEQ ID NO: 11845 - DNA, 3248 bp, Triticum aestivum
  Clone ID: PAT_TA_11845
cggacgcgtggggccagagaagaaggagatggttggcatgcaggaacaggtgtgtaactttattttactacacttataattgacatctgttacctaatgcttgttatttgcctttcaggtttttgtctggaaaatcattgagctgcatgacaagtatgtagcatatgtgacagattgttttcagggccatacactctttcacaaggtctgctggttgatacgtttgttttccacgttgctttcatcgtaaattgaaatggctgcctcattctcaaacttctctttgtccaggcacttaaagaagcctttgaggtcttctgcaataagggtgcgtccggcttgcctgaagcgagttggtcactacttgcatattaatagtgagccgaagttgctagtgctgaattacttgccaccttatgcaacattttggagaaagagcattctggatgttttgcattttcgggatgacaaggaggatctttcaaggatgtatagacaattcgccacgcggtctctcacccccccatctctctcccccccaaaccccacgcggcgacgggcgcaacagaacccagcctcctcctctagggtttgcggccgccgtcgggggcggaaaaccggcggctacggcggcgatggcgggccacgggcaggaccgcaagacgatcgatctggaggatgggtgggcgttcatgcagcggggcatcaccaagctcatcaacatcctcgagggcaagcccgagccgcagttcagctccgaggactacatgatgctctacacgacgatatacaacatgtgcacgcagaagcccccgcacgactactcgcagcagctctatgacaagtaccgcgaggccttcgaggagtacatccgggccacggtattgccatcattaaaagagaagcatgatgagtttatgctcagggagctggtacaaaggtggtctaaccataaagttatggttaggtggctttcacgctttttccattatcttgaccggtacttcatcacacggaggtcgcttactgcacttagagatgttgggcttatttgcttccgagacctgatatttcaagagatcaaagggaaggtaaaagatgcggtgatagctctgatcgatcaagagcgtgaaggtgaacaaattgacagggccttgctgaagaacgtcttggatattttcgttgaaattgggttaggtaatatggattgttacgagaatgacttcgaagatttcttgcttaaggatactacagattactattctgtcaaagctcaaagctggattgttgaggattcttgtcctgattacatgataaaggctgaagagtgcctgaaaagagagaaggagcgagttggtcactacttgcatattaatagtgagccgaagttgctggagaaagtgcaaaatgagttgcttgcaagtggtgaaacctatctttttgttaaggagcattctcggatcttttgcaatgcatacggggtgtacctggttatacgacctggcaacctgctaatatctctgcaaaatttgatgctaaaactatagagctcattgttacaacatatcaggctgcgttgctgttgttattacaatgtatctactaagcttagttactctgagattgtaacacagctgaatctgtcagatgatgatgttgtccgtttgctccattctctctcttgcgcgaaatacaagattcttagcaaagaaccagctggtagaactatttcgcctaatgattcttttgagttcaattcaaaatttactgacaggatgagaaggatcaagatacccctacctcctgttgatgagaagaaaaaggttgttgaggacgttgacaaggaccggaggtatgcaattgatgcatcaattgtgcgtatcatgaagagtcgcaaagttatggcccatacacagctagttgcggagtgtgtggagcagctcagccgcatgttcaagcctgacttcaaagcaatcaagaagaggattgaagatctcatcacgagggattacctggagcgggacaaggacaacgccaacacatacagatatctggcttgagggcagtttggtggtaaaatggaaggcatggttactgaccttccgcttgctagagttcatcaaactatgcttcaacatgttgtattgttgcatcctgttttgaatcctgcggtagacatggctgtgactgtcttgacaactggattctggccaacctacaaaacttttgacataaaccttccgtcgaggctggtgaaatgtgctgaatttttcaaggagttctatgcaacaagaacaaagcacaggaagcttacctggatatactccttggggacctgcaatatcagtgcaaaatttgatgctaaaactatagagctcattgttacaacatatcaggctgcactgctgttgttattcaatggatctactaagcttagttactctgagattgtaacacagctgaacctgtcagatgatgatgttgtccgtttgctccattctctctcttgcgcgaaatacaagattcttagcaaagaaccagctggtagaactatttcgcccaatgattcttttgagttcaattcaaaatttactgacaggatgagaaggatcaagatacccctacctcctgttgatgagaagaaaaaggttgttgaggacgttgacaaggaccggaggtatgcaattgatgcatcaattgtgcgtatcatgaagagtcgcaaagttatggcccatacacagctagttgcggaatgtgtggagcagctcagccgcatgttcaagcctgacttcaaagcaatcaagaagaggattgaagatctcatcacgagggattacctggagcgggacaaggacaacgccaacacatacagatatctggcttgattagtattggtggtaggttgcaagcttgctgatggtggcagctgccgtgtcacgttcatgatacgctccaatgacttgctgcgatgttgcagcttattttggggatttcggttgctatcttcccgggctggtctcattttgtacatgggtcgtcagaaacactagtaggcaactctggattagaggaggcacctcggtaccactgaattatccttctcttgcagtgctttttaagtatgacttagatctaataccttatctttcgtaagtgggagctgcctactgtagtaggaatctactccctctgttcctaaatacaagtctttttagagattccaaaaaaaaaaaaaaaaaaggccccta

SEQ ID NO: 11846 - DNA, 1263 bp, Triticum aestivum
  Clone ID: PAT_TA_11846
gccgccccccgcgcaggtgcggcggcgggctgatgggcctgagaatgaaacgcgggtttagttttgatgctatcctgtggacgcaacggacctgcccctccctctgtggcccctgatgtggttgccgggctttgcgtgctgtcttggcctgctgtccgttcggctgggccgtgcgccttgtcgtttcctggggtggatggggatggggggccctccggtccgtcctccccgcgcccttctgctcctctggtgacgcccggatcgtccccgttccgccccgtgtcctgtccgtccttcggctgtgcaatacctcccagtgttggggcttcactacttacctgtcgtgaggctcctccatcctgttcgccctctgtttttttgccccatgattcttttggtattgtgtatggtatgcggtgtgaactgtgtgattcagtagcaaccagtagtgctgtatttttttgatggtttgtgcctctttctgtgttagcattgtatgacttcacagcaggcggcgatgatgagctgagtttaaactctggagaagatgtggatattgaatatgaggttgatggttggtacctcgtgcgcgaaaccgctccaggaagggatgggaagatggcaggtctggtccctgttttgtacgtgagctcgtgatagcaatgaaccttgtgacatactactctgaagagctgggtgggagcaaatgggcctagtccggaaacgctggttagttttgatgctgtcctgtggaagcaaggacatatccaaccctctccgtgtgtgtgtttgtacggtgcggcggtattgttgctggtctctgtgtgctgattttgtttgctatacatacggctaggccattcaattcattgtttacatgggtggataggaatttgggacactccattccatcttgcatgcgccgttctgctccaccggttatgcttggaaggtttcggttacaccccgtgcccagttcttccatcggctgtgcaatacatcccattgtaattgtataactatttagctgtgaagaggctgttgtaaactgtaggctcaatttttttaccctacgattcttttggtattgtggatccgatggtgtgaactgtgtgattcagtagcatgtaggagtgctgtattttttttatggtttgtgtaaatttttgttttccggtgtatctaggatacatgaaaatataccatagtgaaaacaacaggcacctgatattttactctttttcgccttccctaaaaaaaaaa

SEQ ID NO: 11847 - DNA, 878 bp, Triticum aestivum
  unsure (1)..(878): unsure at all n locations
  Clone ID: PAT_TA_11847
gagagagagaagtgtgagctctgaagaagagctgcagagtagacagaccatcaacgagagtcaatgggcacttgtgtgagcacatgctacccctgctcgtcctccccacccaccgccggcgacgaccacccattgtcctcgtccggcggctctccgactccgggcgccaccaccgtgcatccgctcccgctcgcttccggttctcccgcgcccgccgcttcctccacatcaacctcctcctcctccttctcctcgatgtcggccgcaagctcatccatctccatggccaacaccaccaccaccacctcctcctcctcggctaccactagttattcctcgccgtcgttgtcgtcggagccccgcttctcggccgagttcctcaaggcgcgcgcttgcaaggacacagacgtggagatggaggtcgtggtgctcgaccccaacatcagcagcaatggaaagaagaggaagaagctctcccctgcctccgccgctccgcgtccgtcctcgccaagaacgcctccagctctgtccgtgggcaagtcaccaaggaagaacaagcctggcattggcaacatcaacggccgccgcgcaagcaacatgatttggatgatgaaaagctgacggtgatcgtcgagtcgtcgtccacggaagcgacatgctgaattattgctcattttggctatgtgcatcctagtatgcaaaggccgggatgaactcttggcggccgctagctcatgaccagccaaaatagctaatatatttgttgaatttgattgcgattttttttttctgtcgaactctattgcggcagtaagtggctgcatccaacgtctgtggttaggcttctattttctgttaggataatgtangaacactag

SEQ ID NO: 11848 - DNA, 1016 bp, Triticum aestivum
  unsure (1)..(1016): unsure at all n locations
  Clone ID: PAT_TA_11848
gcctcctccatgttgtacgccgccgtggcagctccgcggaggcacacggaagctcaacgcgaggaaagcccgagctcgacgccctccacacagtagcccgcggagcgcgcccccgccatgagaccctgccccttcggatgcgcttccgaccgcccattcccctgcgcctcctcctgcctcaactgtggcgccgcccttcgcttcctcccgcgcatctgcctaggcccatatcctcatatccctccgcggcagccgtggcggcggcaacggattccgaggaggatgccgtggttgctagggatccacggctagcgcctcattttgtgggcggggcaggagggtcgcctaggtttggggagaacaagacggagttcgagagaaaggcctcgattgccgcgcggttcaagctctgctatgaactgctgcggcagaggaggtggcgggagatgcggggcggcttggcgcagattgtcagcgaacaaggatccgggtctgcagccactctctgtgatatcttgtggagtgagttcagagagtatgattccagcggtgttgtatgggatgctctagcaaatagttatgcaagaactaagatggttcatgatgctctttacgttctcagtaaaatgaacagcctgaatatgcaaatatcagtttccacctatgatagtttattgtatggtctacggaagacagacgtggcattggagctttttgatgaaatggaggcatatggtatctctcacagcgaatattcacatagcattctcatcgatggcctctgcaagcaaaataaagttggagaggctttatctttccttcaagaggcaagggaagggggaacgtttagaccattgggaatgtcctttaacactctgatgtctgcattgtgtaattggggatttattcagcctgcaaaatcgtttttatgtctgatgctgaagtatggattaaaccctaacaggtatacctattctactcttatacaggtnctgtgtaaagtaggttccctagat

SEQ ID NO: 11849 - DNA, 1537 bp, Triticum aestivum
  Clone ID: PAT_TA_11849
tctcaaattaagatagacgttttggatttcctccctgagggaacaactgcatgctaccaacgcgaaattgttcgaatcaatggagctgcggttgaagcaacaaagagcatcatgtcacgcagggatccaagccgaaacaccatccacctcctgtccatgaagttctttttgagagacaatgacaccatatccattggacattctgttggccagatcatggctacccacaaggttgagatagcccaattcgcaattttgacagaggcgcattactcctgccgcggcgatgatgatctggcctcccacgcgtccgattttatgttgttctttgaagcttgcccgggtgcatttggtggtctcacgcgcctcaaactgcaggatttgagatttggtaaatcagacatctgtaatgtcctccttacctgcaagcaactaaaacacctacgcatgttcaattgcgactcaggggtttggaccacactgcaagttgaacacctggagctcagtgagcttgagatcgttaattgttcatttagaaaagtcgtgctcatctccctcccaaaactcacacagatggcctttcatggttggatcgctttccaagatccactatcagttggtgatgtaccattgctcgagactgtagatctcaccaatgtttgtcttagtagccacaaaatggtcaagttaagtaagtttcttggcggcacctctgtgcgtaacctgaggttaggatttgagagcgaaaagatttgggtgcaaccagaacatctgacgagacagctggcatccgtgttctaccagctaacttttgtgcatatggctgaaattccagaagggtatgacctctcctggtcattgttcattcttgaagctgcgcccaacttgaaggagctatatttgacggtgtgggatcatttgtgtacaatggaaatggacagggagaagaggagggcactctcgtatagcataaggaagggtgtaaggtgggaatcatctgcatctcgtttccagcaccggagtctggaaacgctagtaatctttggttttgaatctgaagaatacatgctgacgcatgtcaggtgtgtcatggaagccgcggtgaatctaaagaatgtgttcctatacaataggctggcgtgtaagatgtgccgcgacaaccctctgccgtccagcttcccctttgctgagactaagaagcttttggtggagaagataattaccagtgggatcgattcagctgcctcaattcacttcctggccggcaaagctatatgggcttctcatgttgcaaagaagaacttcccatagtgtctttagttcaagtttgtgttgtaacttgtaatgccctttgtgccaaagctgataacataatttgagtcaactttagtattccttgattgaatgaagtgtaagtttaatcctggcagcattttgttttatcagtaagacgggaacatatgctcctttttgtggtcaattaatgtgacctggaactaacttaacagtttaacatggagaaaaaaatactctgccc

SEQ ID NO: 11850 - DNA, 1021 bp, Triticum aestivum
  unsure (1)..(1021): unsure at all n locations
  Clone ID: PAT_TA_11850
ctgcggggcgcccgcgggcgtggtccgccgtcgtggatttggcgtggtgttggtctgcttcttcagtggggttcatggccgacagcggcgggggccctccgcccccggccgggagacggtggcgatgtatgggtttctttcagaggtgaggttgccagggcggtcgctctctcctcgacaactggttcaccggtccaagcctgcccccggctgcgcggcctccccggccggtcgggcggtgtccgtcctccccgcgcccggggccggggcggcccgctgcggcggcgcactaggtcgggggaccccctggcccggcgaggccgcgcaccatggtgccccccccccggccaccgtcgcccctgttcgcgggcgtctccatggcctgacctctatcccccccgccgccccgatctccgggcgaaagcctacaatctctggatttggggcggcgttggcgcgtcagcgtcatgtacttctttgtaggcgccgtcttgggtggatcagcggtcttgggatttggcgtggtgttgatcgcctgcttcaataaggttcatgctccgacagctgcggtgggcttctgggtcttggccggagacggtgttgatgtatgggtttctttcagaggtgaggtcgccaaggcggtcactctctcctcggcaactggttcaccggtccaagcgtgctcgggggtgagctgctttgcctgctgatgggtcgacgtccttcgatccaggacgagagggcgggggtgccctcttcggcggcagattcggatggtgaaccgagtggcctgcgaggggacgaagcatggctctcctccggcgacgattagctcccttgtcgcgggcgtgtccatgtcattatctgtaaccgtcgtgggctctgaagtacttttgggttcttcagagntcgttagctgttccgtagtgctttgtatccgtgtcgattgtattttccgtttcctgttgtcctgtggttgtaacgtgggtcattgctttatatataaagcggggcgaaagcc

SEQ ID NO: 11851 - DNA, 1039 bp, Triticum aestivum
  Clone ID: PAT_TA_11851
cattgttagagagagtagtccgcccaaatccatcaaaaatccatcgcgccgtcctcccggaagacaccggcggcgcaacgccggtgtcccacggagcccaatccatctctcttcaccggttcacggcctgtggaaagcgaaagtggttgttagggttttgccggcgcctctccgatggcggaagatgctggtagtcggattgaggtggccaacctcctttccctcggcgaggacctcgtcggggtgctcgtgggcatcaaggacggcgaagcccttgcgcaggcctgcgacggggcacggatgctgcgctccgcctgcagatccgagtccggggacctcgagctccaaatcaaagagtatcaggaaaaaataaactccttcaaggaaaagttagacaaggcaaaagctgaaacagttactgatgaagaactgaacacgctacaaaatgagatggaggagaaactccggggggagcaacagcttcgccaagacttaagagcggtgagtgatgagcttgataacctagaccgtcaaaggacttctatagaagaaaggaaggattctgtcaagaagaaggagaaagacatgctgaaggcacaaagtatgctctccatgtgtgtgtcagttacaaatatgatgccagatttcgaagatcaggagaagatttctggatatattgttgacaagaacaggaagaagctagataagttcgaatttgggaagacaatgtcaccagttgagatctgcgacaagctttggaaaatgatttagggcgtggtacctgcagattgtagtcattgtacattagctctggtgcagcatggtggagaaggtggaccggacctggacgaggctgcatctgcaaccacttgaacctgatgctagttatctgacgtagtctagttccttatgattgtacaccaaacaaatgtcagttgtacgcctgtttgtagctactgcccctggtcctggcgagacctctactgctatgcttgtttcaatccatgttgcccctttgtaactctgctgatgtaccctt

SEQ ID NO: 11852 - DNA, 1344 bp, Triticum aestivum
  Clone ID: PAT_TA_11852
ggagaccccccttccccaatttttggtaacccttttttttttttttttgagaaatctgaaaaacgcagggttactgcttggtatgccaccagaactggccggccgtctgctttagcgacaacagaggatgacaacactgaaattacttggcgatacacaaagcacaatcgggttacatgagcaacgccctatcgattttacatgagtagtactccattattgaagtaagaagtaaaggatttcgctatgctccttgcacggtagtactactctgtgcagtttcttacttggatcttttcattagctgctgactctgaggatgctgatgacggggaggacgatggtggacaggatcctgggccacggcagtcgctccaggaagtagatccggtagccgaagtggttgcgctgcgcctgtgctgccctcgcgcgatcagagttggccggccgaccccagcatcgtcggcatccccggccaccgtgctcacttcacgcgtagactaagctgcagcctcaactaccgcgcgcccgccgccgatttcgcgcacccgcaggcggccaccctcgtccccagcagcagaactgttggaacatttgatgcgacgttggagaggatgaggatgacgaggccgaggagcgcgacgcctctggcgctgtcgatccgcgagtagggctccaccagctcccacatcgtgttgggtatgccggtcttgttgaacccgtccaccgtgatgaacatcccgcagaagaagatgagcagcgagtaggacaccttctcgaggcaggcctgtgcgtcggtgaaatcgagcgcgaggagaacgagagcggcggtgatggcggtccaggacatgttgagccccatgaggagggcgatgagcatgccgagggtgatgaggtacacggccgtcttccacaccagcaccttccacctcttctccacgacctcgggcagctcccccttgtccttgtcgccgttggcggcggcctcgtcgtctgtgggcgacgacggcggcgcgtcctcgatgatgacgctcctctgctggctggcggtcctggtgaacttcctggaggaggcgccgtcgatgaggacggggaccgtggagacctcgaccatctcgtgcgacatgctggaggagcggagggacctgatggagaactgcatgtcggcgtcggcggcgttggcgttggagttgacgctcctgctgcgcaggtggtcgccgttgacgctggcgctcctgatgatgggctcgctgacgcagtcgaagtcgtccgggttgatcgaggagacgtgcgacatccttgcgggcgtgaagcggtgcgaggtgacctcgtcgtcgccgacga

SEQ ID NO: 11853 - DNA, 920 bp, Triticum aestivum
  unsure (1)..(920): unsure at all n locations
  Clone ID: PAT_TA_11853
gctcagataatgcaaatttgtttcttcggctttgggggttgaacaattaaatgatcaagaaatactagtgaggtttgctttgcctggctttgggaacaaaacagttcaagagcaggaagacattttagcttacttgtatgctaactggaaagatctgcaacttaattcagctgtagtaaataccttgagggagactaattttgtgacaaatgcaaatgagttttgtacagagctgttcaaaccaaaggaactgcttgacccttcagatgctttgctggcttcagtattttctggggagagaaataagttccctggcgaaaggttcatgtcagatggttggcttggtatactcagaaaagtgggtcttcggatatctacagaggctgatatgatagtacagtgtgctacgaaaatagaaacaatgggaaatgatgtgatgtcatctttagagaaacatgatgactttgatgcagacttgccagacagaaaaaatgaaattccttttgagttatggtcattggcagaatctgttcgtccggtgattttggcaaattttgctactttgtacgatagcactttttgccaaaagatcggaaaaattgtatttgtacctgcagaaaagggctttccaagtattggtggcaagaaagggggtagaagggtatttgcatcttatagtgaagctatcttattaaaggactggccattggcatggagttctgctccaattcttgccaaacaatcaattattccacctgatttttcttggggagcatttcagcttcggagtcctcctgccttctctacagttctaaagcacttgcagactgttgggagaggcaatggtgaggacacacntgcacactgnccatctttatcaggcataatgacagtagaggatgcctttctcaggatcttgc

SEQ ID NO: 11854 - DNA, 715 bp, Triticum aestivum
  Clone ID: PAT_TA_11854
ggcacgaggacaaagaagccccacggtacaaggagcgaagaagcgagcccaaaccattttacccaacacgtccgcctcccctccccactcccaaaaccccagttcgagcgcggcgccggagcgcagataaatagctccccgcgaacacctccatctacggcggcgatggccggcgtcggcgccgatggcggaggagacacggagatgggcggctggtcagagctgctcaacatctccaccaagctcctcgagcaggccgcccccacccctcacttccctaccctccagaggaacctggaccagctcgaggtgctctccacgaagcttaaggccaagacgatccgcgccgaggcgccgtcgcagtcgctctccgccaccaggttgctggcgcgcgaggggatcaacgcggagcagctcaccagggacctcaagtcatttgaactcaagaccacctttgaggatgtttttccatcggaagcaacttctgtcgaggaatacctgcaacagcttcatgaaatggcaattgtctcatccatccaaggagcacaaaaggacaacttacagagttttaacaattatatgatgcaagttcttgaggatgactggcagaaggagaagagagatttcttgcagaggctaagccgactttctacattaccaaagagaaacacccatctagctggggggctggctcgtatgctctgagccctttcag

SEQ ID NO: 11855 - DNA, 738 bp, Triticum aestivum
  unsure (1)..(738): unsure at all n locations
  Clone ID: PAT_TA_11855
ttcggcacgaggnaaccctttccccccgccgtctcctccccgcccctccccaccccacccccactcccaacgcgagcggcggcgatggccaagaagctcgggaagaaggcccgcaagttcgcccacaagcacctccagggcggcgccaagcgcagccgcaagctccgctcccagttcaaccgccgcacccggaaagatgggaagggccgggaggacgacaaccgcctggacggcgacggcggcagcgaggagacccgccgcaacgaccccaccatgaacatgaacgatgatgtagctactttggctaactgtttagagtttccagaagatgagaatgaattagatggggatctatccgacagtgatggctatctttcagaggatcttgagtgtgtgtactactctgacagtgatgatgataatgttatgaaagagtgtattgtacaagatgatctcgacgaacagaacaatgagatgcgcttggctgtgaaaaagcaaaagaaaaagttgaagaagttgttggataaggaccctaagtttgcaaacttccttgagaaatggcaattggaattggtgaactatgaaagtaaagaagattcagatgaacaagatgagatggattctgtggacaacggggtcaattctggtgataaagatcctcctagtgataagatccttacaagcaagacaataagtgaatggtgtcaactagtcttagatgaacctaaagcacctgct

SEQ ID NO: 11856 - DNA, 500 bp, Triticum aestivum
  Clone ID: PAT_TA_11856
ccgccgccccggcgccgcccgcggcccccccgccgccccgcccccgcgccgccgcgtcgccagctggccgccccgcctcgcctgcccgctcccctgcccccccccccagccgcgcctgccgccggcccccccgcgtcccccgcggccgggccgccgccggccggcccccccgccgccgccggcgcgggaggaggtgggggcggcgcccgcggcctgcccgcgggcggggccgggacgggcggcgcgccgtgcggggcggccgcggtggtcgccgtgggcctgcgggcgtggttcccggtcgtggtgcaggcctgcctgtccggcggcagcggcggcggccccgccgccgccgagcccttcgacgacgacatctggcggatccaccagatctacgagatccccagctacgccgccaagtgaagaagcgacggacgcaaaatgcgggcggcattccaccacttggagagagaaactactactaatctatgaggttaccatct

SEQ ID NO: 11857 - DNA, 650 bp, Triticum aestivum
  Clone ID: PAT_TA_11857
aagaagagcactgaaaaagcccaaggctcctcctgcagtggaaccaccaagaacaagcctgtccaagaggccatctcttggagcttctgcaaaggtccagtccagggcatcacatcttccctgctgcatggcctaaaactctgggcatgaacgagacggttgagcttgcccacaccttgtgccacgagatgcatgtctggtttctgaaatttgtgaacgaggccatggatgtgggcttccacctgtttgaagaccagaacatcgcaactaggggaaagcagagcggccatatcacggtggtcctgtcgcagttcaagaggatcagcgactggctggacggagtcggcaagatcgccgacgaggatgcgaccaaggacaatgtggagcgcttgaagcgcaagatctaccagttcgtcatcagccgcatggggtctgccttcgagagctcggtctcagtttcagcaaagagctgaccggatgcttcaagctctgaagtttctttcttagctcgcattttcattattttgtcaggatgagaccacaattgggggttgtggcaatggtatagatcgttttcatatgtcttgctctgtgaataagttagactgtgtgtgacctacaaatgcctcgtgtgtttcagttatgaatga

SEQ ID NO: 11858 - DNA, 772 bp, Triticum aestivum
  unsure (1)..(772): unsure at all n locations
  Clone ID: PAT_TA_11858
gcttaaccgccagnatacttccgttttcaaatgcattttacagaggacttagtgatctcatctcaccatcttggctgagcttgtttaatgcaaatgaatttaaccagttactttcaggtggatctcaggattttgatgttgatgatctgcggaacaacaccaagtacactggtggctataccgagtcaagtcgaactgttaaactcttttgggaggttatcaaagggtttaagccgacagaacgctgcctgctactgaagtttgtgacgagctgctcgcgagccccgttgctcggattcaagtacttgcagcctggtttcacaattcacaaggttccatgcgatgtgacactttgggcttcaatcggagggcaagacgtggaccgcctcccatctgcttcgacatgctacaatacgctcaagcttccgacgtacaagcggtcgagcacgctgaggagcaagctgctgtacgcgatcagctcaaacaccgggtttgaacctgtcgtaggcggtggaggtacgtttgcccgtgcgtgctctgctgctgtgaatagattggagagaggtgcagcgaaattgtatcagaaacctgaacatcttgccgtaaatgtattgttgtgcttgatcactgatttgttttgggtggagtggattgtcatgagccgatgttcgaccccttttttgtctacctttgtggctgatttttaactacatatatattgtatataaaataagcagagcgcaacacggtatgaaaattgtcggagacttnc

SEQ ID NO: 11859 - DNA, 638 bp, Triticum aestivum
  Clone ID: PAT_TA_11859
acgcgtccgcggacgcgtgggcggacgcgtggggggaactagtacggtggtactgttacgctgtatcaagagttaggcggaggattacaggttactgtcatagcaaatccaccatcaatagtgaacgtattcgtccggtgggcttgccgatttttactctcctccgtttcgcacgcaataacaaatacgagaggagagggtcgggaggagtcgtctcgcccttcctcttcttccccgcggccgtcgtcgtccgcgtccgccagtccacgaccagcgcacccaccgccttttcaacggaatgcccaagaagaaggccgcagcgagcggcacgaatcgctgcttcggcgacgacatcctccggcacgtgctgtcctatctgccgctggacgatgccctgcagacctgcgtgctcaacaccaggtggcgcgaccactggaggcacaccaccgacctgagcctcatctttgacgacctgagcttcgagcgtttcaaacagctggtcaagctcttcatccagctccgcggggactcgcctctcgacaagtttgtgatcctcgcctatcctgagagtgacgagtgcacgtacacaaacaccatggtggtgatcgaggacgctctgaagtgccaagctaatgagc

SEQ ID NO: 11860 - DNA, 1102 bp, Triticum aestivum
  Clone ID: PAT_TA_11860
ttcggcacgaggcggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagcaccgacctactcgacccttcggccggcctcgcccgcccgcgccgctcgcggccgggtcgtgtttccggcatcgttactttgaagaaattagagtgctcaaagcaagcgatcgctctggatacattagcatgggactactattccgcactcacgctgtccgaaatggtattcttggagaagtacatatgccctcacaagcaagctgcgccgtaccttgctgaagactatgatgatgcttgcagaggacaagtgcccgatagattcagatttgcatgaaccaagaacaaggtttcccgtttgtctactaaaagtgtttctttctcctaatcagcgtgcccgctcatacgccataccgaacccgtctctgttgtagtacctcgtaacaatgagctatatactgtctcccttttgacccttgtgttggcatacctaagtttaccagtattactcatggatgggccgggtactggtatatggaactcgatgtcaggttagatatcataagcgccgcaatgccttccatcaatgatggtgttccgtgtctccaagtccgatcagggaggcgccgcgcgagtcgaatagctagctaggaaaccgaccggggaggtttattcattacctgaccggaaaccccgtccgtccatttgtgcggatcacagacttacttatgggatattt

SEQ ID NO: 11861 - DNA, 755 bp, Triticum aestivum
  Clone ID: PAT_TA_11861
gaggaaacgtccttaaaggaatatatcagtttattctcattttgattcaacagcagtcctaaactttattctaaatttgtcgattgaagaacaaaaccttgtgaggcgctcgctcaagcaatatactcctcgtattgaggttgatctggtaaactacttgcagagcaagaaagagcgttcacgtcccaagtcttatgaatatgaacagattgattttggaacttctgaagatggttataatctgacatccaggaatagctatccttttggacgggtctctgctagttcctttgacaatgaatctgggaagaggatgcacgcagttcaagatgtccacactgatcatgctaatcagtgttttgagccttcttctgaagctgaaatttttacagcaagtcgggagtcaaagagcaatgctcgctcagttgtagaagctgcacgctcatgggcagattatcctgaaaaatcagatgccaccattgatgatgaaaattctgttggcacccctcgccaggattttggccgtcatgtctctgatggacataataatgctgcttttacaactgttgggaaaaatatgcaagacatggatcaatttgtcgaccttagttctgtgaaggttgtctcacatacaactaacagccccagcataccacaacttcttcatcagataagtaatgatgggtgaagtttcatcccaagacaagcaggacgcattgcagcagttggtgcaagcatctgcgaacatgataact

SEQ ID NO: 11862 - DNA, 1063 bp, Triticum aestivum
  unsure (1)..(1063): unsure at all n locations
  Clone ID: PAT_TA_11862
gcacgagggtgccggcgtcgaagccgtacatcacgctggagggcgccgggcgcgacgtgacggtggtggagtggcacgacaaggcgagcgaccgcggccccgacgggcagcagctccgcacctacaacaccgcctccgtaaccgttctctctaactatttcaccgccaaaaacatcagcttcaagaacacggctccagcaccgatgcccggcatgcaagggggccaggcggtggcgttccgcgtctccggcgacaaggccttcttcttcgggtgcgggttctacggcgcgcaggacacgctgtgcgacgacgccggccggcactacttccgcgactgctacatcgagggcgcctgcggcttccgccccgccgaccccccctcccgccaccccgggccggcactacttccgcgactgctacatcgagggctccatcgacttcatcttcggcaggggccctgcgaacgcaccggcttcgcgttcgtcaactgccgggtgaccggcacggggatgctctacgcggggcgagccatggggcagtactcgcgcatcgtctacgcctacacctacttcgacaacgtcatagcgcccggcggatgggacgactgggaccacaacagcaacaagagcatgacggcgttcttcgggatgtataagaactgggggcccggtgccgacgccgtgcacggcgtgccgtgggcgcgggagctcgactacttcaccgcccgcccgttcctgggcaagagcttcgttaacggattccactggctcacaccagatgtctgaactaccagacagtttccagcaccacagattcagcagacaagaaacattcgtactatacatcacaagcatacaagagtagcacagatataaaggaactagtacagtatagttactcgtttttcatcgatttaaacttcccagtgtagttactagttagtattagaaagcacaggcacagctggccttgtaccagaccaaattgttcatgtaatcttcaaaactaaacagcaaggatgaattcgttatacgcctgcccatatatgcatgnnttgcagggg

SEQ ID NO: 11863 - DNA, 467 bp, Triticum aestivum
  Clone ID: PAT_TA_11863
gcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatctatctcagcttcatcagttaggggcaatcaatgtagtagtagtgtaacgttgatttgcatcttatcttatctgtgggaaaattgatcgaatcgaattgcaggagctatcttaattagcttcatctgttcggatcatgtgtcaatcatattagctgtgatgccaaaaaaaaaa

SEQ ID NO: 11864 - DNA, 796 bp, Triticum aestivum
  unsure (1)..(796): unsure at all n locations
  Clone ID: PAT_TA_11864
cccacgcgtccgcgcgcggttgacccccacaggccactagtaaaggaactccccaccatcctcctcgctgttcgccgccgccgccgcctccctccgctaaatccccaccatccctcctcgcgccgcctcggcccccctccgcagctccccactccgccctcccggcgcgccactcaccgtcgactcgcgcccggaaccctaggcaagcaacggcgatcgccggccagcaggccatggacggcggcgcggcggagctgcgcgagacccaccgcctgacgggccacgccgaccgcgcctggtcgctcgcctggaaccccaacccgggccccggcgcgggccccgtcctcgcctcctgcggcggcgacaagaccgtgcgcatctggaagcgcgcccccgacggcgtctgggacggctccgccctgctcgacggcgtgcacgagcgcacgccggagccgttcccccttgctcccccggcggaagcaccgggcgaccgcgaatttcgatggcaccagccgtctgtgggagctcggatgcggtcgacggcgtgcacgaacgcacggtgcggtcctgcgcctggtcccccgacggcaagctgctggcgaccgcgagtttcgatggcaccaccgcgatttgggagtactccggcggggacttcgagtgcggcgacgcaacgagggggagtgtgtagccggtctagagcgtgtcgctcaggacgtgaagatggtccagtggcacccagtccttagtgntctggttnctgtcagctatgacaataccatcagggtctggggctgat

SEQ ID NO: 11865 - DNA, 732 bp, Triticum aestivum
  unsure (1)..(732): unsure at all n locations
  Clone ID: PAT_TA_11865
ccattggaagggttntcaaggntaagttggtacccggttttccntcagagtttaangacgcnttggcgnggtatangatcatttaggggattgtacggccccccggatgcgcctttatagggacggatcatccaacgccccctcgcatttgcacagccccgttcgctggcatccagatcacccatttcgttcctgcaatcataacaagttcgttcgaccggcccacaaattggttcagatcaagccctgcgccatcgccatgtcttcgacgacggcggcggcatccgacgtcgccggcgtctggttcttcggcaagctctccgccgccatccgtgggaagaagcggcaggccgtgccgacggtgagccacgccgagcaccaacaccagatgggaggggccggtcatggcaagaaggcggccgcggcggcgaagccttccgtcgtcgaccggaaggaggccggcggcggtgggatgtcggacgcgacggtgtacctgctgctcgaccgcttcgcacccagctagtgctcgctcgtctcacccacccctgcttgctcgtgtacctcgactgtatatgtaactacgtttcttaattccgttcttgtactgagacattatgcagaaactctggttgaacttttcttcaaaaaggcacctctcccgcggcggcccccggcccatgcccccccatgggctcctttgcccccccgaccgcgccgtttaaacncnnaggg

SEQ ID NO: 11866 - DNA, 1100 bp, Triticum aestivum
  Clone ID: PAT_TA_11866
tgtcagggtctatgcgtcaaacggaagagctttggattgacaagtataaaccactctcatcgggagagcttgctgttcacaaaaagaaggttgaagatgtaaagaactggttggaagaaaagctgaaggcaccaaagggaacatttggaggacggagtcttgtccttactggccaagctggtgttggaaaatctgcaactgtcaaagcgattgctgctgaggtaggagctgacttatgtgagtggacaaccccagtaccaacactatgggctgagcttgtgcatgctaattcagaacttgagtatgtatccaagttggaagaatttgaaaattttgtgaacaagataaggaaatactcattgctttctccaaccagcattggatcccaaagaaagctaatcatcattctgattgatgacatccctgtaacaagtggaaaagcttcatttgcaagactggggaaatgtttaacaggactaattcaaactactcaaataccaactgtcatttcacttactcaccatcacaaaaatgaggctaatgatactgcaacgtggaactccgaggaacttgagtccttgcttcaaggtgctggtgctcataagattgttttcaatccggtaaccgtaagttctatcaaaaaattcttcttagaatatgcaaacaagaaagctctggcacaactgaagaattagtgcatcagatcgctacatcttgtggaggtgatatcagacatgcgataatgtctcttcaatactattgtcttaatccacgaaggcttgattctgcattggcaataagtgcttctctgtcggagttaaagggtcatgctactctagctccagcgcaggactgttatggccttggctctgtaattcattctccatgcggaagggatgagacacttacattatttcatgcattagggaagtttttgcacaataaaagggaaacacatggtgatgtcaacattgatctggattcattttctttcaaagaacagctaagaagaaatccactaaaaatggatgttccagagatgattctttctcaagcacacgggaaaagtacggactgttgctgactttctacatgaaaat

SEQ ID NO: 11867 - DNA, 811 bp, Triticum aestivum
  Clone ID: PAT_TA_11867
gcacgagccagccgtcaccggagaagcaacgagatgcacggccagcctcgccggccgaagcagccggaggacgacgcggcggcggcggcgaaggccgccaagctccgggagctccaggtccaggtcctccacaaccaccacacctgcacgtacaccgaggaggcgctggggctgagcttcaagcttctcgagataaacccggaggcctacacggcgtggaactacaggaagctcgcgctgcagcacaacctcaaggagctttctgatccagaggccatcaagtcttccgtcgatgccgagctcagagtggtggagcttgctctgaggcagaacccaaagtcctatggagcgtggtatcatcgcaagtggttgttgaatcaaaagcttgcccctgtggatttcaagcgtgaatacggcctcttggataagctattaaaggtggatgcgaggaatttccacggatggaattaccgcaggttccttgcaaaatttatgggggtgccagaagagaaagagcttcagtacacaatggataagatcagtgagaatttcagtaattactcagcatggcataatcgtagtatacttctgtccaatctgctaatccaacgaagtgaaggttttgagtcaaagcagaagatcttctcagaggagtttgaacttgtgattcaggcactgtttacagaccctggtgaccaaagtggatggttctatcacctctggcttttagctcagacatctacccctgataacccacagctgatttcatcttggccttctaatggtgcaaagctcagtttatttccgacca

SEQ ID NO: 11868 - DNA, 520 bp, Triticum aestivum
  Clone ID: PAT_TA_11868
gccggtgcggctcgccggttcccctcctggtctcccctcttctatccgagctcggcagagagagatgtatgtgctcgtgacatctatctacggcatgtcgccatgtcggggtcgatgatcaggtcattggccggtgatatatagcctggtatacattggttgcttcttcattcctactctctttgtttcagtcgtgttctgcaggcgtacgattctgagcttctttgatcttgaatccgtgtgtgaaggatagatcagatgcgctcgatgtccggggagcggtggcagcgcgcgcggacgtcggcaccagccagggagacgatgccgtcggtcgccgagctagtagggtagaagaagaaataggtcatgttgctagcagcttctgttcatttatttacttctgtcgatgttacggtcttgctgttgtttgatgtgcttttttgtaccctccttttgtgggcgtagctaggtgtttcttgtcggtgttaatcgagatcgttcttctggaccaaaaaaaaaa

SEQ ID NO: 11869 - DNA, 509 bp, Triticum aestivum
  Clone ID: PAT_TA_11869
ggggaagagcagatgaaggggccgtgccccaggagaatcaagctctggacttgggagggcgtgtggtcagtccggatggataagcgggatgggcatgatgcaaagtacctgatggacgggtgggacgacttcgtcgacgctcatggcgtggaagcagacgacctgctaaccttccagatcgtggagcctgacggctggtatgttcgaatctacgctccctgtggcaaggagaggccgattggacgactgctgctctagccagcgcatccgcccacgatgattcgccgggatgctagtatcgtagactgtcgtagtatgctatgttctcgtatgtgatgcctcgtgctttactgttttatgttctggtatgatctttgctgtcctagtaggctctgttctttgctgccaggttatcaagttacttattccgtgttgatctatgtaacagaactatgatccggaaacatttttcagattttatgtgtttcctttcaatattaaaaaaaaaa

SEQ ID NO: 11870 - DNA, 674 bp, Triticum aestivum
  Clone ID: PAT_TA_11870
gccggcgtcaagaagatatgattctcggcgcggggcctatcgtcatcggccaggcgtgcgagttcgactactccggcacacaggcttgcaaggcgctcgtcgaggagggatacgaggtggtgctcgtcaactccaacccggccaccatcatgaccgaccccgacctcgcccaccgcacttacatcgggcccatgaccccgccgctcgtcgagggcatcatcgccaatgagcgccccgatgcgctcctccccaccatgggcggacagacggcgctcaacctcgccgtctctctcgctgaatccggcgcgctcgatcgcctcggtgtgcgcctcatcggcgcttccctccctgctatccgcgctgcggaggaccgccagctcttcaagcaggccatggaccgcatcggactcaagacgcccccctctggcatcggcaccacgcttgaggagtgcctcgcaatcgccaaggacattggcgagttccccctgattgtccggcctgctttcacacttggtggcactgggggaggcatcgcgtataacagggccgagtttgaggacatttgccggtctggtctggcggcttcacacacgcagcaggtgcttgtggagaaatccctgctcgggtggaaggagtatcagctggaggtgatgcgtgacatggcggacaatgtg

SEQ ID NO: 11871 - DNA, 967 bp, Triticum aestivum
  Clone ID: PAT_TA_11871
tcggcacgagggtgaagttgctggaccatcaacagcgacccttgacgcgacggctgccgtctgatggaagatcaacgtctctcagcagctgcctctggtgcgaacctgtaagtggaggccagcgtcgttggatgtgaactggatggtggagtttgaatcaacagctgaagcgataacctgcagttaactgaagatgggctattgttgatcttcagataaggggcctgacagataacacgcgatgttttcactagtgacaagtctaggatgtgtatgcttcatgcaatcaggcagtacgatggagataagatgatgtggccattgatgaaaggttcatagtctatttaactttcttacttctttcataaatttgtcggatgagaattttcgcagccagagcttgcatgctgttttggctttgaaagctgcagaaaaacttggccactttttggcaaacagctggtgttgaggtatttcgtttgcatgacgagcacggaaattgtggctgacaatgtgttacgggctactctagaagaccatgaggaatgagtgttattgtcgatgcttatgtagtgtgcaaattgttcatcaccttgtgagggtttggatggtatgtttaatcatccaaagcgcttttatttttttaaaagggaaggggcggccgatcccagcccgtctacaacccacaacgggcgttacgtgccgtttgcaacattagcactacatcggctcctcccgtccacaataggcattaaatgaggcgacgtaaataccaagcaatatagcgtacgtctcatatcctcgaacgagtggatggctcgtgataacatgatcaggcgagctcgtccacgccaataagtttccgccgtgggaacgtgtttttgtatggatgggtgtatgtgcatgtatatgagcatatgtgattgtatcatgttcggggaaggaaaaaaaaaaaaaaaaaaaaaaa

SEQ ID NO: 11872 - DNA, 665 bp, Triticum aestivum
  Clone ID: PAT_TA_11872
gccctggccgcgcccgccgccgccgcccccgccgctcccgtcaatccaaaacccggccacgaatcatggaccaccagcaactccctgcccccctgccggcgccggcggtgagggtgattggcatcgacgacttctttaaggccttcgaccttgtgaaaatcactgggctccccatccccgatgacgcccctgaagtggaggggacaacatgggattttaccaaagcagactccacgggcaacgaccactgggactggatcaagcggcagtgttacaataagtcaaatgagctcagtaacaacagaagagatattctaccactgctgaagaacaagagagcacaccgtagggagattgcaaggctggggagtcaacttaaagatcttgagcaggggctcagagcaaaaattcttgattttgatcaatttgttttgggtgggtttactttcccaagtcattttgatcatttccctgccctcaaggagaaggggaagaagaaaaagtaaatgacagtggcgctgttagtgttcgaaacaaacattactgccttgttgcattcgtgtgttggatgaaacgtagtgcctatgtgatatcagtgggagtggcaatgccatgtatctacattattatcaagtactactgctatatatatgctgtaccagact

SEQ ID NO: 11873 - DNA, 639 bp, Triticum aestivum
  unsure (1)..(639): unsure at all n locations
  Clone ID: PAT_TA_11873
tgcaggnaattcggcacgagggtgattctttattccttttgggtaaactacatgtgctaaaaaatataaaatgttcacatacggtcaaaaatgtccgtggataaaaaaggattcctatgtatatgaaaaacaaattatgtttgtgttaaaaagggttcaacgtgttaaaaaatattcttttaaaaaaatatcatgtattttaaaacttgtttgacgtgcactataaagtattcatactgtaattgaaccatgttcatcatgtaatgtgaaaatgctcatcatgcgttaccactttttcatgatcacatgaacattttttaatgtgtgaaacatttttaaaaattgttcatcggcaagttaaaaactaattctcatgtatttgataaactgattctattttgtaatattgtttgtaatgtaattactaacttgtaccatatattttaaagtgttcatggtgtattaaaacatgttcaacgtgcatttaaaaaatagtcactgcgtatttaaaatgtgcatgatatatcttttaaaaacatcatgtactaaaatattcgttgcacactaaaagaatcatcacacattaagaaaatgtttgtaatgtgttataatgtgcttgttcacatatcaaaaaaaaaa

SEQ ID NO: 11874 - DNA, 783 bp, Triticum aestivum
  unsure (1)..(783): unsure at all n locations
  Clone ID: PAT_TA_11874
gccgtcgcctccccgctgtgcccagctactccacgaccgcccccccttgcactgccgccgctccgtcgcagtgtctccccagccggnatcccgtcgagatccgcaaggccacggcaatggcggatcagggcgaagccagccgcagtgtctccccggccggatcccgtcgagatccgcgaggccacggcaatggtggatcacggcgaggccacgggcttcttccctgcccacacaccggccacgggtgctcccacctaccccatctccttcctcagatccagcctccagctccttcaagcaccaccaaccccttccctcacctcttgcctccccttcccctttctctccccatcggccatatccagtccctaaaggctgaccttgtgcacgcggtgtcagtgccattgatgcaggtcgtgcctgtgtcgatgcagcgcgcaagcgggtttgttcgtgggggtgccaaaccgcgcggaggacgacgagatccgacacatgctcgtgatttccgtccaacaccttgcatccaatgtacagaagcgacaccgaatcgagctaaaacggcaaggagcgccactcaccagagtcatgccgtccaccatgaagagatgtgctgtggagaatctccagcaagagattggcggagatggagtgggggcctgtggccttcgttacaaatgtccttgtaattttaattttaaatttggctttgttttgcattaaattcttgcctgtaatatttttgcgaacctgctgtaattttcttttattnnatnatacggg

SEQ ID NO: 11875 - DNA, 601 bp, Triticum aestivum
  Clone ID: PAT_TA_11875
aattcggcacgagggagaagagagcgcatgttgccgccaacggtgatggcttgtgcgtggcgcagccgtccagggctgaccccctgaactgggggaaggccgccgaggatctgtctgggagccatttggacgcagtgaagcggatggtcgaggagtaccgtaggcccgtggtgaccatggagggcgccagcctgaccatcgccatggtcgccgcggtcgctgctggcagcgacaccagggtggagctcgatgagtcagcccgcggccgcgtcaaggagagcagcgactgggtcatgaacagcatggccaacggcaccgacagctatggcgtcaccactggcttcggtgccacatcccaccggaggaccaaggagggcggcgctctccagagggagctcatcagattccttaatgccggagccttcggcacaggtggacacgaacatgttctgcctgccgcagcaaccagggcggcgatgctcgttcgtgtcaacactctgctccaggggtactctggcatccgcttcgagatcctcgagacggttgctgcacttctcaacgccaacgtgacaccatgcctgccgctccggggcacgatcac

SEQ ID NO: 11876 - DNA, 514 bp, Triticum aestivum
  Clone ID: PAT_TA_11876
cccctcctgaatccggatcgcatcgcgcgctccaccgtgccgcctcgatcgcctcctcctccgacgcgggcgcggctggccggcaccaggaggcgacctgccctccagtttctcgctgcgcggcagtgttcgcgagtgatccgccggttgggtaccatttcacttgcggaggccgcctgacactgttagcacataagactgctgtatacaaaatgtctgaattccttgagcttgaggctctggatgggataaggatgccatggaatgttattccaggcacaagggaggatgctgtgagctgtgtcgtccctgtttctgccatctatactcctctcaagtcaattcctgatatgccagtagtgccatatgctccccttcgctgccgcatgtgtcgttccatcctcaatcccttctccagagtcgactataatgctaagatctggctctgtacattctgctttcagcgcaatcagttccctcaacactattcctcgatctcagaaaacaatctccc

SEQ ID NO: 11877 - DNA, 178 bp, Triticum aestivum
  Clone ID: PAT_TA_11877
tcgcgatctagaactagtcaattcatgctacagtccagtagattattgtaaagctacttttacgtgtgcaatccatggatttgcatggttactgcaaaaaaagatctagaaaatacaagtaatcatcatctcagactgagggtccagctcgatcgatcttgcacttgcagctgaatca

SEQ ID NO: 11878 - DNA, 719 bp, Triticum aestivum
  Clone ID: PAT_TA_11878
acctgctccaaacaattgaccgcgaggcagtgtttgcatacgcggacgacccttgcagcgccaactaccctctcatgaagaagatgcgcgcggtgctggtggagcacgccctggccaacggtgaggctgagcgcaatgtggagacctcggtgtttgccaaggttgccaaattcgagcaggaggtctgcgcgacactgcctcaggaggttgaggctgctagaggtgcagtggagaatggcaccgctgcagaaccgaaccgtatcactgactgccgatcataccctctgtaccggttcgtgcgcgaggagctgggaacagtgtacttgaccggagagaagacacggtcacccggggaggaggtggacaaggtgtttattgccatgaaccagggtaagcacatcgacgcgctgttggaatgcctcaaggagtggaacggcgagcctttgcctatctgctaatcaaggagatgaagagaagatatgctgtgcttcagaactctgaaaggcaccacaatttctaaagtgataatagtgttgtttgatttcatttttttgctttcctaatacttgtagcgccatgcagcaactagaggctgttctgatgtaagcaaaagggcacaacttttcatgacaaatgttgatgttcttgaaaagtgtcgaaagaagccagtctactattgaatcagcacgttgaaactaatggatcggaaattcaggatg

SEQ ID NO: 11879 - DNA, 641 bp, Triticum aestivum
  Clone ID: PAT_TA_11879
attgattccgcaaggtactcattaaaccagtaaaaaatagtctcacaatggaaccactaaagcatgacaaaagtttcttcttagcacgagtagaacaagtgaagatatcacatccattctctcaactgcatcaggaagcatctagataggagaaactacttcagcagcctcacataacaacctgcccaaagccaagccttcttaagcggggatctccacctcgccgtcgtcgatctccgtctgcagatccttggggtccttgccgtcgacggtgcagccgacgctgacgcaggtgccaaggatctccttgacggtgccggccatctccttggccatggagcggaccttcatgatcttggcgatctcgatgacgtcgtcgaggctgatgttgccgctgtgcttgatgttcttgaccttcttgcggtccctctcgggctccttgagcgccttgatgacgagggctgcggcggaggggacgacggacaccttggcctggcgattctgcacggtgagcttgacggtgacgcggaggcccttccagtccttggccgtctccttggcgatgtcttctccgatcttcttcaaagtaacgatgccggaaacacgacccggccaattaaggctaggagcgcgcctcgtgc

SEQ ID NO: 11880 - DNA, 438 bp, Triticum aestivum
  Clone ID: PAT_TA_11880
tgcagctgagctcctcttcagcacatacatctgccggcgtctagccagcttactttcagaatccagatacacatacccctgccggcgtccagctagctcacttgctttagtacgtctgtgcatatttcgatggagtgcgagaacgcacacgttgccgccaacggcgatggcttgtgcatggcgcagccggcgcgggccgacccgctcaactgggggaaggcggcggaggagctctcgtgtagccatttggatgcggtgaagcggatggtggaagagtaccgacggcccgtggtgaccatggagggcgccagcctgaccatcgccatggtcgccgcggtggctgccggcagcgacaccagggtcgagctcgacgagtccgcccgcggccgcgtcaaggagagcagtgattgggtcatgaacagcatgatgaacggcacc

SEQ ID NO: 11881 - DNA, 808 bp, Triticum aestivum
  Clone ID: PAT_TA_11881
ccccgcaccagctcgagaaggcgcgtcagaaggaggcactcaagggggtcaccatcatggagggcgacgctgaggacctcccgttccccaccgactccttcgaccgatacatctccgccggcagcatcgagtactggccagacccacagcgggggatcaaggaagcctacagggtgttgaggtttggtgggctagcttgtgtgattggcccagtgtacccaaccttctggctgtcccgcttcttcgccgacatgtggatgctcttccccaaggaggaagagtacatcgagtggttcaccaaggccgggtttaaggatgtcaagctgaaaaggatcggaccaaagtggtaccgcggtgtccgaaggcatggcctcatcatgggttgctcccgtcacaggcgtcaagagacagagcggagactctcccttagagcttggtcccaagggcggaggatgtcagcaagccagtgaatccgatcaccttcttctttcgcttcctcgtaggaacaatatgtgctgcgtactatgttctggtgcctatttacatgtggataaaggaccagatcgtgcccaaaaggcatgccaatttgagtgaaagggaatgagctgcattgaagagaggatagccaacgtctgaattttactcttctctatattagacgcttcctgcctgttttgtattattacctcttgttttcctgctgctatgtacttcttgcactgctgttcctgtttgtggtaattaataatacttaagacatggatattctccgaaaaaaaaaaaaaaaaaaaaaaaaaaaaaaaaaaaa

SEQ ID NO: 11882 - DNA, 778 bp, Triticum aestivum
  unsure (1)..(778): unsure at all n locations
  Clone ID: PAT_TA_11882
gccggccggtccgggaagaagagcatccctcacctctcccactccatccagctcttctctctcacggccactccacagaatctccacaaagaaaattcagctgctacagtagagatcgccagcctctagtctctgctcgagctcttctctcccacaactgctacatcgagacttcaagatccattgtagatcaaaccaatggcggccaacggcaacgacggtttgtgcgtggccgagccgcggagtgccgacccgctcaactgggggaaagccgcggaggcgctgtcggggagccacctggacgccgtcaagcggatggtggaggagtaccgcaggccggtggtggttatggagggcgcaagcttgaccatcgcccaggtcgcggcggttggccaccgccgacggggccaggtgggactccacgatccgcccgcggcgcgtcaaggagagcaacgactggncatgaccagcatggccaacggaccgacaactacggctcaacaacngcttttggngcaactcccatccggagacaaggaaggcgggtctncaaanggatcatccggtcctaaaccccgggcttttggaccggcacgacgcacttctcccgcggcacancncccggatctttcccgttaaaaatgtccaagtatccggnaccctcaantctcaaacangcacctctaatgaaactnaacgtctgcgtccggacatacgntcgnattctccctcccaattcganttacgcnccaatccttgcttgnctatgacaagtatc

SEQ ID NO: 11883 - DNA, 643 bp, Triticum aestivum
  unsure (1)..(643): unsure at all n locations
  Clone ID: PAT_TA_11883
gtttgatcggccctgtgcacccaaccttctggctgtctcgcttttttgccgatatgtggatgctgttccccactgaagaggagtatatcgaatggttcaaaaaggcagggttcaaggatgttcagctgaagaggattggaccgaagtggtaccgtggtgtccgtaggcatggcctgatcatgggatgctccgtgactgggtgtcaagagagaaagtggggaccccctttacagcttgggtccaaaggctgaagatgtcaagcaagctgtgaaccctacactttttcctttcgcttcctcaatgggaacaatatgtgccgcgtactatgttctgggtgcctatttacatgtgggataaaggaccagattgtgcccaaaggcatgccgatctaagggaggggaattgagctgcaacgaaagagaggataaccaatatctgaattaggcttctctatattaggactcacaccgtttttgtttacctccaaattcctgttgcgggtattaattacttgggtctgtaagtggagaaataatataagactggataaatcgtcaaactctnanagnaatgntcaattgtncagtcantgtcnaanagatcatcgtaaaatctgacgttctacttcatgaacaaaaaataa

SEQ ID NO: 11884 - DNA, 208 bp, Triticum aestivum
  Clone ID: PAT_TA_11884
tcgagcggccgcccgggcaggtcacaattcatgctacagtccagtagattattgtaaagctacttttacgtgtgcaatccatggatttgcatggttactgcaaaattttgcatgtacgtacgtacaccatgaattggcgatgaggttggcgcttggcaaaaaaaaaaaaactcgagactagttctcacctcggccgcgaccacgctaa

SEQ ID NO: 11885 - DNA, 611 bp, Triticum aestivum
  unsure (1)..(611): unsure at all n locations
  Clone ID: PAT_TA_11885
ctcagcgctactcctcctcttctccagccactatcacccagtgttgctcctcctcttctacatgtgttgtgccgacgatgcactccactctcctggagtgcgcgcggccgtggtggctggccagagccagggcatcaccccttatcagtgaggaacccataggcgccatggaagctcctctgccatgggtctgatctggccgtcctgccccagtcgccggcccgctccggatccggccagcagcctcgcctccaatccgattcggacggccccgcccacagcctccgccacctgcgacacgccccccagaggtccggccgatcccgcgccgctcatccttgcttcgtcctctgctcggcactcgcgttttccgcctcgccccggcctgctccaagccaccaaccgaagcatgtccacgaagtccaaccggccctcctcccaggcgcggctcttcgtcgtttgcccgcgttgctccaccaggcaccagcagcttcgtgttgagcccgtcgaactggcggtgcactcggcgcagcttggcctgcactccctgcnnnnctagcnacgacagcgccggcacgaagtcgctgatgttgaaacttccgnngccggtc

SEQ ID NO: 11886 - DNA, 1143 bp, Triticum aestivum
  Clone ID: PAT_TA_11886
tgctcaccgataggtgtgccctggacaacacaaggctcgccattgctgcgatcggcaagctcatgtttgcgcagttctcggagttggtgaacgacttctacaacaacggtctaccttccaacctttccggcgggcgcaacccgagtttggactatggtttcaagggtgctgagattgccatggcctcatattgctccgagctccagttcctaggcaacccagtgaccaaccatgtccaaagcgccgagcaacacaaccaagatgtcaactctctcggcctcatctcctcccggaagaccgccgaggccattgacatattgaagctcatgtcctcgacattcttggtcgccttgtgccaggccatcgacctccgtcacctcgaggagaatataaaggaagccgtcaagagttgtgtgaagatggcagccaggaaaacactgagcaccaacaacaatggccatctccacaacgcacgcttctgcgagaaggacctgctgctcacgattgaccgcgaggcggtgttcgcgtatgcagatgacccttgcagcgctaactacccactaatgcagaagatgcgtgcggttctcgtggagcacgccttggccaatggtgaggccgagcgcaacgtggagacatcggtgtttgcaaagcttgccgcgtttgagcaggagctccatgcagtgctaccaaaggaggtggaggctgcctcgaacctccgtggagaacggcaccgccgcgcagcagaaccgtatcaccggatgccgatcgtacccactctacaggttggtgcgcaaggagcttgggactgagtacttgactggggagaagacacggtctcctggggaagaggtggacaaggtgtttgccgccatgaaccaaggcaagcacatcgacgcgctgctggagtgcctcaaagagtggaacggtgagcccttgcctatctgctgaacagaggatcaagaaactgaagagaagacagtgtgcttcagatttcataaggctgcggctcttcttagctgaagtgataatattttttcaatttgtatttcctcaaaaatcaatgtttgggaagttgtaacaattcttacagagctgccatgttcttgccaaaaattgcaactgcatacttgtacaactatatat

SEQ ID NO: 11887 - DNA, 1163 bp, Triticum aestivum
  unsure (1)..(1163): unsure at all n locations
  Clone ID: PAT_TA_11887
tccacccagccgaactcgtcagcgcgcagcagcctctcccgcgaggttttttcatttgagagattagtcagcgtctgcatacgttagtcgttatataaaccatgggtggggtacttggtttgatacagattgatcaatcaacagtagccatcaaggagaccttcgggaagtttgatgccatcctgcaacctggatgccactgcttgccatggtgcctagggcagcagattgctggatatctttctctgcgtgtgcaacagcttgatgtccgatgcgaaacaaaaacaaaggataatgtctttgtcaatgttgtgngcatctgtgcagtaccgtgctcttgctgacaaggcatctgatgccttttacaggcttagcaacaccaggggagcaaatccagtcatatgtctttgatgtcatcagggcaagtgttccaaagatgaacttggatgatgcctttgagcagaagaatgaaatcgccaaagctgtagaagatgaacttgaaaaggcaatgtcgatgtatggatacgagattgtgcagactctgattgttgatattgagcccgatgagcatgtgaagagagccatgaatgagatcaatgcagctgctaggctgaggttggctgccaccgagaaagctgaggcagagaagatactgcagatcaagagagctgaaggtgatgcagaatccaagtacttggccggtctaggtatcgcaagacagcgccaggctatagtggatgggctgagagacagtgttcttgctttctctgagaatgttcctgggacctctgcaaaggatgtcatggacatggttctggtgacccagtacttcgacaccatgaaggagatcggggcctcatccaagtcctcgtcggtcttcatccctcatggaccaggtgctgtcagagacatcgcagcgcagataagggatggtcagctccaggccagtctgctgtgagcacgttgatgcatacttttgacattcccatcagtaaagaagtacatatacctcatgagacaagtaaaacttattagggataatgtgagtactttcatatcagtagtgcttgttcgttctatctatctggtacgtgtgattatttattatcgagataaatgttatataggtttgtagaacaagatgagggccagttgctgtaaaa

SEQ ID NO: 11888 - DNA, 733 bp, Triticum aestivum
  Clone ID: PAT_TA_11888
cagcaacttccagttccagctacactgctattcccacgatcgagcccctgcagggtaccaaactaccaatacatactcttcatatccttcagactagtgctttagccagctcgtccatccgcaagcgcaatggagtgcgagaatggcgaggttgctgccaacggcaacagcgtgtgcatggcaatccagcatgccgacccgcttaactgggggaaggcggcggaggagctgacgggtagccacttggacgaagtgaagaggatggtggcagactaccgcaagcccgtggtgaccatcgagggcgcaagcctgagcatcgccaaggtcgcggccgtggcagctgccggcgaggtggtggtggagctggacgagtctgctcgtgcgcgcgtcaaggccagcagcgactgggtcatgaacagcatgatgaacggcaccgacagctacggcgtcaccaccggtttcggtgcaacgtcccaccggaggaccaaggagggcggcgctctccaaagagagctcatcaggttcctcaacgctggtgcgttcggcaccggctccgacgctcatgttctgccggctgcgaccacacgtgcagccatgctcgtccgcatcaacaccctccttcaaggctactctgggatccggttcgagatcctcgaggcggttgccaagttgctcaatgccaatgtcacgccgtgcctgccccttcggggcaccatcaccgcgtcgggtgacc

SEQ ID NO: 11889 - DNA, 637 bp, Triticum aestivum
  Clone ID: PAT_TA_11889
ccttgcagcgccaactactcgttgatgcaaaagatgcgtgcggttctcgtggagcccgccttggccaatggtgaggccgagcccgacatggagacatctgtctttgccaagcttgccgcattcgagcaggagctccgtgcagtgttaccaaaggaggttgaggctgcccggtcctccgtggagaacggcaccgccacacagcataaccgtatcaccggatgccggtcatacccgctctacaggttcgtgcgcaaggagcttgggactgagtacttgactggggagaagacacggtctcctggggaagaggtggacaaggtgtttgtcgccatgaaccagggcaagcacatcgacgcgctgctggagtgcctaaaagagtggaacggtgagcccttgcctctctgctgaacagaggatcaagaaactgaagagaagactgtgtgcagaaggctttggatcttttaaatgataaatgataatatttttccaattgtattttcttaaatattgatgttttgtgggatggaacatcctttcggagctgccatgttgtttccaaaaattgcaactgcataacttgtagtatgataatatttgttataaaaaaaaagaaaaaaaaaaaaaaaaaaggccccta

SEQ ID NO: 11890 - DNA, 508 bp, Triticum aestivum
  Clone ID: PAT_TA_11890
tttgggtttcgcctcaagctcttcttccatccatccatctatctataaacgtacgcaattagtactagcagtggtagctcccctcacatctgtcgtgcttgtactgctccctgcattgtttttgttccatctgtgtaacctgcaatggagtgcgagaccggcctcgtcggttccctcaacggcgagggcctctgtatgtcggccccccgcgccgaccccctcaactgggtgaagaccgccgaggagctcaccgggagccacctcgacgaggtgaagaagatggtggcgcagttccgcgagccactggtcaccatcgagggcgcctccctcgggatcgcgcaggtggccgccgtggccgctggcgctggcgtcgccagggtcgcgctcgacgagtccgcccgcggccgcgtcaaggagagcagcgactgggtcatgaacagcatgatgaacggcaccgacagctacggcgtcaccaccggcttcggggccacctcccaccgccggacca

SEQ ID NO: 11891 - DNA, 1372 bp, Triticum aestivum
  Clone ID: PAT_TA_11891
cgtcctgagtaacggttgccaattatcattaccgtttgaatttacatgcagtgagctccaggcagatgcccagaacggccagtagctagaaggccctacctgaatagcatactaactgttgcacaacagaatatagaatctttgcatccccacctcccagcaggcactaccagtgcaggggagttgagccatgctatgttaaaagccaacgcacttggcccatctgaaccagcatgatatcttctttggtaaccgatagggttccagagatgcaggatccaactccagggacttaggatctgtccagatgtatacccctcgttcttgcttgcttcccggcaccgtgttgtcaaggattattgcaacaaccagagccaccacaacattgatggatagaagagcgttcactgcataatttagcccatcactggcagtgcgaactggtccactcgaagctgcagtgtacggaacaagatagcccggtagaatgagattggagctgggttcatattgctgaaagtatgcggggatggacagggagatgaacagggtaaaaccaacgattatcatgttccttgagcttacagcttcggtatatctcaatgtggataagccaagtgcgacaataagagcccaggtgaagcaaagaacagaggcggccaaagcaacagggatagaagcaaggagagctccgatttttccaaagacagagaaaatgaccagcaaggctcccccaagctgcaaagctcttctgctggccattttggttgtgtcaagggtatggatgttctctgttaatgttgtcgacccagttcctgtaccccatagtccggcgataaaagtacaaatcccctcaaggccaatccctctgctaacaactccacgtgttggagggcttaaattaactagcaacgaagcagcatgatatgatgaaagtgaatcaactgatgcaaccactgaaactatcaccataacgatagctgttttgaaatgaaatgtaggagggccccactgcaatggatacggaaccctcacccaggcagcacttctccaagcattagaaacatcagttcgacaacgcctcataatctctgcatgtcttctgcatgaatccaataatatatttgaactgggtatacttgaactgcagcccttgaagttgtatgcaccaccagcagttaggaagaatgcatacacccatataatgccaacactgagtggtactgcatagatgaggaagatatggtttccaaacagggatatttttctcatgtacagggtgcacagaagaagcaatacaatgaggggcatgcttatttctacacaactaccagcatgagggaaaccataactaaaaaccctcgtgccgaat

SEQ ID NO: 11892 - DNA, 529 bp, Triticum aestivum
  Clone ID: PAT_TA_11892
cggtttcgcctcaagctcttcttccacccatccatccatctatctatccatctataaacgtacgcaattagtactagcagtggtagcatctgtcgtgcttgtactgctccctgcattgttttcgttccatctgttgtgtaacctgcaatggagtgcgagaccggcctcgtcggctccctcaacggcgaggggctctgtatgtcggccccccgcgccgaccccctcaactgggtgaagaccgccgaggagctcaccgggagccacctcgaggaggtgaagaagatggtggcgcagttccgcgagccgctggtcaccatcgagggcgcctccctcgggatcgcgcaggtggccgccgtggccgcgggcgccggcgtcgccagggtcgcgctcgacgagtccgcccgcggccgcgtcaaggagagcagcgactgggtcatgaccagcatgatgaacggcaccgacagctacggcgtcaccaccggcttcggggccacctcccaccgccgcaccaaggagggcggcgcgctcc

SEQ ID NO: 11893 - DNA, 644 bp, Triticum aestivum
  unsure (1)..(644): unsure at all n locations
  Clone ID: PAT_TA_11893
gcacgaggtagcttccggtttcgcctcaagctcttcttccatccatccatccatctatctataaacgtacgcgattaagtactagcagtggtagctccccccacatctgtcgtgcttgtacctctccctgcattgtttttgttccatctgttgtgtaacctgcaatggagtgcgagaccggcctcgtcggctccctcaacggcgaggggctctgtatgtcggccccccgcgccgaccccctaaactgggtgaagaccgccgaggagctcaccgggagccacctcgaggaggtgaagaagatggtggcgcagttccgcgagccgctggtgaccatcgagggcgcctccctcgggatcgcgcaagtggccgccgtggccgccggcgccggcgtcgccagggtcgcgctcgaacaatccgcccgcggccgcgtcaaggagagcagcgactgggtcatgaccagcatgatgaacggcaccgacagctacggcgtcaccaccggcttcggggccacctcccaccgccggaccaaggagggcggcgcgctccagagagagctcatcnnnntccttaacgccggtgccttcggaactggcacggacggacacgttctgcccgccgaggcgacacgcgcgnnnnngctcgtc

SEQ ID NO: 11894 - DNA, 703 bp, Triticum aestivum
  Clone ID: PAT_TA_11894
caccctactaaagggaacaaaagctggagctccacccgcggtggcggccgctctagaactagtggatcccccgggctgcaggaattcggcaccagatccggatcgcatcgcgcgctccaccgtgccgcctcgatcgcctcctcctccgacgccggcgacgccgacgccgacgccggtgcggctggccggcaccaggaggcgacctgccctccagtttctcgcggcgcggcagtgttcgcgagtgatccgccggttgggtaccatttcacttgcggaggccacctgacacagttatcttaagactgctgtatacaaaatgtctgaatttcttgagcttgaggctctggatgggataaggatgccatggaacgttattccaggcacaaaggaggatgctgtgagctgtgtcgtccctgtttctgccatctatactcctctcaagtcaattcctgatatgccagtagtgccatatgctccccttcgctgccgcatgtgtcgttccatcctcaatcccttctccagagtcgactataatgctaagatctggctctgtacattctgctttcagcgcaatcagttccctcaacactattcctcaatctcagaaaacaatcttcctccagaactcttccctcagtataccactattgagtacatgtccactgcagaaacaggtcctgtaatgcctcctgttttcatcttt

SEQ ID NO: 11895 - DNA, 1082 bp, Triticum aestivum
  Clone ID: PAT_TA_11895
cgtccgtattgacgtatctcgtggaaaggcaatccacggtggaaactttcagggcacgcccatcggtgtgtccatggacaacacgaggcttgccattgctgcgattggcaagctcatgtttgcccagttctcggagctagtaaacgacttctacaacaatggcttgccctccaacctctctggtggccgcaacccaagtcttgactatggcttcaagggtgccgagatcgcaatggcgtcatactgctcggagctccaattcttgggcaaccctgtgaccaaccatgtccagagtgcggaacagcacaaccaagatgttaactccctcggattaatctcagcccgtaagactgccgaggccatcgacattctgaagctcatgtcctctacatttttggttgcactgtgccaagccatcgacctgcgccacctcgaggagaatgtcaagaacgcagtcaaggattgtgtcacaagagtggtcaggaagaccctgatcacaaatgacatgggtggcctccacaacgcgcgcttttgtgagaaggaccttattcgaacaatcgaccgcgaggcggtgtttgcatacgcggacgacccttgcagcgccaactatcctctcatgaagaagatgcgagcagtgttggtggagcacgccttggccaacggcgaggctgagcgcaacgcggaaacctcggtgtttgccaaggttgccaaattcgagcaggagctttgtgcgacactacctcaggaagttgaggctgccagaggtgcagtggagaatggcaccaccgcagagccgaaccgcattgttgactgccggtcataccctctataccggttcgttcgcaaggagctgggaacggtgtacttgaccggagagaagacacggtcccccggggaggaggtggacaaggtgtttgttgctatgaaccagggtaagcacatcgacgcgctgctggagtgcctcaaggagtggaacggcgagcccctgcctctctgctaatcagggagatgaagagaagatgctgtgcttcaggattctgaaggctccccttgttctgaactgataatgctactgttgtttg

SEQ ID NO: 11896 - DNA, 1303 bp, Triticum aestivum
  Clone ID: PAT_TA_11896
cactcctccacgcggcggcggcggctcacctccaccccactccctccgagcgaaggccagcaatggcgatggcctccgcgcacgcgccgagcggcgccgggagcctggcgccgcgcggggcgctcagggtgcgcgcccctgccgggctgggctacctcggcctcggcccctccaggccggccctccgccccgtcgccctcgcgcggcgcgccgccccctcgggcgcccggcacccgctgctgaagagcgccgcggcctcctcgcccccggccgctgcggcggcgcggcccgcctcggcgccgcgcttcatccagcacaagaaggaggccttctggttctaccgcttcctctccatcgtctacgaccacgtcatcaacccgggccactggaccgaggacatgcgcgacgacgcgctcgagcccgccgacctccacagccgcaagctcaaggtcgtcgacgtcggcggcggcacgggcttcaccacgctcggcatcgtcaggcacgtcgaccccgccaacgtcacgctgctcgaccagtcgccccaccagctcgagaaggccaggcagaaggaggcgctcaagggggtcgacatcatggagggcgacgccgaggacctccccttccccaccgacaccttcgaccgatacgtctccgccggcagcattgagtactggcctgacccgcagcgaggaatcaaggaggcctacagggtcctcaggctcggcgggaaagcttgtttgatcggccccgtgcacccaaccttttggctgtctcgcttttttgccgatatgtggatgctgttccccactgaagaggagtatattgaatggttcacgaaggcagggttcaaggatgttcagctcaagaggattggaccgaagtggtaccgtggtgtccgtaggcatggcctgatcatggggtgctccgtgacgggtgtcaagagagaaagcggggactcccctttacagcttggtccgaaggctgaagatgtcagcaagcccgtgaatcctatcacctttttcttccgcttcctcatgggaacaatatgtgccgcgtactatgttctggtgcctatttacatgtggataaaggaccagattgtgcccaaaggcatgccgatctaagggaggggaattgagctgcagcgaagagaggatagccaatatctgaattaggcttctctatattaggcacttcacatctgtttttgtttaccttttatatttcctgttgtcgtgtatttactttactttgggtcttgttatgtggagaaataatatttatgacttggattaaaaaaaaa

SEQ ID NO: 11897 - DNA, 634 bp, Triticum aestivum
  Clone ID: PAT_TA_11897
ccctcatgcagaagatgcgtgcagttcttgtggagcacgccttggccaatggtgaggccgagcgcgacgtggagacgtcggtgtttgccaagcttgccatgttcgagcaggagctccgtgcagtgttgccaaatgaggtcgaggccgcccgcagtgccgtggagaatggcactgcaacacagcaaaaccgtatcgccgattgtcggtcgtacccgctctaccggttcgtgcgcaaggagcttggaacagagtacttgaccggggagaagacgcggtctcctggcgaagaggtggacaaggtgttcgttgccatgaaccagggcaagcacatcgacgcgctgctggagtgtctcaaggagtggaacggcgagcccctacctatctgttgaacagaggatccaggaatggaagagcagttgcttcagatttcagaaggctccagtgattatactgttttttcattgtaatttctaaaagttgatgtttgcaacgttcttccagagcttccaatgccaaagattgcaattgcatgacttggtagtgttgggtagccggtagaactttgttgatgtaagttataaaagggtacagtgtgtgataagtttccatggtaaatatactggttcaagaaagt

SEQ ID NO: 11898 - DNA, 512 bp, Triticum aestivum
  Clone ID: PAT_TA_11898
cacgaggttcttctcagtttgagctcctcttcagcgccaccgatcaatccatcaccacccccagaattcatccagaatcacagatacgcatacacccgcccggcttctagcttacttgctttagcacttctttgcatatctcgatggagtgcgagaacgggcacgttgccgccaacggcgatggcctgtgcgtggcacagccggcgcgggccgacccgctcaactgggggaaggccgcggaggagctgtccggaagccacttggatgcggtgaagcggatggtcgaggagtaccgtaagccggtggtgaccatggagggcgccagcctgaccattgccatggtcgccgcggtggctgccggcagcgacaccagggtgggagctcgacgagtccgctcgcggccgcgtcaaggagagcagcgactgggtcatgaacagcatgatgaacggcaccgacagctacggtgtcaccaccggcttcggcgcaactctcaacggaggacaaggagggcg

SEQ ID NO: 11899 - DNA, 1705 bp, Triticum aestivum
  Clone ID: PAT_TA_11899
cgcagaagcatttaagattgcgggcatccagcatggcttctttgagctgcaacccaaggaaggtcttgctatggttaatggcacggcggtgggttctggactcgcgtccatagttctctttgaagcgaatgtccttggtgtgcttgctgaagttttgtcagccgtgttctgcgaagtgatgaacggcaagccagagtacaccgaccatctgacacacaagttgaagcaccatcctggacagatcgaggccgcggcaatcatggaacacatcctggagggcagctcctacatgatgctcgcaaagaagcttggtgagctcgacccattgatgaagccaaagcaagacagatatgctctccgcacatcgccgcaatggcttgggccacaaattgaggtcatccgtgcagcgacgaagtcgattgagcgtgagatcaactccgtcaatgacaacccactcattgacgtgtctcgtggaaaggcaattcatggtggcaacttccaaggcacgcccatcggtgtgtcgatggacaacacgaggcttgccgttgctgcgatcggcaagctcatgtttgcccagttctcggagctagtgaatgacttctacaacaatggtttgccctccaatctctcaggtggccgcaacccaagcctggactatggcttcaagggtgccgagatcgccatggcttcatactgctcggagctccaatttttgggcaaccctgtgaccaaccatgtccaaagtgcagagcagcacaatcaagacgtgaactccctcggattaatctcagctcgtaagactgccgaggccatcgacattctgaagctcatgtcctctacatttttggttgcgctgtgccaagccatcgacttgcgccacctcgaggagaatgtcaagaacgccgtcaagaattgtgtcacaagagtggccaggaagaccatcacaaatgacatgggtggcctccacaacacgcgtttttgtgagaaggacctgctccaaacaatcgaccgtgaggcggtgtttgcatacgcagacgaaccttgcagcgccaactatcctctcatgaagaagatgcgagcagtgctggtggagcacgccttggccaacggcaaggctgagcgcaacgtggaaacctcgggtgtttgccaaggttgccaaattcgagcaggagctctgtgcgacactacctcaggaggttgaggctgctagaggtgcagtggagaatggcaccgccgcagagccgaaccgcatcgttgactgccggtcataccctctataccggttcgttcgcaaggagctgggaacggtgtacttgaccggagagaagacacggtcccccggggaggaggtggacaaggtgtttgttgctatgaaccagggtaagcacatcgacgcgctgttggagtgcctcaaggagtggaacggcgagcccctgcctctctgctaatcagggagatgaagagaagatgctgtgcttcaggattctgaaggctcccgttgttctgaactgataatgctactgttgtttgatttcgttctttctttgtttttcccctcttctaaaacgttggtgcatgcaacgttcttccggagctagaggccattgccaaagattgcactctgcaatacttgtagcgcagcaactagagcttgtgccaatgtaagcgaaagggcacaaattttcatgtcaaatgttatgtctac

SEQ ID NO: 11900 - DNA, 915 bp, Triticum aestivum
  Clone ID: PAT_TA_11900
aacataagtagattcaacatgcattcagaaatgaaactgcaaatgggtatcaaatgtttcacaatctctgatgtcacggcggcagaaggatttcaagtactctaaaacatttagctagaagggactaaaccattgatcataaccaccaacaaaaatattttccttgtttacagaacaccatcgcacttcgcacttccgtttcaaacagattactttgaggtcgtcttgtccttggtcttctgtattttcaacaccttcttcacgatcttctgctcctcaaccaagaaagcgcggatgatcctttccctcaccgcagttccagagagcactccaccatagggacggttcacagtcctgcggttcctagacaaccttgatcttttgtattcagtaggcctgaggtggggaatcccctggatcttcttcccggtcacagggcacttggggccgctcgccctcttcttggtgtactggtacacgagcttaccacctgcggtacacaaggaacaaaaccgaccgatttcagcgaagatcttggcacgaacaaatcagaagccaccaaattatgggagaaaatcgtccagaaaagagggggaggggatccagacctggggtcttgacgacccgcgtctggttggacttggtggcatagctgtgcctcttccggtaggtcaggcgctgcaccatgtttccgacatgccatgcgagttgggcagtgccacaacagctctaatcggagttcatagctgaccctagaagaacctatcaacagatggatcagactccgacaagctaccttcaaagttcaccttgcagccagcaggtagctgcaacccagcttcctcgcagctctgccttgtaacctgaggacatgatcggacgtcgaggtacctcggccgcgaccacgctaatcaa

SEQ ID NO: 11901 - DNA, 1734 bp, Triticum aestivum
  unsure (1)..(1734): unsure at all n locations
  Clone ID: PAT_TA_11901
ggcacgatcaccgcatccggtgacctcgtcccgctttcgtacatcgcgggcctggtcaccggccgcccaaactccatggcgactgctccagatggcacgaaggttaatgccgctgaggcatttaagatcgccggcattcagcatggcttcttcgagctgcagccaaaggaaggcctagccatggtgaatggcacggcagtgggctcagggcttgcatccatggtgcttttcgaggctaacatccttagcctccttgccgaggtcctgtcagccgtcttctgcgaggtgatgaacggcaagccagagtacaccgaccacttgacccacaaattgaagcaccaccccggacagattgaggctgctgctatcatggagcatatcctggaaggcagctcctacatgatgctcgcgaagaagctcggtgagcttgacccattgatgaagccaaagcaagataggtatgcactccgcacatcgccacagtggcttggcccttagattgaggttatccgtgctgccaccaagtcgatcgagcgggaaatcaactccgtcaacgacaacccactcatcgacgtctcccgtggcaaagctatccacggtggcaatttccagggcacacccatcggtgtgtccatggacaacaccaggcttgccattgctgcgattggcaagctcatgtttgcccaattctcagagctggtgaacgacttctacaacaacggtctgccttcaaacctctccggtgggcgcaacccaagcttggactatggcttcaagggtgccgagattgccatggcctcgtactgctccgagctccaattcttaggcaaccctgtgaccaaccatgttcagagcgcggagcaacacaaccaagatgtcaactctcttggtctcatctcctcaaggaagactgcagaggccattgacatattgaagctcatgtcctcaacattcttggtcgcgttgtgccaggctatcgacctccgccaccttgaggagaatgtcaagaatgctgtcaagagctgcgtgaagacagtggctaggaagacactgagcactgataacaatggccatctccacaacgcacgcttctgcgagaaggaccttctgctcacaatcgaccgtgaggccgtgttcgcgtacgcagatgacccctgcagcgccaactaccccctcatgcagaagatgcgtgcagttctcgtggagcacgccttggccaatggtgaggccgagcgcgacgtcgagacgtcggtgtttgccaagcttgccatgttcgagcaggagctccgtgcagtgttgccaaaggaggtcgaggccgcccgaagcgccgtggagaatggcaccgcagcacagcaaaaccgtatcgccgaatgtcggtcgtacccgctctaccggttcgtgcgcaaggagcttggaacggagtacttgaccggggagaagacgcggtctcctggcgaagaggtggacaaggtgttcgttgccatgaaccaaggcaagcacatcgacgcgctgctggagtgcctcaaggagtggaacggcgagcccctgcctctctgctgaacagagcatcaagaaatggaagagtagcgtgcttcagatttcagaagcctgcagtgctgatactgttttttcattgtaatttctaaaagtgatgtttgcaacgttcttccagagcttccaatgcattgccaaagattgcaattgcatacaggcagtgtnggtagacagtaaaac

SEQ ID NO: 11902 - DNA, 1642 bp, Triticum aestivum
  Clone ID: PAT_TA_11902
aggaaggcctagccatggtgaatggcacggcagtgggctcagggcttgcatccatggtgctttttgaggctaacatccttagcctccttgtcgaggtcctgtcagccgtcttctgcgaggtgatgaacggcaagccagagtacaccgatcacttgacccacaaattgaagcaccaccccgggcagatcgaggctgccgccatcatggagcatatccttgaaggcagctcctacatgatgctcgcaaagaagctcggtgagcttgacccattgatgaagccaaagcaagataggtatgcactccgcacatcgccgcagtggcttggccctcagattgaggttatccgtgctgccaccaagtcgatcgagcgggaaatcaactccgtcaatgataatccactcatcgacgtctcccgtggcaaagctatccatggtggcaacttccagggcacacccatcggtgtgtccatggacaacaccaggcttgccattgctgcgattggcaagctcatgtttgctcaattctcagagctggtgaacgacttctacaacaacggtcttccttccaacctctctggtgggcgcaacccaagcttggactatggcttcaagggtgccgagattgcaatggcctcctactgctccgagcttcagttcttgggcaaccctgtgaccaaccatgtccaaagtgcggagcagcacaaccaagatgtcaactctcttggtctcatctcctcgaggaagaccgccgaggccattgacatactcaagctcatgtcctcgacgttcttggttgcgttgtgccaggctatcgacctccgccaccttgaggagaatgtcaagaatgctgtcaagagttgtgtgaagactgtggctaggaagacactgagcaccgataccaatggccatctccacaatgcgcgcttctgcgagaaggaccttctgctcacaatcgaccgtgaggcggtgtttgcgtacgcagacgatccttgtagcgccaactacccactcatgcagaagatgcgtgcagttcttgtggagcatgccttggcaaatggtgaggccgagcgtgacgtggagacgtcagtgttcgcgaagcttgccacattcgagcaggagcttcgggcagtgctgccgaaggaggtcgaggctgccaggagcgccgtggagaatggcactgccgcacaacaaaaccgtattgacgaatgtcggtcgtacccactctaccgattcgtgcgcaaggagcttggaacggagtacttgaccggagagaagacgcggtctcctggcgaagaggtggacaaggtgttcattgccatgaaccagggcaagcacatcgatgcgctgcttgagtgcctcaaggagtggaacggcgagcccctacctctctgctaaatagaggatcgagaaagtgaagagtagtgtgcttcaaatttctgaaggctcttatgataatactgttttttcattatatattctaaaagttgatgtttacaatgttcttctagagctgccaatgtattgccaaagattgcaattgcatgacttggtagtgttgggtagccagtagaacttttatgatgtacgtaagttaaaaaggcaatgtgtgttaattttcatgataaaaaaaaaaaaaaaaaaaa

SEQ ID NO: 11903 - DNA, 911 bp, Triticum aestivum
  Clone ID: PAT_TA_11903
gaggcgctcaagggggtccagatcatggagggcgacgccgaggacctccccttccccactgacaccttcgaccgatacgtctccgccggcagcattgagtactggcctgacccgcagcgaggaatcaaggaggcctacagggtcctcaggctcggcgggaaagcttgtttgatcggccctgtgcatccaaccttttggctgtctcgctttttcgctgatatgtggatgctgttccccactgaagaggagtacatcgaatggttcacaaaggcagggttcaaggatgttcagctgaagaggattggaccaaaatggtaccgtggtgtccgtaggcatggcctgatcatggggtgctctgtgacgggcgtcaagagagaaagcggggactcccctttacagcttggtccgaaggctgaagacgtcagcaagcccgtgaatcctatcacctttttcttccgcttcctcatgggaacaatatgtgccgcgtactatgttctggtgcctatttacatgtggataaaggaccagattgtgcccaaaggcatgccgatctaagggaggggaattgagctgcagcgaagagaggatagccaatatctgaattaggcttctctatattaggcacttcacatctgtttttgtttaccttttatatttcctgttgtcgtgtatttactttactttgggtcttgttatgtggagaaataatatttatgacttggattaaacgcgtcagagctcttgagcgtgaaatggctcatttgtagcaggtcattgtttcacaaatagaatgtatctgtaatatttctccaccgtatgctgacttgctaagtggtagacaaaaatgatacatgagctgaattcctatttatttgttgcatctcgccatcaaaaaaaaaaaaaaaaaaaaa

SEQ ID NO: 11904 - DNA, 1770 bp, Triticum aestivum
  Clone ID: PAT_TA_11904
catttaagattgctggcatccagcatggcttcttcgagctgcagcccaaggaaggccttgctatggtgaacggcacggcagtgggctcggggcttgcatccatggtccttttcgaggctaacatccttagtcttctcgccgaggtcctgtcagctgtcttctgtgaggttatgaacggcaagccagagtacaccgaccacttgacccataagttgaagcaccaccctgggcagatcgaggctgccgccatcatggagcacatactcgaaggcagctcctacatgatgcttgctaagaagctcggcgagctcgacccattgatgaagccaaagcaagataggtatgcactccgcacgtcaccgcagtggcttggtcctcagattgaggtcattcgtgctgccacgaagtctattgagcgagagatcaactccgtcaacgacaacccactcatcgacgtctcccgtggcaaggctattcatggtggaaacttccagggcacaccaatcggtgtgtctatggacaacaccaggcttgccattgccgcgattggcaagctcatgtttgcccaattctcagagttggtgaacgacttctacaacaacggtcttccttccaacctctccggtgggcgcaacccaagcttggactatggcttcaagggtgccgagattgccatggcctcgtactgctccgagctccagttcttgggcaaccctgtgaccaaccatgtccagagcgcagagcagcacaaccaagatgtcaactctcttggcctcatctcctcaaggaagactgccgaggccattgacatactgaagcttatgtcctcaacattcttggtcgcgttgtgccaagctatcgacctccgccacctagaggagaatgtcaagaatgccgcgaagagttgtgtgaagactgtagctaggaagacactgagcaccaacaacaatggtcatctccacaatgcacgcttctgtgagaaggacttgctgctcacaatcgaccgtgaggcggtgtttgcttacgcagatgacccttgcagcgccaactacccactgatgcagaagatgcgtgcagtcctcgtggagcatgtcttggccaatggtgaggctgagcgcgatgtggagacatcggtgtttgctaaacttgccatatttgaacaggagctccgtgcagtgcttccaaaggaggtcgaggctgcccgaggtgccgtagagaatggtactgctacacaacaaaaccgtatcgctgagtgtcgatcataccctctctaccggtttgtgcgcaaggagcttggaactgagtacttgaccggggagaagactaggtctcccggcgaagaggtggacaaggtgttcgttgctatgaaccagggcaagcacattgacgcactacttgagtgtctcaaggggtggaacggtgagcccctacctatctgctgaggatcaagaacttgaagagaagatagagtactttaaagttcaaaaggcttgagatgttcttagttgataagtgataatactgtttttcattggatttccttagaagtcgatgttttgtaatgttcttacagagctgccaggttgttgccaaaaattgcaattgcatgctttgggtagtgataggtagccactagaactactatgatgcaagttaaaaggatacaatgtgtgataaatattcatgataaatttacttgtcccttttttgaaaaaaaaaaaaaactcgagctagttctctctctctctctctctctctctctcacctcgg

SEQ ID NO: 11905 - DNA, 811 bp, Triticum aestivum
  Clone ID: PAT_TA_11905
cccttccccactgacacattcgaccgatacgtctccgccggcagcattgagtactggcctgacccgcagagaggaatcaaggaggcctacagggtcctgaggctcggcgggaaagcttgtttgatcggccctgtgcacccaaccttctggctgtctcgcttttttgccgatatgtggatgctgttccccactgaagaggagtatatcgaatggttcaaaaaggcagggttcaaggatgttcagctgaagaggattggaccgaagtggtaccgtggtgtccgtaggcatggcctgatcatgggatgctccgtgactggtgtcaagagagaaagtggggactcccctttacagcttggtccaaaggctgaagatgtcagcaagcctgtgaatcctatcacttttttctttcgcttcctcatgggaacaatatgtgccgcgtactatgttctggtgcctatttacatgtggataaaggaccagattgtgcccaaaggcatgccgatctaagggaggggaattgagctgcaacgaagagaggatagccaatatctgaattaggcttctctatattaggcacttcacatctgtttttgtttaccttctatatttcctgttgtcgtgtatttattttactttgggtcttgttatgtggagaaataatatttaagacttggattaaatgcgtcaaagctcttgagagtgaatggctcatttgtagcaggtcattgttctgaataggatgcatctgtaatatttctgcactgtttgctgacttgctaagtggtacacaaaaaatgatacatgagctgaa

SEQ ID NO: 11906 - DNA, 2527 bp, Triticum aestivum
  Clone ID: PAT_TA_11906
ttcatctgcagctacagctcctcttcagcacaaccctttcttcaggacacagatcaatccagatacacatacaccacctgccgagtgccgacgtctagctgctagcttactttcagaatccagatacacacacacctgccggcgtccgttgctgcatatttcgatggagtgcgagaacgcacacgttgccgccaacggcgatggcttgtgcgtggcgcagccggcgcgggccgacccactcaactgggggaaggcggcggaggagctctcgggtagccatttggaggcggtgaagcggatggtggaggagtaccgcaagccggtcgtgacgatggagggcgccagcctgaccatcgcgatggtcgccgcggtggctgccggcagcgacaccagagtggagctggacgagtccgcccgcggccgcgtcaaggagagcagcgactgggtcatgaacagcatgatgaacggcaccgacagttacggtgtcaccaccggcttcggcgccacctctcaccggaggaccaaggagggcggcgctctccagagagagctcatccgattccttaacgcgggagccttcggcaccggcaccgacggccacgttctgcctgccgcagcgacaagggcggcgatgctcgtccgartcaataccttgctccagggatactcagggatccgcttcgagadcctcgagacgatcgccacgcttctcaacgccaacgtgacaccttgcctgccgctccggggcacgatcaccgcgtcgggtgacctcgtcccgctttcctacatcgccggcctggtcaccggccgcccaaactccatggcgacggctccggatggttcgaaggttaatgctgcggaggcatttaagatcgccggcatccagcacggcttcttcgagctacagcccaaggaaggccttgccatggtgaatggcacggcagtgggctcaggccttgcctccatggtgcttttcgaggcaaacgtccttagcctccttgctgaggtcttgtcgggcgtcttctgttaggkcatgaacggcgagccggagttcaccgaccacttgacccataagttgaagcaccaccccgggcaaattgaggccgccgccatcatggagcacatccttgaaggcagctcctacatgatgctcgcaaagaagctcggtgagcttgacccactgatgaagccaaagcaagatagatatgcactccgcacgtcgccgcagtggcttggccctcagattgaggtcatccgtgctgccaccaagtcaatcgagcgggagatcaattccgtcaacgacaatccactcatcgatgtctcgcgcggcaaagctatccatggtggcaacttccagggcacgcccatcggtgtgtccatggacaacaccaggcttgccattgctgcaatcggcaagctcatgtttgcccagttctcggagctggtgaacgacttctacaacaacggtctgccttccaacctctccggcgggcgcaatccaagcttggactatggcttcaagggtgccgagattgccatggcctcgtactgctccgagctccaattcttgggcaaccctgtgaccaaccatgtccagagcgcggagcaacacaaccaagatgtcaactctcttggtctcatctcctcaaggaagaccgcagaggccattgacatattgaagctcatgtcctcgacattcttggtcgcgttgtgccaggctatcgacctccgccacctcgaggagaatgtcaagaatgctgtcgagagctgcgtgaagacggtcgctaggaagacactgagcactgataacaatggtcatctccacaaggcacgcttctgcgagaaggaccttctgctcacaatcgaccgtgaagccgtgttcgcgtacgcagatgacccctgcagcgccaactaccccctcatgcagaagatgcgtgcagttcttgtggagcacgccttggccaatggtgaggccgagcgcgacgtggagacatcggtgtttgccaagcttgccatgttcgagcaggagctccgtgcagtgttgccaaaggaggtcgaggccgcccgcagtgccgtggagaatggcactgcagcacaacaaaaccgtatcgccgattgtcggtcgtacccgctctaccggttcgtgcgcaaggagcttggaacagagtatttgaccggggagaagacgcggtctcctggagaagaggtagacaaggtgttcgttgccatgaaccagggcaagcacatcgacgcgctgctggagtgtctccaaggagtggaacggcgagcccctacctatctgttgaacagaggatccagaaatggaagagcacctgcttcagatttcagaaggctccagtgattatactgttttttcattgtaatttctaaaagttgatgtgtgcaatgttctttcagagcttccaatgcattgccaaagattgcaattgcatgatttggtagtgttgggcagatagtgaaacttctttgatgtaagttataaaagggtacctgcccgggcggccgc

SEQ ID NO: 11907 - DNA, 2452 bp, Triticum aestivum
  Clone ID: PAT_TA_11907
ctcaccttcatctgcaatttgagctcctcgatcttcagcgcaagtccatctaccagaatttatccagacccacacacatacacctgcccggtctccagcttactcgttttagaacttacttgcatatctcgatggagttcgagaacgccaatggcttgtgcgtcgctcagccggcgcgggccgacccgctgaactgggggaaggcggcggaggagctgtccgggagccatctagaggcggtgaagcggatggtcgaggagtaccgcaggcccgtggtgaccatggagggcgccagcctgaccatcgccatggtcgccgctgtggccgccggcagcgacaccagggtggagctcgatgagtccgcccgtggccgtgtcaaggagagcagtgactgggtcatgaacagcatggccaacggcaccgacagctacggcgttaccactggcttcggcgccacctcccatcggaggaccaaggaggggggcgcgctgcagagggagctcatccggttccttaacgccggtgcgttcggcaccggcagcgacggccacgttctgcccgcggccaccacgcgtgcggcgatgctcgtccgcgtcaacaccctgctccaagggtactctggcatccgctttgagatcctcgagaccatcgccacgctgctcaacgccaacgtgacaccgtgcctgccgctccggggcaccatcaccgcttctggtgatcttgtcccgctctcctacatcgccggacttgtcaccggccgcccaaatgctgtggctgttgctcccgatggcacaaaagttaatgccgccgaggcatttaagattgccggtatccaacatggcttcttcgagctacagcccaaggaaggccttgccatggttaatggcacggcggtgggctccgggctcgcgtccattgttctctttgaagcgaacatctttggtgtgcttgctgaagttttgtcggccgtgttctgcgaagtgatgaacggcaagccagagtacaccgaccacctaacacacaagttgaagcaccaccccggacagatcgaggctgcggccatcatggagcacatcctggagggcagctcctacatgatgctcgcgaagaaacttggtgaactcgacccattgatgaagccaaagcaagatagatatgctctccgcacatcaccacaatggctcggtcctcaaattgaggtcattcgtgcagcgacgaagtcgatcgagcgcgagatcaactccgtcaatgacaacccactcattgacgtatctcgtggaaaggcaattcatggaggcaacttccagggcacaccaatcggtgtgtccatggacaacacgaggcttgccattgctgcgatcggcaagctcatgtttgcccagttctcggagctagtgaacgacttctacaacaatggcttgccctccaacctctctggtggccgcaacccaagcttggactatggcttcaagggtgccgagatcgccatggcgtcatactgctcggagcttcaattcttgggcaaccctgtgaccaaccatgtccagagcgcggagcagcacaaccaagatgttaactccctcggattaatctcgtctcggaagactgccgaggccatcgacattctgaagctcatgtcctctacgtttctggttgcgttgtgccaagccatcgacctgcgccaccttgaagagaatgtcaagaacgccgtcaagaattgtgtcacgagagtggctaggaagaccctgatcacaaatgacatgggtggcctccacaacgctcgtttttgtgagaaggacttgcttcagacaatcgaccgggaagcggtgtttgcatacgcagacgacccttgcagcgccaactaccctctcatgaagaagatgcgtgcggtgctggtggagcacgccttggccaatggcgaggctgagcgcaacgcggaaacctcggtgtttgccaaggttgctacattcgagcaggagctctgcgcggcactgcctcaggaggtcgaggctgctagaggtgcagtggagaatggcaccgccgcagaaccgaaccgtatcgctgactgccggtcataccctctgtaccggttcgtgcgcaaggagttagggacggtgtacttgaccggagagaagacacggtcacccggggaggaggtggacaaagtgttcattgccatgaaccagggaaagcacatcgacgctctgctagagtgcctgaaggagtggaacggcgagcctctgcctatctgctaatcaggagatgaagagaagatgccgtgcttcagaatttctgaaaactgataatactgttgtttgattttatcttatgtttccacttctgaagcgttgatgcatgcaacgttcttccggagctagagcgtaagcttatgctgatgtaagtgaaagggtataaattttcatgacaaaaaaaaaaaaaaaaaaggccccta

SEQ ID NO: 11908 - DNA, 2762 bp, Triticum aestivum
  Clone ID: PAT_TA_11908
tcgcatcgcgcgctccaccgtgccgcttcgatcgcctccccctcctccaacgccggcgacgccgacgccgacgccggtgcggttggccggcactaggaggcgacctgcccccaagtttctcgcggcgcggtagtgttcgcgagtgatccgccggttgggtaccatttcacttgctgaggccgcctgacacagttagcacataagactgttgtatacaaaatgtctgaattccttgagcttgaggctctggatgggataaggatgccatggaatgttattccaggcacaagggaggatgctgtgaagctgtgtcgtccctgtttctgccatctatactcctctcaagtcaattcctgatatgccagtagtgccatatgctccccttcgctgcccgcatgtgtcgttccatcctcaatcctttctccagagtcgactataatgctaagatctggctctgtacattctgctttcagcgcaatcagttccctcaacactattcctcgatctcagaaaacaatctccctccagaactctttcctcagtataccacaattgagtacatatccactgcagaaacaggtcctgtaatgcctcctgttttcatctttgttgtggatacttgcattatcgaggaagaaattggttatttgaagtctgctctggcacaggctactgagctattgccagataattcccttattggattcattacttttgggacatatgtacaggtgcatgaattgggttttggtttgttgccgaagtcatatgtgttcaagggaacaaaggaggtcagcaaggaacaaatattggagcaaatgtgcttctttgcaggcaaacaaaagcccaccacaggggttatagctggaactagggatggtctttcatcagagagcatctctaggttccttgtgcctgcttcagagtgcgagtttgtactgaactcagttattgaagagctgcaaaaggacccttggcatattccagctgatcaacgtgcatcaagatgcactggagctgcattaagtgtggccgccagtctcttgggggtttgtgtccctggatcaggtgctaggatcatggcatttgttgggggtccatctacagagggacctggttctattgtatccaaatccttaacagaaccaattcgctcacacaaagaccttgataaagactcggctccactttttgataaagctgttaagttctatgatcagattgctaagcagcttgtgcaccaaggacatgtgctggatttgtttgcttgtgcagtcgatcaggttggtgttgctgaaatgaaggttgcaattgagaagactgggggaattgttgtgcttgctgaaagttttggtcactctgttttcaaagactcgcttctccgcatctttcagtcagcagacaacggccttggattatcattcaatggtattcttgagattaactgctcaaaagatgtaaagattcaaggcattattgggccttgttcttccctggagaagaaaagtcctctgtctgcagatactgttattggtcagggaaatactagcgcctggaagatgtgtggtcttgacaagaaaacatcgctttgctttgtatatgacatctcaagaaaagttggcccagattcagtcgctcagcagacaggcgaacagctctaccttcaatttgtaacctattatcagcatcatgagggccagatgagattgcgaactactacgatctccagacaatgggcttctggttctgctagtgtgcaggagctgatagatgggtttgatcaagaagccgcagccgcagttgtggcacgcttggtctcatttaagatggaaactgaggctgattttgatccaataagatggcttgaccgtgctttgatacgtttatgtaccaaatttggagactatcagaaggaaacaccctcatctttcagtttgtctccacgtctatcaatattcccccagtttatgtttaatttgaggcgttctcagtttgtacaggttttcaataatagccccgatgaaaccgcatactttaggatgatgttggagagggaaaatgtgggcaatgcagttgcaatgattcaaccttcacttatatcctactcatttcaatcagggccaatgcctgttctcttggatgcaactgcaattgctcctgacaagatccttttgttggattcttatttttctgtggttattttccatgggataaccattgcacaatggcgaaatgctggctaccaagatcaagaaggccacgaggtgtttgcgcagttgttgaaagctccacatgaggaatctgatagcataatcaaggagcggtttcctgtgccccgtttggttgtttgtgatcaatatggatctcaggctcggttcttactggcaaagctaaatccatccgtggcatataactctgacaaccctgctcccggaggagacgtgatattcccggatgatgtgagcttcgaggtgttcatggcccatctccagcggttagcggtccaataggcgatatatgactctgcggagagcaattttgtccccccaaagcaatcatctcttgtggtgtacagtaaaaaggcattgttcgttcgtgtttatcatgtcttgttactttgtattgtgttagacgggtttatgcgacttcggttatgaaagtgtaaaaaggcgcatgctatcttgtgaaccatgttgtgccatgccagttagagtatatgtatgtggatggaccggttctcttcaaaaaaaaaaaaaaaaaaa

SEQ ID NO: 11909 - DNA, 2044 bp, Triticum aestivum
  Clone ID: PAT_TA_11909
gcacgaggtaacgcttgagccttcggcaacggcagcgacggccacgttctgcctgctgcggcgacgagggcagccatgctcgtgcgtgtcaacaccctgcttcagggatattctggcatccgcttcgagatcctcgagacgatcgccacgctcctcaacgccaacgtgacaccatgcctaccgcttaggggcactatcaccgcgtctggtgacctggtcccgctttcctatattgcgggactggtaaccggccgcccaaactccatcgccacggctccggatggcaccaaggttaacgcggtggaggcatttaagattgctggcatccagcatggcttcttcgagttgcagcccaaggaaggccttgccatggtgaacggcacagcagttggctcagggcttgcatccatggtccttttcgaggctaacatccttagcctccttgcagaggtcctgtcggctgtcttctgtgaggtcatgaacggcaagccggagtacaccgaccacttgacccataagttgaagcaccaccctgggcagatcgaggctgccgccatcatggagcacatacttgaaggcagctcctacatgatgcttgctaagaagctcggcgagctcgacccattgatgaagccaaagcaagatagatatgcactccgcacatcaccgcagtggctcggtcctcagattgaggccatccgtgctgccaccaagtccattgagcgagagatcaactccgtcaacgacaacccactcatcgacgtctctcgcgacaaggctatccatggtggaaacttccagggcacaccaatcggtgtgtctatggacaacaccaggcttgccattgctgcgattggcaagctcatgtttgcccaattctcagagttggtgaacgacttctacaacaacggtcttccttccaacctctctggtgggcgcaacccgagcttggactatggcttcaagggtgccgagattgccatggcctcgtactgctccgagctccagttcttgggcaaccctgtgaccaaccatgtccagagcgcagagcagcacaaccaagatgtcaactctcttggcctcatctcctcaaggaagactgccgaggccattgacatactgaagctcatgtcctcgacattcttggtcgcgttgtgccaggctatcgacctccgccaccttgaggagaatgtcaagaatgccgtgaagagttgtgtgaagactgtggctaggaagacactgagcaccaacaacaatggtcatctccacaatgcgcgcttctgtgagaaggacttgttgctcacaatcgaccgtgaggcggtgttcgcttacgcggatgacccctgcagcgccaactacccactgatgcagaagatgcgtgcagttctcgtggagcatgccttggccaatggtgaggctgagcgcgatgcggagacatcagtgtttgctaaacttgccatatttgaacaggagctccgtgcagtgcttccaaaggaggtcgaggctgcccgaagtgccgtggagaacggtactgctacacaacaaaaccggtatcgcttgaatgtcgatcataccctctctaccgattcgtgcgcaaggagcttggaactgagtatttgaccggggagaagactaggtctcccggtgaagaggtggacaaggtgttcgttgctatgaaccagggcaagcacattgatgcactacttgagtgtctcaaggggtggaacggtgagcccctacctatctgctgaggatcaagaacttgaagagaagatagagtgcttcaaagttcagaaggcttcagatattcttagctgataagtgataatactgttttttcattggattttcttagaagccgatgttttgtaatgttattacaaagctactaggttgttgccaaaaattgcaattgcatgctttggtagcgataggtagccaatagaactactgtcatgtaagttaaaagggtacaatgtgtgataaatattcatgataaatttacttgtccctttttttaaaaaaaaaaaaaaaaaaactcgag

SEQ ID NO: 11910 - DNA, 1760 bp, Triticum aestivum
  Clone ID: PAT_TA_11910
actccgtggccactgccccagacggcggcatggtttacgcggtttttgcgttcattaccgccggtatccagcatggcttcttcgagctgcagcccaaggaagggcttgccatggtgaacggcacagcagtgggctccgggcttgcatccatggtgcttttcgaggctaacatcctcagcctccttgccgaggttctatcagccgtcttctgtgaggtcatgaacggcaagccggagtacactgaccacctgacacacaagctaaagcaccaccctggacagatcgaggctgccgccatcatggagcacatccttgaaggaagctcctacatggcactcgcaaagaagctcggcgagcttgacccattgatgaagccaaagcaagataggtacgcactccgaacatcgccgcaatggcttggcccccagatagaggtgatacgcgctgccaccaagtcaatcgagcgtgagatcaactctgtcaacgacaacccactcattgacgtctcccgtggcaaggccatccatggcggcaacttccagggtacgcctatcggcgtgtccatggacaacaccaggcttgccattgctgcgatcggcaagctcatgtttgcccagttctcggagctggtgaacgatctctacaacaacggtttgccttccaacctctccggcgggcgcaacccgagtttggactatggcttcaagggagctgagattgcgatggcctcatactgctccgagctccagttcttagggaacccggtgaccaaccatgtccaaagcgccgagcaacacaatcaagatgtcaactctctcggtctcatctcctccaggaagaccgccgaggccattgacatactcaagctcatgtcctccacattcatggtcgccttgtgccaagccatcgacctccgccatcttgaggagaatgtcaaggatgccgtcaagagctgcgtgaagatgacggccaggaagacattgagcaccaccaacaatgggcacctccacaatgcgcgattctgcgagaaagacctgctgctcacgattgaccgtgaggcggtgtttgcgtatgcagatgacccttgcagcgccaactacccattgatgcagaagatgcgtgcggttctcgtggagcacgccttggccaatggtgaggccgaacgcgacgtggagacatccgtctttgccaagcttgccgcgttcgagcaggagctcccgtgcagtgctaccaaaggaggttgaggctgcccggacctccgtggagaacggcaccgccacacagcagaaccgtatcaccgaatgccggtcatacccgctctacaggttcgtgcgcaaggagcttgggactgagtacttgactggggagaagacacggtctcctggggaagaggtggacaaggtgtttgtcgccatgaaccagggcaagcacatcgacgcgctgctggagtgcctaaaagagtggaacggtgagcccttgcccctctgctgaacagaggatcaagaaactgaagagaagactgtgtgcagaaggctctgtatcttcttagctggagtactctcttagctgataagtgataatattttttcaattgtattttcttaagaatcgatgttttgtgggatggaacattctttcggagctgccatgttgtttccaaaaattgcaactgcataacttgtacaacttctatgatgtaagttatagaagggtactgtgtatgataatatttgtgataaatgtattggtctttttttaaa
